United States Patent 7,833,706 (GENETIC POLYMORPHISMS ASSOCIATED WITH RHEUMATOID ARTHRITIS, METHODS OF DETECTION AND USES THEREOF) - sequence listing, part 11

SEQ ID NO: 10898 - DNA, 23724 bp, Homo sapiens
  misc_feature (1)...(23724): n = A,T,C or G, or insertion/deletion polymorphism (see Tables 1-2)
tatcagtaggccaattttctacatggtgtaaagatggctgccagcagtaactagagccattggcctcttcatttacatctaatggaaggaagatcatcttttttggcagcctcctcaggagagaaaataagcttcctttcccaaaagccctgagcaaaaatttccttgtatcttgctagttcattcgtgatctaatcatgtgcctggggaaatgggaattgcttactggcttaaccaactgggacccattcctgaagctgagggtggggtccaccatattccagttcctgttaagaaggagatgggctgcaaccttaacaggatcctaaccctaaccctaaccctactgtgttgctggacattgtggcagcaacacagtaaccaaccaattctataaaacatgtataggcccagtcttggtggctcacgcctgtaatcccagcacttgggaggccaaggcatgtggatcacttgagtccaggagttcaagaccagcctggtcaacaaggcaaaaccctgtctctactaaaaatacaaaattagctgggcatggtggtgcatgtctgtaatcccagctactcgggaggctgaggcaggagaattgcttggaccagaggtggaggtttcagtgagctgagatcatgccactgcactccagcctggacgacagagtgagactccatctcaaaaaatagatatagctatataaaatatataacacgtatatgtaaatatacatgtatataaatatatatgcatattatatacaacatgtatataaatatatatgcatattatatacaacatgtatatataaatatatatgcctagacccccgcccccaccaaaaaatatctataaggaaacaaaccaataagtcagaacgattatttcttggtggatgaaattataggtaaatgttttccttctgtgttttgtgtaatgggcatggattacctaaacacaaacagtaaactttatttacgaaaataatgggacataccccactatttccttctactccaacccctaccccagcaagggcctcagagtaactgaagccagaggccccacggagtcgttcttgctgctgacagagccaaaccccagtaccccatgggccctggttgtttgctggacagatgccaccaaaccactctcattgcattagcctggatgctgtggcccctaaaggccacagcttgggctgctgagggttgaccaaccagccagtggaaccagtggtggagactgtgaccataacagtaccaggaaggaacactgtggcatcagcagcatgagaagcccaagatctcccaagacagatctctgcccataatccatgcctcttatgtggcagcatgtaatttaggccagcagtcttcctcaagtggggccaaggttggggattagtctgtgatggggtcaggctcagacagggtctaggtcagcccttagttgagtagtctgtagcctagggctagatacagggctcagtccatgattgggcttagtctttagtctgtgaccaggagccaggctcagtctgtgaccagggtcatgtctctgtcaatgactaagttcagggctcagtctgtgaccagattcagggcacagtcttccgtttagggctcagtgtgtgaccagaattgcatgatccagggtcagaattcagtctgtggtcagagttcagtcaatgattaggctcaggactcagtctttgaccaagattagggctcagtcttctgccagagtcagggttaaaaggttagtctgactcttctgccagagtcagtctaaaaggttagtctgggctggggctagaattcagtctgtgactaaggctcagtcttagagaaggataagggcttgatctgggcccagaactaaggtctcaagttgggatcagcctaattcaggcttagatcagtatgtgactagagtcagggttcattctaaggtgatgtcagagctcagtcaagagctggagtagaggcttagtcaataccaagagtcgggttcaagttggaggatcaggaccatgaccagggcttaatctggctctatgctctgttctgagctccaataaagaagcttctggaggcataggagcccagagcaagtcagtctgcaagaaatgagagcccccaggcaagcttagcagggtctggtggctgcaggaagtttcccctggactgctgaggccgggtgtcctagagcctctaacctacatggctctgctgcttgagatcccctcgcaccagaataaaaatagccactcacttcagagcagctgacagcgggtgctgggctgcctaggaggagggggagccgaagagaaggaggagagaggcctgagctcagccccagctgtgtgaccttgggaaagtcactcctcctcctccagcccatttcctgagtggcagaatggggagtgaggatgacatctgcctcagagggtgagaatgaagtgctggggacataacatgtgaagcttgttaccaacaagaaaccctggagtgaagccttgggagaagaaatgctcttttgtgccctgtatacttcctcctcagggaagccctcccagataaccccttctttcacattcccacaatatcctgtatcaccctctacacctttgcagatggtagccatagcatgacctccctcatggcgggcctgggtcagggtgaccagggagagaaaggaaggaggacagaccctcggtaccgttgccatcctcaggtgcccctggaaagtgaaccgaggaagaggaggaggaaaaagacaggaaagacttctctcccttccctgctcatgtttactccgaaccaaagggcaggagggtacatgtccaaatttctcatcctttcacagccagaaccttccttccccatccatgctttgtacctgctgttctctctgctttccagccagggcgtttctcttcttcgatttggcagcacggactctccttcaaagaaggggttcaacagtcagctcctctgtcgggaagaattatccactgcctctccaggagctccatgctctgtcctctctctactggctgtgtaatccctgggcctcggtttcttcctctgtccaatgggggcctcattaccaacctcacagggttactatggagagtaactgggatactccatctatcactggcatcctgccttcctatccctgacccacacagcctgaaggacagcactgagtttccaggagtgggctggatgagccctggaccctgcctcagtacgcccacccccctcccccaccaagagtgagggcaaggagggagccagaaagggcctccagagacagccgtctccaggggggcggttctccctgacagctgcccccagcctgccgccctgagccccagagcctgttatcaacctccttagtcatcacaccaggagctcaaatatagctccaactcactcccttttcagctggggtccgccccctacccccttctcctgacaagaccaggcttgggtctcagagccccttccttgtcctcccaggagagtaaccaccctcagcctgtttcagcatccaccacatgggcaggctgaagtcaatggtggtgatgatgatgatgataaatacagagcagccacctttatggagagcttgctgtgccaggctctatgctaaacatttcatatatattatcctgttgaatcttcaccagcaaacttaggaggtgtctgctgttttaatctcccttacacaaattgggaatcagagtgacctcctcaagtaagtcagtggcagggccagaaacaaagtcccctgcagggtctgagctcagggagcgggtggtgggaaatcctgggttgccctcctgaggcagaggagccctctgcagacacatttgcatgacatttgcctggcttccaaagggcactgatgcccctgtcccagccctagatggctgagccttaggactggtcccagaggcctggatctgcccatcattccctctaggattgcatgaaaagctgggtagtcttgggggctcccattttctttttcttttttcttttctttctttctttttttttttttttttgagacagggcctctctctgtcacccaggctggagtgcagtggtacgatcttggctcattgcaacctccacctccacctcccaggttcaaacaattctcctgtctcagcctcccaagtcgctgagactacaggcatgtaccaccacacccggctcatttttatatttttagtggagatggggtttcgccatgttgaccaggctggtctcgaactcctgacctcaggtgatctgcccacctcagcctcccaaagtgctgggattacccgcactttgccagtactcccccagcccgggggctcccattttcttatttgtaaaacaggagacagaggataagacaggatgagttcgaatcttcctttttctggtaacctgagcatcaccaccaggtctactctcacatcctccctgactgtcacctccaactccaacactacctctttcattgacacaacaccatcatcagtattggtatcatcatcacctctacctttgccatcaccatcacctccaccaccttcaccacaaccactgctagccccctacttccatcatcacagttacatacatcatcacatccatcaccacagtcgccttccccgtcaccactgtcaccatctccactatcgctgtccaaagacctttctaccccaacactctaatatggcctgagtctctgcccctgcaaattccagcagagatgctggcctgagaatacagactagacctactgacagtcaagcagaggtaggaagtgccttcaggagaggaaagtgaggcatctgccttcatgtaggagactgcacaggcccatgcagatgctccatgttggttaacagggagctctgcacacacaactctgaacactttctgcctaaagtgggtgggatcactcctctctaagccatgagaaacagatcccacagccatcccagcccaatctgaccctcatcacccattcactcttctaattcatttattcattcaacaaacactcccgtaggcctgttggggaccatgtcctgggctgggtcctggctgtagcaattctcaggcctgtttgtaactctcttgtcagtctgttaccccactgctgggcccttctccacccaagttcccttcccccagatagctcgaagggcttgtgctcatcctaggtcactaagttttctcactgaaacacaggagaccttctcagttcaccaggtgaccttgagcaagttcccctcccaaaccacacccagtgaatactggagagaagaaagctgacagaagccgggctgggttaggcctggctgtggggacatctgagggcagctaggtgtctgcagaagaggaggggctggtgctgaggcctgagatgggaaaagactgcagtggctggagcctgagtgtctggttctgggttgggaagaatagagcctgggactggcagtaggagtggagagggtggcaccaagacctgaaaatggggcaagggtgggggccggggcaagctctgagctggcagggagccaggaaggtcacaggatcagggcaagaactcagttgtctctgaggccctggagagggtgcagacctctgaaccacctgtcctaccttaaggcaggtgtgttaatgcccctccctggagcaaagggctgaccaggcctacggcagaaaggtgaaggtagacagacagcctccttcctgctgccagttgggacctgggccaggcagatgggtacactctcccctccccactccatggctgttccagcctcagcagcctgtttgaaggattcccagggggtagccaccttgcttcggcctcttccaggctgggaagtgggagcctgtgcctttaaattctcagcaggttgaaatggctgatgacatcactggttcccgggagcggtagagctggagccggagccaagggagtccaggctgccgggggctgcagacatggagggccagagcagcaggggcagcaggaggccagggacccgggctggcctgggttccctgcccatgccccagggtgttgcccaaactggggcaccctccaaggtaagacccctgagacccagtgccccccgctttcctgatccctggttccacacaccccccccacatanactgcaggctccctggtgctcctgactgaggggctggtactttcctctgctcagcgagcaggggctaggtgaagagagcaccctgggggctgaggggcagtgacaggatgcccggagacagatgaagttagccatctccaggagcccttgggagagtcctggactgggtatcagaggacccagctgtgctccacctttgctgtgtgaccttggccaagttgcttttcctctctgagccaatgcaaaatgagggggcttgtcgctgaagactaaaactgtgacatctgggatggctaagttgttagtactggaggcggtgtgatagttggggggaagccggcacacagtgtgacacttggagccaaggagggtgcctaaaatgccacctcaaagaactgagtttgagaagggaggtggagatggagttttaggtactctgaactgagaaggatacgggacagaaacagaagtgcgtctccagaggcagggcctccctgcgccctgttaccctacctagggccatcctggggcaagtatagacattcttctgccctccttggtgaaggacactttatcctgtcttctggagacaggggacatcagagagaatagatggggaaggaggataggtctctacaggactccgtgactccccacccctcccacctgccggacataaatgggatacctgcttgcctgtcctttcaggtaggggagaaagtggaggatgtaagagggcacaacctgggcacagagagatgtgacaccaggatcaacttagaatcctggacttgctctgaatgctagattcacacttggtgaggatggactattcaacggggctagatggaattctagcaaatgttgggctcataaatgcagacaatgggagatgaagattccccagaatataatgtggccaggaaccctagaccccatcccttcattttacagacagagaaactgaggcgctgggcagagaggtacttgcctaaggtcacacagagctgggctttgaatctacacagccagtctcagctcccagctcttgctcctgagtggagctctgggaatgggtaagagaacagagagggctgtaaccaagggatttggatgtttagggggcggtggggaactgagggtttctgggcattatgaaggaagrgagaggtatttaacaagctgcacctgtaggtctgtatcttgacaatagaaaaagaaaagaaacaggctgtccccagtgtgcccagacctgggatgtcaggtcagtagccgtggctgggggagcttcagggactgcagtgggagggttgcccagggaagctgccccgaatgggcagggtgtgggtgccagccaggaaggcaaggcaagtcctcaggtttaggttcacactctgcctcatttgagtcagggtctgagtttccccatctgtgaaagaggtttcagacttaaaggaggggttagggttttgtgtcctatctcctccaagacagaagttgacctgcagcagaatagattgaagtgagatagtaggaagaacttccttggaaagatgtgcctttcttagctagatgaactctgccagggtctatatggaagttggggcccaatgccctggttagggtcactctgaatctttgacttgtcctccacaaggtggactcaagttttcagctcccagcaaagaagaacgcagccctaggaccctcggaaccaaggttggctctggcacctgtagggccacgggcagctatgtcagcttcctcggaaggaccgaggctggctctggcatctccccgaccaatcctggctccactgtgtacccctgaagggcagaaaacagctactgcccaccgcagctccagcctggccccaacatctgtgggccagctggtgatgtctgcctcagctggaccaaagcctcccccagcgaccacaggctcagttctggctccgacgtccctggggctggtgatgcctgcctcagcagggccaagatctcccccagtcaccctggggcccaatctggccccaacctccagagaccagaagcaggagccacctgcctccgtgggacccaagccaacactggcagcctctggcctgagcctggccctggcttctgaggagcagcccccagaactcccctccaccccttccccggtgcccagtccagttctgtctccaactcaggaacaggccctggctccagcatccacggcatcaggcrcagcctctgtgggacagacatcagctagaaagagggatgccccagcccctagacctctccctgcttctgaggggcatctccagcctccagctcagacatctggtcctacaggctccccaccctgcatccaaacctccccagaccctcggctctccccctccttccgagcccggcctgaggccctccacagcagccctgaggatcctgttttgccacggccaccccagaccttgcccttggatgtgggccagggtccttcagagcctggcactcactcccctggacttctgtcccccaccttccggcctggggccccctcaggccagactgtgcccccacctctgcccaagccaccccgatcacccagccgttccccaagccactccccgaatcgctctccctgtgttcccccagcccctgacatggccctcccaaggcttggcacncagagtacagggcctggcaggtgcctgagccccaaccttcaggcccaagaagccccagccccagtcaccacctcctcttctacatccaccctgtcatcctccccttggtcagctcagcctacctggaagagcgaccccggcttccggtgagggggccctctcccaagaaaggtggctggggcttagctctgaggttagccattcttccagggtggatggtgtgctctacctcagcttctctctctgaggaagagtctttggggagggggttgctgggcccactctgtgacgctcagaagatagcatcccctcctaaggaacttgccgcctctcagttgatctccccagggagagtgtggcagagggacaggattcggggcctcctgtgggtccttcttagggctttggcccacacctgcctccatttagttccccagggagtcctgtgaaaggaagcttgagggtgagggagtggtgccaggactacaccctcatatgcccctgccctcaggatcactgtggtcacatggaacgtgggcactgccatgcccccagacgatgtcacatccctcctccacctgggcggtggtgacgacagcgacggcgcagacatgatcgccatagggtgaggtggcagggcatgtggaccccctcctgagcccctcgggccttccgggccctccacccatggcaggggcttccagggcacctctccaatcccatggccaccctgcccccacccctccaggttgcaggaagtgaactccatgctcaacaagcgactcaaggacgccctcttcacggaccagtggagtgagctgttcatggatgcgmtagggcccttcaacttcgtgctggtaacgcacccctcaccccctggacagccagagaccctgctgaattcctgkytccagctgtaccctggctcactgtggggcccgctgggcctctgtggctgggtccgtgacatgggtgggtggaggagcagacctgaaggtgggcgcgagggcgggggagttgtgttctgtcccccagccacgtggcctcccgctgcaggtgagttcggtgaggatgcagggtgtcatcctgctgctgttcgccaagtactaccacctgcccttcctgcgagacgtgcagaccgactgcacgcgcactggcctgggcggctactgggtgagcctgtgagcaggcccagaagaggatgggacatgaagggggctttagattagtccccccgccccatgcacagcaaggtccccttcccatcctccaccctttaccctgcggcccagcccccccatgcaccacccaataccccatcctattcctctatacccccgcccttttctctccccactgtgtcccagcgttgttcctcatttctgtaggacccacccaccttccacccacatctcctctctaacccccgctcccagtgcctcacctcctggcctaagccccgcccatgagccatccgaccctgcctccctagggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgagtatgggctggggtggggccaaatagagcttgggtggggctagtgatgggggtttttgtaccaccttgggtggggcttatggagagaggcagggcctatggggtttagtgcccacccaaactagttgtaggaacacgaaagcagagagcagttggatggggaggggcggagcttgtagggtggagctttgctgaggggccccgccttgctgaaggtcagaacctaatttcctgtagaccggtccctctgcttttcctctgccctttggtgggctggaggctctggcaccactcacccactcactacatcccctcgggttggatgggctggaaggatctgggctgagcccttatcctccatggacctgttgacaccccccactgccccccacatctctcccatcccccaccccaaacagcctcgtgttctggttcggggacctgaacttccgcattgagagctatgacctgcactttgtcaagtttgccatcgacagtgaccagctccatcagctctgggagaaggaccaggtggggtccttgtccccagaagcacacagagcatgtcccaggacacgcctgtaccttagactatggtccctgtcctcacctgccccaccccctccctgggcacagcagagcccaagctgttgtccaatctgctctcctggaccccccacagctcaacatggccaagaacacctggcccattctgaagggctttcaggaggggcccctcaacttcgctcccaccttcaagtttgatgtgggtaccaacaaatacgataccaggtgagctcagtccgaggagggactgaggggaagtgggctgaggtcttctcgaacagggagactttgggaagaggggcaggaggcaaggtggagggttacatcttgatccccagcccctgaaacttggggtacccctgctcactgcagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcaggtgagttctggcctcatcctccccgcatgaaatccccaggcccaactcggcataccactgcccctcaccattaccctttgtataaccccttgtacctgccctcagcagcatccatttgttgtaacagtggaaatggggttgcaatctacattttcagatgaggaagctgaggctcagacacatggcatcacctgcccagggtcacccaactagtaagaggaacagttaggatttgaacccaagtgagtctggtttcagagcccatgccttttcttttttttttttttttttttttgagacagagtctcattctgtcacccaggctggagtgcagtggcgcgatcttagctcactgcaagctccgcctcccgggttcaagtgattctcctgcctcagcctcctgagtagctgggattacatcacccgccaccacgccaggctaatttttgtatttttagtggagacagggtttcaccatgttggccaggctggtcttgaactcctgacctcctgatccacccacctcggcctcccaaagtgctgggattacaggcgtgagctaccgtgcctggccaactttttttttttttttttttttctttgagacggagtcttgctcagccgccccaggctggagtgcagtggcacaatcttggctcactgcaaccaccatctcctgggtccaagcgattctcccgtctcagcctcccaagtagctgggattacaggcacccgccgtcatgcccggctaatttttgtattttagtagagacagggtttcaccrtgttggccaggctggtcttgaactgctgacctcaggtgatccacccacctcagcctcccaaagtgctaagattacaggcatgagccactgtgcccggcgccctttttttttttttttttttttaatgcagtctcactctgttgcccaggctggagtgcagtggcgtggtctcggctcactgcaacctctacctcctgggttcaagtgattctcctgcctcagcctcctgagtaactgggattacagctgcccgccaccacgcctggctaatttttgtatttagtagagatggggttttgccatgttggccaggctggtctcgaactcctgacctccggtgatctgcccacctcggcctcccaaagtgctgggattacaaggtgtgagccaccacacccagccttagagcccgtgccttttctgctaatctctaactcctgtcttctgagaaaggtttagagtaatttatcttaaaattcatttataggctggcgcagtggctcacacctgtaatctcaacactttgagaggctgaggtggaaggatcacttcagctcaggagtttaagaccggcctgagcaacacagtgagacactgtctttaaaaaaaatcaaaaaaaggccgagcgcagtggctcacgcctgtaatcccagcactttgggaggctgatgtgggcggatcacatgaggccaggagtttgagaccagcctggccaacatggcgaaacccatctctactaaaaatacaaaaattagcctggcgcagtggtgcatgcctgtaatcccagttgcttgggaggctgaggcacaagaatcacttgaacctgggaggcagaggttgcagtgagccagtatcgtgccactgcactccagcctgggtgacatgagcaagactgtgtctcagggaaaaaataaaaataaaaataaaatttagctaggtggtgcacacctgtattcccagctatttatgaggctgaggtgggaagatcactggagcttggaagatctagtctgctgtgagctgtgatcgtaccactgcactccagcccaggcaacagagcaagaccttgtctcaaaaaaaaaaaaaaattcacatatgcatcatcattttcactactagtgtcttaaaaataacaaagaaaagatataaaaattcacatatataataagaccagcaaaatcaaactccatgtaacattcattcatattcattcattcrttatttactgagtacttaactgtcttaccatatgccaagcattatgagagtgtgtagtgatggggagggagagcaaagatataaaaaatacaaagctgaactcttaagtagttactataatttatattgtatttaggattgaggttcctggttgccgacatcaaaangggaaatcctagaatctcagaaccagacctgtgagaccaatttggcccactccctttttttctgtggcgggatctgaggctcctcatggggtaggcacatgccccaaaccatacacaggctctgcagtggcagagcagggtagatcccatcttttcagccctgaaacccaactctgggctcttcaagtctcttgatctgataagagggagcccagcaggccagaaaatgtttttcctggtaactttgtcacatggccagtcagtgggacattggccaatatctttagctgggaatggaaatatccccacgcttggcctgccatgacctctggcaaaagtgttgggcatgaagatttaacccacaattagggacctcacctgaaaaatcactccttttgacaccccatcctgtccttcccacctcctccaggactctgtccctttaaaaacatttcccaaccaggtgcagtggctcacgcctgtaatcccagcactttgggaggctgaggcagacggatcactaggtcaggagttcgagaccagcctggccaacacagtgaaaccctctctctactaaaaatacaaaaattacctgggtgtggtggtgcgcacctgtagtcctagctactcgggaggctgaggtagaggaattgcttgaacccgggaggcggaggttgcagtgagttgagatggcaccactgcactccagcctgggctacagagcgagactctgtctcaaaaaaaaaaaaaaaattcccattgagtacctactacatgccaggcctgtgtagtgcactttacatatgtcatccttttgaatgcctcagtaggccctgagatgtcccagttttcctctctgttttactggtgagggaaactgaggctcagagaacttaagtctcttagccaaggcaatgcagtcagaatagggctcagtaggggttttgatgctgcaaggccttggagggcattttcaaaggtctacccttgcccgcccctgctgttaggaacacaggaacagggaaagaatgtgccagttacttctggaacagattggctcggaagctgagggagggaaacctgaaactaggtaaacaggggatcagacaaagatctggtgttggcaacaactcagtccttccctgagggacagaggtggggtcaatatcctggcagcctgccacctcagcagctccacccattcaggtggcgcccctggtgggtctgggttgaccttggggaaaggatactcgtggttataactttccttcatggactgatgacaaggtaatagttagtaaccgcttagtacttagactcagttggagaaactgaaccttgggatggttagagcctgccctggggtaacatagcgagttagcagtagagcctggaagtggactgaggtctccatcctcccacgcagagctcttcttgcctgctcaggaatattcagcttaccccaaatacccagtgcatcataggattttattggtcttccttgctagcatagagacaaatcatttattgagcacttactggtatactgggaaatttatgggatgctttgcaaatggtgtctcactgaatctgctgaacaactccaagagtaaaataagagtctctgagtttggccgggcacggtggctcatgcctataatcccagcactttgggaggctgaggtgggtggatcatttgaggtcaggagttcaagaacagcctggccaacatggtgaaacgctgcctctactaaaaatacaaaaattagccaggcgtgatggcggtacctgtggtctcagctactggggaggctgagacaggagaatcacttgaacccgggaggtggaggttgcagtgagccgagattgcaccactgcactccagcctgggtgacagagcgagactccatctcagaaaaagaaaaaaaaaaaaaagagtctctgagtttacagatgagggccctggcattcagagaggctgaggaactcacccagcctgtcaacggcagaaccagagccaaatccaggatttgctagcttcaaagctatgttctcactcactccctaaggaggctgtgggcagaaggaaccctgggctgggaggcagcacagggsttggtwtttatactagacctgttctgcytcagtttcccagtctgtaaagtggccctttgtctcaggcaatttgtgctaagacccaagagccttaagtgtgtgggatactagagggtmtcccctgatgtggccccctgcccctgccttgcctggacagtttgccttcagggacgacatgccactggtgcggctggaggtggcagatgagtgggtgcrgcccgagcaggcggtggtgaggtaccgcatggaaacagtgttcgcccgcagctcctgggactggatcggcttataccgggtgagaggggcagtggtggtcagcgactcagggaagaaagggscctggaggagcagctgaacagcatggtggggtcactggcttgtccagatcttgatgccacactgggagactgctgggatcagmcattayagggtcacaacactgattccacaacactgatcccccaggtgggtttccgccattgcaaggactatgtggcttatgtctgggccaaacatgaagatgtggatgggaatacmtaccaggtacttaaaaggagtgggagagtcagggcaagtccttgttgcctttgggacctcagaactcaccttgggggctctcaggtggcctccctgacccccaacttaggcttatacccctgggcctaccaggtaacattcagtgaggaatcactgcccaagggccatggagacttcatcctgggctactatagtcacaaccacagcatcctcatyggcatcactgaacccttccaggtaagtaggccagactgctgggctgggggtgcctaaagacttttgtcaaatgccacagcctctacattctgntccttgagttcagacaaataacctgacctcccaagatctgccaacgagagaggcagacctcgggaggtcaggcctcagtggctgggttggggagcagggcgccccagtgaccagcatttcccccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctcactctcggctctttcctacttgttagtagtcttgggatggtggtagtcagaggcagggactaaagaggtgagggaatgacagaaccgacatttaccaggcaccagctgtatacattacacatgccatctcctttaatctgcatcacaaccctgtgagatcagtgctattcttagacccatttcacaggtgagcgaactgaggcctttaaaaggttacatcaacctctcaagatcagacaccaaaccatagttcagctaggtgtcgcaggggggagtacttattaagtgctaagcactgtatatgtattggttcacttaatcctcaacaaccctatgaggtagctcctgtttagagaccccctttttttagaggaggaaactaaggcttagagtgcaagagggaggtcctttgcgcaaaggcatggaggagatttgaatttaggtttagggctgggccaggaagggcacggcagccgttaaaaaaagaggcccccctgggaggaggggagctgaaagccctctccaacacccaccccaatcctggattcagacacagacatttctgtgacatccctaacttcccacctgctacctcaggccacagcacccaggcactagggctcccctaggcaggtttttgaggcatgtattatttttgcaacacggacatacatgtacctcctcctggtactgcctggggctgctgcaataagttaccctttccccattctcatctgtatgtgaagttccctggcaaggccaaagcccagggcatcagaatgagcttcctgaacaccacatccaggcatagaagagttgtgtcatacatagctcaaggttacccagaacagcaggagatgtggtccagcatttgggccttgagatccccccattcatcctcttgattgtccacaacagcctctgccatgcttcagtctaacctacggaggggaggctgagattcccaaggcttggcatagccatgggcaaggtccaggctggtgcccaggaaagctgaaactgaggtcactggctccaggacttctgctgcctgtcgggtctcctggctgcctgggttagctgcaggcactggttgtagaatgacatggggcctctcaggggctctgaaggccatggctgcctctcatctgtgcctttatcctggagctggtgtcgcctctgctgaagcctccgcaagtgccgggctgacaccctgatggccctagggtctctggaacagctgtaaggagagaagagtggggcagatgatcagggctgacaaggatcccaccttactctgcagacagtgggctgaggcccagagagagagggggctggggccacagtcaccagcaaggcagagaggggtgggtttcacggagaaagggtataataaaccgggctggtacctggaggcctgggttctgccactagctggctgtggaaacctgagccagaagcctcagcctcatctatgaaatgggaaagttaagaaggagctggctttgagaatcggaatccagatgaaagcagagcacagtggctcacgcctgtaatcccagcactttaggaggccgaggtgggaggatcgcttgagtccagaagttcaagaccaaatgagattgtggattaggagtgagttaagtacacattttgctgtgtgccaggcggggcatgacctatgtgcatcctgccgtttccttggttcctacgaccattttacagacaaagacatggaaacttggaaaggtgaaccagttgccaaggtcatgtgggaatcaaatgacaaagccaagatgcgacccatagaggccaactgcagagctggacctggggcagcagggggtagagggatgaggctatggataggagctcagaggtctcccgatcccttcccctaccccttggcccaagcattcaaagtgggtataggcaacccaccctttgagaaaaccccccatccctcctggctctgacatcacttactttttgccttccacacagtccagtggaggggccagcttgaagcaggttgtgcccagcagctcccaaagcatgttggtaacctcgggtgggctgtggagcctcaggaagcgtgccagactgagaacagaggcaggctcaggccggggcagggccttgccagccaggggccccttcccatgcctggcagcaggcagcccaccccgcgagggttcaaaggggcctcaccggcgcgtgcagttgcagtggaagaggggctcttgggcgctgttgagcagctggaactcgatttcccggggcccaatctggtgctcacactggtccaggtggcggcggaagctgcggcagacccagcgggcacctgaggggtggatgtggtgttgatgggagcccaatccaccagggaggccccaccaatgcctgcgccatccgggagaaacaccagcacgtgtgctcagtcacacacacagattccctccatttcatgccttctgagtctttgtgccctcagtgtgccgcccttgtggcagtgcctccctacccccaagccgccaaacacggtagtactgctatgggggacacccagagtactgacggtagtcaagaaaggcttccaggaggcataggctgctaaactgagggtgggagagaagacaaggagaggaggaacagcatgtgcaaaggcctcacggtaggagagagcctggcgcttttgaggaaccaagtgaagtttgtgaaactagagttttgactgggggtagggtctgcagggccaaggcttgagggcctctgggtgttgggacatcattggctgagataaagaggagtggtggtgggtgcacagtggggcctgatgtggtcaaattcgtggattatgaaaatcctgtgctgcagtgtgatttcatgggagaggttgggaaatcccaggaggaaactggtgcaggaaaagaggcaacacatggccacccctaaacagaagcagggacaccccctcatgtcaggaacccccaaggttaggttctgagctcaccctgaggttttaggccaccctgtgggccctggaggcctgtgggggccacatcaagcctgggagagaccatagggtcctggagggctgtggtgttggctttgctggggcgcttggaccctttctgatgtggtggccccttccgaaggtgctgcttctgtcgaggcttgggaggggctgggctccgggagctgggagttggggaggtggcccgggagctccaggaggcattgtagaaggtcctgggctgcaggcgagcgaggggcactgtgccgtacatcctacacctgggtggtggcagttggtggaaattggtgactgggaatcccccttccagaagcccccagggtcgtctccatggagatcaatgctctgccagtcccatcccccatcccgctgggttgtgggggacacccaaggagggtctgcatcccgggccctcaggagaggacatgcaggatgggacatcattccctggaagacagacagacagatagctctccctcaccaggcttggagcctgggctccctctctgtctggaaagggacatgagggggtggccacgtacccgccccaccagtaccacgccacacacgcctcctgctcctccagcacaaagcaggggatctccagcacgttgaagaaggccacgcccacgatgtccgagatggagtcgtgctgattctgtaggcattgctgaaacctgccccagaacagatacccaggaccctggggcatggagggctgtctggctcctcccacagcccactgtgccactaccagctgggtggtttggggtccaagcatcccttctttctggcctcagctttcctacctgcactgtggggtccaagctggctgagctttaagatcctctgcaatcccaatgtctagttacccaggaactgggtaactctgccctgtccctgagctctgggccctcgctgcctgccaccaacctggtgtcacagtcacagtgggagatggtgtggaatcggtagtttcggatgccatagttgtactgcaagggtgagatgttctgtgggcagcggtcatgttcccggcaacagagatcaggtccctggaagacccctgcagggaggggaggggagagggcaccaactcagcagggtcctaggcatcatgcaccagctatgcccccctggtaggaagagggcagagacctggttctcaccccagccctgacacaaacgccatgagggtcctcagaccagtcactctcccttctgtgggactctcagagtttcaaagctggaaaagagaagccaagctgcagcctctgttgggcaactctaaatgccaggtagcccacccataaatacatggaaaggtcttcctcaggggaattggagtctgcctccagagttcccaagcccacgccccaaataaaactccaaaattatgaatgtgtgtatgatggaatggcaaacaggcagggtgcaacctttctcactggcacaaggaggtgtcgccaggatgccaacctactctgactcaggtgccaagccctcccccaaccctgcacacaaacgcacagacatctgtactgatagtgcaagaaattcatctatgtttattaccatctaaaaaatagcactctttactaagcatttcccacatgcctggcacttcccacatccaggttcacagccagccctgaaagggaggtatcaccttcattttacaggtgaggaaataagtccagagaggggaagtgacttgctcagcttgtatgtgctgagttgggatttgaacccaggcctttcgtctcagcatccattccactgggcaccccgtgcccacaaagcctcctcctgggtaatggctttttggctcagttgaccctggatcctcccccagcctgcccagtccctcggatggcatttaatgaggactcccaggtttgaataagactttccccaaccgtgacctcatttaagcaccccatgatgagattcgtgattgcccccactttacagataaggaaattgaggttcaccatggtcaagtcactcccccagggacacacagcctaggagagtaagggctggggctgaagaaaccttgcttccccgatcggaccccccagcccacacacccctcatggctcacccagctccgaggagttcccagcagaatctccaactccacaccacagtgtgccaggcatggtccatcctctcttctctcgctggtgccctccaccagggactccactctgccctgctgctcgcttcttcctggcccctgctggactctcctcaagcgctcggcatgcctcccactgactctgaagagtggccagtgctctctgcagctcgggtccgggggtgtggatgaaggagccccaggcagtctcatgagcacagagagcaccgtaggctgcggtgagctccggctcatcctcccagctacatgcctgcagcctcctatgcgcatcccagcgggcatggatcagggccagtccctgagcatccttggccaggaagctcaggtaccccagtgggttgccagggacggccttggtcaagtggcaggaggtcctgtaccagcggagggcaggggagccccccagggccacccccaggaagcccagcatcccaaacagccctgcctgaacccccattctgcactggcccagtccagtcagacaaagcccctgggatgcctgcccttggtggccccaccaggcggcagctgagcagtggaacggaagcggagcccagcaggcccggtgcggcgggaccaatgaatggagctgcgggaggaggaggaaagaggctggagtatggggtgatcttgggcttgtaaccgaatccaccagccgggcaggacgctgattggctgaggagtgcacttgccagggcccacgcccccattctgcctgccttctcagcaccatccagtcacctgctgccagccctgcctagattgggactatgggagccaaagccctaagctgtgggatgggga

SEQ ID NO: 10899 - DNA, 71919 bp, Homo sapiens
  misc_feature (1)...(71919): n = A,T,C or G, or insertion/deletion polymorphism (see Tables 1-2)
tctgcccgcctcagcctcccaaagtgctgggattacaggtgggacccaccacgctcggccataatctctcagttacacttaagtataaacagacaattgagaatcataaaacatttagaaaagacctccaacaaataaaaaagagaccaaaataaacccaacaaagcactgatgaagtgctaccacccatgatgaaatcttgctaaaaaattgaacctggccgggcgcagtggctcacgcctgtaatcccacgacttcaggaggccgaggcaggtggatcacctaaggtcaggagttcaagaccagcctggacaacatggtgaaaccccgtctctaataaaaatacaaaaattagccgggcatggtggcaggtgcctgtaatcccagctacttgggaggctgaggcaggagaatcgcttgaacccaggaggtggaggctgcaggagccgagatcacgccattacactccagcctgggtgacaagcgtgaaactccatctcaaaaaaaaaaaaaaattgaacctgaatatcatccagcctcatctagaactaagtacagtaagtcctcacttaatgtcattgataggttcttggaaacggcaactttaagcaaaatgatgtataaggagaccaattttaccataaaaggtagttgatacaaacaagatttaagttcctgtaacatatttctggtcagaaaacatcaccaaacttctaaataaagatccaaacccttttaatattaaacactgaaataaatgtgagctatacatatatgtacagaagattcataagaacaagtaagataattatttacccacttattccagttcagggtcaaggttggctagagtgtatcctggcagctcagggcacaaggggggatgccaccctggacaggaagccattcatggcattgcacactcacacacacactcactgacactaggatcatttagacatgtcaatgaagctaatgtgcttatcgtggggacatgggaggaaatcagagcatccggcaaaaacccacataggcatgaggaatgtgccaactacagacagacagtggacccatccagaatcaattttttcttatcaatgttatgttttaacaaaatgttgagagtaccacacaatcaaaaatgtatagactataatcaaaataacatctatagataaggtactctgctacgcattagtgctaagcacttttcatgaactacctactttaatataactacctcagcaagtggttatcaacttcattttacagctggagggctcaaggttcccagctaacaagtggcggaactgggactagtacaggcagacctcagagatactgagagttcagctgcagaccacataaataaagccagtcacatgaattttttgatttcccagttcatataaaagttatgtcagctgggcacggtgactcacgcctgtaatcccagcactttgggaggccgagatgggcggtcatgaggtcaggagatcgagaccatcctggctagcacagtgaaaccccgtctctactaaaaatacaaaaaattagccgggcgtggtggcgggcgcctgtagtcccagctactcgggaggctgagggaggagaatggcgtgaacccaggaggcagaacttgcagtgagccaagatcacgccactgcactccagcctgggcaacagagctacactccgtctcaaaaaaaaaaaaaagttatgtctacacttgtagttaagtgtgcaatagcattgtctaaaaaactaatgtacataccttaatttaaaaatatttggccgggcacagtggctcacacctgtaatctcagcactttgggaggccaaggtgggtgggtcacggggtcaggagttcgagaccagcctggccaatatggtgaaaccccgttctactaaaaatacaaaaattagctggtggtggtggtgggcacctgtaatcccagctactcaggaggctgaggcaggagaattgcttgaacctgggagacggaggttgtagcaagccgagatcacgccattgcattccagcctgggcgacagagcaacactcagactcaaaaaaaaaaacaaaaaacaaaaacaaaacaaacacacacacacaaaaacaccactttattgggcaggcacaatggctcacgcctgtaatcccagcactttgggaggcccaggcgggagaatcacctgagatcaggaatttgagaccagcctggccaacatggcaaaaccctgtctctactaaaaacacaaaattagctgggtgtagtggcaggtgcctgtaattccagctactcaggaggctgaggcaggagaatcgcttgaacccaggaggcagaggttgcagtgagccaagatcatgccaatgcattccaccgtgggtgatgagatgaaactgtctcaaaaataaaaataaaaataaataaaaacaccttattgctaaaaaatgctaacaattatctgattcttcagtgagttgtaatatttttgccagtagagggtcttgcctccatgttaatagctgctgactgatcagggtagtgattgctgaaggttggaatggctatggcaatttattttttctttttttttttttttttgagacagagtctcactctgtggtgcgatctcggctcccgggttcaagcgattctcctgcctcagcctcccaaatagtggggattacaggtgcccgccaccacaactggcttttatattcttagtagagtcagggtttcaccatgttggccaggctggtcttgaactactgacctcaagtgatcgcccacctcagccacccaaagtgctaggattacaggcatgagcctgtaatgcaggattatactgcatccggcaactgtggcattttcaatgttttttttttttttttttttaagatggagtctcactctgtcgcccaggctggagcacagtggttgcaatgctcactgcaacctccgcctcctgggttcaagcgattctcctgcctcagcctctggagtagctgggactacaggcgcataccaccgtgcctggtaatatttgtatttttagtagagacggggtttcaccatgttggccagactggtctcgaactcctgacctcaggtaatccgcccgcctcagcctcccaaagtgctatgacaatttcttaaaataagacaatagtgatgtgtgtcacatcgatggactctcttcctttcatcaaagatttctctatagcatgtaatgctatttaatagcattttacccacagtagaacatctttcaaattgaagtcaatcctcttaaatcctaccactgctttgtcaactaagtttatgtaatactctaaatcctttgctgtcatttcaacaatgttcacagcatcttcaccaggtgtagatttcaactcaagaaaccactttcaccaggcacggtgattcacacctgtaatcccagcactttgggaggctgagagatggagaccatcctggctaacacagtgaaaccctgtctctactaaaaatacaaaaaattagccaggcgtggtgacacatgcctgtaatcccagctactcgggaggctgaggcagaagaatcacttgaacccgggaggcggaggttgtggtgagcactttgggaggccaaggcaggaggactgcttgagaccaggagttcaagaccagcctgctcaactaacaagaccctcatctcaaaaaaaaaattagcgaggcatggtattacacacccaggtactgaggaggcaggaggctaaggcaggaggatcactttcgcctagaagttcaagtctgcaatgagccatgatcaccactgcactccagcctggacaacagaacaagaccctgtctgaaaacaaaagtaaaaacaaagccgggcatgtagtggctcaggtctgtaatcccagcactttgggaggccgaagcaggtggatcacatgaggtcaggaggtcaagagtgtgccatgcactccagcctgggcaataagagtgaaactccatctcaaaaaaaaaaaaaaagaaaaaaagaaaccactcctcatccatccaagttttatcatgaggttgcagcaattggtcacatttttaggctccccttctaattccagtttgcttgatttttctatcatatctgcagttacttcctccactcgggtcttgagtctctcagttatccatggcggcctgactcaactttttcaaactccttttaatgatttttttttttttttagacggagtcttgctctgtcgcccaggctggagtgcagtggtgcagtcttggctcactgcaacctctgcctcctgggttcaagcaattctcatgcctcagcctcctgagtaactgggattacaggcgcccaccaccacacccagctaatttttgtatttttagtagacacagggtttcttcaagttggccaggctggaattgatattttaaccccttcccacaaatcatgaatgttcttaatggcacctagaaatcctttccagaacattttcaatttactttgcccagatccatcagaggaatcactacctatggcagctatggcgtcacaaaatatatatatatttttttgatatggagtctcatcactctgtcgcccaggctggagtgcaatggcacaatcttggctcactgcaagctccgcctcccgggttcaagtgattctcctgcctcagcctccccagtagctgggattatgggtgcccgccaccacatccggctaatattttgtattttttagttgagacggggtttcactatgttggccaggctggtctcaaactcctgacctcgtgatccacccgcctcggcctcccaaagtgctgggattacaggcatgagccaccatgcccagcccacaaaatgtatttcttaaataatgacttgaaagtcaaaattactccttgaaccatgggctatagaatgcatactgtgttagcagacatgtaaagtaacattaatctctttgtacatcttcatcagagttccttggtgaccaggtgccttgttaatgaccagtaatatcttgaaaggaatccttttttctgaacagtaggtctcgatagtaggcttaaaatattcagtaaaccacactgtaaatatgatgtaaagacattcagtaaagagatgtgtggtcatcctgggtttgttgttgcatttacagagcataggcatttctagcttcgtcatttctagcttttgatataaagtgagagacatggaactcttcctttcactgaacacttaggggccactgtggggctattaattggcctaatttcaatattgttgcctctcaggctacaaggaggaccgagagggaggagagaaacagggaactggcaggtagtggagcagtcagacacaacacttaagtttgctgtcttataccagtgaggttcgtggccacctaaaacaattgcaataacaacatcaaagatcactgatcacagatcactgtaacggtgcacctgaaataaaaagtttgaaatatagcgatagttaccaaagtgtaagtgacaggaagtgggcacatgctgttgaaaaaatagttgctcggtgcagggctgcttgctacaaactttcaatttgtaaaaaacacggtatctgtgaagtgcaataaagcgaggtatggctgtactcaagtccctcacatcattcattcaacaaatatttacaacacatctacacagcagttaagaaacctgaacagcctcccataaaaacaggtacccacctcccacgcggggaaggcttccaggtttgtttactgcgttactccctgcgggctcagtgggagtaaggtcgcccatataccagcccttccgctcctgggccacggagccgggaggaggaaacccctgatttggatccgcgcacgctaaggggcattgcgtggactcgagcaccggccaggagcgcactagacgcctgggaggatgcggtgcccccagggcggaagacaagaagccgagaagacgcggcgggagaggatggcaggctccgggccccgtcctgcgccctcttgtcgcacttcctccattcccgcaccacagacccgcaggtagacaacatcacctgcactttcaggggaggaagcggaggctcggacagatttcaccgggctcggaggaacccgactgaggtccttgccgggctcactgccggaaaggccgagcccagaagagggtggggacgttagggccgggcctcgtacctggggaagccgagccatcgggcctgacgttgggagaaaacccggcggtatacggcgatccgggacctgcttcttaactcccgcgcggtccacgcccgcctcagcgcttcgcgcgcctctagacgccagtctcgcgcgggcccgccctcgtctccacggcgacgcggcgcgcacgaggaccaccccgcccagaccccggggcttgcgcagcctcagtcgggtaggtggcgcacttcgggttgctttgcagcagcagcaatgagaatcggtttcgaggggcgtggagcatgcaccctctgggcatccccaccgagggttctttatctccttggctcgccagcttcgctctgagctcagcttgctactgctcctcttagacaagagaagtgggaggtattccgaggcggaaccccgagttacgccgcccgcggccgagcactaaagatgaggttccagctgggaggcggctgcgtacgaaagtcctccctccctcacttccggastcgtgcgtgggcctctctggcttttggttcacagggagtggaaaccggaacccgtggagtatgacccgcccatgcgtggacccggcaggttgctacaacttgcacttggaggggagaggtcccaaggcccccgaattagaaatgccaggctcatctctttttgtaacccttcattttaaaatgtaattaataascactctttttgttaaatttttaaatttgggccgatcctaataatcttaaaaataggagtgggaggggtaagtgggacttttcaaatacttttttacgtgctttgtaaaacatttgaaagcacgtgagattcctggtgcagagmctaaaagcagtagttatttatttgaaagattttacgctaaaaacaggaaaattaacttgttgggtgtctcgggcttagcatcacagacaatttgtatttttgccctattttctacatgctaatttttgcaattaaaacatttattatttattttttgagaaggagtctccctctgtagcccaggctgcagtgcagtggcgtgatctgggctcacttccacctccacctcccgggttcaagtgtttctcctgcctcagcctcccaggcgcacgccaccacgcccggctaatttttttttgtttttttgatagagacggtttttaccatgttggccaggtgtgtctcgaactcctgacctcagatgatccgcccgcctcggcctcccaaagtgctgtgattacaggcatgagccaccgcgcctggccctaaattatgttttatatggtgaaacctcgtctctactaaaaataaaatttaaaaaattagccgggggtggtagtgggcacctgtaatcccagctactggggaggctgaggcaggagaatcgcttgaacccaggaggcaaatgttgcagtgggccgagatcgtgtatttgcatttgcctgggcaacaagagcaaaactgtctcaataataataataataataatttaaagggagttctactttagcggacatcaatgctaatgttttagggacaacttttatctgaacttaatgtggccaagtagttttaaaataatttagtaagcttcaaggttgtaattaacagtataacaaaaatatatttactgtaatttagcctaagtacttttatgtaattatgtaaatttatataaattatatatttaggataagtcaataagcacttctttctagatgatttgagctaatttcctaatgctttcttcctgttatgtgcatttaccatcctcagctttgacaaatttaggagggatgaaaggcatttccatttgagttacaatgaaaatagtcctgttgggaaagattagaagataatagtacataataatagctaggacaaggacatcttagaggctgggcacggtggctcacacctgtaatctgagcattttggaaggctgagccaggagaattgcctgagcccagtagttcaagaacagcctgggcaacatagtgcccatctctacaaaatataaaaaatttgaccaggcgcggtggctcaygcctataatcccagcactttgagaggccaaggtgggtgatcacttgaggtcaggagtttgagaccagcctggccaacacggtgaaaccccatctctactactaaaaatagaaaaattagccaggcgtggagtcacgagcctgtaatcccggctactcggggggttggggcaggagaatcgcttgaacctggtgggggcggttgcagtaagccaagatcctgccactgcactccagcctgggtgacagagcgagactctgtctcgaaaaaaaaaaaaatctaagggttactcttggagcaagaaaaactgagtaggaaaaagcccatttagagaggtgcaatccagccttctgtgatgaggctgctgaaaggtcatggcctggcattaaactctctcacaggtgctctcataatttctgggtttctagtattttcttttttcttttttttttttttttgagacagtttcacttttgtcacccaggctggagtgcagtggcgcgatctcggctcactgcaacctccgcctctcaggttcaagcaattttcctagctcagccacccaagtagctgggattacaggcatatgctaccacgcccagctaattttgtatttttagtagagacggggtttggtcacgttggccaggctggtctagaattcctgatctcaagtgatcctcccaccttagcctcccaaagtgctaggatcacaggcatgagccaccatgtccggccagtttctggtattttcatttgcttctctgctgttcttggactgctaatttccccgactgactgaacctttgagaccccttatgccaaactttgggccaacaatttagacctaaaccaagatcttacacatatttagtaaagaactagaataatttctctctcaaagagctttcccaagctgatacttgaaaattggttattagttgcagaagggggcatttagaattacaaattattggcctggcacgatggctcacacccagcactttcggagcccaaggttgggggatcacgtgaggtcaggagttcagaccagcctggccaacatggtgaaaccccatctctactaaaaatacaaaagttagccaggtgtggtggcacaggcctgtagtcccagcttcttgggaggctgaggcatgagaattgcttgaactcaggaggcagaggttgagtgagccgattgtgccactgcactctagcctgggcgacagagcaaaacttggtctcaaaaaattacaagttataggccaggcgcggtggctcacacctgtaatcacaacactttgggaggccaaggcgggtggatcatgaagtcaggagatcgagaccatcctggctaacgtggtgaaaccctgtctctactaaaaataaaaaatttagccgggcgtggtggcgggcgcctgtagtcccagctactcgggaggctgaggcagaatggcctgaacccagggggcagagcttgcagtgagccgagattacgctactgcactccagcctggacgacagagcgagactccgtctcaaaaaaaaattacaaattatcaggccgggcgtggtagctcatgcctgtaatcccagcactttgggaggccgaggtgggcggatcatgaggtcaggagtttgagaccagcctgaccaacatggtgaaatcctgtctctactaaaaatacaaaaattagctgggcgtggtggcatgcgcctgtaatcccagctactcaggaggctgaggcaggagaatcacttgaacctgggaggcagaggttgcagtgaaccaagatcacaccattgcactccagcctgggcgatacagcgagactccttctcaaaaaataaaaaataaaaataaaaattatcctgccaaggagagtaacactcaaaaactacaatgaaacaagaatttgcaatttgtaagcatctagcttttgccaggcacaggtgaaagaagtttagggaagcctcccttagattattaccttttttcctaggtaataaccatcttcttctataaggacagagtgagactttgagaggtaagaaatgagttgaggccaaagttctacaagacattaaaggagcctagtggaaaagtaggtcctaagtaggatagaccagagggctcaggaaattagttccagctatcaaatcatgatagctacaatgccctgggcactgatatcatgtatggcttgtggtggtttaaaacatgcctacacattccttgacattcctcccacatagaggtggagtctaagttcctttgctttgaatatagggtagccgtgctgactcctttctaaggaacagaatgtggcacgtggtagaactgattccagggctaggttaggaaaggcaatacagcaactatatggctttcttgttcgctctctgaacacttgcccttagaatccagccctgatatttcaaggaagctcagacacagggagaggccatgtgtaagtgttccagggacagctctaatggtcccaggtcctagctgacagccaccatcaaccaccagacatgtacgcttttacgggaccctcagccccagcctttgggctgcccccactggtgctgaatggatcagaaaccagccgtcccagcaggaaccagcccattttgcagatttgagagcaaaatataattggaattctggggtggtttgttacgtaacagtaggtaaccagaaatccataatttccgggtttctagtattttctttttcaagaaagctcaggtgtggtggctcatgcctgtaatcccagtgcttttggaggctgaggcaggaggatcacttgaggccaggaatttgagaccagcctgagcaacatagcaagatcccgtctctgcaaaaaatcgttaaaaattagcctgctgtagtggcaggagcctgtagtcccagctatttgggaggctgaggctggagcagtgagctatgattgtgccattgctttccagcctggatgacagagcaagacttcatcacccccaaaataaaataaccagagcagtgtttttaatgttatctttaattccctctgcaagcctaaaaagtaggtatactgcgatccctttcggaaaaatgaggaaagggagatccaggtggtgaaatgcctggctcaggtttcacactaattggcagggtcaggatttagcagcttcaaagaacgggccttctccactactccagggagtctccaagacactaaaggggattagacctgtttcccacagctttaggaagaatttggattccaaaaacagcttgattgttaaaataataacatctgtattatcacctgcaacgtgtctctgtataggcttaaaaaggctcagcagctttatgggttatatatggttttttacccaccttatcctgtttaatcttaactgccccatgagcaggttatatcatcttcgcaatttcacaggtaaaactaagaatcaatagactaactctccatagcttgtaggaggtggcagagatgagaatgcaaactcaggcctgatgtgcaagtgtttccctctgcctcttgcctgtaaaaaaacagtttgtaagaaacacactttattcagtaatacaaacgaaaagttttctgttgccargattcacaagaagggagctgagttagtggtcactcactgcccaacaccctaatttcacaagtgaagtgaagttccaacaaagtaggcctcttggaagaaatgtagacgttgctgtcctttaaccaggaaaattgcgttctcgggacttcacgcctatgtatcgcttcacaccaacgctgcgcagtaccacagggcagaaatgggtgcttgtggtattccagcacataggacttcctccccaggatgcagttacccacactgctcacatatttgcatttctgtggccccctgtcagcctgagtctgcactacgtggtaagcacttgacattcgccgtctcatttccccaactccactcgcacttcccctttctgtgcaggctaaggacagattcaggttaccggagggaaacaacatttcaatgaatttgttagtcgcctttatcgctatcaaagccaatcgtgacaagtttgtcttttaatgcagcaaccagtactcgcgcataagcctcatagatttacagaggccattttagaaacacgaccgaaacttaggttaagtcagctttgcctaagatcacgccactcgcaaaacagctgaggttcgaacccgcactgggaaggctcggaagaccccaatctcctatctcaaattcccactgccgaagccccacggttctctgcctatgcgaaccatgcaaatacagcggtcgtcgcgccacaggccgtgctagccgccagcccagccccatctagccaccgcctccgggagagtggcgtgccgcgagtcgcgggtcccaagtgccgtccgctctgccctgcagcgcgcgtgggaacgcggcggcggtggcctctgggctgcccacggcgaccgcctgcgcgcacgggagcgggtttccgctatccccaccgtggcctcctcctcgccgccaccaccttcccaccccccggcccgcgcaggggctggcgtccgggnagcgcgcggcgatgcttctttttcgcccggcaccgctgcagccacctcacatccgggcgcgcggcggggaaggcggcgccggggccagggtgcgtggagggagttattaagggggagggggccgaagaggaggggcggagggccgggctgcagttacggcggctgaagagagacagcccaagccggtcggggtgggggcgcgagagcgaaggctgcggggagcggcgctgggaccggtgcgggcagcggggaggggagcggcggccgaggcaaagggccgccgagcggcggaggcaccgagtaagggtcggcggcggtggcggctgggtccggggcaccgcgcgcccggtgctcccgggtgtagaaggggcgcgggcgcattgctcccggggtcgcgtgcgtgagcgcgggcgccggggcgcccgcagggggtgggcaggggcgcgaggcccgcaaggcggccggcgggtagccggcgggctggctggcggggaccgagccgccgggccggggaggacggctgcgggcctgcgctagctccagcttgaagcgcccgggcmgggagattcggcctccctcctccctgcggccggccgcccctcagtgagtacggtcnccgcccttcctccgaaggaggccgctgggcccgggcctgcgtgagggrctgcgggttggggtcgcggcccggggaagccaagtttcggagctgaagccggtgctcgccctttccttgccatcggcgcccctgacatggccacaggtgcggctggcctggcgaggggcgctcgggccccgtccccagtccctgatcgccggataacaaggggcagctggcgccgtccattggcaagtgacaggcactttccaacagacttcgcgggttcccagcctaaccagtcttctacctgcccccactccgggaaacttccccaccagtcttgaaagatccccatgggtggcagctactaatcttggtttctcttgtgttaaagctgcttaaaggttatataccttgaattgggcaccttctactttttaccatgttgatgcttaggatactaggaaagagaactgagtaccaatgattctatctccaagttctaatttatagcataattttggggtggggacttgtttttaacactagctgttttgagagattaaaaagtttcagcttctgaagaaacagccaagatttctgaaaacttactgttctcggtgacaattttgtgccgatttatcttccaggtgcagagcattgtagaccaaggagccatggataggagaagtatgggtgaaacagaaagtggagatgctttccttgacctgaagaagcctcctgcctccaaatgcccccatcgctatacaaaagtaaggtttgccactaatgaaatagtgtttctttttaggtggcgaagttagtaacattgtataactatttcattcctattaagtggtaatctcattctgactcactacatggactaaatattaactaaatttagtagtgcattactttgaacatttttctgcaagtgtagatacccagcgtttaagctggaatttgctttgagnggcttttaggtgaagggaatgtaggcttagatttttttaaaattgcggatcagtatactttgtaagttctgtaacagctatgtaattggtacgtttattgatttacatactgtactgtgaggattaaagccctaggatgcgttacaaagttagtgtcctctgtattgatgtttccttaagaggcagactccccataggaatgctcttgagtgtgcttttcatgggtaactggcttttcaatcctgtttttttattttctattacaaattggatatggactcaaaaaagtaaggcttcagtcatatttcccctagctaaaaactggagatgcttaaactgcttgtccagataactgcttttgggagagagagraagtcatatttattaaagatcttgcatcagtacatgtcttgttggctactgaatgtttttgaagaggttgacaggactcaaattgtaaattcatttctgggtccctgaaatgtgtcaggctggatcccataaaacttgctcaacagtgttgaagcagttgggaccactgatgacaagaagggttatatcctagttgggcacacatccatatatttccttagtatggatttttctttttttttttttttttttgcacccgacagggcgtcactttgtcgccgaggctggaatgcagtggtgcaatcatggctcactgcagcctggacctcccgggctcaagccatcctcccatctcagtctcctgagtagctgggaccacaggcgtgcaccagtacgctcggctaatttttgtattttttatagagatgggaattcgccatgttgcccaggcaaactcctgggcttaagcaatncgcccaccttggcctcccaaagtgttgggattacaggggtgagccactgtgccaggcctcagtcattgactctgacatggcttattgtccctggcttcctgggatactgattggttaatgctttaaagccagctcttgtttgtgttctggtgcactactcttacctacttgataaagtatcaaatactgtcagattaatactcattttcagcactgaaggaaactgaactgcagtaagagaaatgttttcaggtgtaaagtgttcttggttgattgctctcttaggatgatctgttttggtatgacagcatgtaagttgatagaaaactttttccacattcagatttggtcttcccaaatatattttctctcaaacctgagagtgtttkagtagtgtttcacaacttaaattcatttcctaaaatgctgacaggtgaattctgaatggagaaaagccatcaaatgaagggaaaagaaaatcttccagtacttttttttttttgagatggagttttactcttgttgcccaggctggagtgcaatggcaccacctctgcctcctaagttcaagtgattctcctgcctcagcctcctgagtagctgggattacaggcacgcgtcaacatgcccagctgatttttttttttttttttatagtagagacggggtttctccatgttggtcaggctagtctcgaactcccaacctcaggtgatctgcccgccttggcctcccaaagtgctgggatcacaggcgtgagccactgcgcccagcygttccagtacttatttttttgtttctttgagacggagtctcgctctatcaccagagtgcaatggtgcgatcttgattcactagcctctgcctcctgggttcaagtgattatcctgcatcagcctcccaagtagctgggactacaggcgtgcgccaccatgcccagctaatttttgtagttttagtggagacgggatcttgccatgttggccaggctggtcttgaaatcctgaactcaagtgattcacctgcctcagcctcccaaagtgctgggattacacgtgtgagccactgcacctggcccccttccagtactttttgtttattattttttttgagccggagtctcactgtgtcgcccaggctggagtgtagtggtgcaatctcggctcactgcaacctctgcctccctggttcaagcgattctcctgcctcagcctcccaagtagctgggactacaggtgcacgctgccacacccagctaattttgtttttgtatttttatttttatttatttwttttttttgagacggagtttcgctcttgtcgccgaggctggagtgcaatggtgctatctcggctcactgcagtctccgcctccggggttcaagtgattctgctgcctcagcctcccaagtagctgggattacaggcatgtgccaccacgcccagctcatttttgtatttttagtagagacagggttttgccatgttggccaggctggtctcaaactcctgacctcgctggtctcgaactcctgacctcaggtgatccacccgcctcggccccccaaaatgctggaattataggtgtgagccactgcacctggcctatttttttttgtatttttagtagagacggtttcactgtgttgctggtgttgaactcctgagctcaggtgatccacccacctaggcctcccaaagtgctgggattataggtgtgagccaccragcctggccccttccagtacttttatttttatttttttgagatggagtttcactcctgctgctcaggctggagtgcaatggcacgatcttggctcrctgcaacctccgcttcccgggttcaagcaattctcctgcctcagcctcctgagtaggtgggattacaggcatgcaccaccatgcctggctaattttgtatgttggtcagtcctgtcttgaactcctgacctcaggtgatccacccacctcagccttccaaagtgctgggattataggtgtgagccaccacacccaccctttccagtatttttttcactaaagttctaaccagtagtctactggtagagtccaggcagagaggcttttgaatcactttcacacaccgatcagaggttaacatgtatatttcatctttgtgtatgtttctatctttatgcttacatcatttttagggagatatttctctttcttagggtaggacttatgtttctttgcagtaaagattaagaacctcagtattgtccatttttgacagtccagcctcagaattctgtcatacgtagataaatgtgccttgaagaactggttaaaagcattttttagcttaatgacagtggagcttagatttaagtcttttctaccaaattaattggaaataggtttactttctactcttaagaggatttagttaatgacaattttaggatagtgtttaggcagtgttagggtagtgctttcatggttttcaacactctagtaattctatgcgggacttggggataaagaagtcttctccctttaaagagagcttgaaatgattatgtgttcctagcactataataaatatgttagttccacaactggaataatattcaaaccatccttcttccttgtctatgtactgagatcaaagtactggaataaatagactttaatgatgtttctgccacttcaagttcacgggctagaagatctagaagcagtagagggaaactgttttcactggtgattttgaggtggagtttcactcttgttgcccaggctggagtgcaatggcgccatctccgctcaccgcaacctccgccccaggttcaacctattctcctgcttcaccttcctgagtagctgggattacaagcatgcgccaccacgcccggctaatttttgtctttttagtagtgacagggtttctccatgttggtcaggctggtgtcaaactcccgacctcaggtgatccgcccaccttggcttcccaaactgctgggattacaggtgtgagccggccggtgatttttttttttttttaaataggtggtgtattctgtggaaacttgtagctgtgtatgtttacttacagggtcaaaaaaacacgttggccagatgagagggccccttaaccattgacccttcttagtttagtgttcagttgctttctgggataatgttagtagtttgttgttcagaattcgaagagtttttgtttttcccccatgagtagaagaagtataaatgttttggtcaggtgcttttcagagtaatgtaccagagtttccttttgtgtgaagacatcctttagttagcttgtttcgcaaatgttaatatgcctgggggatcacctttaggccttgggaaaggaattctgagtggtaagcaggggtggtcctgaagattctactttttaacccactcccaagtggtgcacatgctgctggtccactgactatactttaagtatcaaggctttggtcttccttagagaacttgataaatggtgttggtggtgtcaagtaactcagatgcatagttattctttggggttcagatgatgttcattgtgcttcgaagaatattttaggacctcaagttagagtcacattgggtgcattcagacctactcctaaatctcattgtgggatggttataaatgggtttatcatatgcacctgttaccctgagggtcttgaacccctaagttataaatgctggtctgttttctaggccacattcctaagaccaaaagctatattttggtagtatctaagtatgcatttttaaagtgatcggatcatgttgaaggacttttggaggttatagagtggggtctcacctgaaagttatggtttaagagtggtttagacagtggttctcaaagtgtggtccctgaactagcattagcatcatctggtaacttgttagaaatacaaatctcaggcctcttctcagtggtattaaaggagaaacttggggagtagagcttaaccgtctgcatttaacaagctcttcaggggattctggctctggttcaagtttgagaaccattggcttaagaaatgatcacctgctcgctgggtgtggtggctcacacttgtaatcccagcagttagggagactgagatgggaggattgcttgagcccaggagttcaagaccagcctgggcaggatgacaagaccctgtcactacaaaaaaaatttaaaaattagctaggtatggtggcgtattgcctgtagtctcagctacacaggggactgaggtgagagaatcgtttgaggctgcagtgagccatcatcgcgccatttcactacagcctgtgcaacaaaaagagaccctgtctcaaaaaaaaaaaaaaaaaaaaaagatcatctcctggcagtggtgctcattcaactttttcttcaccagaagcccttgttcaccagttctggaatatagtacctgctattctgttagtgatgccatcttctgcttgaaatacaaaatagaaatgttttaggccatcccactattcagatccatgtggttttcttttctgtttttttgttttgagacagagtctctgtctgtcgccaggctggagtgcagtggccctatgtcggctcactgcaacctctgcctcccgggttcaagcaatttccctacctcagcctcttgagtagctgggactacaggcgcgtgcctccatgcccagctaattttttttacattttagtagagatggggtttcaccatgttggccaggatggtctcgatctcctgatctcatgatccacccaccttggcctcctaaagtgctctgattacaggcgtgagccaccacgcctggcctcacatccatgttattttcgtcaagtgaatagactaatctgtttttttttgtttgtttttgagacygcgtctcactctgtcacccaggctggagtgcagtgttgcaatcttggctcactgcaacctctgcttcccaggttcaagcarttctcctgcctcagcctcctgagtagctgggattacaggcacrtgccatgatgcccagctaatttttgtatttttattagaaacggggtttcaccatattggtaaggttggtctcaaactcctgacctcaagtgatccacctgccgtggcctgccaaagtgctgggattacaggcgtgagctaccgcacccggccaaatagactaatcttataaaggatacatacgttatgctgttcttcctttgctcctgtgttttgccactgattccttattaaatgactgtcacctgccagttggacagggaataaaagcagagacactcagaacattcagcttgatactgaccagtgttaaacatgcgtattaaagttaagtgaatgttgaattatcttagtttaacttcatgtggaatttttttttttttttttgagacaggctctcactgttatccaggctggagtgcagtggtacagttaactcactgcagcctcgaactctgcattcatgcgatccttccacctcagcctcctgagtagctaggactacaggtgtgtgtcaccacacatggctaattttttcatttctttgtagagataggatctcattatgttgcccaggctggtctccaactcctgacctcaagcgatcctcctgcctcagcctcctaaagtgctggaattccaggtgtgagccactgcatctggccccatgtggactcctcataaccttgactagttacaaagtggcattattgtagtcattagtgtctccagggatctttaagggaggccatcctaatttgtggctggtaggccaattggtcatagcagtcagtacagccatgtttgtctttcctttaaaacaatcaggaaaatggacaagcagttgaagtgactgacttgagtcatcctagccttcttggatataatcagaagacttgaagccaatccccagagaaaagagtaactgatttaaatcctaggttgaaacaggaatcaggtggtccctttttccagtacagaaatcttatttgataactaaatgtatcttttataaactgagtagtaactcaggtggcatttctgtgacaaatttaggtataaacttcttaaactaatttaaggatacctatttatgttggagaaggtagaattatggtatgaaaagtcattgggaggacaaggtgggaggatgaattgagtccaggagttcacgaccagactgggcaatatagtgagaccccatctcgttaaaaaaaaaaaaaattgccagaggtggtggtgtgcacctgtggtcccagatactcaagaggctaacgtgggaggatcacttgagcttgggaagttgagcttgcagtgagctatgactgcaccattgcactccagcatgggcaacagagtgagactctgtctcaaaggaaaaaaaaattattcaatcttaatgtgtcaactgtccagaaaacctatcttactggaagttgttagagcaggctggctggcaagaccatagagaatagcttctgactgctttttcctacccgttccttttttgttattgttgagacagagtcttgcacgatcttggctcactgcaacctccacctcccaggttgaagtgattctcctgcctcagcctcctgagtagttgggattacaggtgtgtgccaccatgcccagctgattttcttttttttagtagagacgatttcgccatgttggccaggatggtctcaaactcctgacctcaagtgatctgcccaccttggtctcctaaagtgctggggttacagacgtgagccactgcacccggcccctgcctgttcggttttgttttgttttcagagggagttttgttcctgttgcccaggctggagtgcaatggcgtgatcttggctcaccacaacctctgcctcccgggttcaagcgattctcctgccttagcctcccgagtagctgggactacaggcgcacgccaccatgcccggctaattttttgtatttttagtatagatggggtttctccatgttaggctggtctcaaacttctgacctcaggtgatctgcccgtctcaccctcccaaagtgctgggattacaggcgtgagccaccacgcctgcccaggaatatttcccttttaatcccccttccataaatgtgacttatgtgaaattctacataatgtcagaaggtccatcagaatgcatagttgtttctgcataggatttctgcagaaagaaatggataaggattttaaccattgttcttttgggcttttgttgagattcatttgctttccactttaatagtgatcaccaaaagtgggtgttcatactagtaattccccaataggttttgggagccttgacacattttctttaaggaaggctgctgcaactaagaaaatatgtttatgcttccttgggtgtgtggctcttgggcaattagcagcttgttcttgcctagtcaggttttagtaacctgtgcaaaaagtgaagtctcaggtattaactcttatattcgccatatggtaatcttaatgaattcattcgtgatcagtaagttcctatgggttaagactttccaggctaggcacagtggctcacacttgtaatcccagcactttaggaggctgaggcaagatgatcacttgagcctaagagttcagaccagcctgggcaacacagcaagacctcatctctacaaaaaattttttaaattagctggatgtggtggcatgcacctgtagtcttagctgcttgggaggctgaggcaagaaagatcacttgagtccatgagttttgaggctgcagtgagctatgatcatgccactgcactccagcctgagagtgagaacctgtctcaaaaaaaaaactccaaaaggatagattaaaaaaaaaaaaaaaaaacacctttccaaaagggtaatatcacatcctttcttgaaatactcataagaaggaagcactcctagttagagtggccacttcccaagtattctgtctttagccatagttgaacgttttctttgaaaatatcccaaaggggtatttccacgaataatgttaagggctcttgatgagatggcaagtttaagaactcttttcatgcttgcttcggcagcacatatactaaaattgcaacaatacagagaagattagcatggcccctgcgcaaggatgacacgcaaattcatgaagtgttccatatttaaaaaaaaaaaagactcttctcttgtccaggcatggtggctcacacccgtaatcctaacactttgggaggccgaggcaaacggattacctgagctcaggcagcctggccaacatgatgaaaccgcatctctactaaaatacaagaaaaacattagccgggcatggcggcatgagcctgtaatcccacctactcaggaggctgaggcagcagaattgcttgaacgctggaggcagaggttgcagtgagctgagatcgccttggtgacagagtgagattccatctccaaaaaaaaaaaaaaatttctttcgagagactggaagagctgtaggggtggggacaagagtcatctgtctatgtgtggcactaaactgggcacacaggatatattatgtggacagttgtaaagagagcaaactttttttttttttttttttgaaacagtctctctgtgtcacccaggctggggtgcagtggtgcgatctcagctcactgcaagctccgcctcccgggttcacgctattctcctgcctcagcctcccgagtagctgggactacaggcacctgccaccacgcccggctaatttttttgtatttttgatagagacggggtttcaccatgttagccaggatggtctcgatctcctgacctcatgatccgcccgcctcagcctcccaaagtgctgggattacaggcttgagccactgtgcccggccatttttttgtattttcagtagagacagggtttcactgtgttagccaggatggtctcgatctcgtgacctcgtgatccgcccgccttggcctcccaaagtgctgggattacaggtgtgagccactgcactcagcatttttttttttttttttttttgagacagagtcttgctctgtcacccatgctgtagtgctgtggcatgatctcggctcactacaacctctgtctcctgggttcaggcagttcttgtgcctcagcctcctgaatagtacctgggatttcaggtgtccaccaccaggcccagctagtttttttatttttagtagagacgtggtttcaccatgttggccaggctgctcatgaactcctgactcaagtgatagctggtctcggcctcccaatgttttgagattacaggtgtcagccagcatgcctggcccaaactgtattgacttagctcatggtttctctcttccccacttaagtaggggatcttcttgtgctgggataccaccttaagcatcttaggatcatgctggaaggtaacacatttagtgctgtaaacagtgaggaagttttctctcatttttccctaaatgtccacgtggaccttgggccatattttgagaaacatgctcagttggaagcaataatttttaacctcttgggcattcattggaaatcttttgaaggtgtgaacattcactgcagaaattgcacaaatgcatcattttccatatggtttcaaatgggaggtcttacactccttgacaccatggaactgatttaagaagtcttacttttcaagaacagtaaatactgtttacctagatgtttacagtgactccctgccacttttacaacccaagagttgtcttgtttctaagcccatttctcagtgaagaaaatggctctttatcctctatggacaggtgagctatgttttagccattgtatttggtcaaaagtgcgccctggcacaaataatgttgctggtgtggttaatgtcagtgtgtaactagcttgctactctgccttctgctcttacaggcctgtgaagtttgtacatctgttcacttaagcatcacacctatgtatgctaagcatgtaaagtcaacaacgaaaactggaatacggaagtgaaaatgagaattttgttaactcttcttaactgagagtagttggtgtttatcactctgtgattagagcaataactctaagaggaaagattatattgaacaaaacattaactttgaataacctctcaatttcaaattctctytttttgtttttttttttttttttttttttttggagacagaggtcttgttctgttgccgaggctggagaatctcagcttactgcaacttccacctcctgaattcaaccaatttctcctgcttcggcctctcaagtgaggctgagattacaggcatgcgccatcatacccagctaattttttaatttttagtagagacagggttttgctatgttggccatgctggtcttgaactcctgacctcaagtaatacgtccggcctcttttttttttgagacaggttttctgtcactcgggctagagcgcggtggtacaattacagctcattgcggcctggatctcctgggctcaaccaagtcgcctggacaataggcatgccaccatgccctgcctttttttttttttttttttgagacagggtctccctcaaaaagggtgcagtcttggctcactgcaacctctgcctcccaggttcgcaattctcatacctcagcctcccaagtagctggggctacaggtgtgcacccccacacctggctaatttttttgtttgtttgacacagaatcttactctgttgtccaggctggagtgcagtggtgtgatcttagctcactgcaacctctgcctcccaggctcaggcaattctcctgcctgagtctcccaagtagctgggattacaggcgtgccaggctggtcttgaactcctgatcttaagtgatccacccgccttggcctcccaaagtgctgtgattacatgtgtgagccaccgtgcccagcccatattttcctatttttaaactaatatcctttttctgttcaaggattctatccaggataccatattatgtttagttgtcctctctctttagcctcctattttcctttttttaagactgttacttctgttaaagtattttttgattcctcgtcaataggaccaaaattaggcttttctggatgttttgtggttgtgttaaagtattaacctttcccaggtgactcctaaataaataggtaaaatcattatagagttcagcaaacagctgtagtggtaattgagaacacctattgggatccctgttacctttggagttaaaagtttcaaacaaaacaccacttagaaacttccctacattaagaatttacacatttaagcgtgaaagattgtctttgattgaatagcacattagggttcttagtatctgcatggggtagtaaggggatatgtgataatctttagttacttttaagagtaaaaaattgctttgcagtggtttttcctgtagcattatgtataagtatttcctatattgcaaggtccttcctgtttctactagaaaaattttaagccctcttgtccttaggatttctgtgttacagtaatatctgatattttcataattactattgctccatcctccctgaacccctccccccagccccaaagttgtgctaaccctacagatctgacaccatgtttgccctgaagatttctctggagtctcccgtggtgtgttttgtttttttctttttttgagacagggtctctgtcacccaggatggagagcagtggtgcgatcgctgcagccttgacctcaagtgaccctcccaccgcagcctcctgagtagcggggaccacacttggtgaattttttttttttttttttttaaacggagtctcgctctgtcacccaggctggagtgcagtggcgcgaactcagatcactgcaacctcagcctccctacaggtagctgggattacaggcgtccgctaccacacctggctaagttttatatttttagtagagacagggtttcaccatgttggccaggctggtctcaaactcctggcctcaagtgatctgcctgcctcagcctcctatagtgctgggattacaggcgtgagccactgtgcccggcccactcgatgaattttaaaatattttttgtagagacaggtgtctccttatattgcccaggctgatcttgaactcctggactcaagcagtcttcccgcttcagcctcccaaagttctgggagtacagatgtgagccactggacctggctgactcctatctttactggtgatttataggttgtatgttctttgacagttttttttcagaattttgaacagcctttaggtatgtctttgtatttggaactgtgtttatctcagtcttacaaatttttattcgtatttctatccagttataagacaggtaattgataaataaatcctaaataaatgcaaatgcctgattgatatcctggtcttaaaactgaagtatcatatagtcctaaggcggcatcttgtcctgaagaaaacatttagatgcttcagttttctgtaaacactagagaattcatggtatgctatacccagtgattcttgtgggctgattgagcaaatctgtccctccatcctcaccccaagatgttgaatcagtgatctgagaagcagtgcacattctcctactacaaggcctgggatgggagtgttgccaaagtcatggcatagtggtatgtgcttttttgcaaggcagttgcagcattttactggtgctgaaagtttcggaattgctttttaactttattataaaaaatatttcaaagtataccaaaaggaggcagtagtttgttgtatatatgggtagatatgtgtgttagtgtgcatgtgtgtatatatatgtgtgtatatgtaagtgtgtatatttcctaactctactgaaagggccttcaagcaaatgaggatacccagttcccagaccttggtgttttatgcaattcctcacttaaagaaactaggatttctcagaaatagctgattccagggctgggacaggatgaatacaaaataagctagaacgtatgacagtctttaggaaaaaaaaaaaaaaaagatggcatgttgaaaaagacacatgggccagtttgaagaggcacccactggcaaaatctgggacagtttgagcgccacataattgaggacattaatgagttatagaccaacagaaaaaccaggagtcagccgggcacggtggctcacgcctgtaatcccagcactttgggaggctgagacaggcagatcacttgaggtcaggagttgcagagcagtctggtcaacgtggtgaaactccgtctctactaaaaatacaaaaaaaattagccagccatggtggtgcatgcctgtagtcccagctattcgggaggctgaggtggaagaagtgcttcaacccagaaggcaggggttgcagtgagccaagattgcgccagtgcactccagcctgggcgatagagcaagactgtctcaaaaaaaaaaaaagaggaaaaactaggagtctgtgagtccataccaataatacataggtatataaacaggggaaaggaggacttgcctttacagtatgatgccaagtgctggctggtaaatatggagagtggagagagggctagagtggcaaaatgaagagtggtttggtcaagaatcattaatggatgctaactttagtggaaaactgaagaccaagatatttgggtgattttaaagtgtctccccacagattgcatgctaaatgcaaatgggaaagcagtaactaaatagtagagaaactagagaataccttgaccaaatgatccaaattagcaccatagataaaggacagwtgaacatcatggcctccagaagtgacggtctgtgaaggacacagcacctcttcagttagtattctgccccatggatatttaggctcagtctatcatgagaaaacatcagaccaacccaaaatgaataatgttcttttacagaaagggactatattttctagaaatgtcactatcataagagacaaaagttgtagaaatgttctagattaagggagaccaaagagatacaacaatcaaatatckgattctagactggatcctgttttggagggggaagatcaatataaaggacattactgggtcaatttacaaaactggaattgggaaggtagattagaaaaaagtattatcaatagttgtagttataaaaaaaactggcagttcttctcaacttgggtctgcagaagtcttcatgccctgaggcatccgttatatgtgagggattagcctctctcctgtgcataccagctaagtacatccttgagagaatgggaaaatagttcactcaggtcattttctgtagggctaaattctctcatggagctggataacaggctgtaaaggaatatcttcattcttaggaaataggcactgcagtatttaggagtaaggcatcatgacttatgcaatttactctctagtcaaaaaaaaaaaaaaaaagctcgctcatatgtggaagccaaaaaaacttggcttcgtggagatagagaatagaatgatagataccagagtctgggaaaggtgtgtgggtgggatggcagaatacaaagaggttggttatatggatacaaacatgcagttgaaggagtaaattctaatgtttgatagcagagcagagtggctgtggttaacaagtgtattgtatatttcaaaacagctagaagggaggactttaaatgtctccaaaacataggaaggataaatacttgaggtaattgacacccragatatcctgacttgatcattacacagtttatacatgtaacaaaatatcacatataccccataagtgtatacaaatgtctgtatcaatttttttaaaattctgcaaaaaagtaaatgataaatagggagaaatgttaataggtacatagtatatggatgttttttgtgttttttcagtcttgcaacattacatttaaaaaaaactatcgccccccggcccggttgctcacacctgtaatcccagcactttgggaggccgaggcgggcagatcgcctgaggtcaggggtttgagaccagcccggccaacatggcaaaaccccgtctctactaaaaatacaaaaattagccaggcatggtggcgtgtgcctgtaattccagccacttgggagactgaagcaagagaattgcttgaacccaggaggtggaggttgtagtgggccaagattgtgccactgcacttcatcctgggctacagagtgagattccatgtaaaaaaaaaaaaaaaaaatccccttgtaagttgtcatctaatgcattgaaaattggtaagattaggcagaggttttatctaacactaaagtttccttgccttgatgagctttcagtgttacgaaatgttattcaatagcaattatgagagattgttttagccagaaactgatcacttttaagttactggattattctgcttgagcttgtgagaacctcaatgtactccagtcctttctgaaataaggcaagatgtaaataagaattgtgtgaagtgtttaagatggacacttagaattattcagaacagaagtttaaagtgtgtggcctaagaaatgtaattcaaaatgactatttgacttctctttttaggaagaactcttggatataaaagaactcccccattccaaacagaggccttcatgcctttctgaaaaatatgacaggtatgtgtgtcattctagtccttaactacttctagtcaataactttttgttataccaaacttggtaaattaagaattgtattgttttgaagttttctggtagaattataagtgaaagagggatttcgagaggtaataagatgggtttcaactacctaggaatgaaactaaaattaaaagatgacctggtcagagtcacatagtcagaaagcagaattaagacttgaacccgacagggcatggtggcttatgcctgtaatcccagcactttgggaggccaaggcaggcggatcacgaggtcaggagatcgagaccatcctggctgacatggtgaaaccccatctctactaaaaatacaaaaaattagccaggcgtggtggcgtgcgcctgtagtcccagctactcgggaggctgaggcaggagaatggcatgaactcgggaggcggagcctgcagtgagctgagatcgcactactgcactccagcctgggcgacartgcgagattccgtctcaaaaaaaaaaaaaaagacttgaacccaggagtcctcaccagggtcttgtcctctaccagtggttttttgcactgtactttgagggtacctgcctcaggtatgctgctcaggggcgctcttggttctttttttttgcattcccacaaaaaactattcagccgttcagattagctttatttcatcctagtttccctcagaagaagaaggctttggtttgggaagactatagctaaaaatggtctgaaaatctcctacaataatcctatattgtactacttatggccaccttagtcatttcttttctttttttttttttgtccgagacagagtttcactctttttgcccaggctggagtgcattggcgcgatctgggctcactgcaacctccacctcccaggttcaagcgattctcctgcctcagcctcccgagtagctgggattacaggcacccactaccacgcacagctaatgtttttgtatttatggtacctatggtactatagtgcctatagtcccaagtactcaggaggccaaagygagaggtttgcttgagcccaggagcttgaggatgcagtgaattatgattgtgtcactgcactccagcctgagcaacagagatcctatctcaaaaaaaaaaaaaaaaaaagtcctatttaaccaggaaattgaacattaatatgatgctttatatgttaaaaaaaatgtaggctaatactaatataaaccatctaccttgatatttaagagatgatgggccaggtgcagtggctcacacctgtaatcccagcactttgggaggccagggcgggcagatcacaaggtcaggggtttgagaccagcctggccaacatggcgaaaccctgtgtctactaaaaatacaaaaattagctgggtgtggtggcacatgcctatagtcccagctactcgggaggctgaggcaggagaatcgcttgaacccgggaggtggaggttgcgttgatcctagactgcgccattgcactgcagcctgggcaacagagcaagactccatctcaaaaaaaacaaaacaacaacaacaaaaaaacctggatgcctcaaccacattccctgatgaaggtgatacttgatacttgaataatggctatgccaattagttaggatttttcttttttttttttttttttttgaggtggagtttcgctcttgttgcctaggctggagtgcaatggcgcaatcttggctcaccacaaccttcccctcccgggttcaagcgattctcctgcctcagcctcccgagtagttgggattacaggcacccaccaccacacctggctaatttttatagttttagtagagacggggtttcaccatgttggccaggctggtctcgaactcctgacctcaggtgatccacccacctcagcctcccaaagtgctgggattagcaggcatgagccactgcgtctggcctacaaaatatatttttaaaaattatctgggcatggtggcacctgcctgtagtcataactactcaggaggctgagatgggaggatcacctgagtccagaagtttcaggctgcagtgaggtataatcatgccactgcattccagcctgggtgacagaactctgagaccctgtctgaaaaaaataaaaaagttatcctgggcagacaaacagcttttatttctgaagcagagacattgtgcctggtggtaaaaataagaaagaggagagagcttctcatttcctttcacctctctgagaactaaaatttgttgggctcttaaatgctagataatcctcaccactaccctagaaggtaggtagtatatattttattgtgaggagtttgagactgaaaagctaactcacttattcaagaaatgttcattggtacctgctatgtcataaatactgtgccagattctataaaatattccgtggcttcatggggcattggtctatggaaggatataatcaaatacttgtaaaaatttatcattgcaaacatcacaggctgcaaaggacaagtgtgaagtacgttgctagtgtatagcatggcctggtctaatctgggggctgggaagttctttctgcagaagatgcagctcagtaacttgtccaggatgttcccagtagtggtggcaaaactagaattaaagcccagattttgggctccagagtttctgctcgtgcacagtactacccaccaccccatcattacacagagaataaaataaaacctaaactacacattttaggtcgtaagagctgtttgccctgcttgtggaaaaactaagactgtgcatagaaattctggaaaaatacacatcaaatgatccaggtgctacttctggtgagagagttaagggactcttttttctcctttgtattagtcttcagtaaacaacagttaatatttatggaacatcttctttgtatagtacaggcgtagttattgtaatccatgtgcatgccaaggtatatggtctgaatgtttcaattgtgtacagaccattagttttcaagtgactgttggtgttgtgtgatcaacaacaaagcattactgaattaatagatgtttttgttttcatattaaaagaggtaacaattctgcaggcagtcatgaagctttattttagaaatgggtttctggctgggcgtagtggctcacatctgtaatcccagcactttgggaagccaaggcaggcagattacttgaggttaggagttagagacctggcctggccaactggtgaaaccccatctctactaaaaatacaaaaattagcaagatgtggtggtgggcacttgtaatcccagctactggtgaggctgaggcagaagaatcacttgaacctgggaggcagagggtgcagtgagctgagatcacgccactgcgctccatcctgggcgacagagcgagaccctgtctcaaaaaaggagaaatgggtttccataactattagctgaggaggtttagaaatcacactgcctatatggttcatgggcgtaagtgctaacagttgtattttttgacctgtagtgatggtgtctgggaccctgagaagtggcatgcctctctctacccagcttcagggcggagctcaccagtggaaagtctgaagaaagagttggatacagaccggccttccctggtgcgcaggatagtaggtgagcacacagtcactcagaagtggggttagtgattttggggacatgcttttgcctgctggtttcattcttagctctgagaattttatgctttgaggggaaatgtcattatcaggaaactgatttatcggttggatttttcctaatcagcagggtaaagtcatagtctactttgtcacagctatataagaagactgttaggctgtgtgcttctgaattaaaagtaccgattatctttcactggcatggataactgagttagatgtggtgggtagcataaagctgtgctggaaatctcattatgctttctttcatatgtgagaccagtcctccggtataaattagttctggcaattcttttttttttgttctgtttttttttgagacggagtcttgctctgttgcctagtctgcaacctctgcctcctgggttcaagcaattctctgccttagccacccaagtagctgggattacaggtgcctgccaccatgcctggctagtttttgtatttttagtagagatggggtttcaccatcttggccaggctggtcttgaactgctaacctcgtgatccacccacctcggcctcccaaaatgctgggattacaggcatgagccactgcgcccggcctagttctggcaattcttaattcatagtggactgtgatcggaataaaggcttggatacggtttgagactgaagttaagtctgatcttccaactttcctagtttaaagtttacccctttagaaacgttgtttaagggtgaaatggagaccaggtaatataaaagcagtcaaggaacttgttgcaagaactttttttgagatgagaggacgactcatcataaaaacttggaactaaacgaaaaagatagcccggctctagtttaagctataagacccttctacacagtctgtcagtacactcagtacagtaatgtctctcaaagaatttattctagcagaatcattaaagatatgcagagactttattaaaatgatgaaaactgagaaggaacctaaatatccaacagtagaaatgggtcgcgtaaacttcggtntatccatatatgggaatgttacattgcattgtcctgtaaaaccatgttgcagatgtgtttattggcaaataatgntcatgacgtactgactcatagaaaactctccatattgtatcctgtgtttggaaaaaacagactgcacagaaattctgtaaaagtacacaacagaacattctaggagctgtttgtgataacagaattaaagcagatttttctcacatggactaatcttcagtttcctggtttttctaggaagacattttttgtatggtgacatgtttgttcttcctacaccaataaatttattgagatagaatttacatatagcctgcacaaaaagtataccatttgatgtcttgacatgtgtatatacctgtgaaaccgttaccaaaatcaacataagcatttttatcacccccaaaagttccctagtattcctatgtgtccctccctttagctgccccccccacaacacttcccccttcccaagcaagcgctgatttgctttgtttttttttgttgtttttttgagacagagtctccctctgttgcctaggctggagtacagtggcgtggtctctgcttactgcaacctctgcctcccaggttaaagcgattgtcttgcctcagcttcctgagtagctgggattacacatacacgttccaccgtgcccagctaatttttttttcccccaccgagacagagtcttgctctgtcacccaggctggagtgcagtggcgcgatctcggctcactgcaacctctgcctcccgggttcaagcgattgtcgcgcctcagcctcccaagtagctgggattataggcgtgcgccaccatgcctggctaatttttgtatttttagtagagacagggtttcaccatgttggccaggctggtcttaaactcctgacctcaagtgatccacccacctcagcctcccaaagtgctgggatcacaggcatgagtcaccgtgcctggccccaatttttgtatttttagtagagacaaggtttccctatgttggccaggctggtgttgaactcccaacctcaggtgatccacctgtcttggcctcccaaagtgttgggattacaggcatgagccatagtgtccggactgatctgctttctgtatctgctttctgttyctatagattagtttacatttcctaggattttatataaatggagttactatagtatatactccttgtatagcttttttcattaagaatagttacgatttatccacgttgttgagtgtctagtttattttcattgcttaatagtattccattgtatggatttagcagttgatccgtttatctgttgatgtacatttgggttgtttccagtttttgactgttaaataaccaaagctgcaatgaacattcatgtacaagtctctggacataagctttcttttctcttgggtaaaaacctaggattaaaatggctgggttgtatagcagatgtatgtttaaccttctgggaaattgccaaactgttttccaaagtagttgtaccattttacgtttccaccagtggtgtatgagagttgcacttgctccaacatcctcatctgcacttggaatggtcatttaaattttagccattgtaataggcgtgtagtagtatcacatggtttaatttgcatttccctaatgactaattatgttgagtatcttttcatatgcttatttgccttccacataacctctttggtgaagtgtctgttcaaaccatttgtctatttttcaattgtgttggttttttttttttttttttgagacagagtctggctcttggtgcccaggctacagtgcagtggtgcagtctcagctcactgcaacctccacttcccaggtttaagcgattctcctgcctcagcctcccaagtagctgggattacaggtgcctaccaccacgcctggctaattttgtatttttagtagagacgaggtttcaccatgttggtcaggctagtctcgaactcctaacctcaggtgatccacctacctcagcctcccaaagtgctgggattacaggcgtgagccactgggttggtttattaagagattttatgtgttctgaatttaagtcctttatcagaaaaatgctttgaaatattttgtctcagtctgtggcttgtctttgcattctctaaacagtgtctttcaaagagtagaagttttaaattttgatcaagcccagtctatcagtgttttttaaatggatcatgcttttggtgtcatgcctaagaaaactttgcctaacccagtgccacaaggatttcctcctatattttgttctagaaatttttagttttaggttttacatttagatctgtgatccattttgaattaatttttgtatatatctgtttatatatatatatatatatatatatatttttttttttttttttttttttttgagactgaatcttagtcttttgcccaggctacagtgtagcggggtgacttctgctactgcaacctctgcctccaggttcaagcgattctcctgcctcagcctcccaagtaactgggattacaggcacctgccacaatgcctggctaatttttgtagttttagtagagacggggtttcaccatcttggccaggctggtcttgaactcctaacctcgtgatccacctgccttgacgtcccaaagtactggattataggcgtgagccaccatgcccggccccaaatatagatttaagttcatttctttgtctgtggatatctaaccgttcaacaccattttgttgaagagacactttaactttttaagcagttattttttcaaatacgcctgctgtagtttattagttgacaaaacatttgctaataattcttagataaggatttggtcaaaataaaggcactgcaaagactaatcatggaaaattatttatcgtgacgtacttctattgctgcaaagaggaaggccaatgtctcagccttatttaaatacataatgtacatgttaccctgaatctgctgataagcccaattttagtggtgactctcttccaaccatccccttcctcccatcagtcatggacatactatctaaaaaagaagaaaacacccttgttggtttgtttaactttgtctttcccacgtccttccagatccacgagagcgtgtgaaagaagatgacttagatgttgttctcagccctcagagacggagctttggagggggctgccacgtgacagccgctgtyagctcccggcgctcaggaagtccattagagaaagatagtgatgggcttcgtctgcttggtggacgtaggattggcagtgggaggataatctctgcccggacctttgagaaggatcaccgtcttagcgataaggacctgcgggacttgagagacagagaccgagagagggacttcaaggacaagcgtttcagggtttgtctttttttttttttttttttttttaaattgagacggagtttcgctcttgttgcccaggctggagtgcaatggcacgatcttgactcactgctgcctcagcccagtatctgggattataggcaygcaccaccatacccggctaactttttatatttttagtagagacggggtttctccatgttagtcaggctggtctctcaagctcccaaccttaggtgatcggcctgcctcggcctcccaaagtgctgggattacaggcgtgagccaccacacccgacctgggtttgtcttctagattctttggtagttcatgtgcttggggacttgatattcactttttttataccaggttactttgagaacaggcatgaacacagcctgctcttaaaccagtcagggaggaaggggtgggggtggtgatgggcctcaggtatacagcatcatatcttcctttcactattgaacattacaacgaagaccytgactgaagtagaaatggcttgactagaaattttttaatcttgctttatgtacttttccagagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtcagttcaaactttgggagggaagttcgctgttttaaaatgagatgtaggctgggcgtggtggctcacacctgtaatcccaacactttgggaggccgaggtgggcggatcacctgaggtcaggagtttgagaccagcctggccaacatggtgaaaccccgtctccacaaaaattcaaaaattagtggggtgtggtggctggtgcctgtagtcccagctactcgggaggctgaggcacaagaattgcttgaacctgggaggcagaggttgcagtgagctatcacaccactgcactccagcctgggtgacagagcaagactgtctcaaaaataaaatagagatgtgattatcactggctaattgtacacttaggaatgggcaccagatgtataggaaatggcaagtttttcatgatgcatcctgattttgaaatctttttttttttttgagacggagtctcgctcagttgcccgggctggagtgcagtggcaccatctcagctcactgcagcctccatttccttggttcaagcgattcttccctgcctcagcctcccgagtagctgggattacaggtgcctgccatgacgcctgggtaattttttctatttttagtagagatggggtttcaccatgttgcccaggctggtctcgaactcctgacctcaggtgatcacccgcctcggcatcccaaagtgctgggattataggtgtgagccaccatgcccagcccctgcaactgcttaagtgaggattcactaagtgtagatcatactgtttccctaactcgttctgcctgccacactaaacagaaaagtctgaagttatcctgtaagaggactgtgtacatgaaagagttccccagaaataagaaacgtggtagaaaaatgagaggtctcatttattgagcaattatgtcctaaacacagtggtgagtgtattttgtctgtgtaatccttcatctcctaatgaccttgtgcagtgtaggtacttttttatgcccatttcatagatgagcaaatggaggctcagaggrcttaagtaactcaaggacacttaaggtagtcaccatggaaataagtagtgaagtcaagagtaaagcaagatgcttctgggcatcagagcctaccttcttcatcatggtattaggccttcccaggtcagttgtttgtgatttgccttctctcaaacttagtttcaggatgagtacggtggctcacgcctgtgatcccagcactttgggaggccaaggcgggtggatcatttgaggtcaggagtttgagaccagcctggccaacatggtgaaaccctgtctatattgaaaatacaaaaattagctgggtgtgttgacgcatgcctgtactcccggctactggagaggctgaggcaggagaattgcttgaatccaggagacaggttgcagcgagattgtgctactgcactccagcctgggagacagagttgagactctgtctccaaaaaaaccaaaaaaacctagtttcctcagctgtaagatggggtcagatatctcccttgctaaactgaaggagccagagctaatgtgtgtgaagtacctgctgcagagtgggagcccattggtctgcagccaatcattttttagggcagtgacctggctctaaggtggccagtcccaggctgatggtcttgggaaggaggcactgtagagccaggtggggactaacctgggttaaagtactagggctcctgcttagaaaaggataatttttgacaaaattttgacagctgggcctgtttctttgtaaagggaagaacaatgcctatcataacttaagggttacctttagcattgaagaacacatgtacccatcagaactcagcctccaagaaggcactcagtaaattctacctgcctcaagctttcaggcttagttgaaagccttttggcagatactaggcaacaaaaggggaaagcctttttttttgttttttgtttgtttgtttgttttgagatggagtcttgctttgttgcctaggctggagtgcagtggcacgatcttagctcacggcaaactccgcctccgggttcacgccattctcctgcctcagcctcccgagtagctgggactacaggcgcccaccaccacgcccagctaaatttttgtatttttagtagagatggggtttcactatgttagccaggatggtctcgatctcctgacctcgtgatccacccgcctcagcctcccaaagtactgggattacaggcgtgagccactgcgccagtcctctatttttttttttaattaattttcttttttttttgagacggagtctcgctctgtcacccaggctggagtgcagtggtgcgatcttggctcactgcaagctccgcctcccagggtcaagcaattctgcctcagcctccggagtagcggaactacaggcgcgtgccaacacacccagctaattttttgtatttttagtagagatggtgtttcaccgtgttagccaggatggtctcaatctcctgacctcatgatccacctgcctcagcctcccaaagtgctgagattataggcgtgaaccactgcgcctggtctgggaaagctattttaataaataagggaaaaatcagtgccaccttaacattttgatgaagacaaatataagcagaaataagctgatggcatttatttagaaggagaaggaaatggagaatcaaaatactcatcttcttttgtagtcttcaaaatatagtacatattaccattatctttgtgctatcacacagtgttccctaggataatgtaagaaaytgataggtaacttggaagactttgctattaaattggctttgagatatgtctttgtctcattcttaattaaagcagcacccaataaagcaccactttaacgataaagatcaggcttctggtgagaaaaaattatgtttttcttaagtgaggtgaaatctgaatttcarccattcttgtatcaagtgcaggagtcaggagtgagatagattggtagtggcacctccttattttacagatgcagagagaaattgagacctggagagaagggatggatttcatggsagagcctggagtagaatccaggggtcttggttcatcccattagctaactacagaatgtctctaggttgcccttgctatgtatttaaaayaaataaaaacaaataaaaacattaaaaactaagatgtcagatgccttaaatgttagcatctggcagtttcactttgtctccccatcctaaaaacaactgaacattgtagagtatacctggcactacagagtaagacaaagctggttagaccaggttccctaccctcagagtttagcctcaccagagagttactattatacagtgtgacaagtactcagagatgacataaggattatagagaaggtagcaattaattttactaggtagggcaaaaatgggtaggcrgggcaagcttcccagagaaggtcacatttgaatttcgccttgaaggatgagctacaacaaccaacctgtaggcaagtgaaaattgccctcatgccaggtttctcataaataccttaggttgctgagccctgactgaaagtggtgctacaggtgcatgggcagaagcagagctaaattaatttggttccatttttaagcagtaagagacttgcaaagactatcctttaaaaaaaaaatcactagaaaaagaactaggcatggtgctggacacagtggctcactactgtaatcctagcactttgggaggccaaggcaggaggatcacttgaggtcagcagtttaagtccaggctgtgcaatttagcgagactcagtctctacaaaaaattaaaaaattatccaggcatggtggtgtgcacctgtggtcccagatactctggaggctaaggcaggaggatcacctgagcccaggaggtagagactacagtgagctgtgatcgtgccactactctccagcctgtgcaacagagcaagaccccatctcaaaaaaaaaaaaaaaaaaaagacccccctccactatagaaaatatgaagttcccacgaagggaaccataatcctccccacatcccrttggtattctagctttattaaggcttttttccttttctgcctcccgtagaagggggactgttttattcttgcaagtacagtacctgcacgagaagtctgctttttaagtcatgtgtggctcttctacatgtatactgatggctgaagccacagagggacactggagtgatttacttatcagacggtttttgtcctggttttgctttcaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcggtgagtgtagcagcacacttaaaaatgtgtggttaaatttgacctgagtatttaagacatcggtttgaaagtgttgttttgctagatgcytttggggtttttggcttttattcttacatatttaaatttttgttggctttgttttgagaggcttaatggataatatgagatttttgtaccagttaactcttttttaagctggtggtgttagactaaaaattctttttttgttgtttttttttttttgagttggaatcttactctgtcacccaggctgaagtgcagtggcacgatcttggctcattgcaacctccgtctcctgggttcaagcgattcttctgcctcagcctcctgagtagttgggatcacaggtgtgtgccaccatgcccagctaatttttgtatttttagtagagatggggtttcactatgttggccagacgggtcttgaactcctgaccttgtgatcctcctgtcttggtctcccaaagtgctgggattacaggcgtgagccaccgcacctggctttttaaagttatttttagaattcctgtttatcactaagatgcttatattttggatacactccccaatttttcacagtgatgtatcatgcttatcttatattttaattaatacaaaattagtgcacttaaaagtcagcattatttaaggtatgagcatctacaggtggaatgtgattgaaattgtctagataattcctctgaaaatagaaattctggaaacaataattagggtcttgaattaaaatcccttcaaaagaagtatattgtggcttaatttgggtatggattatgaaaacattcttccagataagaacaaagaataaatctaagcttcccctgcttaactttggaaactgtgggttccagatttcaaataaaacagtcactaattctgtcatccatgtaccagtttttgaaaaagcatgttttctgtttatcagtgggattgacgtgaaagtatatgacttattttcaaggatatgtctgatttttggatagatgtttgctctatcttgtcttttctaaatattgataagaatactgcaaaaaatcaatttggatakttgactgaatttatggtatgatttgaattgaaaaattttttaaatgcttaaatctagtttttaagaaagattggcactatttcataatttctaccaaagcaatttattgttcatagtgtgttatttaattgtccttattaaatgtaaactatggaggttggatttggaaacagaaaacacctgaaaactctctattaatctcaaacagaaattagagatcagttgaaatttcatcttccacaatcatactttttctaaactttgacttggaattacagtctttatgagctctgcttttttagcctttggcttctgaaactctcaagattgaatttcataatgttcattacaaccttgaaaccactaagtttgaagcaatggttttctttcatcagttccccatacttgatatttagttgaaggtcactcatcagcttgtcagtggaatgctgtggcattgacactgttctctgagaacatttggtagtacgtggatttactcctgaggcaaaggatagaaacccaaaaacctttttgtagcatagaggctttgctttatattcttagaaagtagtggtggttcatgcctgtaatcccagcactttgggaggccaaggcaggtggatcatttgaggtcagaagttcgagacaagcctggccaacatggtaaaaacccatctctactaaaaataaaattaaaaatagccaggcatatggtggcgtatgcctgtagtctcagctactcgagagcctgaggcataagaatcacttgaacctgggaggcagaggttgcagtgagccaagattgcacccctgcacttcagcctgggcaacagagcgagactgtcttaaaaaaatagtagaccgggtgtggtggctcatgcttgtaatcccagcactttgggaggccaaggcgggcggatcacaaggtcaggagatcgagaccatcctggctaacacggtaaaaccccgtctctactaaaaatacaaaaaattagccgggcgtggtggcaggcgcctgtagtcccagctactcaggaggctgaggcaggagaatggtgtgaacccgggaggcggagcttgcagtgagccgagatcgtgccactgcactccagcctgggtgacagagcgagactctgtctcaaaaaaaaaaaaaaaaaagtaataaaaaataaaaaaggaaagtaagtagatggttatactcaagtttgggttattcagaaattacccaggatggaggaagaaaaaggtgttcaaattcctaggttctgagagtatttatcttcaggtcacgagcatgaaaggaagtttcaaagtaagtgaccctttcataagatttaaaccttcttgtcctttttcatctagaaactattagtttttattgtctttttcttcagatgatagaagatgttttgggagaagggtcagtctctgccagtcggttcagtaggtggttctctaacccgagcagatcaggaagccgatccagcagtcttgggtcaacaccacatgaagagctagagagacttgcaggtaaaatggcttcagattctgcccttgaaggtaaacctgggtttttccctgatatggttcattttatcttcattagtcaggagtcaattagggtcaaagggtctctggacaactgaaaagccttcaatttgtgtccttttaatattgttgaaggggccgggtgcagtggctcacgcctgtaatcccagcactttgggaggccaaggcaggcagatcacaaggttaggagtttgagaccagcctggccaacatggtgaaacccccatctctactaaaaatacaaaaatcagccaggcgtggtggcgggcatctgtagtcccagctactcaggaggctgaggcaggagaatcgcttgaaactggcaggcggaggttgcagtgagccgagattgcgccactgcactccagcctgggcgaaaaagcgaaactccatctcaaagaaaaaaaaaaaaaaaaagaaagaaagaaaaatactgtcgaaggcatgtttctttactggaacagattaattttgagtatgtttatttgcaatatcaggtctggagcaagccatcctctctcctggacagaactcggggaattactttgctcctataccattggaagaccatgctgaaaataaagtggatattttagaaatgctacagaaagccaaagtggatttgaaacctcttctttccagcctttctgcaaataaagaaaaacttaaagaaagctgtaagtgtttatgaatatctgttttagatatctgaaaaggtctagatgttcagtcttcargcagttgggtctaacataacctctgtttcataaaaagtcaaatatatattgggtttttgtttaatgttcttttttaaaaactcatttcatcaaacaataccacctctttgagaatctcacagtgggtcatgagccctatgagaacttttcctgtaagttcttacctagggtctggttgtaataatccagtgaatgttgaaaacaaactccagtgaatgttttattcctccagagcataacttaccatttcctcacaaatctgccctagtcttccatgttcttgcttaggctataaattctcaacataaaaacttagtgatataatgaccacggtgcaggcagcaatcttggcaatgttgggctatctgggattcttgtcccaggtaacaagtctcccagaagactcatatccttctgcaggatgcacagcaggagcttgtcaagttttaaagaatagcacttcatagttgtggtcccccagtttctagcatctaaacattttaggtttagtttatgccatctcttagtacacaatttgattttaagtgttattagtttatttttggtgtcagtcttttctgacagtctcatctcaattttgaaataaattattttcatcttatctgtcatactagccaaagagaattcctaccagatatctctttgcttgatttaacctggacgttctcaacttctcagcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagcgtaagtatctgacacaaaccccccacccttttctcctttttttttcttctttttcccaccacaataaaaggatttttaaaaaggtattctgagtaagttggaaattctttagtagtcatttggtccttgatgcttttgtgtgttccttaattattgatatgctatttgttactggaaaaagcaggcttgtggttaatttatatgtattgtgggtgacagtataaagattaaaagattcagtcttaatggtaatgcctgtataactttaagtcactgctaaaatgaggtataaaactatctttttggatgaactccagagacaattttcttgttattcagctacttaagttcatattctttaccatatttgtatagtaaaatctttattcacatcttctaattattcccagataccagggattacctgcattcttgcagtcatacaaatcatttgtaaagtatctaagatggggctgagcacagtggctcacgcgtgtaatcccagcactttgggaggctgaggcaggcagatcacctgaagtcaggagtttgagaccagcctggccaacatggtgaaacgccatctctactaaaaataaaaattagccaggcgtgggggcatgcgcctgtaatctcagctacttgggaggccaagacaagagaactgcttgaacctgggaaatgaaagttgcagtgagccgaggtcacgccactgcactccaggctgggcaacagagtgagactgtctccaaaaaaaaaaaaaraaagtaagatgggtttgtcaggataattacattctgtcaatttactaatggaaaaagttgtggctccaagttaaaaacaaaacttgtaggcatgaagttaggttacaaggtgacacaactgcatatcaccttgtaaatgcaaatgtttataatatactggttctttgtcctaacaattttgagagggtagttcttacccatagcctatgtgttaatatcactatctcttgatacaaactaatgtggaagcagggtagatatgaataataaaaacataaacatggacttattctagttgctaagttatagcaaatttaccaaattgagttttctctctttttttcctgttccctgcttgcctgggaacttaccagttagccaagatgcaagtagcaatagctgtttgaatcattatgtcttataccaaaagaaagcaactgacttttagcattccttatctgaccaataggacagacagaggttccattattccttagtgccaggactgacctacacttgaaaggaggcacctcagataggtagactgacttctttgtatctgaccacaccataccagttgcaggagaatgtccctgtaaaactgctttagagttacttttatacaaagaattattagatacaaatgctttcaaatgaagatcagactgaaagatggtagactatcctattttcctttctcgttacatttgtgtcttggtgattgggtgctgactgcaatgstgtggttcatatcttataattagcttctttcttttggtgtgagcaactaaaaatatggaakggggcattcagcagtttacctgatgtttttccacattttattgcagatatgattctaggatttgatattaacacaatttactcgagttgtaagggcagttggtttgatgttggggttttagcactcagaagtgtatctggttttagctgagcaaatgagcctcaaacacctgccaaacggatggatgacacattcaagtggctaggcaaaggctaagacaaactcagctagcaggaaagaatacaacaaggaaagtaatggagtaagaatagcaggtgttatctcaaaatattgctcaatttgcatgttgttaagtcatggtttactttttgaattcggtgtctttaattactactgctgtgtatgttttgtatactatttctgatctgcctccatccatttaggttgtcatattggttcatccaaaaataatacatgctggttcaatctaaattctgttttaaattatagattctatcctccaagtataataagccatgcagtataaagttgtctatttgtttttattagatggaagtaaatgactcttaaagagattacttataaaatcatctgcctttagtcccagttccaaaatcaacaataaaatacttgggtattcttgagctatttgtcatgcctagacactgctttggactttgacagctccatctagtggaagggaaactacaccagagaaagcacttcacacagagctaaatgggcatagggatgtcctgaaatgcaggaggggactccaggttggatgcacaaaatgtaaccactggccaggcctggtggtgtacacctatagttcgagctacgtgggaggccaaggtgggagggttgcttgaacccagaagttcaaggccagcctggagaacatagacctgtcccaaaaaaaaaaaaaaaagtaaccactactgctttaagagtggaggatttgaattttgccctgtatgtgatacccattttggaacagctcgtttaaaaaataataaagttgccgggtgcggtggctcatgcctgtaatcccagtactttgggaggccgaggcgggcagatcacgaggtcaggagatcgagaccatcctggccaacatggtgaaaccccgtctctactgaaaaaaaaaaaaaattagctgggcgtggtggcatgtgcctgtagtcccagttactcaggaggctgaggcaggagaattgcttgaaccctggaggcagaggttgcagtgagccaagatcgtgccattgcactctagcctggtgacagagcaagactctgtctcaaaaaataaaataataaagcttaaatttcctgaaatatgaaactctgaaatataacaattttggccaaacctgcatgttgtttactaggattttaaaaccatatgtgtaggcagggtgtggtgggtcacgtctataatttagccagcactttgggaggccaaggccagaggattgcttgagcccaggagttcaagaccagcctgggcaacgtggcaaaaccccatctctacaaaaaatataaaaattagttgggtgtggtggcatacacctgtagtcccagctactcaggaggctgagatgagaggatcgcttgtgtctgagaggtcaaggctgcagcaagccatgattgcaccactgcactccagactgggcaacagaacaagaccctgtctcttttgtgtgtgtgtgtgtgtgtgtgtgtgtgtgtgtgtgtgtgtgtgtgtgtgtagtatatatatatgtgtgtatgtatgtgtgtatatgtatgtgtatgtatatgtgtatatgtgtgtgtatatatgtatgtatatatgtatgtgtgtatatatgagtgtgtgtgtgtgtgtgtgtgtctccaataaatcttgttaaaggtaatgggtagcaagagttatctcaagtaagtgttccccggtttcaccatttttcccccttttggtcacagtgttagaaacagggaaatggacttaggattagcatagtgaggatctctgaggggactttgcatgtacatgtgaacggtctttccatccccagatctttgagacctgtgtgatgagagcggaacacgttggtctaagttttctgtgacttgagtatcattctgctrttaactccctaggagtattttatgctttcttgtggtccccaatcaatctgtaagttaagtgagttaagaaagttaaaaccagttttcttttgactcttttagcgaaaccttgaaagccatttgatgtcccctgctgagattccaggccagcctgtccctaagaacatcctgcakgtacttcacaatcttatactgaggccttggagtcttgaacagtagtcttctgaaccagttttgcttagtggtccaactttgggccttagaaaatgatctgtgttgcctggcaatcagagaggtgatattgttgcctgacatagtttggtgttgcttttaatctcaatgggcaggggataggggatggctaaaaaagttgacaaagtaagccttgacttctagtttcctttgcagtttctgtgaaacttaaaagtatctagccaggcacggtggctcacacctgtaatctcagcactttgggaggctgaggtgggtggatcacctgaggtcaggagtttgagaccagcctggccaacatggtgaaaccttgactctactaaaaatacaaaaattggcctggtgtggtggcacatgcctgtaatcccaactccttaggaggctgaggcgtgagaatcgcttgaacccggtaggcagaggttgtggtgagccgagatcatgtcactgcactccagcctgggtgatagagtgagactctgtctcaaaaaaaaaaaaaaggaacctctatttatagcactaacttagagcatatgttgctagctgaacattcagataaatgtgttgcatgtacacatgccaagtccttcagttgagcatgagggagatccatcttgtggctctcaaaagttaatccataattcacagcctctgagtagaaggaataactaagttcacagggatttggcttttctgcctttaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtaaatatacttatttgtcaaaagaaatatgaatttatggccaggcacggtagctcatgcctgtaattccagcactctgggaggccgaggtgggcagatcacctgaggtcagaagtttgagaccagcctggccaacgtggtgaaaccccatctctactaaaaatacaaaaatagccagacgtggyggtgcatgcctgtaatcccagctacgcaggaggctgagacaggagaatcgcttgaatctgagaggcggaggttgcagtgagccaagatcacgccactgtactccagcctgggcgacagagcgagactctgtctcaaaaaaataaataaatatacttttgggggatggggtaccaaacgtggaagataccagctgctcttctaggtgaatatgttcatgttatagattttttttttattgaaatctaactttgatctagctctttagtcttattccttattttgggaattcaatccaaaaaaagttaatttggcttcttaagtttttctttgatatagtagaagtcagtgtagtggttatctatgaagctattgagttttgatagacaatctgctgttaagtcttatggctaattcagaatgtgactgaaagaaaagttccagaaagtgtcttagcaaagtatttacatggaatgtcgtagtgttcctgctatcctaggccactttaggctgctggccactctggctcctgccaaacaaaccttgagaggcattttttgaaatcttctgtccacagtcaaacaatggagagaatgtgtattctcagagcaatggtgtctattttaataccagctggcttagtgataacgggacaaactgctggctaggaaagctcttctctcccagagagaggtcttggctttaaaaggagcaatgctgatggcttagttgagaagcaatttggacagtgctctggttgaggtccacatagcccacngttggggcacagagggagagggacatctgtcagcccaataaatcagtgctttccaagagatggcgttcagcaagaaatgncatgcattaatgaaaatgcctccctgatgcacacataccatcttggtactcactgagactaactttcccgacaggtttcacaccaggaccacagcagctactcggagatccattccaaggcatgcgcaaacccatgagccccatcacagcccaggtcaggctgagctttctcaaactcaatctcttgcttgcccttcaccctcttggtgcatggggagtggagagctgaactgttgtgattcttaaaaatggttttgaggccaggcatagtggctcatgcccgtaatcccagcactttgggaggtggaggcaggaggatcacttgagcccaaaagtaaatttaaaaaatgagccaggtatagcggcatgcatctgtagtcccagctacacaggaggctgaggcaggagaatcgcttgagcccaagagtttgagactgccgtgagctatgatggtgccactgtactccagcctaggtggcagagtgagaccctgtctctaaaagaaatggttttgatctatatttcaagctcagtgaaggttagacaatttgctgaataattcaagtaatacttaaattgttaatcttgttcactgcgatggcagcacaatctagtcagtttcgcagtatctaatttttttcagcttctgcttaacatacctttctaagagtgaagagaaacctttgtagaaagtgtggtgtccttactcttctcctgaccctcccstctccttttcagcagatgagccagctggagttgcaacaggcagctttagaagggctggccttgccacatgaccttgctgtacaggcagcaaacttctaccagcctggttttggcaaaccacaggtggacagaaccagagatggattcagaaacaggtaaattactaatcctgctcatgtggagatttacggataagttttcctgaaactaataaattacttatctgcagtataattctgttgtacatactgtggtatgttcagtatgtggtagaaattccatcccaatccaaatcaatagaagaaatagatttaatagcggaaatatgattaaattstactgcaaggcatagggctttcattctatatggttttatttccgttcttgatttataaattactttttttccttgagtttgctaattagccatatggaagggatgctgctcgcctaatttacctcacaagattgttatgagtaaatatattttaaaatcttaggatgtttctaccagttaaaccattcatttttacaaatgaaactagcatagctccttattcctttccccacagattcaatgttcttatcaaactcccttgatgcaggtttgctacatcagcagttttttggccagagctgacaggtttgttgatcagagctgttaacaagtagagtactgagttcactcttctctttttcgatagttgcaacaaatggtaaaatgaaattaatcataagttagggagaaaagggaaaggagtggcaatattattttattgtaaaataaaacagacaaaactatataaaacaaatgtgtagcttattataaggcaaacttccttgttaactactcagagggcctccatgtgccctgtgccagtaataccccttttcctcctcagaactctccactgtccagcctttaaaagtaatcactaccttaattaaaaataatttatcaccaaaatgcacatccctgaacactatagtttagtctacctttaaaatactcngtacttaatgttttgatgtgattcttaaagttactaccacagtgcctcagtgttttgcttcagctggttttacctgttaaccctttcagaagatactgagaccaggagatagccttacacaagcacatcctatttatagcacccttccaccgaaacagagagctccagactggtctgctgaacccctctcacgtgctttctgtctatagcataatgcagttacctagtattcattgatgtgatttgtgactttcacagtacttttaactttttttttttttttttttttggagacaatctcttgatctgttgcccaggatggagtgcagtggcacaatcttggctcactgcaacctcctcctcctgggttcaagcagttctcatgcctcagcctcccgagtagctaggattacaggagtgtgccaccacacccggctagttttttgtatttttagtagagatggggtttcrctatgttggccagacttgaattcctggcctcaagtgattcacctgcttcggtccccaaagtgctgggattacaggcatgagccaccgcacctggcccagaattttatatgatcttcatatcaaccctgtgaggtagatggggggggggggcggtacgtaactgcattttacagatacagaaaacaggtttttaaaacatggcttactcaaaactagcaagcatatttgagtcatttcagtctagccttcatgttttggatcagcatcagcctcttaggtcctccctgtgtacagttgtgtccctccaacaaacatgcctttccccttaccttgcttttttwaattgtattcatcactgtctagcatattatttattgtttgtctccctgcctgtagtaaccccactccatcctgcagccccaagaatgtaacctccatgaggccagagattatttttcttttattcactgctgtattccaagaacctggaacagtgtctgtagcaggtgctcaaatatgtttaccagaaggaatgataggtcatgtgggaccctcaagtttggggttcattttttagtcactcagaatagtactgatctgtctgcccatgttgtcatacacacagtcacagcatggcagcaatggggtactaactagaaagaagccatgaatttaggttttccatctatctgtgattcagagaacttcaggtcagtgactatacttgggccttgacctttgaggcctgaggtcaatcttgtgtagaccaagagtggtcctaaaatagctgaaactcttgattctgtatttgatttgaacgagtgtcacacacagcatcagttctgtgccaggcactgtgctaattattgccgctccctgcccagtgaagcacaggcagcccaagaatgaaggccctccctagcgcacctcactggtgtagtctgcagtaaactatacaccagctctggataaccctacaactcccaagttcctgtacctattctgtctacctgaactgttgttctctagcttcttcttgatcgcacccaatggaatgcagcttcttccccaggaagcatccctgcagtgccttgttatttcttctaacccctccattttcccattgtactttgttggtgcctaatatctacatgccttggtttgctctaggtgattgtctcccccgctagactgagagctcttacaagactgggactgtgtttcattttccttttgtcttccctcagagcttagcatgtgcttttgtgtrtgttaggcctaaatgcttgggaaattgaattggataagggaaaggggatgttaaaacttctaggctggtcttgagtattatatggttttaagacttgaagttaagcagattggggttcatgctgataattggtttgttcacaggcaacagcgagtgaccaagtcaccagcacccgtgcatcgagggaattcctcttcccctgcccctgctgcctccatcacaagcatggtcagtgacctttagtaactgtgaaggactttaaggcttctccctgtttggttgtgcatggattgtaccactgtgtgccctaaatgtccttgagttccttccacggaaataactgacctagtagtttttcataactgtctattaggtctttcccttttaggacacagtctaagtcttaggattttaatgaagcccctatattggggaaaatatgttccagcagagatgatcatgggccagggcacacgaggtgatatagtatgttcaaagaaatgaaccaggtgtggggagacaggaggacgatagtgagagacaggaggtgaagtggacagaggtgactgggtcagacagtggggagtctattgaaacttgcaggggagttcacaaattcggattcaccacttcaggtctcagtgatataaactaaggctggaacagaagggtttgcttatatgcagtgagaagtctagttttataactatcattactttaaaaaatgtttcattccagctgggcgtggtggctcacgcctgtaatcccaggactttcagaggccgaggtaggtagattgtttgagttcaggagttcaagaccagactgggcaacctagtgagaccctgtctctacccctaatacaaaaarttagtcgggcatggtggtgcacatctgtggtcccagctatactcgggaggccgaggtgggaggatcacttgagtccaggaggcagaggttgcagtgagccaagatcgtgccactgccctccctagtgagtccccgtctcaaaaaaaaaaaaaaaaaaggttcattccccacaaatctttatcatctaatcaaagccgatagagaagaaggaaaaaaaaaaataactttgctgcgtgcttcagaaccccacgtgggtctttgcaccggtgaccttgaaggcagcagggtttggaaagaacttttttgtttataagtcaagccctgtctcctgccatcaaagatgtggggttgtttggtgagaaaaggcaaatgcataataaaatcaccaaggtagaaatagtgaagaggtaagaaatgactccaaatgattaatcctgatggctgaggagactattgagataaatttgacttttctggtagccaagttaagggaaatattaggagtatggagtaattctggttttgatgttatctttgaaatgtcctttcgcagaaggaaggtctgttgctccaagttatatttctggccatgttctttctcttgccagcctaatcccaggctgggaaatctgtgacgcagaggctgcataggcatgtccccattatcacacagttgtaagcaagggataatgtacttgggacactgcctatttgccccattctgtttttcctccagcagctacagaacagaatactacagttggcctatgctaccaatgtggggactctttgttgagtatcttgacaagttaatcctggcttagtattagagaacggcacttagagaatgtgctaatgccaattgtttttctctgcagctttctccttcctttacccctacctcagtgattcgtaagatgtacgagagcaaagagaaaagcaaggaggagccagcatctggaaaagcagctcttggtgacagtaaagaggatactcagaaggccagtgaaggtactgcagagctgttaagggcactgctcaagaaagtatgtgatggagaaaacatgggcctgagcgctgaccagcctgatattctatacaaagccctgggcaagaccactagcttctctggactatggttctgtgtcagtgagaaggttctgtgtgacagtgagaagaattgggccagctcacaattgcttggttgcttgaaatttgaccaatctaagagtgctactaccagacgggtagaatgagtgttagtttagaatccttagttaggcttcaaagttaataattagtatacttatttggcaaattaatataattcagcgagttttacttctgaaagattatgtccagcctgtggagacttaagtgtccaacatagaaaatatgtgagaggcttttaggagttgcacagtagggattgtgaaggacrtggtaacatgcggattccaaattagggtttacagaggtgttaaaagtacagatctgagagatttttgcctgtgtttgagaaggcttggggtgggtggtggggaggaaatcctgttggtactattaagacagtttgggttctttgaccagactctaattgccatttagattttctgttgtgatagatttgcataatctaggccacagccatttgtgcagagaagggtgcccaacaattcatcttctggtcctgtttatgaagcaaacgatggttcctaccgtgtagtcctctaaacttgttaagggtatcagataagaattgtgaccttaagaaatgagatttattagaccagtgggaggccacaagtgtttgggagaggtttgccaaaatattttttgtttggttcctcacagaaaacctcctgtcatccagytctgtacccagtgccgatcgagactcttctcccactacaaattccaaactgtcagcattacagaggtcttcgtgttccaccccactgtcccaggccaaccgttacaccaaagaacaagattatcgacctaaagcaactggragaaaaacacccaccttggcatccccagttcctacaacaccttttctccgccctgtccaccaagttccccttgtcccccatgtccctatggttaggcctgctcaccagcttcacccagggttggtacagaggatgctggcccagggagtacatccacagcatcttccaagtttgctccaaactggtgagtttccagcctgacttgggtgtcgtcagtttgtgggcctaggggacaattgttggcactgatgaagtgctataatgtgggagatttccatccctagaaagatgttactagattctcccatctaactggcaggcagtgggcccaatccagtcaatcccctagtcctttaaaagattaggaacctagcttgaagattctttttttttttttttttttttttcctttttgtagagacagaagtctcactctgtctgcctggctggagtgcagtggcgcaatctcagctcactgcaacctctgcctcctgagttcaagcaattctcctgcctcagcctcccgagtagctgggactacaggtgcacgccgccacacccggataatttattttgtattttagtagagacaggatttcaccgtgttgcccaggctggtctcaaactcctaagtttaggcagtccacccacatcggcctcccaaagtgtcaggattacaggcgtgagccagagaattcttcattcttttttgagtctcgctctgtcgcccaggctagagtgcagtggcgcgatctctgctcactgcaacctctgcctctcccgagttctaggtccctgcctcagccttccgagtagctgggattacaggcgcctgccactacacctggctaatttttgtatttttagtagagacagggtttcaccatgttggccatactggtctcgaactcctgacctcgtggtccgcctgctttggcctcccaaagtgctggggattacaggcgtgagccactgcgcagagcccttcattcttaacaaacttccagatcagcaaaactgtacagtgaagctggaaaacttccaggtaacattaagactactcagctgcttgctttttctgctcaacaggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcaggtaggttcaggaatgtgacaggtgagtttgggacggacttagggagtcttgaagctttgaggactagtttccagtggagatgaattaacactttcattctttaacttgttctaagtttgggacaaagtgtaaccagataataagatgaagtaaattgacctctatgcaatttgggattactgttcctgcaaagtcagtgggaaragccaagtgttttctggctttttcctttgcctgttaggagagagggctgagaatccaacagaggttcagcatccggcctgcccagggtatataccccctcaccagttaatgttgctgcttctgtgatgtggttacttagccatgagaagtagcggtcatgtcatccagggtgggttttcaatactggtagcttctgaatagctcagctttccatggtactgttttctggcattgttggtattttgcaaaggagtttctaaagaagccctagaaaaaatcctctagtaaagacttttctttggatagggtttgaatgaagcagggtctaataaactttccttctcatgctgtgaatgataacccttcttatctccacagttctgcatcctccaggctctggttcccatgcagcagctgtcagcgttcagacaacccctcagaacgtgcccagccggtcaggcctgccccacatgcactcccagctggagcatcgccccagccagaggagcagctcccctgtgggccttgccaaatggtttggctcagatgtgctacagcaacccctgccctccatgcccgccaaagttatcagtgtagatgaattggaataccgacagtgagcagggcaggcagactcaactaagcccggacctgtggtggcacactgggcaggaccctgcttcatctcgggttggtttatgggcttttactttggagcactctgtgtgaagctgtttggtggaacccatgcatctggtgtggtccgcattatgatggaaggatcttaaccagtcgagtggagtgtacattgtctgaatacaggatgcacaatgttgtcaatcctggaaatggtctttcttttttgtaagatatgtgaatgaagtgttggtgtcctcaccaagaggtggcacctaagggttctgaggaaataaatgtatagacccttatgtacagacctgtgtataaacaacttttgtatatacatataggatagcttttttgaactatacagctgtacataaaagtagctgatattagttaggcctgtgtcaacagtttggatttttttcacttgtacatttgggattttcttttggttgattaaaattgcatatgctaagtgtgtgaatgaagtaactgacattgttgtgtttatttcctctctgaaacccttcctaattttgtttggagacagggtctcactctgtgtcacccaggctggagtacagtggtgcaatcgtggctcactgcagcttcaacctcctgggctcaagcgatcctctcacctcagcctcccaagtagatggaactacaggcacatgccactaacttttttcttattttttgtagaggcagggtcttaccatgtagcccaagctagtcttcctaatttctaaccagccaagctatgctcagtatgttcctttaaggaagtgatctgaagtttaagtaagttaagtttttcttgaaaacccatggaaattgggcactgtggctcacgcctgtaatctcagcactctgggaggcagaggcaggcgaatcacaargtcaagagatcaagaccatcctagccaagatggtgaaatcccatctctactaaaaatacaaaactagctgggcatggtggcccacacttgtagtcccagctactcgggaggctgagacagaagaatcgcctgaacctgggaggcagaggttgcagtgagctgagatcacgccactgcagtccagcctggcgacagagtgagactccatcttaaaaaaaaaaaaaagttaattggactctatcttgatttaggagaaatcaactatggcctttttccttgagctttaaagaccccaacaggtcagtttatactggactgaccctatagatagcatagccttgtggctaataccaggatatctatagtgtaatttccaagattaaactgacctagtgaaaacagtttattgaggaatcatctattacatatggtagtttctctcaaacaaatcatgtttactggggcatcctgtttctctaagctcagagttctgagcttagacccactgaagtctaagaatttcccttaagactcatgcattaattgactccttgtgttctgtatcacattccttagctcacaattgttttattattcaccttaactattagtatatacatagcacttacggataaagattctacagaatacagtacagttctgagtcccctttcctaactggaggtttttcagtcctgctatgaggtgatacttatttcccatgctactcaagttaatytaccagagttctagatatttgtccattcaggaccattttaggactccatgctaaagggtcagataatgaggtaaaggtcaaggtggttggatttttgactacaagggtagtagagtcttgggcagcctaagtcttgaccgtttgttagggaataatgactataagcctggaactgcccaccctgccgtgtacttgcaggaatacaagaaagcaggtcacctttcaagaaaacctggctttatggattatgcatgaagtcagtctcttcctggtacttttctttcagcctcattagtaatccccttcccccatgctattcactccatgtgattcctcagcttcagaaatagaccctctgtttagaatttttggcaaatgctttctggtttccacaggtggaagctggaacgcagtcccaagtgtcaatggcagaacacagaracctgaatccagttccacctttcctgtgtatcctcttccacttatcttacttccccttcatgttgaaccaacgttaataggtgcaaggtaaggaggactgggttgaagctgctagtaaaggcttccttttcagactagaagctagtaggacagaaacaggtaccatgcaaagagcaaagccattagctggtgattggcaaatggcgccagaaggaaataagggagtattgctaagagtatcagcagaagctagacatacaggttttagcaaaagtattttggtaaacacaaggactagaggaagcgggagggtgggggggggatgaaggcaaaagacacattaatgcagtcttcaaggagctaagaccttgatataggatgagggcagagaggaagggatgtctttggagaaacttttgatgtcttgcaggcacgagatgagttcacaagcaatcagtgctggaaggatgtgcaaaataaaagttaagagaagctgaggatatagaaggcatcctgaaagtaaaacagctgaggaccacaaagcatatcatggaaaatctgttaagcaggggaggtcaggtaggagaggaaagaatagtccctcccaaaggaagcagttaaataagtctgtgggaggtcagtggtaaaaggaagtgggaatgaagtgaacagagagtgcagctaggccttcccctaggagatagctactgagtgtcttttaagccagactctattaacagggaagggaagtgggaggtccattggcctttgtgaactatgagcataaacacaaaccaagaatgacgataacttacagggttaaattctggttcttcaataattctattccctttaccaacaattgattcaaaaatagacatgtgacccaattttaggccacgagacaacaaactgggtggcttctggaaaacagcttcccaaaaaggtaagaccaagttcccttccatttcagccgcttaagttagcactttctgctaaatgcagctaaacgtgttctaactagttaaatggcacagaacaatggatctgtttacttgtaataaagtcaggaaagaaacatggaatatgtaaaagcacaggaaattcaaatcatgctatgacagccaaaccagtaaagtcttagagttaatgaggagaaagcctttagctgtacctccacagtggccataccctaggcagcattcccaataccaaacatacccctctcccagaactgctaagtctaagcccagaggagaaagggaaaggtagggtaattctctcctcaaggagaccaggggtccctggaccaagccatggggagggtgctaaatgatggacacaaagcctattcacagaacatcctgaggccttaggatgaactggatttcagcaaccttctctccccaacattctggcagtgctaaatgcttgctcaatgaaagtgaattttggcaagaagagtccccagaaacccaatatgttctggctggagaacaaaccttcctggaaatcccgtagctcagaaagccaatgtttccctgttcccctgcagggttggggcaggctctagaccacggcctctatcatgaatgcaccagtggtatcaaggccgatattctgaaaagtaactagcataccaggcttcaggagcttaccttccaggtctggggacagtgacaagcccaagctccaggaagactatcaaagggaaacaactgctattagggcagcaggagaaacaagcactggagagaggctgagtatgtgaataatcccacactgtgatcactcatgacctgctaaaagctctggcttgcctcatttgaagaaataatcaaattctgtcttgctgcaaacctattcttcctgattttctcagggactactccatccatactgaaataatgtttgacttcttcccaagagcaagttagttaacaagtttaagatttctcccccatacttacatgtccataccctcccttctgcccatattctttaattatttaatttttatttcttggagacagggtctcactctgtcacccaggctggagtgcagtggcccatcttagctcactgcagcctggacctcccaggctcaagcagtcctcacctcagcctcccgaacagctgggactgcaggcatgcaccaccatgcccacctaattttttaaatttttttgtagagattgggcctcgctatgttgtccaggctggtctcgaactcctgagctcaggcgatcttcctgccttgacctcccaaagtgctgggattacaggtgtgagctactgggcccagccccctccgtccatattgttacccaccacaccaagattttcatcaaccagtttcacataatcagagcaatccccttaaattcctatattcctagtcccccaaatatctgattatgtccttagcatcctctcaagtagtcctgacaccaagcctcctcctaaaccgcccacctccatatatacacatatgtgaacacacaaacctgctttgatcacaccagttgcctcacttgcaatgcaccttcgcccaagttattggctgaagccaggactttcatggggattcaagcagaaagtctgggttatgggaaagaaggcatttagttggccgggcacggtggctcacacctgtaatcccagcactctgggaggctgaggcaggcggatcacctgaggtcaggaattcaagaccagcctgaccaacatggagaaaccccatctctactaaaaatacaaaattagcggggcatggtggtacctgcctgtaatcccagctaatcaggaggctgacacaggagaatcgcttgaacccgggaggcggaggttgcggtgagccgagatcatgccattgcactccagcctgggcagcaagagcgaaactccatctcaaaaaaaaaaaaagaaaaagaaaaagaaaaaagcattttagtggcccaggtggcaacatagttcagctcaacattcaacccaacactgatgatgtacagctgtgctctgcatagggcagacagcccagtaaaaggctcggtgcaacaaaagccaagagtcattgagtacttacaaattgcttagcacagtatttgacatataagtaccatctccctccattactaacaatcaccaccgcagaaagtaagtgctattactatccccatgttacatgaggaaactgaggctcataaaggttgggtaatttgttcagggctccacagctaactagaggtggacctgcaatttcaaaccctgatctgcctggtcggagtacttaattacatgatctcccaaaataggttagccttgcggggagtgatcagttaacttacataaagtccttcctctctccagtatcatgtgggaaagactacttgaaaggactgaaagccatatctagtttggaaggggttcccataagtaaacatcaagtaagatgcagcatgtcatatttttatccatttcacactcaagatgaagttcccaaggatcccttctgtagctgcttcaccgtatatacccttcctcattcagcccatcccaaaacaaattctgacaatgacacatgagctgcatgtagctgaccagcctaccagatcttttatgcagttcgacatacaaggtgacaccaaggtaagacaaatgaagttccagtttgggtgcctccatctccctcccctggatcctgatccagtgactgccaaaaccagaaagaactggggtagggtgcttgatcatggggaacgctgttgtggttcgtccggcagatgggaaaagggaaaggtttcacttcttcacaatttgaatgacatcctcatcctccaacgtatggtctttacccactttctgaggattgtgtttcacagagagaccccagaccagagcactgcatggaagggaaaaagaacagtcagtgtaaataataacctagcttctgccctatttgcctggatgccacccttctgctcagatttagtatcatacccttaagaaccatagacctacaaaagctttatcttccctagcagcatgagacactgaagccttaacataaaagccggtaaagacttctggaagttgtgtggttcctcttattgcagaaagtcaaagacaaaaaacatgtttagtataaagagcctagtttaaaattaaaagaaagcatggatttgttatagagaaatactctgggccgggcgcaggggctcatgcctgtaatcccaccactttgggaggccgaagggtgtggatcacctgagatcaggcgttcaagaaaagcctggccaacatggtgaaaccccgtctccactaaaaatacaaaaattagctgggcatggtggcgggtgcctgtaatcccaactactcgggaggctgaggcagaagaatggcttgaacccgggaggcggaggttgcagtgagccaagatcatgccgttgcactccaggttgggcaacgagcgaaactccgcctcaaaaaaaaaaaaaaaaatccgtctttaatcttcatagagaaataccctgaaaatttcagactgattcttacagatacaatatcacttatagactgttagagaatacctgtttttgctgggtttcctgaaaccatcagtgggtactgacaagaaattagggcctccctcttcagccatgccaggaaaatcttcctccctaaccagaaactgtaattgatatgtcctcccgatttactggaatatgtgaaggtaatttatatccatgggcctccaaacttaagaatatgttgtgctagagatgaaaactggtgaataagacaccgagacctgcctcacagagactaagaactatgtaccaagagtaaaaaaggtggccatattgttgttatattatcattgagtcaaaacctctttaaaaaatctatattccaggccgggcacggtggctcatgcctctaattccagcactttgggaggctgaggcgggcggatcacgaggtcaggagttcgagaccagcatggctaatatggtgaaaccctgtctctactaaaaatacaaaaattaggccaggcgtggtggctcacacctgtaattccagcatttgggaggcccaggcgggcggatcatgaggtcaagagatcgagaccatcctggccaacatggtgaaaccccatctctactaaaaatacaaaaaaattagctgggcgtggtagcgcgcacctatagtcccagctacttgggaggctgaggcaggagaatcgcttgaacctgggaggcggaggttgcagtgagccaagatcgcgccactgcactccagcctgggcgactgagtctctctcagtctcaaaaaaaaaaaaaacacacacacacacaaaaaacacaaagcacagagtaagggatcagtgtggtcaaggacatgaaggaaatggaaaagggataaatgttataattaattaggcctgaagatgaaagttttctattattaagagagttgtaccagtctgggcagcatggagaaaccctagctctagaaaaatagaaaaaattagccaggcatggtggtttgcacctgtagtcccagctatttaaaaggctaaggtgggaggatcgcttgagcccaggagttcaaggctgcagtgaaccacgattacgccactggactccagcctgggcggcaacagaacaagaccctatctcaaaaaaaccaaaaagatagttgtgcaataattaaagaaaaaaaaaaaaacagtaaaataagagcaaataaaatcctgtttgcttcgatatgtttcttatctgagacatttttctcccctttttaattccctggtaaatttaaagttctgaaggttttgaacaatgttttgccaccatagaaggaaagagctatatataaatctacaaagtttgaaaaaggacagtgtttaactttttacaaaagtcatctttaccagttaaagtaactgccaaagcataatgttttgactgtggtggaaattagcacttacatgtggaatatagttgttttatatgtaaggatctgaaggtcaataaaggacttcactctctcagtactcttaggatcagaaacaagttttttctttctttggttggttttttgaggaagggtctcagtccgctgcccaggctagagtacagggggcatgatcattatcttggctcgctgcaatgtcaacctcctgggctcaagcaatcctacctctgcctcctgagtagctgggaccacaggtgcctggtaccatgtctggctaatttttttatttttgataaaaacggggtctcactatattgcctagtctgatctcacactcctggactcaagcagtcctcctgccttggccacaaagtgctgagattacaggcgtgagctaccacacctagccctattttcttcttttgtttttaaccctttttcctattcagaaaaaaaagtgcggcgggcacagtggctcacgcctgtaatcccaacactttggggggccgaggtggacagatcacgaggtcaggagatcgagaccatcctggctaacatggtgaaaccccgtctctactaaaaatacaaaaaattagccaggcatggtggcaggcacctgtagttccagctactcgggaggctgaggcaggagaatggcatgaacccgggaggcggagcttgcagtgagccgagatcgcaccactgcactcagcctgggcaacagagcaagactccgtctcaaaaaaaaaaaaaaaaaagcgggggggggggaaggccgggtgcagtggctagtgtctgtaatcccagcactttggg

SEQ ID NO: 10900 - DNA, 15063 bp, Homo sapiens
aacgcgtggtggcggtacaagctaagagagtgaatgaaagctctgcagactcggtggactccgtttcatccagaagccaagtaaaaatacagaccacgtttacagctaaagctgagatagatgtgtccgggaaggcagtcgtcgccagacaagttgtaagaacgaatttaaaaatctctgcaaagacatccgagagggtcgacggtagatgtggtgattgggagctgaaaaggatttttcttccgtattcagacataatagacatgatgcaaactaaagtacagaacaagaaaaggcaagtggctttcttcattttattgatgctttggggagaggtgggttctgaatcgattcagtattccgtattggaggagacagaaagtggcacgtttgtggccaacttgacaaaggacctgggactgagggtgggggagctggcttcgcggggcgctcgggttgttttcaaagggaacagacaacatttgcagtttgatccacagacccatgatttactgctaaatgaaaaactggaccgggaggagctgtgtggctccactgagccgtgtgtgctacctttccaagtgttactggaaaaccccttgcagttttttcaggcttccttgcgagtcagagatataaatgaccacgccccggaattccctgccagagaaatgctcctgaaaatatcagaaattactatgccaggaaagatatttcctttgaaaatggcacacgatttagacaccggcagcaacggccttcagaggtacacaatcagctccaaccctcacttccacgttctcacccgcaatcgcagcgaaggcaggaagttcccggagctggtgctagacaaaccgttggaccgcgaggagcagccccaactcaggctaacgctgatcgcgctggatggcgggtctccgccccggtcagggacctccgagattcagatccaggttttggacatcaatgacaacgtccccgagtttgctcaggagctctatgaagcacaagtccctgagaacaaccccctcggctctctggttattaccgtctcagccagagatttagatgcaggatcgtttgggaaggtatcttacgccctgtttcaagtcgatgacgtcaaccaacccttcgaaataaacgcaatcacaggagaaattcggctgagaaaggctttggattttgaggaaattcagtcttatgacgtggatgttgaggctacagatggtggaggcctatcaggaaaatgctctttagtcgtcagggtcctggacgtgaatgacaatgcccctgaactcaccatgtcgttcttcatcagcctcatcccagaaaacttaccagagatcacagtggcagttttcagtgtttcagatgcagactctggacataaccaacaggttatttgttcaatagagaacaatctcccctttctactaagaccttccgtggagaatttctacaccctggtaacagaaggcgcgctggacagagagagcagagccgagtacaacatcactatcacggtcactgatttggggacaccaaggctgaaaacccagcagagcataactgtgcaggtctccgacgtcaatgacaacgcccccgccttcacccaaacctcctacaccctgttcgtccgcgagaacaacagccccgccctgcacatcggcagcgtcagcgccacagacagagactcaggcatcaacgcccaggtcacctactcgctgctgccgccccaggacccgcacctgcccctctcttccctggtctccatcaacgcggacaacggccacctgtttgccctcaggtcgctggactacgaggccctgcagtctttcgagttccgcgtgggcgccacagaccgcggctccccggcgttgagcagcgaggcgctggtgcgcttgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccggtctgttcggcgtgtgggcgcacaatggcgaggtgcgcaccgccaggctgctgagcgagcgagacgcagccaagcagaggctggtggtgcttgtcaaggacaatggcgagcctccgcgctcggccaccgccacgctgcacgtgctcctggtggacggcttctcccagccctacctgcctctccctgaggcggccccggcccaagcccaggccgactctctcaccgtctacctggtggtggcgttggcctcggtgtcgtcgctcttcctcttttcggtgctcctgttcgtggcggtgcggctgtgcaggaggagcagggcggcctcggtgggtcgctactcggtgcccgagggtccctttccagggcatctggtggatgtgagcggcaccgggaccctatcccagagctaccagtacaaggtgtgtctgacgggaggctcagaaacaaatgagttcaagttcctgaagccgattatgcccaacttccctcctcagggcactgagagagaaatggaagaaacccccacctctcggaatagcttcccgttcagttaagtgtgggattattttactaaatcttacttatgtttggagatctcttttaacttaaagttacatggtctgtttcttgtttattttacctctattctttaggttgaaattttatataaagtaagatactggtatcttagtatttcctgttcatgcttagtagtttattacttcacttgagggtacttgacaatatgaacaaaaagtaaatttttatttgcataattttaagcttttgaaattaaattatctattcttccccccccccaaaaaaaagtattgtaaatccttaagtaaaattgtatttctagctattggtaagagttgtttcactattgctatgtaggactgtttaaaatgtgagtatctgatattatttaatcctccaatgtctcattttgcagtaactcctacagtgtgtaacactaaaaataagaactaatgatggctaaacactaaagtagccattcatacttatgcatattttagtatcccataatagtcaatccaaaatttttgtgactatagactttactgaagtgtcaacacattagtttgtgagcctcatgtaagaacatgatggtctttttttaaaaaaaaagtcgtgccaattataagtgcttaataaatatttgctgaatgttactaacattctagtattgattttttaaaaaaactattgtatctacagcgaaatgctaatatcctctctacaataaaatatccttaccaatgagtgaaagtatgaaatatcacttcttagtcaaatcactgttgctttccttcaaaacagaaaacagctttgactcttctactcaccctacacaccgttacagaaaataaaatgcttaacagcatattttatctttttttctttgtctcacaatttgaaagttgaaagatttcaaattatatttgccaaactcctcctctcactttctcaagatgtttgatatctaccaagatctaagtaaggtattagtggcaggttattcggtaacatcagattttcccttctagtgttgtgtaagcatcatttgcttgtattaaccattacaccatttaccttcacagtttagcccatatctagtcttatttgtgtcagctgtatttgtgatatttcatttaaaaatccctctttcaactttctatcaaaggcaagcaatgtatattaaaataacaattcagtgactattttattttattttgagacggagttttgctcttgttgcccaggttggactgtaatggtgcgatcttcgctcactgcaacctccgcctccctggttcaagtgattctcctgcctcagcctccttagtaactaagattacaggcgcatgccaccaaacccagctaatttttgtatttttaggagagacagggtttcaccatcttgaccaggctggtctcgaattcctgacctcatgatccacccgcctcagcctcccaaagcgctgggattacaggtgtgagccaccacacctggctgactattttatttttatccttaattgaagtggaactgggctgaactaaattacatttgactgtgttttgtgtccagataagtgaactgactgtcatggatgattaccaactgattaaatgagtgtggggaacatttactattttgtgttctcagatatataccctattctccttagaacagcattcttccttggtgagattccttcttccattgttctcactccagtcacttggctttagttggagcagtagtgtttttcaatatccccatccccctaatcctagagaatgtacactggggtagtatactgtccaatgcagacaggtcaatacccttccccagacagtgtatttttgactttgtcaactttgttgtcttctttacatctgtagaaaagacattgcctagattctgagcttatattgattttttttttttttttttgagacagagtcttgctctgtcacccgggctgaaatgcagtggcacaatctcagctcactgcaacatccacctcccaggttcaagtgattcttctgcctcagcctcctgagtagctgggactacaggtgtgcaccaccacacccgattaatttttatatttttagtagaaacgaggtttcaccatattggccaggctggtctcaaactcttggcctccagtgatccacccacctcagcctcccaaagtgctgggattacaggcgtgagccaccacacctggcctatattgatttttaataagacaaaccaccattttctctaaatttcactgggcattgcacataataaatttatgaagcaaaaaaagtcctaaatggtggccaggtatggtagctcaagcctgtaatcccagcactttgggaggccgaggcaggcagatcacttgaggccaggagttcaagaccatcctggccaatatggtgaaatgtcatgtctactaaaactacaaaaattagcctggtgtggtagcacgcacctgtagtcctagcttctcaggaggctgagtcaggagaatcgcttgaacctgggaggtagaggttgcagtgggccaagattgaggccactgcactccagcctgggcaacagagtgagaccacgtctcaaaaaaaaaaacaaaaaattcccaatggttatgtagaccagagactaacaagaaacaatatttttattttctttcgggagttacaggcacattacaatatgagaatgaaactagattttgaaagttcatgatttcttccagtacaatagaacaaattagcatttttgtaatagaatgtaaattccccaagagcaagaatttttatgtttcatttactgtattatcccaggaagctacatgaatgtccctacaggtaaatacttgttaataaatgaatttgcctggagcagagttttgtgtactgaacctgcacctttataaggaagatgaatatagatacagacattacttttgctgtaacaaccattcttagctacctgaacaaggcctcataatagccgggggaaaagggagtatataacaggctatgacctaaaaggcctgctatatgttttagctattacagtatacagtgtgctttgaaatgaaaattatctgaagttgtaaagcagaacgcttggtggcgctgcaggctgagtgaaaaactgcagaatcagtgtctccttaaaagctgtgcgggttttctggcagctccaaaaggaaacactttttcactactggggataggtttcagagaggcagccatcccatgtcggtcaatgttaaaaagaactaactcaagatatttaaatcaagatagctgagttggctgtaaagcaattattttgtgattaaatactgcatcttttggaccctgaggaatgatggagacgccgctccccaaagcaccagagaaaaggcaagtgaccgccattattttcttattactactgtgggaggcgggcagcgctacgattaagtattcagttctagaagagagggacagcggctcttttgtggccaacttagcaaaagatctggggctgggtgtaggggaactggccgcgagaggcgcccggattctttccaaagggaacaaacagtatttgcagctcgaacggaagagtgggaatttgctcctaaaagaaaaattggaccgggaagagttgtgcggtgacatagatccatgtatactacatttccagatgttactgaaaaatccggtgcagtttattcaaggtgaactacagctccaagatgtaaatgaccatgccccagaattcttggaaaatgaaatcctcctgaaaatctccgaaggcagccatccagggacttcatttcctttgaaaatagctcaagatttggacgtaggtagcaacacagttcagaactactcaattagcaccaactcctatttccaccttttcactcgcaatcacagcgacggcaagaaatacccagagctcgtgctggatcaagcgctggacckcgaggagcagccccagctcaggttaaccctcacagcgctggatggtgggtcaccgcccagaactgggacttcccaggttctcatagtgattgtagatatcaatgacaacgtccctgaatttgctcagcggcgctacgaggtgcaggtcccagagaacacccctataggttcccttgtcatcaccgtctctgccagggatttagatgctgggacccacggggagctctcctattcattttttcaatactccaatcaaatcattcaggcctttgaaataaactcaatcacgggagaaattagatttaaaaaggcgttggattttgaggaaattcaatcttatcacatggaagttgaggcctcagacggtgggggtctttcaggaaaatgcaccgtagccatagaggtaatggatataaacgacaacgcaccggaacttactatgtccttacttatcagtgatatcctagaaaactccccagaaacagtggtcgctgttttcggaatttcggatccggactccgggaacaatggaaaaatgatgtgttccatccaagaccatctccctttccttctaaaacctaccttagaaaatttctacactttgttaacagaaggagcgctagacagagagagcagggccgagtacaacatcaccattactgtcacagacttggggacacccaggctgaaaaccgagtacaacataaccctgcgggtctccgacgtcaatgacaacgcccccgccttcacccaaacctcctacaccctgttcgtccgcgagaacaacagccccgccctgcacatcggcagtgtcvgcgchacagacagagactcaggcaccaacgctcaggtcacctactcgctgctgccgccccagaacccgcacctgcccctcgcctccctggtctccatcaacacagacaacggccacctgtttgccctcaggtcgctggactacgaggccctgcaggagttcgagttccgcgtgggcgcctcagaccgcggttctccggctttgagcagcgaggcgctggtgcgcgtgctggtgtgctggacgccaacgacaactcgcccttcgtgctgtacccgctgcagaacggctccgcgccctgcaccgagctggtgccccgggcggccgagccgggctacctggtgaccaaggtggtggcggtggacggtgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacytgcctctccctgaggcggccccggcccaggcccaggccgactcgctcaccgtctacctggtggtggcgttggcttcggtgtcttcgctcttcctcttctcggtgctcctgttcgtggcggtgcggctgtgcagaaggagcagggcggcctcggtgggtcgctactcggtgcccgagggcccctttccagggcatctggtggacgtgagtggcaccaggaccctgtcccagaattatcagtatgaagtttacctggcagaaagctctgagagccagttaaagtttcttaaaccggtacttcccaacttcttgggtgaagggactggtggggacagcgaggcaaactccaactctaggaatcattttgggttcaattaggaatctgacaacaggtcgtgataaatcatagaattcactattcatctgtaagttcccaattctctcattcgcgtagagtcacatattcacacattagtaatggctgtcatatttatagctatttcaacctgctggactattttccattccctttaatttttgttgtggtggttgtcagctatgttagttayagcatgtgcacacaatagcagagaaatggtgtttcctatggttgttgtttttgtttggtcagattttggaactcacaggtgttttcaggttcccagtatttgaacttgttcattgatatgttatgattaagagaatagtgtttcaaactttctggttatcatcagcatgactctaagtctatcgtaaatcacagcttttagcctaaaaaataattttcatttatgcaaaaattttagtaatcttgtaaattgttgcacttctgttgtgttgtttcaaaaacactactcttccctcaaatgaaccaatattttacctaggtgatgttttctctcctgaatttcttttttcaaaattgatatttatagaccatcggctgttattctaaaggattcaactcctgttacatgaaagaataatagaaaaaaggttggttgacttgtgattgctttttttttaataataaatggctttggtatgtaaataatgattctccttcttttaaaataatatatagcagtggctcacacctgtaatcctagcactttgggaggccaaggtgggcggatcacctgaggtcaggagttcgagaccagcctggccaacatgttgaaaccccatctctactaaaaaatacaaaaattagctgggcgtggtgacaagtgcctgtaatcccagttacttgggaggctgaggcaggagaatcccttgtgcctcggaggcggaggttgcagtgagctgagatcatgccactgcaatccagcctgggtgacagagagagactccatctcaaaaataaataaataaataaaaataaaatataatcatatgattcaaacatacagtaagtacaaaagagaaagcaaattaacatcattattccaccatcagaactaatttcattaagtcaacatcattctaaaatatttcaatgaatgtatataagaataaagtaatagatgaaaataattttataaaatggatctataataaattgatagcttctgataaaaatgattagattgaatacaataaaacgaagtgtgaaactatagaacttgcttaagctttgataagtagtccctataaaggttaaaaagcaagattagatgcatattaagacattagcattacttaactgcctgcttaaaaatgagcaaataaacattttatacccgttctcttctttcttaaacttacttatcctttttgtattaaatatatattaccttatcaatatttataacatttacaatgtattttgaaagaatacttgccataattgtttatgcatttcatattttttttagacggagtttcactcttgttgcccaggctggagtgcagtggcgtgatctcggctcattgcagcctccacctcccgggttcaagcgattctcctgcctcagcctcacaagtacctgggatgacaggcgtgcgccaccatgcctggctaatgctgtatttttagtagagatggggtttcaccatgttggtcaggctggtctcgaactcctgacctcaggtgatccacctgcctcgggctcccaaagtgctgggattacaggtgtgagccactgcacctggccagcatttcatattttttaaattttaatttaaaagtttaatgctagttttccaattttattcaagtctgactgcccagggtaaccacttttgatgctcttatgtgttttcccatatttacttccctatttttaaaaatcacatatgcttataaagtgctttttctcaaatcccagttttagatatccagtttttaaggggtacacacacagacgcacacacaactcggacatttcctctacctagcaatatcaaaattctgtttagataatgtttatataattgtcaccataaaaatgttacttacacctaagcctgaagagtaaaaacaaaaagcctctttttttacctttaaggtcataattgccttctttttcaactacttttctatgtacatcttttaaaattacccacaaattttgtaaagcctgaagctcctaacttaggttaaactcataaagaaatttatcggttccattcttttctcctggagccatcctggagctattcagagtcttgttccattgtacattgtttgctctctagacctactgcacagctggcagtttgcttttcccactaacttgggagtttatcttcctcttccatttgatttcctcttctggattttacatcttcctcttgtttggttttctcccttaactgtcagaagaatatttggtaataaatcttttgatcatatgaatataaaaatttcagatgtcagaaacgcaaatgtctatttgaagattttgttgggtgtggaattataggttaggaattatttgctgctagtattttgaagacattcctctgttgtcttctaatcaccaaagttgagatattacccattcttttctgagaaactttgttttccttctagatccctgattctcaaccaatggcaattttgccacctttggtaaatgtctggcaattatcaaacatttggcaatgtctggaaacatttttgatggtcacagctgccaacagtgctgaggctgagaaaccttaatccagataaattgaggttcttgtatgtacctccagtgttctagaatttcgtcactgtgtcatactataagaattttggtcatttattgcactagttactcaatgagacttgacaatcttgagacatgttcttcagactagaacaggattgttagggttttttttaattaaaaaattatttcccctactaaatggtttttggttttttattctgcaatttctgttaattgtatactgacctggtttgatatttaatttttcttattcttgttctatcttctgtctttattttcctggattccagtaaatttcctctatggctaaattttaagcttttgctatcatagttttactttcagaaagctttttcttggtctctgcatatttctttctatagtagccttgcagttttaaaattctttggtgagctataattcacataccataatattcacttttttaaaaattgagtttggtggtttttagtatattccaagggctgtacaattattaccactatctaattctagaacatttttcacattttcatcagcacaaagaagaaacctggtacccttaagcagtcactccccattccctcctccttccagcccctggaaaccactaatcaactttatgtttctttggatttgcctgttctagacatttcgtgtaaattgaatcatagaatatgtctggcttcttacacttaacataatgttttcaaggttcattcatgttacagcatgcatcagcacttcattcttttctatggctaaataatatcccattgtatgaatgtaccacattttgtttgttcatcaattggtgggcattcgggtttgtttccactatttgctattatgaataatgctgctaggaacattcatgtatgagtttttgtgtgaacatgttttcatttctcttgggtgtatacctaggaatggaattactgggtcacatactgactctatataactttttgaggaactgtcaaactgttttccaaagtgactataccattttacattcctctcaacagtgtatgagggttccaatttgtctacatcctcaccaacacttattttttgttattatagccatcttagaaggtgtgaagtagtatcctattatggtttgaattgcatttcccaaatgactaatcatgttatatttcttttcatatgcttattgttcatttgagtatcttctttaaagaaatgtatactcaaattctttgccagttatctaattttttaatattttaattgttgaatgttagtagttctttatatgttctggatactagactcttatcagatacatgatttacaaatactttctgccattctgtgagttgtgttttcactttattggtagtgtcctctgaagtaaaaaagattttttaaaattttgatgaagcccaattatgtatcgttttcttttttttgagacagaatctcgctctgtcgcccagactggagtgcagtggtgcaatctcagctcactgcaacctctgcctcttgggttcaagtgattctcctgcctcagcctcccaagtagctgggattacaggcgcctgccaccacgcctggctgattttttgtatttttagtagagatgaggtttcaccatgttggccaggctggtctcaaactcctgacctcaggtgatccacccgtctcagccttccaaagtgctgggattacaggcgtgagccaccgtgcccggtgtattttttccttttataaaataaggcacttaaaagctgataaacattgtatgtttgggtgggactagttgagtggtggacctcaccttagggtaatgaaacaggaaacatttggagacaaaaggtcaatatctgtaagtcttctctcttgggctcacattgttcttcagagagaaattcagtaaggatgggtaggatggaagttattataaacttgacacctagcactttgtaagctccttggtttgagagaaagtgtcttaattttttttaacccactttctcactaagatctcagtcctgccctaagttgtgctcatgtccttcagtccagagcccttcctattaaaccactatggatattacacctcctattttctgccatgatgagaaaagggaaagtgccttgcttcgctgagtaggaaaggaattctcagatataagtactccttatatagatcttcagccaatgttatttttagcctctccctgggtcctcagtctggattattactatggctacatttgattttcttattaattttcctccttttcatttgagagcaacaagaaaaaagaaaaaaaaagaaaactgtcagttaccaattgtctgtgtgctttgcatcttccaaaatttttgtgacttctctcccctgcgatttattcttctccattatttttgtctttatagctttgtttattttaaacccttgccctctatcatttacataaagtttcaggaaaaaattgagaaaaactagtgtgctcaaactagagtaaaatacagtccttactgtcagtcatattgtgctagttttcctgtacctgaatcatttatgttgttttatctcgatttgcttgatttcatcagatgtcagtctttagataagagttcataggtgctgtattttttcacatgcttgagaaatacaatttagctgggtataaaatttttcaatggactttcttttcatcaaagatttgttgacattaaatataacattagttcttctatcatagtttctacagtcatctataagtcacttgatttttatccttaagtagtatttttttcaaaaagaattcatcagtactagcacaagggttaatgaattctttcctgtttgctgcattgttgtctttgtacttgagcaacagcttggctatgtgtaaaataattgagccataatttatttccctcagaatcttgtagacatttccattctgttttggtattaaatgttgctcagggaaatactgaagcctgtttgcttcacctgtaggtaacttgttttctatccttgaaattcattatctttatcagattatgtcttgattatggtaattacacattacttttccctggaactcagcgtgccttttcaatctgttcatgcagatattttcaagtatatcatttatttatttatatatggtaagtatattttgttttaaaatctgccttatagttctaatatctgaagtttgtgtgggcctatgcctactctattttgtttctgctccttctcattcatgatgtctttgtttctttgtaggatgtgcatggttgattgcccttgaaaatttatttgtagggtatctacaaagcctaggttgcacatgttccaactatcaaaatggattttcatttgtttcagccaggatattggaaacactatcaatagtggactatcacaaattaattaaatggcttgaggttccttgcatctcaacctatgtatattcaaaatacaaatacacaagagggccacgtgcagtggtgtgggcctgtagtcccagctactcaggaggttgaggtgggaagatcacttgagctcaggagttctatacccacctaggcagtagggtaagaccccatctcaatacacacacacaaacacacacacacacacacacacaatatgtaggtacaacttcccaggcatgtttttttttctttttcttcttctctgcttaaaatcagggagacttctatataattccctggagttagaggctgagggcaggtttagatttgctggtgtttacactgtatttacattatggatgtatccctgagtggtcccttaatatgaagaggatctttctataatatgctgcaactgtggttacacctgagccttgat

SEQ ID NO: 10901 - DNA, 17797 bp, Homo sapiens
agcagcacccagaacctcgtagtagcgctgcaagaagggctggaggcgactctccagccgctgtagctcctggagcacctcgacatactccgcaggggaaggatggctgtggacaaacccaaggggcaatgagccaaagccttcctcagattcccaccctcacagtcaacagggaccacatgtgccctctttctccctggtctcccagagccctggcccaatccttctctggaccagcagagcttctattctcttcaacctccgcctcccaggttcaaacgattctcctgcctctgcctcccaagtagctgggattaagttgcctgccaccacacccggctaatttttgttttttttttttttttttttttttgagacagagtctcgctctatcacccaggctggagtgcagtggtgcgacctcagctcactgcaagctccgtctcctgggttcacaccattctcctgactcagcctcccgagtagctgggactacaggtgcccgccaccatgcccagctaattttttgtatttttagtagagacggggtttcatcatgttagccaggatagtctcgatctcttgacctcatgatccacccgcctcggcctcccaaagtgctgggattacaggcgtgagccactgtgcccggcctgtattttttagtagagacagggtttcaccatgttggccaggctggtctcgaactcctgacctcaggtgatctgcccgcctctgcctcccaaagtgctgagattacaggcatgagccactgcacccagccaaagcttctattctttactcccacccatgagaggatagggagaagaaaatgaactgctcccaccctccccaccacaatcctgcacctacaatggtgaaagactaattctaagaaagagagcaggccttcgtgaactcagaggagaattccgatcaggctcaggagataccatttggatttccttgccatagggagagcagcagttcttctcagctgcctgtcctagcgtcatttacctataccgagagagcccctcctcgcccctcaatgctaacccttcaactaagacctccaagtaatcctttccctcccttgccatggttcatttccttctccccatacttcacttaggattccccacccactaaagattccctccatctctcacttgggtgcatttgtttccggggcaggtgttgggcccgctggggctgggccaggagtgagctccgggttctgggctggggcacgctcctccacttcttctgcctccatgggctcccggggaggtgcttcactttcaactggttctgatgtttgagagctcaaggctactggctccggggtcacagccggtggctgcgggggcggctgactgtgctgcggttggggccctcctcgacactgaaggtaggggagagtcaggataccaaaggcagggtaagactgctgcagaggattactctacaggagactgaacagagaaagtatcctaactagactccctgaaggcatggctctgcaattttatctccgactcgctagcaactagcataagactgacacaaattagatgcataataagcatctgtaatttttttttttttttttgagacagagtctcgctctgttgcccaggctggagtgcagtggcatgatctcagctcactgtaacctccgcctcccaggttcaagaaattctcttgcctcagccttctaagtagccaggcctacaggcgcgtgccaccacacccaactaatttttgtacttgtagtagagacagggtttcaccatgttggccaggctggattggaactcctgaccacacgttatccccctgccatggcgacccaaagtgctgggattacaggcaggagccaccacacccggccacagcatctgtaatatttgtaaataaatttctaacaaagagtagagattgtggtttcctttcctccacaagttggtttcccagcctccacaagttaagagagtagaatcctttaattgaaaagagatgccatgagactaagtctgaaacaaactccccagataccaggcaccaagaggattggcagaaatgagagagcctcacaaagatactttttctgcccaaaagaatgaatactgcagagaagactagattatgaaggccaaaccctgtggatgtggccagtgaagccctaactcccaggctgagagaaaagggagagggagggtggagagagaccctagccagccttgcccacttacctccatccgggatagtaaggtctgtatatccctgatcatgtgctgagccatcaccagccgtacccggggctcactctacaatgagagaaggtttatcagggtaggttacagatgaagccatgagttctaccacctactaaatcaggtcccagccatctctcagccaggtccaccccacctcccagcctccttctcccagatccccttccctgaccctcggaggcccctcaatacctgaatcggggcctgttccatgttgatgtgaacatccacagcagagccgtcactctggggaaagggtaagggaagttgttctgggagaagccaacactaaggcctccacacctccaattcattccctggagccctacctccttttctccttaaagactgagaccaatagcacaccacagggccccctgaacccaatctaaagatggaagcatctatcttattaattccctggtgctaccacaaccaaagctacccacaaaagccctcccctgtggaacataagcttacaggaagattgaaggttccaaccatgacatagctgttggcattccggtcatgaacagaggccccaggcccccgagtaccagggggggatcccccaccatgagtggctgaggcagaccccgtcccagaagatgccccagaagggaggtgagtctgaggaggagcccgttccaccaggtggataacctttcccccaacatctgcagaaaaatagacacacaccaaaacatagtatgaacaggtaaacccatggcctcagttcatccctccagacagtagccccaacctctgaactgcctccccagcccccttactgtattcctgaagcttcttatcatcttgcagaactcgtccctggtaaatgagccgttgtttttcagatgggatgctgacagaggcagcaatgtgctccttaaactcttttacattcatctgaaaagaagaggcatgcacaggaatggaaagaatggaggaaagaggaagaacaaagacagacaaccgagttgtggaggtgaggggtaaaaaccaccacagaatcactacccgtttgtcttgaccgtgagatcattactgtgcaaacccttaaactaaagtaacagctgtcaaaatacagacaataaatttggcttggcgcggtggctcacacctgtaatcccagcactttgggaggccaaggcaggcagatcacattaggtcaggagttcgagaccagcctggccaacatggtaaaaccccttttttaccaaaaatacaaaaaaataagccaggcatggtggtcgcctgtaatcccagctactagggaggctgaagcaagagaatcacttgaattcgggaggcggaggttgcagtgagccgagatcgcatcactacactctagcctgggtgacagagagggactccatctcaaaaaattaaataaataaacttaatgaagctcaggttatagatccaggaaaaataacacggatgaaaaacaaaaaaaaaacacatggacattatattatctgtctggcatccaagggagtatgtgtctagagacatcagtgacccctttccaaacacaagatgataccagtttatttaccagactctcctgtgatttccaagattaaaaaatggcaaagaagatggggtctggtatcaggttaatgaagaaagactaagaagataagaaagcaaaaaaggtcccagcacagtggctcacacctgtaatcccagcactttgggaggccgaggcaggtggatcacctgaggtcaggagttcaagaccagcctggccaacacggtaaaaccctgtctctactaaaaatacaaaaattagccgggcgtggtagtaggcgtcgtctgtaatcccagatactcaggaggctgaggcaggaaaattgcttgaacccaggaggcagaggttgcagtgagctgagattgcgccccagccctccatcctgggcaacaagagcaaaactccatctcaaaaaaaaaaaaaaaagcaaaaagagaaatatttttcctaactacaaactgactcttgggaagtaccagagtatttatatacatctaatcacaagtctatatatggctttcttatatccaggtaatatcacattttagaaaaccatggaccaccccacatgcaatttgtctccaagtattacaggagtaaagacacagatagctatgtccaaggctttaagctcaagagactcaagctatgccataaaaattagtaatttcactcaacagtctatcaaggacctatctccattatgggttctgatttctaccctttaaaaacacagcatagacctgaccaatgtctatcagtaagacacacttgcttagggttcctgtgctgtttcccttcccaaaggccagagccatgcctgtccctttgggttggggtccacccatgatgatgacacacagattcttccttcctctgtatttccctctgcattaagttctatccatgtggaggacagaacaaaatcagcctcactcacaaaacatcagaaaacgttctactggaatacgaacaaagggatcaataaaaagaaaatctgaggccaggtgcggtggctcatgcctgtaataccagcactttgggaggccgaggagggcacatcacctgaggtaaggagttcgagaccagcctgaccaacatggtgaaaccccgtctctactaaaaatacaaaaatcagctgggtatagtggcacacgcctataatcccagctactcaggaggctgagataggaaaatcgcttgaacccaagaggtggaagtttcagtgagtcgagatcgcgccactgcactccagcctggaagacagggcgtgactccatctcaaaaaaaagaaaaaaaaagaaaatctggtgaccagaaaatcaagctcatctctcaggctaaggggcctaaacgaggaaaagctaaaggtgtcttccagaactagtgaggtgtctcacctgggcccccacaataaaggtacgagtttgagagtccaaggtcttcaccaacacctccaagctgtcaggctcctccacagcggtactggtactatcattaggctccatggccgacaggtctctaaagaagaacgaaggaaggaaggcccgctgttgcccagaccagagtgtacccgaaagactccctagcattaatccctgccccaatacctaaaaagtttctcctgcacacacacacattcacacctgtccccatcccccttctgattccggggcacagggagagaaacacaaagggcaggagatcgacggcttagggagctggaggacgagaggtgggaggggctccacgacgccaatcacaataagcagggagccagtcagattaggaaggaagcacgagaccagagactagtgtcatcaccggtcacggcaggacaagcgccccagaggtcggaaaatcctgggacaacgcgaaagcggtggtcgccccacactctgcggagaaagtggtttcgcgcacgcgcgccacgcccatcgaaccctcctaactcactatagacccgaaacggcactcacggggcgacagacctgctagctgactgcccgcgtctactgccttcccacggtgttccagcagaacggcacaactaacccacagccaaacacacacacacacacacacacacacacacacacacacacacccaccaccccgcggctccgcccccgacttccccacggaccgtcacttccggtctcccccaaacctgccaccgacggccacttccgtttccccgatagtatttggggatctcgaagcgatacttccggctccccccaggtccccaagctttacttttgtggggcacgacgagaaagtccgcagccccaaacagtgagtttctgagggcgagtcgggccggggccggcctakgtgggagggagccgagcaccccgaggagccgccaccgctgtcgcccgggggaccgtactacgcctgcgtgcgtcgcactacggatgcgtggacacttaagcatcgccccaccccctcccccctctggcggcgttcacgtctgtgcgcgcgcttgagcgctagaagattgaggtggctaccgtaaatgcctgaaaaacagtcaccagctgggactctaccactgcctcgagaggggctatggacggtcgtatggaccttggactttggagatgggggattatgccacattcatctatgtttaaatcttggcaggctgataatttcaggcggcactgtcctagccagctaaaactcttctccaccctattgccctcgctgcgccctttcttctgtgcctccggaagttactctttcagtaggcgtttgggggcggcactggtcaattttgttctcggttgcttggttgggctagatttcggttctgccgggtgggcgttttaagggctgtgggcgtcacattcgtcggtgtgtggccaaggggacatgacacgttttaggaaaagtaaacgtgctactaagttgcacgacttgtcaagaaaagaggcgcttccgagtttgagaattgggagcaaatggagtccgagtggacagaaagacaagaccctgaccgtggggaatttaaaggccggccagcgtgcttccgaaggccgggggtggaggcattaccgcctctccgtgccctcttctcttaacctgccctgggccaagggcctcggccccgcgaaactgcgagtcctccagaaagacacatcgctgttggggtgtccaacctttctgggattcgtagtttatacccaggtcctggttatattttagttaagagttctaataagcagctgtttaatgagcacttgtgccagcccatatactacgggttttgtgtattattttaaaaagccttttaacgagcttttaacattttttaagtgagtacacttagacgaacataagtgtcagaattgacaaatccaggcctacaggactccagatcgagcacttgtactttactgccccaataaaaagctgttaacattttagcttatttttttgagagagggtctcgctttgtcgcccaggctggagtgcagtggcgcaatcacaactcactgtagcctctgcctcccgagcccaaccgatcttcccacctcagcctccctagtagggaccacagatgcacaccaccacacctggctaattttatttttatagagatggggtcttgctatgttgcccagcctggtcttgcagacttggcctcccaaagtgctgggattataggtgtgagctactgtgcctaaccacattttagctttttattacaaaaattttcggccgggcgcagtgactcacacttgggaggatgaggcgggtggatcacgaggtcaggagttcaagaccagcctggccaaaatggtgaaaccccatctctactaaaaatacaaaaattagcctggcgtggtggcgggcgcctgtaatcccagctacttgggaggctgaggcagagaattgctttgaacccgggaggtggagattgcagtgagccaagatcgcgccactgcactccagcttgggcaacagaacgagactcccatctcaaaaaaaaaaaaaaaaaaatkcaaacattacaccaaaatagaacagtattaataaactctaatatactggtcacccaaattttgtttgttttttaactaaatcgcaagcctcagccctcggcaaattttttgtggcagtccatgggatataaatttatcaagctaggtgtggtggctcatgcctgtaatcccaacactttaggaggctaaggtgggccgactgcttgagctcaggagtttaataccagcctggggcaacatggtgaaactccgtgtctacaaaaaattagctaggcgtgatggcgtgcacctatacctcctactcgggaatcatctgagccggggaagtcaaagtcatgcctgggcgacagagtgagaccctgtcttaaaaataaataagtaaataaataatctatcgaggaagatccatctctcacagcattaactgctccagtcacttggtgctatccaaggacaacctatttggcaattcttactgcctattatttgagaacttattacccaccagaaactaagtgctttgcaaacattactattaattatagcaaatatatactttggamttaccatgtgcaagtctttgctaagggctttatgtgcattatttcatttaatcctataagattgatgatttgccaattttacagatgaaaaaacagacatagcagttaggggttggtggtgttttgtttgtttggagacagagtctctgtcgcccaagctggagtgcagtggcacaatcagggctcattgcagcctcgacatcccaggctcaagcaatcctccctcctcagcctccctagtagctgggactacaggcgtgtgccaccacatcggctaatttttgtaytttttgtagagacagagttttgccatgtagcccaggctggttttgaactcctgggctcaagccatccgcccaccttggcctctcaaagtgctgagattacaggcatgagctacctgccctgcctgtagttagggtttggacacattctgcctgacaccaacatctatcctctctaacagccagattacatagcctctttgtagtaataaatgttgagtgaatgtgtcagtgaacactgccagggtatacatatttttctaattgtaaactaaagagagcaatccaccgtgccccagcacctgcatcatacctgttctaaagcatttaccaagttgtattgcaatggtttgtctacacagctagttttccctctaacgacttcttcaagatcaggggctatgtcttattcgtttttttatgtccccggggattagctagttcttgggaaacaactgggacttgggattcaaaacagtttgctaagtgaatgaatgagaggcccagtcaagctacttcccttcagtgctgcacagtgcaacaaataaccagctcagatacaggttcaaagaccacaggcttctccctggacagctcagctctcctcataactcctgagaaaccctggacatgccagggtgtactatggagtggttgcatccggaagagggggaggaagtcccaaacactaagtaatccaggtttgggttggaaaacaaggttgaagttactcattagcaggtgaaagggtcaagggtcgaacgcaagggagctgaaagcagagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggaggtatggactgagattrggggaagcctatggtggaggctctgagggacttgggtggatggcctaggatgactggagaccatcttgggaaaggaagagaggaagggggtgtgagtgttgtgataatgaaagcaagaagaaaaatatcagtactgtggccatcaatgcagaggcatggcagaattggggggtggggtggttacccaggttgactggggaggggcaaagaggaaaagtcatttaatgactctttgtcatggatccaatccccagttggaaagaggaaggcagccaacacctctacccctaaatcttgctgttttgactgatgaagaggttgaacccatcctgtgctggaacccaccctcttttgctcccttcattgtctctccagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgtgagtggtaaggaggcagaagcatcactgggttcagtctctgcccaaagtgtgagaatccacccaccaagagctggcctcttagctggtatatctactatgcttggcccacggaattcagtggctgtattaattgccctctggagaaagatgtgcctaaccaatgcttggtagcttgaaacccaaggagagctgggcttcaataacaaatacaatggagtaaatagaagccgggacaggccagacgtggtggctcacgcctgtaatcccagcactttgggaggctgaggcggacagatcacgaggtcaggagatcgagaccatcctggctaacacagtgaaaccccgtctctactaaaaatataaaaaactagctgggcatggtggtgggcacctgtagtcccagctactcacgaggttgaggcaggagaatggcgtgaacccgggaggcagagcttgcrgtgagccgagatggcgccactgcactccagcctgggcaacagagtgagactctgtctcaaaaaaaaaaaaaagaagctgggacactatggttggggtgatgctcattctttcctccttgccaccaccacctctgcaggaaagaygggctctgtgtgccccggaaatggatctaccacctgactgaagggagcacagatctcagaactgaaggttggttcttcccagccctcaccctcccttgagtttggttctgcatctctgttctcatacttctcccacctgccttgacaggccgccctgacatgaagactgagctcttttccagctcatgcccaggtggaatcatgctgaatgagacaggccagggttaccagcgctttctcctctacagtgagtagggatacaaggcaggaagggttggagggaaacaagggagggcaggagaactmctcactctgggtcctatgacaccctcccaggaagagctaggtgcttccaggggttttgactggcctgaccccaccttgcccttccagatcgctcaccacatcctcccgaaaagtgtgtggaggaattcaagtccctgacttcctgcctggactccaaagccttcttattgactcctaggaatcaaggtaaggkgttaaaatctcataaaacaggattaggactcacmaagtcttctggtgttacagggtgaaagaggctcgtgtgatgtcaccagagggatgtggctaagagctgtgatgtcacctgagggaggcaggatgggttctgggctactcaaaagagaggtttctgagtttgcactggataaagggggcagagggtcatacgtggagggaaaagagccttagagactcccctttgacacagggaatgaaagaacacgttctcccccaccccattactatcaactttgcttttctccctggacttcccttctgtccttctttttccctccccccatcacagaggcctgtgagctgtccaataactgacctgtaacttcatctaagtccccagatgggtacaatgggagctgagttgttggagggagaagctggagacttccagctccagctcccactcaagataataaagataatttttcaatcctcatctcattctggggtttgtctccagacgtcattcccactcctcccatttcaacattccccctggatcctctaccacctaaactcccagctggacggtgtcagtaagaacagagtggcagtaactctcactttgtagtggtatatttaggatttgatgtgacacagttatttattgctgagtgagcaaacccctagcccccaagtggggactacaggcttcagtgcttcccccacactgcctgagctaccagcccttctgcactggccctcctgccaatactgcctgcactgtccccactccctctggctcccatgatcaccagatccgccctgcaggctccctgtcacctgtggggccctatccagaccccctaatccacttgcctagcagccccactcttccctcgatggctcagatcctgagatccaaggaacaccctgggtttcccaaccactctcttactgcagaggtctgtctatcctgccctggtctcctccaccccaggagagttttcaaaggtagagaggaccctttggtctttattcaccaccatcatacttttttttttttttgcttttaaaaagtggaggtggaaaaaaaaaaaaaactgaaggtgggagaaaagtaaaagcaaaaataacagctggtgaatccaagagcagtgccctcactgtccataaacacaaacaccctaaatagttctgttctctcctgtgtatgaaggggggccctgcaccctcgtactcgggtttcttccccatccctgaggtccctatgcttacaatttgggtcatgcctcacacttttctcctaaagcccacactctcttcaccctttgcccccaccccacggtcacagcccctttcccgggtctcccctctgctcctcaccttccctctccaacccctcactctcccagtcagtggccgcctcatccccattgggctcccggaggctgacagccagcaccaaggcctgcaggagaccaaagaggcaggcgaagtgcaaagggtgggcagtaagtaggctcagaacagcatggagcccatgcagggcagccaggaaggacagtaggccatgtagccagaggcccagcggtccacgcaggcccagtgtgtccaaggctgcccgcagtggtcgtgagcacagggccagcagggcagaggccagcagctccagaagatgcagggtcaggttggtggagatctgcagacactcttctgggccccccaagtaccgggagggagctcctggttccccccgcagccagcccaacagcttctcacgcctaccaggtttctccaatggggctcctggcccagggacgctcagtcccccttcaggggacacccctggtctcctggtgccacctgaatccacatgatcccatctgagtttgggactggcccctccagcctccagtctcccagactcttgagtgctagagataggctggtcccacttgagggaatccattcttttgctccctagctgctcaacttggggctcctccttgcttggttcggaagcagccctagaaaccctcaatgcccccgagtccttagtcttgggatgccccacatcttccatggtttctggggcactatcccagtcacttcctgaattctccgaggagctgtccacccgtctgggttctgggtaaggcgggtcaggcctcattggtttccggcggccccaagggcgaggtagccagccaccaagccgtcgcaggaacatggctggggtgtgtaatgggcccccaaattctgaggctgcttcctggcactactcagactctcaggatctcctcagaagccagagtctttctggctcagaacaggtatttgcctggtgatgcagtcctactctgaattcagaagtggctcctcccttctctgaatagtcatgcagcctcaagtgtggcaagtagtttgcttcctcttcagttctggggtaaaggggggcatacccaaattcattcaccatccacacccccacaatctgagattccaagaatctcagatctgacaaggcctgggtcaccaccagagagtcctctctgcgtttccggatttccttcccagcaggcagcaccccaagtttcactcaccaaggccacaccccaaggtgtcccagaaactggggaggcagtgctccatccaataaagcgggcaggaaggtggccccaggtcctaggtgctcctggatcgtgtagtctttaactgctgccccaagggacctcaaggaataggaattctctttgttaggaggtggaatgaaagtgtccagcaaactccagccagcagcgttcgtcccttgatttagagggctatgatttctacaaagtggcccgactggcccgcgaacacgcagcagagacgcggcctccacaaggtcagaactaagatgtcctcagagatccccagttacgaagcaaagcgcgggcctacttcgggacctacgcgtccgggcgctgtgcgcggggaccgctcccgggcccagcgtcggggccgcggccttggggagccgccgggagccgcgaagcccggaagcagctgcaccaggactggaaggacccgcgggggcggtgccgcagctcatggggcggaccctgcgaatagaccgcccccgtataccccgcgctgtctgtgcgcgccggaccgccaaaccgagattagcaaggaccaggaccttaatataaacccagctccccattttcccgggtttctcatgcttccctaaactcggtcgccccctacagccccctgcccctgggttcttttccacatcccccaccactcctccatttcgcatccaagacttcatgaaaggctttcccagaaaagaaaaaatgaggagtcttgcgacttgaacagccctcccctgcccgtctgcaaatttgaattcctggatttcacaacagtgagctcttcttgtgcctaccacccggcatgagcaagacaagggggtgggtggtgggagagtggggaagtgtgggaaagaaaagtgtagacaaatgggtggaacaaagaagtttaaagtttagatttgggggctagagttctggtcccagttcaactaagtgtacaagcttgataatcgtgggccttcctatcacactggcctcttccagcaaaaccctacccattctcatctctagaggccttgacttcccttatcaccctgcattataatatttgataacatgggccgggagtggtggctcatgcctgcaaccccagcactttgggaagccgaggccggcggatcacctgaggtcgggagttcaagaccagcttggccaacatggagaaaccccgtctctactaaaaatacaaaattagctgggcgtggtggggcatgcctgtaatcccagctactggggaggctgaggcaggagaatcccttgaactcggggggcagaggttgtggtgagccgagatcatgccattgcactccagcctgggcaatgagagcgaaactgcatctcaaaaaaaaaagaaaaaaattgataacatggcactttccctctccagctgtgaactctttgagggttgggaatgtctttacctgtattcttggcacatagtatatggacttatgtttgtgaaatcagtgaattggctgtagtcagggaactcctcctgggggaagtgagacttgcacgaagctgggcaattcttggtccaggggggttgaaagaataggtgggggactcccaggagggtctgggacctgaaagtgaacccagattggcagggaggtgaccttatcatgccacctggagaggctgccccttctgactcaggtgggacttgcatgtggctcccaggcttctgtttggcttcctcaaaatagcttccagaaaagtgaataaaccacaaatggttgatttatttctgactctcagcccgtctctcacgaagacagagcctattgaccaaaaacttcaggatctgcatctgagcagatcccaggaaggggaagtcaaagggcccaggtcagaggcccaagttcagacttcagcagcagactagggtcagactttaccaaagtcagaactcgaggttcatgtaagtccttagatcccgctcccaagccctgtctttctcctccctccttctctcctccctccagctcagtgtggccacccgagggggtctctccctcccagccacagctcgggtatcccaagctgggaaatgtgtcactcggggctggggtgctgatctgtagcctagtccttcctggtccctcttgaggacagtggggatgggattggcacggccctcaccccggggtcccagccccattcctggctcccagccccccctcagcagcagtttgaagcccgggctggagatgggcaccccaagtggaaggttgggaggctgaggaccctgcgacagtgacagcaggtgagcagtggatgtgcggtggttggaatcttggaagtgggtgtcacagttctcgcagtactggagggagggagtaggagacctgcagagaaagaagaaaaagcattaagggcaggggaaggaaaaggggaagagttgaggcctcagagggggctggcagggtagaataggatcttttcagcttttctgctaaggaacaaattgccagctaggcatagtggctcacgcctgtaatcccaacactttgggaggcagaggcgggcagatggctttgagctcaggagtttgagaccagcctgggcaaaatggcaacgcctgctttttttttttttttttttgagatggagtcttgctctgctgcccaggttggagtgcagtgccatgatcctggctcactgcaacttccaccttagcgattctcctgcctcagcctcccaagtagccgggattacaggcacatgccaccatgtcccggcaaagcctgctttctacaaaaaatatgcttgagcccaggaagcggaggttgcagtgagctgaaatcacaccattgcacaccagcctgggcgacagagtgagatgagtgagactttgtctcaaaaaaaaaaaaaaaaaaaaaagggacaaattgccttccttcctacttaacagtgagggatccaggctggtccaaaggtggtggtgagttatctgaattaattgttcactcagttacagatcaaactccttactccacttttcccctccttctcactactgcacttgacttgtcttaaaaacaaatttctttaaaccattgtgggatccagagcagaatagttgaaagaaaaaaatggtaaccagacctagcaaactcttgggcaaggggagggacattagtcataatgactatagctaacattcatgtattgcatactatgcggcatgcactattctagcattttacatatattaacccattgaatcctaacaacaattcttactacccccatttctaagatgagaaaactggaacatgtagacattaggttgtttgcccaagtaagtggaatcaggctttaaatccagggagctcatgtttataaccacttgactatactaccctgtcaacctacacatgaggataaggaaagaactcttcagcactgtgctggggcgtctggtgtggtgtggctgggagaggcagaacacaatgagacatgggtctgagctaaagtttccccttaccggttttccgggctccttgtctctccatggctctccctgaccatgcgggctacctcagggaagccagcttcttcagcgagctgagccgcatccctgccactcagctcacagacccccacccaggcagccccacggcccaggagatagctcacagctgccccctggcccgctcgagcagcacacatcagtggggtccaccagaaggcatcccgggcgttgatattccccccagctcctcctgcctcatgcggttccagcagtctcctaagttctggcaggtccccctcctgggctgccctcagtatccggtgagtcatcttatcctcagcctcaagggatctcccttgtccatgtcttcctg

SEQ ID NO: 10902 - DNA, 30449 bp, Homo sapiens
agagtctcggccgtgttgcccaggctggtcttgaactcctggactcaagtgatcctcccacctcagcctctcaaagtgcagtgactacaggtgtgagccaatatgtgtgtggctttaaagtgacttttctgttgggatgagaaagaagatctttctccttttttttccttgagacagggtctcactctgttgccctggctggagtgcggtggcgcgatcttggctcactgcaacctctgcctcctgggttcaagtgattcttccacctcagcctcccgaatagctgggattaccggtgcatgccaccactcccagctaattttttgtatttttagtagggatggggtttcaccatgttggccaggctggcctcaaactcctgacctcaagtgatcctcctgcctcagcctcccaaagtgctgggatcacaggtgtgagccaccacgcctggccaaaagttctttctcttatgtttgttgtcagaccacttttgtgctatgtatctccccctccttaagggacttaataaaatgacaccactttgtacaattcccaaatgttatttcactgctggagatggtggggtgctgtcaaatgtttttcagcagctagcaatatggtgagaacattactgaggcagtgggtttcagatactgggtgtttgtttttgtttttgttattaggcagagactcaccctctgtctcaaaaaaaataatgattgcctagtactagttcatttaaattaatttcctagagcatatttaagtgggtcttttttttttttttttttttttgagacagatccttactctgtcaccgaggctggaatgcagtggcatgatcttggctcactgcaacctctacctcctgtgttcaaatgattctcgtgcctcagcctcctgtatacctgggactacaggcatgcaccacacacagctaatttttgtatttttatattttatttttaaattttttttttcctcctgggttcaagtgattctcgtgcctcacctcctgagtagctgggattacaggtgcacaccacaatgcccagctaatttttgtatttttttttttttgagacggagtcttgctttgtcacccaggctggagtgtagtggtgtgatctccgctcactgcaagctctgcctcccagttcacgccatttttctacctcagcctcccaagtagctgggactacaggtgcccgccaccatgcccggctaattttttgtatttttagtagagacggggtttcaccgtgttagccaggatggtctcgatctcctgacctcgtgatccacccgcctcggcctcccaaagtgctgagattataggcgtgagccaccacgcccggccaatttttgtatttttagtagagatggggattcgccgtgttggccaggctggtcttgaagtcctggcctcaagtgatccgcccaccttggcctcctaaagttctgggattataggcatgagccaccgcacatggcctagacgctgggttttaaagactttcagaattttacaaaaattggggcagagaactgccaactttatttttggcaagataaggacgtttttaaaactgctatttattacgattatttttatttatttatttttcttgagatggagtctcactctgtcacccaggctggagtgcagtggctcgatctcgcctcactacaacctccacctcccgggttcaagtgattctcctgcttcagcctcccgagtagctgggattacaggcgtctgccactatgcccagctaattttttgtatttttagtagagatggggtttcacgatgttggccaggctggtgtcgaactcctgacctcgtgattcgcccgcctcgtcctccctaagtgctggaattataggcgtgagccaccgtgcccggccacagttattttattttataactttaaaatagagatgaggtcttgctatgttgtctgggctgttctccagctggcttcaggcgatcctcctgcctcagcctcccagaatgcttggattataggcgtgaacaaccattcccagccaaaggctgtttttttaaatttttgcaccattctctcaaagagcactggtgttttgatagcattcctcaaatagcatttcaaggggctcgaggattggggaatggagaggacatcactcatgcctgcatcatcaagagtaatgctacctacctttatccacatatgggctctggttccaaagcaataaatgtttgaaaatagctagcctgggtgacattcacagtgagaccctttctctacaaaaaaaaaaaaaaaaagtcgggaatggtggctcatgcctgtaatcccagcactttgggaggctgaggtgggcagatcatgaggtcaggagatcgagaccatcctggctaacacggtgaaaccccgtctctactaaaaatacaaaaaattagccaggagtggtggccggcatctgtagtcccagctactcgggaggctgaggcaggagaatggcgtgaacctgggagatggagctttcagtgagccgagattgtgccactgcactccagactggccgacagagcgagactccatctcaaaaaaaaatcagctgggcatggtggctcaagcctgtaatcacagctactcaagtggccacagtgagccatgatcacgccatttcactccagccttggccatagagtgagaccctgtcgcaaaaataaaaaaaaaatagctgatggttttgggagtcacacagacttggactgaagttcccatttgttctaaactcataaagtttaaaacaacctctctgagcccctggaaggtaataactactttgaaagatggctgtaaagattacaaatactatatagaatacaggtctagcctttaccagttgtttaatggtagctgttaagaataggttggtttggccggggacagtggttcacacctgtaatcccagcactttggggagctgaagtgggcagatcgcctgagatcaggagttaaggaacagcctggccaacatggtgaaaccccatctctactaaaaataaaaaattagccgggcatgatggcatgcgcctgaagtcctagctactcaggagactgaggcaggagaatcgcttgaacctgggaggcagaggttgcagtgagccaagatcacaccactgcacttcagcctggctgacagtgagactccatctcaaaaaaaaaaaaaaaaaaaaaaagaatggattggtttagggagaggagatgtggggttgaaaataaactactctgttagttgtctttcctactccagggcttaggaatgcccccttttggttctaccttttctgacatcctcaagtccttgacttctcccagtcatgttctcatcccagctctgaagtcacctctatgttgactttgttataaactaatttgattcttctctccctctgcccttgacagcatctgtggaaccctccattctgtggatcaggtgagatatagcacgggccccagaattggttcctggagaaggagaggggagacttaagggttgggttcttacatcatgtctctagggttaataatggtgttcgtcggccaggcacggtggctcacgcctgtaatcccagcactttgagaggccgaggcctgaggtcaggagttcaagacaagcctgacaaacatggtgaaaccccgtctctactaaaaatacaaaaaattagctgggcgtggtggtgggcacctgtaatcccagctagtcgagaggctgaggcaggaaaatcatttgaacccaggaggcggagattgcagtgagccgagatggcaccattgcactccagcctgggcaacaagagcaaaactcttgtctcaaaaaaaaaaaaataataataataatggtgttcatcttcctttcctagtatctcaacatcaaactaactgacatcagtgtcacagaccctgagaaataccctcacatggtgagttggggtctgtggagaagaggaaacacctctaaagcaggaggcccctgggtggttagaggacatttttaagggtgttttcatatttgtccatctttgtctagttatcagtgaagaactgcttcattcggggctcagtggtccgatacgtgcagctgccagcagatgaggtcgacacacagttgctacaggatgcggcaaggaaggaagccctgcagcagaaacagtgatggctcctcctcctcttcccctccctctttcattggtgacccataaccccaagtcccagcccagaacccctaacccccaatacttgaaggggttttgtttttttactaatgatggttttgtgggttttttttaagggatgagtggatgagaggagtaatagggaacagctatcctctcttgagaaggggaggataagtaggctgggaaacttcaaagccttcccagtccccagcacctgcctttctcactacttctctggagatggtaggagagtttcctaggtctttccagggcagcatgtgattcatttggggatggaaggaatctgtcccgcatcgggaataaaatttatgatgcaaatttgtgttttggttctgttactatgtgttgggcagggggctgggacatggaaaaggatgtcgaattcatccaagcccctgttactctgcgttaacccagccaagaatccaactcagcttcccactactctccttggtataaagcatataatacagttgctctacaccatgtttccccaacatgtccctacctgtatgttctccctgtggccttttgcttataccatacctgcaactggagtgcttgctgtccttccattaatgtgatagtgtcataagatacatttcatgctaccagacttcaccaatccaaccaaatcagttcatgttttctgaatatgtatagaagataaatacaagtgatgtaatttatattttagagaaaagttgtgactgggaattactaaacttcattcactcattcagcaaatatgagttcatgatacagatgagacttctcagccttaagggacccttagagaccatctagtgtgaccctcctttttgtttttgagacgggagtctcactctgttgcccagggtggagtgcactggcttggtctggctcactgcaacctccgcctcccggttcaagcgattctcctgccacagctcctgagtagctgggattacagatgcccaccaccatgcccggctaatttttttttttttttttttttttgagatggagtctcactttgtcacccaggctggactgcagtggtgtgatcttagctctgcaatctccgcctcccaggttcaagtgatcttcttgcctcagcttcccaagtagctgggcttacaggtgtgtgccaccacgcctggctaatttttgtatttttacaaatactgcagctctgtcgccaggctggagtgcagtggcacgatctcagttcactgcaacctcaacctccagggttcaagcaattccctgcctcaggctccggggtagctgggattacaggcgcctgccaccacacctggctaatttttgtatttttagtagagacggggtttcaccatcttggcctggctggtcttgaactcctgacctggtgatccacccgccctggcctcccagagtgctgggattacaggcgtgagacgggctttcaccaccttggccaggctagtcttgaacttctgacctcaggtgatccgcccacctcggcctcccaaagtgctgggattataggcgtgagccactgcgcccggccgtcacccttttttcatacatgaggagatgaggctcaaagaggaagctggacgccagggcctcggcaaatggacctccccttcggtcctcatcaggcggctccctgctgggcacctccccgctaccgggtggggaacgccctccaccggcagggccggccgaccctcttgggccagttccctagctgcccgctgggcgccgccctcgccacccggccgaggacccgcacaaggtgcccgtggcggcgcctgacgggagcgtcgtgctcaggggtgtcctctcgtcctgcgtccgcgcccagcgccccgcgccccgcgctgttcctcgtgagaccggcgggcggcgagccgcgcggcccccggggcagtgtcggacacggcgggcgcgcactcgcaggcggggcacggccgcccccgccaggacccgcaggcccggaaacgctccctgtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtacgtacacgcggctcgaacccgcatccaaccagacgccgacccgctcctgagagccttccacactccccgaagccccgcgatggtggatagttcctcttccccaggaactccccactgacactgcccctctgagagccaggtcctcggctcctgacagcctgcctggtcagaccctcagtcctatgggactcgggtgtctgcggcgaaggagctcccgtgagggtcccctctctactcaaacataggacccacctcgatcccgcagtcttcccctgtctctctttctccttaggtttttccacttcgttcggaccttctcataactatgtccaccctctacgtctcccctcacccagatgccttccccagcctccgagccctcatagccgctcgctatggggaggctggggagggtcccggatggggaggagcccacccccgcatctgtctccagccacccccgactagcaggactmsctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggtgagggggttgtacagaagagggggaggggagaaattcagaggagggaagcgaggactggaatggacaatgagacaagaaggtagtacatcagatgtgggaaaagagtgatcaaatcccagattgccaactggtatggtaaccctgggcacgtttcatagacccgctgtgtcttggtcttcctatgtctatgaacacgcaggcaagttgatgtaatgcttgcctcactgagttaataggattaaaagatgtgcgcagagcacatagtttagtgccaggcacttttaaagtctcttrgtaaaagtttgatgagtctgaaattgatgaggatagaagttatttgaattgtaggaaaagactgggtgagggagagatgacaattgctgggaggagataaaagagaaatgaaatgaggaaggtaagtgagaggagagataaccctgccagattgtaactatcagtccttccaaaggagacctgtgccttggtgtactttcaactctgcctccttgcatggtattgagcacatgatggaaaattagtatttcttgaatggatgaatgaatgtggcagaccctgacttgctccctcatattgtgatcaccctatctacaatagagtccttgcattcagaatgtctgtccaaacaaacaaataaaatagagtccctctcttctggaattccctgtttgttcccctcttttatttcttttcttttctttttttttttttttttttgagacggaatctccttctgttgcccaggctggagtgccacggtgcgatggtgcgatctcagctcactgctcaagcgattctcctgcctcagccttctgagtagctgggattacaggcgcccaccaccttgtccggctaattttttgtatttttagtagagatggggttttgtcatgttgaccaggctggtctcgaactcctaacctcagatggtctgctcgcctcggcctcccaaagtgctgagattataggtgtgagccaccacgcctggcccctgttcccctcattctgctttatttttcttcataggagttaagaaaaatagggcacttcattttatatttgctcatttgttgttcccctacaagaatgttaactctaccaggtcagggttctgtccatctgttcgtgttttcctctcattccctggagaagtacttaatacatatttattgatgttctgaacctggcagttattgagatgcctcatataatctttacttctatgcttaacatattgcatctaacacataagtattgagtagggatttgttggatgagtcagaagtgttttgtttttttttttctgagacggagtctcgctgtgttgcccaggctggagtgcagtggcgtgatctcggctcactgcaagctccacctcctgggttcatgccattctcctgcctcagcctcccgagtagctgggactacaggcgcccgccaccacgcctggctattttttttttgtatttttagtagagatgaggtttcaccatgttagccaggawggtctcgatctcctgacctcgtgatccgcccagaagtatttttattgtgactatttgagtgaagaaatgggactcagaggtggtgatttgtgagagtggggtggagggaggccacatggattgggttgtggtgggagatggaggtgggccaaaccttgtctcacacttcttccccttcctgccaggctgtgctgggggccctgggcagggccctgagccccttggaggagtggcttcggctgcacacctacttggccggggaggcccccactctggctgacctggcggctgtcacagccttgctgctgcctttccgatacgtgagtcaccaggcctggggaagaacaagactgctctcctcagacctcactgtagggtgactgagaagagtcatttatttcctgttccaggtcctagacccacctgccygccggatctggaataatgtgactcgctggtttgtcacgtgtgtccggcagccagaattccgagccgtgctaggagaagtggttctatactcaggagccaggcctctctctcatcagccaggtgaggaagggcgaggagttggaggataggggcttccctggggccttccatgcaactcactttctttttttcctagaaatggcagaatcactggggcagggtcctgcgggagaggagggagaggggggaggtcagcatgggcaagacctcgggcatctaaaataccccatctgaaacctagtatggccgtccaagagggtccccagctggctgagtctgaatttctgcacctctctctaggcccygaggctcctgccctcccaaagacagctgctcagctcaagaaagaggcaaagaaacgggagaagctagagaaattccaacagaagcagaagatccaacagcagcagccacctccaggggaggtgaggcgagggtggagctggaaggaaagttgatgtgtgcggtgatgggttggctgatgcctgggcctatgtcttctccctcccaagcagaagaaaccaaaaccagagaagagggagaaacgggatcctggggtcattacctatgacctcccaaccccacccggggaaaagaaaggtactaggagtgggaaggggctcacccctcagcagccccttctaagttttcaccctatcttgctctattcttgctctcaccactttgtttggtgaggaattgcagaccccctgccctgcctctaggcccctcaaatgcctgtcctatgatgtgagtgacggagatcccgatccctctctgccagcacgtctccttcccagagtgctcccagccacggcactgagccctcccttcctctcccccagatgtcagtggccccatgcccgactcctacagccctcggtatgtggaggctgcctggtacccttggtgggagcagcagggcttcttcaagccagagtatggggtgagtaggcactgctgcccaggcccagagtgggtggggtggggaagggcaggactgaaggatgtgttgcctgggaggggctgggagaggtgacctgaggccttaaacatgtgccatccttctccaccatcagcgtcctaatgtgtcagcagcaaatccccgaggtgtcttcatgatgtgcatcccaccccccaatgtgacaggctccctgcacctgggccatgcactsaccaacgccatccaggactccctgactcgatggtgagcttctatctgcaccttcctctggttccctctgcctagtctggctctctccttttccctgacagccccccgagcctctctccttctgggttggtgctcacttctgcccccagtggtgctacacttctctctgtcattccaatctgatcatttagcttcctctcctagtccagtactcccatgcaacaccgccacttgcagactctcttctatcccttctttctttatttaattttaatttaatttaatttaattttttgtaaagatgagttttcactttgttgctcagtctggtctccaactcctggctcaagtgattctcctgtctcagactcccagagtgctgggattataggtgtgaggcaccacacccagtctctcccttctttttctagtaacaataacattattttgaatttaattaggaacatatgaatatatatatttttttttggggggacagagtcttgttctgttgcccaggccggagtgcagtgacgccatctcggctcatggcaaccgctgcctcctgggttcaagtgattctcctgcctcagcctcccaagtagctgggattacaggaatgcgccaccacaactgaccaaaatatatgaatatattcttgtaagaaatttaaagtttcaaatctccttgaccatccccctccacacctacttcctcctaagatttagccattgttatcactttgatgtgtatcttcccagatctttcctatttacttacatatacacgtacccatagaaatttatagttctccttttgggtgagtcttttctattttttaacataaagggttcatattacacttgttatgatctagctttcttcttacacttaatactttctcttggagatctttccttgtccttacacacataccacacatactgacttccttctttttaattgttccataatatctcatagtgtggctgtaccatagtgaagtcattcttttttttttttttttttttttttttttgagacagagtttcactctttttgctcaggctggagtacagtggcatgatctcggctcaccgcaacctccacctcctaggttcaagcgattctcttgcctcagcctcccaagtagctggcattacaggcacctgccaccgygcctggctaatttttgtatttttagtagagatggggtttcaccatgttggccaggctggtctcaaactcctgacctcaggtgatctgcctgcctcggcctcccaaagtgctgggattacaggcgtgagccactgctcccggcctggagtcactttttaattaatgattcattctgttttttgttttttgttttttttctgttgaaaaccttactctaatgcacatccctgtatatcaagtttgtccaacctgcagcctgtgggccacatgcggcccaggacggctttgaatgcagcctaacacaaatttgtaaactttgtttaaacatttaagaatttttttgcgattttttttttttagctcatcagctatcgttagtgttagtgtatttttttaaatttatttttattatttatttatttatttattttttgagacgggtcttgcactgtcacccaggctggagtgcagtggcacagtctcggctcactgcaagctccaaactccgcctcccacgttaacgccattctcctgcctcagcctcccaagtagctaggactacaggtgcccaccaccacgcccggctaattttttttttgtatttttagtagagacggggtttcaccatgttagccaggatggtctcgatctcctgacctcgtgatccgcccgcctcggactcccaaagtgctgggattacaggcgtgagccactgctcccagccagtgttagtgtattttatctgtggcccaagacaattcttccatgtggcccagggaagccaaaagattggatacccctgctctatatgcttgctgaagcatgtgtggaagggtttcgctggtgtagctatcaagaagtgaaactgctaggtcggcaggggcacacctatattaagtacaaacggaagctgccaagttgccctgcagaatggctttgctgattgatacctccaggaattgctgtgagagtgttcatttccccacccttgctaagcctgagcattagggttgcctaattagttttgccaatctgatgggcaaaaaaatacctctgttgttttactttgtacctttctgattgctattgaagttgtgcctattttcatgttttttggccagtcaggtttacccatatgtgaattgtctgtatctatcttttccccgtttttctattgattcttcgttctttttctttttaattttttttttgagaattctttacctgttctgggtatcaatttttttgttaaatattgtaaatgtttttgttgtattattgtgtggtagttttcctgttaattgtaaatgtttctcctgttttctgttactatttgttttcactgttaatattttaattagtgataaatacaaagtaatattctaggtgacaaatctttttaaaaagtattttaaaataactttaccatttttggaaaccagggtttattatatttaaattttgagaattttttctggtgtcttatgtactaaattaatgtggtcaaaaaatatttactgggcccaactatgtgccacctctgctctgagcactgggaatataatgtttgattgtgcattttgcaagtaactgagagctaggaaaacagttatatgttttatttttttatttttattattattattattattttgagacagagtctctctctgtcgcccaggctggagtgcggtggcgcaatcttggctcactgcaagctctgcttcccaggttcacagcatactcctgcctcagcctcctgagtagctgggactacaggcgcccgccaccacgcctggctaattttttgtattttttttagtagagacagggtttcaccctgtcggccaggatggtctcgatctcttgacctcatgatctgctcacctcggcctcccaaagtgctgggattacaggcgtgacccaccgckcctggcctgtttttttttttgttttttttgtttttttgagacagagtctctctcggtttcccaggctggagtgcagtgatgcgcgcttactgcaacctctgcctcctgagctcaagcgattctcctgcctcagccttctgagtagctgggattacaggcgcatgccaccacacctggctaatttttgtatttttagtagagacggggtttcaccatgttggtcaggcttgtttcgagctcctgaccttgtgatcctcccgcttcggtctcccaaagtgctaggatgacaggcatgagccacttcgtccagccaacagttctgttaaatacacataacatacaatggccaagttgtttgcgtttgtgtttgcgtttttgttttttcaatttttcaattttttttttttctttggaaatggggtcttgctctgtcacccaggctggagtgcagtggcgcagtctctgctcactgcaagctcctcctcccaggttcacaccattctcctgcctcagcctcctgagtagctgggactataggagcccaccaccacgcctggctaattttttttgtatttttagtagagacggggtttcaccgtgttagccaagatggtctcgatctcctgacctcgtgattcgcgtacctcggcgtcccaaagtgctgggattataggcgtgagccaccacgcccggccctgtttttcaattttttaataaaatcaagagagggtctcgctatgttgcccaggctggtcttgaacttctgggctcaagcaatcctcctgcctcagtctcccaaagtgctgggactacaggcatgaaccaccatacctggcctccaagtttgtttacatgaaaacagaatgactacttttttttttttaattgagacagagtctcgctctgtcgcccaggctggagtgcagtgacgcgatctcgtctcactgcaacctcaaccacttgggttcaagcgattcttgtgtctcagtctcctgagtagctgggactacaggcacgcaccaccacgcccagctaattcttttgcatttttagtagacagagttttgccatgttggccaagctggtcttgaactcctaacctgaagtaagccgcctgcctcggcctcccaaagtgctgggattacaggtgtgagccactgtgcctggccacatacttcttataaaactcttaaggtagccacattttttttccagtgaacgtggtttaaataaaatgtgagacactcccattactttaatggaatagagttatatcaactttttatttttatttatttgtttatttatttatttttgagacagagtctctctcactgtgttggccagattggagtgcatcggcatgatcacagcacaatcatagcttggtgcagcctcaacctcagccacccaagtagctgggaacaaaggtgcacgccaccatgcctggcttttttttttttttttttgcagagactaggtctcactatgttgcccaggctagtctgcaactcctgggctcaagcagtcctctcaccttggcctcccaaagtgttggggttataggcttgagccactgtgcctggcttgaattctttaatctatctaaagtttctttttgtgactattggtaagggggagattttttccaaataattagctagttgtttcaaacattttgaatagtttatccttattttactgataggaagtgccaactttcacaaacactaaatttgcttgtatctgtttccaggtactattttgttcctgtttagtaacttattttaacaattagaacttttgctatcctgtttggcaggagcctcctcttcgttcttttttttttttttttttttttttttgagacagagtctcactctgtcatccgggctggagtgcagtggcacaatttcaactcactgcaacctccccctcccagcttcaagcgattctcgtgcttcagcctcccaagtagctgggattacaggtatgcaccaccatcctggctaatttttatatttttggtagagacagggtcttgccatgttggtcaggctggtctcgaactcctgtcctcaagtgatccactcgccttggcctcccaaagtcctggggttacaggtgtgagccaccacgcatgcctgtctttgttctttttccatattgccttggctcttccttcaaatcttttctccttgactagctttagaatcacaagggttccagctccacccctgcttctttctttttttktttgtttgttttttggagacggagtctcactctgtcacccaggctggagtgcaatggcatgatcccagcttgctgcaacctctgcttcccgggttcaagcaattctcctgcctcagccttccaagtagctgggattacaggcacatgccaccacgcccagctaattttgtatttttaatacagacagggttttaccatattggccaggcttatcttgaagtccccacctcaggtgatccacccacctcggcttcccaaagtgctgggattacaggcgcatgccaccatgcccagctaattttgtatttttagtagagacggggttttaccatgttggccaggctcatctcgaactcccccacctgaggtgatccacccacctcagcctcccaaagttctgggattacaggcgtgagccaccgcgtccggcctccctgcttctttatttagtccactgactccttgcctgaagcctctgctttctttggtgccaggccccactggcctggctcaccctctggtcctycatgccccctaacaggcaccgcatgcgtggggagaccaccctgtggaaccctggctgtgaccatgcaggtattgccacccaggtggtggtggagaagaagctrtggcgtgagcagggactgagccggcaccagctgggccgcgaggcctttctacaggaagtctggaagtggaaggaggagtgagtatgcagcatccctgtgggcatcgcagccctgcctccctgtcccctatccagaagacctctgtcacctgtaaccccttggccacagggtcagaccctcccacagaggcagagtcagttggctctagggcccaggtaaatttcagggggatgggtgatctccacactgcccagtcagccacctgatgtctccctctagcccaggcacgagtgctgacctcagcctgtctgcttccaggaaaggtgaccggatttaccaccagttgaagaagcttggcagctccttggactgggatcgagcctgtttcaccatggaccctgtgcgtgggaggagtgtcaaagctggggcaggagtaggagtctccccagggtgggacccccacaggagaaagcagaggtgttgtggccctctctcaggagctggcccatgtaaaacaccatggagggctcagctgcaaatgccacttcccacccctcgccatggccctttccatatcatggcccttcatgttccctgtcttggctctgggagctccagattcctccagatggcacatgatcaggaccccgtctcccatggagcytgaactcccagtgtcctctgcaccagtacttgtccccagctgattgtcttcctcgccatctgcagcattacaaggcttgttgcctgctcttgtgttcccttagtcctctctccccctcaaggaaagaaggaaagtactcccctcagaggggtctttgtgctggccagtgggactctgtatgggcaaggcctcactggagccctgggtgtctgcctgggcctccaggcacaaggcccatctctctgacttctccctcctccaccccagaaactctcagcagctgtgacagaggcctttgtccggcttcacgaggaaggcatcatctatcgcagtacccgccttgttaactggtcctgcaccctcaactccgccatctctgacattgaggtgcgccccccaacctggcctgtctccatctccaatctaccctggccctggccctggcccctgggccacgcctctaaatacccattttacaggtggataagaaggagctgacaggtcgcaccctgctctccgtgcctggctacaaggagaaggtggagttcggggtcctcgtgtcctttgcctataaggtccaaggctcaggtaggagccaggggcaccaggatcctgggctgggagtggcaggaaggggccaaggccaagaccacaaggccttctgtcaccccagatagcgacgaggaggtggtggtggcaacaactcggatcgagacaatgctgggagatgtggctgtagctgtgcaccccaaagataccagataccaggtgggggactgtccacagttagggaaggagttctggccaaaaagggctcccatccttatggggtggaggggttggacttaggcccctggctgaggagaggaaactgggttagaaactggtcttcagcttctttcccagctctgagggtagagctattggggactgtttgggggagttcaagtgttgggatagtcagggccctggaaaggaaggacttgggcccagcccttcgtgcatttttaaaaagttaaatagccaggcacrgtggctcatgcctgtaatcccagcgctttgggaggctgaggcaggtgaatcataaggtcacgagttcgagactagcctggccaacatagtgaaaccccatctctactaaaaatacaaaaaattagccagttgtagtggcgggtgcctgtaatctcagctactcaggaggctgaggcaggagaatcgcttgaacctgggatgcggaggttgcagtgagctgagatcactctgctgcactccagccttggtgacagagcgagactccgtctcaaaaaaaaaaaaaaaagttaaatagagacaaggtctcactctgttaaccatgctgatcttgaactcctggcctcaaggaagcctcctgccccagcctcccaaagtgtgggggttagagatgtgagccatggcaccaggccccttcatgcttttatttatttatttatttttgagagagggtctcactctatcgcccaggctagagtgcagtggcaccatcttggctcactgcaacctccacctcccgggttcaagcagtacttgtgcctcagcctcttgagtagctgagattacaggcacgcgtcaccacacctggctaattttttttttgtatttttagtagagactaggtttccccatgttggccaggctggtctccaactcccggcctcaagtgatctgcccacctcagcctcccaaagttctgggattacaggtgggaatcacggcgtctggccctgcttcatgcgtttttggtatctttccgcccccagcacctgaaggggaagaacgtgatccacccattcctgtctcggagccttcccattgtcttcgatgaatttgtggacatggactttggcacaggtgggcaaggggctggtcctgtggggagaggaaaagactggagctgcaccctagctgtccatcttctctcagagaaaaagaaaataagcttcagccaaatagacagagcttggggtggttctcaagggactgtattagacaagtgggggccaggagtggtctcggagctacatccttcagcaaaagaggtgagtgtaggaaggaactccgtggagtccctcatgacctgggcatcctgatgtacacccaggtgctgtgaagatcacccccgcacatgaccaaaatgactatgaagttgggcagcggcacgggctggaggccatcagcatcatggactcccggggggccctcatcartgtgcctycgcctttcctggtgaggctgcctgaggcaagagtgcccgggtcagggagatggagggatggctgggcatcgccatgatgaggcctcattcctacccagggcctgcccaggtttgaggccaggaaagcggtgctggtggcgctgaaggagcggggactgttccgtggcattgaggacaaccccatggtggtgccactttgcaagtgagggtgggggcctgggacgggaggaagatggagggctcctcagggttttaccgcctggccttctcacctacgtgtacccccagccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccggtgtgtagggtcctcagtgtgggaggggcttgccgagggctgagcagggctcactcgggccaggctccatcaggccctccctgatttctcctccccgacatttgcagggagtggtgcatttccaggcagctgtggtggggccatcgcatcccagcctactttgtcactgtcagtgacccagcggtgccccctggggaggtgagcagagggccagagctagctgctgggacaccctgctggagtggtgggtttactggrtccttggtggggggaggggcagggtgagccagaagcagacacacccccttgggtaatcactgcacctgtggcaggaccctgatgggcggtactgggtgagtggacgcaatgaggcggaggcccgggagaaggcagccaaggagttcggagtgtcccctgacaagatcagtctccagcaaggcaaggcggggctttgagggtctggagggagttgtggggggcagagctccactccctctgacctctgacctttggcctctctcagatgaggatgtattggatacctggttctcctctggcctcttccccttatccattttgggctggcccaaccaggtgtgttcctggggccggggcttggcgggacaggggactggagggtgggtgttggctccccttcacaccctggtctgccctcagtcagaagacctgagtgtgttctaccccgggacactgctggagaccggtcatgacatcctcttcttctgggtggcccggatggtcatgctgggcctgaagctcacgggcaggctgccctttagagaggtgcggagacagccgagaccctcccatsgcccccagcctcctctcctaccgtcctgtgctgcagcgcagacccygcgtggctggggcatggggttagctgtgggcaggcctgaccygggggctggtgtggggttgaaatccagcctgggccctgctcagtgattcctgtgcccagggcttcatcttcccagaggaaggagtgcttctgattcacataaaggcgctcaacgagctcttggggacactcagtgggacctgaggttcacagtggggtagaccagacacagtcctggtcggggcactgaggccggggaaggagaggactgagtctcatgggcctccccacctgctctgcaggtctacctccatgccatcgtgcgagatgctcacggccggaagatgagcaagtctctaggcaatgtcatcgatcccctggaygtcatctatggaatctccctgcaggtgggctgggtgctgggccagccaggaagggccgtggggctgtggtcacagccacctgactgctcccactccaccctcagggcctccacaaccagctgctgaacagcaacctggatcccagcgaggtggagaaggccaaagaagggcaggtatggagggttgggctgggctaagcaggagcacagcgtggatggggctggctgaggacgctcctccccctgcctcttccctgtagaaagctgacttcccagcggggattcctgaatgtggcaccgatgctctccggtttggattatgtgcctacatgtcccagggtatggcccccaaagcgtccctcccagccactccttcctccttctgtgaggcccatccctcttctccaccctgagcctctggtgggcatgggctgggaagagggtgatgaggactcacatctcacccccgacccaggtcgtgacatcaacctggatgtgaaccggatactgggttaccgccacttctgcaacaagctctggaatgccaccaagtttgcccttcgtggccttgggaagggttttgtgccctcacccacctcccaggtaagggcctggtgggcagcaaagctggcagcactcacacaggctgtacccctgtccggagcagcctccatgtagctggggggacagatagacacagagacagacagttaaagggaaagcccagcgcattgggggctggggcctgtcacttcttcccagatcctggcacataggtggttgctttggactcatcagactctggatgaagatttgcccatgactcctgcccccatggggttctggcaccctcccctggcccgccggctgatacaccctctctccccaagcccggaggccatgagagcctggtggaccgctggatccgcagccgcctgacagaggctgtgaggctcagcaatcaaggcttccaggcctacgacttccyggccgtcaccactgcccagtacagcttctggctctatgagctctgtgatgtctacttggtgagaaggagcacagcggggcaggggatggtgggggcaggtggscagcagagccctgggctcagttttgccagagttggccttgagacctaagccaacccatccccttcccagtcctcacaggcacagcgagggctcaaggctagacctccagccgtgagccctgtacctctcgtcccctaggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagaggtatggcatggcctggagaggggagtctgacctgccctccaggccccctcaccccctcctccaccccacagtgctcctggaaggaccccgaggcagaagccgcccttgagctggcgctaagcatcacgcgagccgtgcgctccctgcgggccgactacaacctcacccggatccggcctgactgtgagcctcaggcccccatgtccgccccatcccactgtcccctcagcctactctgggacccagtgtccggcagtgactgcttggtttcctgtctccatggagctaggcctcacctttctccctccctggcaggtttcctggaagtggcggatgaggccacgggcgccctggcatcggcggtgtcgggctaygtgcaggccctggccagcgcaggtgtggtggctgttctggccctgggggctcccgccccccagggttgcgctgtggctctggcttctgatcgctgctccatccacctgcagcttcaggggctgrtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaaggtgtgtggcctgggtgggcatttcccacaccatccccttcctccatcaaaaccctggtctgggctggtccgagtgcagtggtgttgacaactaattgatcgtaaccagttacagatttctttgttccttctccactcccactagccttaaaaaacaaaacagcctggctcagtggctcacacctgtaatcccagaratttgggaggccaaggtgggtggatcacttgagcccaggggtttgagaccagccaacatggtgaaatcccatctctacaacaaaaatacaaaaattagctggccatagtggcacacacttggggtcccagctactcggggggctgaggtgggcggattgcttgagcctgggaggtcaagactgcagtgagccgagatcatgccactgcacttgagcctgggcaacagagagaagaccctgtctggaaaaaaaacaaaacaaaacaaaaaccaatcctggtctggaagctggactctgtacccaaccctggggaatccactggggagcatggagcccaggcgctttgagcagggaccatagaaggccctccccttacacatggggagcagctgggggctgggcacaacccagggtcacacaacaggtgggagacggaggctgacctagaaccaggcatcctatctcccagccagacccttcgtaccccacccagctgcccaaaatgtggaaacctgcatgcctggggctgggcttggggtccacatgtagtcggggagccctgggcctcccaccacttactttcaagcctactgggctgaccctggaaggccagtcttgtttgtcccctgcctcctgggttccgccagagagaagcagtggagtaaactgcacagacacagagaaaaccagtcatggaggccaagarctagagagccttgagtggacgtggttaatctcacttggttctcccaagagccctgggaggggggcaatatcatcatcatcatctgacaaatgaagtgaccggcctgggagactgtgctctcctgcttaggtggggacactgaatggggaacacgtaggctctgaggttcctttgttcttggggactcaccacttggtggaaaaaggcaagacccaagaggtggtggtggaagtgggggtgctggtgggaatgggtggggagccaggccagccaggttcacgcctcctctgagctactgacctcccatggtcctcgctcatcttyccaactttgttgtcctgggtgtttgggggtctcttcacttggacctgggtcctyacccaccccctggttccactccagctccaacagacagaagcagagctcaggaaggtggatgaggccatcgccctattccagaagatgctgtgatccaccacccagcttcacccctcacccccagcggctcaccatggggatggcagcaataaaatattttcccacaaaatcctcttgtcatctgtggtgggggcagagaggggagcagaggggctgggtgcctgaatccttgggggctgcagggtgggagtgaggccctggttctggagggcagaggggtgcgtctatctgggtctgtccctggcactgtgccaggcctgagtcacgctgcttactcccttcctcctccccagctctcactcacctccgcactgcagccaagggaggcccgccctggcgtgggctgctgcctgtggctttgggcaggcaggagcgaaagggccaggggttgcctgtcctcccccaccctgttgaggccttcctccccctctgctgagcctcggttaattataactctgacctaagtgccctgtgacgtcaagcccgggccagccctgcccaggagacccagcaaccaggtaggggagggcctgagaggactcaggcttcctgagcatggggagtgtttctgcggcagggctggggacgcagccagggactggggaggggggcgtgggggaggaaccttggacccctctcctggcaggtgtgtatgtccctaatggtccgatgaggccctcaggttgtctgggtgacagcgagagggtggggaagccaggctggagcagacacgacttttgaggtaaagcaggttcccatggagacccgcagagccggcctgccctggaatcgcggctgcttcctcctcccttgagagccttctgtctcccaggtccatgtctcagccatgctccccacggaggtcccccaatcccacccgggcccctcagcgttgcttctgctgcagctgttgctgccccccacatctgccttcttccccaacatctggagcctgctggctgcccctggctccatcacccaccaagacctaactgaggaggcagcgctcaacgtcaccctgcagctcttcctggagcagccacccccaggccgcccccctcttcgtcttgaggacttcctggtgagcatcccagggtcctgtcacacccctgccagagtccccaattccatggggcctctactccttgagggctctggttgccaagagaagagacacccatggccccacccctgcagcaataatacccagtagtcttggtcctgaaattaggagtccccctccttagaaaggtccgggactgtccctcctttgtggggctcaggaccctcatacccagccttgagtgtcagttgctgagataaggtgggcaacagtcaatccaaagggcctccctggagccccgtcgcccgctattctccccagggtcgaacactccttgctgatgacctctttgccgcctactttggacctggttcttctcggcggttccgagcagccttaggtgaggtgtctcgtgccaatgcagcccaggacttcctgccaacttccaggaatgaccccgacctgcactttgatgctgagcgactgggtcagggacgcgcgcgcctggtaggggctctgcgggagaccgtggtggcagccagggcccttgaccacaccctggctcgccagcgcctcggggctgcacttcatgccctgcaggtgagaacagggttgggttgatggtcagaggggtcttcacttccgtgcctgtccgggatggagcgcgtcctatggtgccttcttgatcatgtctcctccactctggaaggggtgggcactggcacgcggtgccccgaggctgtgtcccagttccccacctccaagctggcagtgcttcctgtaggaacagcaaggagggcgctgtggctggagagaagtgagggtgagagaggaaggctgcgaggtcagagagctgagggagcagcacacgcagcaggactctgcaggccgagagaggccttgggttagactctgagctgggaagagatgctgggacagtttccacctgggcaaagctctgctctgagcaatggagagagggcagtggaggggacttggggtgtctggtgggagcagtaggggtgggaggggactttcgggatggggaactcaaaggagtggcatattagtgctggagatggtgagaaaggccagactagtgcctcactccccttctcctgtcctccggaccaggatttctacagtcatagcaactgggtggagctgggcgagcagcagccacaccctcacctcctctggccaaggcaggagctccagaacctggcacaaggtatggctgtgaccctggtggtgaggcaggagtccacagggccacctcagtccacccagccactgtgtcacattctgaagtcccagagggtatgatgttacttaatctccacaaggactgaggtcccccagtccaagcaacgcctggctcagttaagcagcttccccaaggtcacacagggaaaagtagctaggaccaggtctccagacctcagtcccgtcttaagtgtggcttcctccccgcactgactcccatggggccttctctcacagccccctcaccctctcacctggaagctgcctcctgtccacaactcacagagggcataatccccataggattggtccctacacgtactgtgtttgtttttttcttattatttatttatgtatttattttttagagatgaggtctcactgtgtggcgcaggctgctctgcccgccttagcctcctaaagtgctgggattacagtcgtgagccaccgcacccagcctgtgctgtgttttccagcacagccctagtttcaaacattcaggctcactgcgggcccatgatcctaggttttagttcagaaagctttgctagggaacttctgggtgttcgcctcatcccagctgggaggagaagctgaaaaggtttgggtgggtggggataaaggctgggggtggcagaatcttgggttctagccctgccctctcttcccagtggccgatcctacctgctccgattgcgaggagttgagctgccccaggaattggctgggcttcacactcctcacctctggctactttggaactcatcccccgaaacctccaggtaccagacaagaaagttccccagaagtaaggggagaaagtcattcccttacaggatctctgtcctgtaggcccgtatgcctttgctatggcatctcctcctaggaggagaggatgctgggaacagggtgggtggaggaaagtcccctgaggaggctgtggtggggttgaggtaggggagcaacttcttcctccgctgataggatttctcccttgtcataggcagttttgggggactggctggagggatcaggggatccaccatgtgctgtggtgactgaccaccacgccctaagatttactccagaattcccctccacaaagcaccatcctttttatcctttttttttttttttttttttgagatggagttttgttctttttgcccaggctggagtacagtggcacgatctcggctcactgcaacctccgcctcccaggttcaagcgattctcctgcctcagcctcccgagtagctgggattacgggcatgtgccaccacgcccggctaattttgtacttttagtagagacagggtttcatcatgttggccaggcttgtctcaaactcctgacttcaggtgatccacccacctcagcctcccaaaatgctgggattactggtgtgagccaccatgcccagccatcatttatttatttatttattttttgagaccgagtcttgctctgccacccaggctggagtgcagtggcgtgatctcggttcactgcaacctccgcctcttgggatcaagctattttccttcctcagcctcctaagtagctgggattacaagcacgcgccaccacacctggctaatttttatagttttagtagaaacagagcttcaccatgttggccaggctggtcttgaactcctgatctcagatgatctgccggcctcggcctcccaaagcgctgggattccaggcgtgagccaccgcgccaaccccgtcatcatttcttgctgaacccttgctgaggggtgagagggtcaggccaggcctgaaagggcctcattttcttaggaggcagtgggtttttgacctccactctccagatccctttccccaacccagggaaatgtagccacgggggccattttgaccggagcagctcccagccaccgaggggaggcatcaacaaggacagcacatccccaggcttctcccctcaccacatgctgcacctccaggctgcaaaactggcccttctagcctccatccaggccttcagccttctgcgaagccgcctgggagacagggatttctccaggtgagtggcctcctggggatggaccccttcatggggaggcgctcctgcgggaagggagaaaccaggcgctggggacaaacgtgcaggcccttcactgtgtctctggcttgctccccaggctgctggacatcaccccagcctccagcctgagctttgtcctggacaccacgggcagcatgggtgaggagatcaacgctgccaaaatccaggctcgccaccttgtggagcagcggagaggcagccccatggagcctgtccactatgtcctggtgccttttcatgacccaggtaagtgtggtctggctaggacagtagaggggaggaaaattcaaggtaagggatagactgggcgtggtggctcacgcctgtaatcccagcactttgggaggctgaggcaggtggatcacctgaggtcgggagtttgagaccagcctgactaatatggagaaaccccgtctctactaaaaatacaaaattagccgggcgtggtggtgggcacctataatcccagctactcgggaggctgaggcaggagaatcgcttgaacccaggaggcagaggttgtggtgagccccgagatcgtgcctttgcactccagcctgggcaacaagagcaaaaagctctgtcacaaaaaaaaaaaaaaaaaaaaaaaaaaaaaagaaaagaaagaaaaaaaaaagaaaagataaaaaggtaagggataaaggcctgtggtgaggaagtgggctcggggtggcacttcctgtagtcccgagtgagcctctactgtgtgcatacagaaaattagcagcaacctgggtggggtggctcacacctgtaatcccagcactttgggaggcagaggtgggtggatcgtttgagcccaggatttcaagaccaacctgggcaacacagagaaacacaggtctctacaaaaaaattaataaaaattatgtgtgggtgtggtggcacatgcctatagtcccagctacttgggaagctgaggcaggaggatcacttgagcccaggagactgaggctgcagtgagccgtgatggcactactgcactccagagcggcctgggtgacgcagtgagaccctgtctctaaaaaaaaaaaaaaagataactagcagacttgcctcccactctttctaaaatggcagcactttccatgagtttaatgcatgattcatgctttggcacgtggcctctgctttcttaggctttcatgctaataaaccattttctttttttttttttttttttttttttgagacggagtctcgctctgtcgcccaggctggagtgccatggcgcgatctcggctcactacaagctccgtctcccgggttcacgccattctcctgtctcagcctcctgagtagctgggactacaggcgcccgccaccacgcccggctaatttttgtatttttagtagagacggagtttcaccgtgttaaccaggatggtctccatctcctgacctcgtgatccgcccgcctcggcctcccaaagtgctgggattacaggtgtgagccaccgtgcccggccgccattttcaattctctccatttcctatagacagagattggtatcaagatggggttgttggggccaggcttctgggaagcatctgagataactagctacattgtattccttttccattgattagaagttagactctctggcttgagtctgactgtgtgtctttaggctggtcatgtaaactttctttgcctcga

SEQ ID NO: 10903 - DNA, 24990 bp, Homo sapiens
  misc_feature (1)...(24990): n = A,T,C or G, or insertion/deletion polymorphism (see Tables 1-2)
ctcatgcctgctcatcttccatttcattctcaaatctttaggggaaagggagaggagagagacattgctgtttccccactttccagtccaagcatctatcccaacagataagcaaatttcacttgtcatcctctttatgtatctttctcaaatgtcttgttctctagccaggcttaaggatataatcttcctggtttgtggctctctttcgtcttgattccttgatgactgcctccaaagagctgagctctggcacaattagacttgagggagatagtgtgagtcagtcaacaagcatgtagtatctacactttgggggagagcctatactctttcttatttctttttttacaaattattattttgagacagaatttctcaaattcctttctacctcaggaaaggaaaggaaattggataaggcgactttgtcgccaggctgaagtgcagtggtgtgatctcggctcactgcaacctctgcctcccgggttcaagcgattctcctgcctcagcctcctaagtagctgagactacaggcacacacctccacaccagcctaatttttgtatttttagtaaagacggggtttcaccatgttggcccgactggtctcaaactcctgacctcgagtgatccacccaccttggcctcccaaagtgctgggatgacaggcatgagccactgcgcctggccactctttcctatttctgaatcttcacaggttgttggtcccttcctagtcctgtgtttctcaagttaagactagggggaatctacaggtccatggctatcttctctggggaactcttctaaaactttaagtttgtgcttacctcttgatgggccatatttttaaaaagagaaatattttcatacatgatgatttggattaggttttttttaggggtttcaatgcctatatttgtatttgtgtttatttatttatttattttttgagacagtcttgctgtgtcgcccaggctggagtgcaatggtgtgatcttggctcactgcaacctccgcctcctgggttcaagcgattcttctgtctcagcctcccaagtagctgggactataggcgtgtgccaccacgccaggctaatttttgaatttttaatagagacggagtttcaccatattgaccttgtgatccgctcgcctcggcctccgtgcagtggcgcgatctcagctcactgcaacctccgcctcccaggttcaagcgattctcctgcctcagtctcctgagtagctgggactacaggcatgcgccacaccagctaatttttgtatttttagtagagacggggtttcaccatgttggccaggctggtctcaaactcctgacctaaagtgatccgcctgccttggcgccgtggctcacgcctgtaatcccaacactttgggaagccgaggtgggcagatcacttctggtcgggagtttgagaccagcctggctgacatggtgaaaccccatcttcactaaaaatacaaaaattagccaggcatggtggcaggtgcctgtcatccccgctacttgggaggctgaggcaggataatcgcttgaacctgggaggcagaggttgtaatgagccgagatctcgccagtgcactccagcctgcgtgacagagtgatactccgtctcaaaaaaaacaaaaaacaaaaaaacaaaaacaaacaaacaaaaccagggagagaattgttttgacacaagtctttggctaatgatgaaaccgtctcccttcctggctgtcctggcatggtttttatagtctgaggcacaatggtgagagcaaacttaagagggagccaaagtgaggtactcaagagagggatccttctttcctggagaactgtggtagcccaggctgtgtaggtagctggacaagcaagactgaatcacaataggtctctacatcttctattaggaggagaacctgcaacatccagtggagcaggtcacaccagttatacatgtaaaatgtaggataaactaaaggggcacagagccaggggagaagacaatgggatgagactgttctagaatctcatcccattggttcattgctgggtgtggtggctcacacctataatcccagcactttgggaggctgagatgggatgatggcttgaggccaggagtttgagaccagcctggtaaacacagcagaccccatctctctaaaaaaaaaaaaaaaaaaagaaaaacatacggtttatgaaccagcagcatctgcattaaccagcttattgaaatgcagaatcacaggccccacaacagacttcctaaatcataatctgcaacttaacaagttccctaggtgatatgtatgcacacttatgtttgaaaagcactaagatttcttgatgaaggaggacttgaaaggcaatgatggatgtgaaaggaaaggtaaagagaagcctcaggtagtcacccaagggacagggccggttggagagagagtcccgaggttttatcctggagaacaccctgtactgaatgagctctgaacataaagatagttagcataggagggcctgaagtctccagataaaaggctgctgccactatcatttaccacgacctctgccattctccactctattgtcatccgcccccagtctccattccaggacttctctacactttgactttttgtttgtttgtttgtttgtttgagacggagtcttgcgctgtcgcccaggctggagcgcagtggcacgatcttggctcaccgcaagctccgccttccgggttcatgccattctcctgcctcagcctcccgggtagctgggactataggtgcccgccaccacgcccagctaattttttgtatttttagtagagacggggtttcaccatgttgtccaggctggtctcgaacccctgacctcaagtgatccccccgccgccccgccccctcccccccgccccgcccccccccgccgcctcggcctcccaaattgctgggattacaggcgtgcgcgatgcccggctttttatttatttatttatttatttttgaggcgggaatcttgctctgtcgccaggctggattgcagtggcaccatctcggctcactgcaacctccgactccctggttcaagcgattctcccacctcagcctcccaagtagctgggattacaggcacacgccaccatgcccagctaactttttgtatttttagtagagacgagatttcaccatgttgccaggatggtctcgatcacctgacctcgtgatccgcccacctcagcctcccagagtctcagttgccaaagctggagtgcaatggcgcgatctcggctcactgcaacctccgcttcccaggtaagccattctcctgcctcagcctcctgggtagctgggatataggcgcccgccatcacgccgagctatttttgcatttttagtagagacggggtttcaccatgttggccaggctggtcttgaactcctgacctcaacctcccaaagtgctgggattacaggcgtgagccaccgcgcccggcccaccttttttttttttttttttttttttttttgtttgagacggagtctctagtctcgctctgtcgcccaggctggagtgcaatggtgtgatctcggctcactgcaacgtctgtctcccgggttcaagcgattctcctgtttcagccttccgagtagttgggattacaggcgcgcgccaccatgacctactaatttttgtatttttagtagagacagggtctcaccatgttggcccactttgactcttgagcagcctggccagcccgaccgcgccaaattctgttcgattctgcctagttcggttgctctggcctagttcagttgctaaggcctggagcttcatggttgcggaggaaatgatgtcacgttcaataggcgggctaaccagattcctcccttctcccgattggctgccaggaatttgactagattcggagtctcgcgggctccagggttagttgtcagtatctttcccagttgttccgccccctacccccgcctcccgcaccgcgcccctctccggctgccctctccgtgtggggcaaggctccgagggcagcattcagtagccatttagctttggaaggagaggtgattcgaatggcccggctcctcctgtcaccatgctaggcactttggccgcgcaggtacttattgacccgaccgggtgtccgtagttggcgcggctaccttaaccgcagggaattgtggaatttatagttctaaattatatgtgggtggaacggggaagctggagcagatttttggaggaaagcaaaactggggactttcaggactaggggcctgggtctcagaagaatgggaaaggacgagaaaggagtctaaataagaaccctgctattagcattgtttggttttcttttcaggtgctgacctgaacctggttcatccctttctgaccaaaactgttcactcaccgtggaagggactaagcatccatatggagacgccaccagtcaatacaattggagaaaaggacacctctcagccgcaacaagagtgggaaaagaaccttcgggagaaccttgattcagttattcagattaggcagcagccccgagaccctcctaccgaaacgcttgagctggaagtaagcccagatccagccagccaaattctagagcatactcaaggagctgaaaaactggttgctgaacttgaaggagactctcataagtctcatggatcaaccagtcagatgccagaggcccttcaagcttctgatctctggtactgccccgatgggagctttgtcaagaagatcgtaatccgtggccatggcttggacaaacccaaactaggctcctgctgccgggtactggctttggggtttcctttcggatcagggccgccagagggctggacagagctaactatgggcgtagggccatggagggaggaaacttggggggagctcatagagaaatgcttggagtccatgtgtcaaggtgaggaagcagagcttcagctgcctgggcactctggacctcctgtcaggctcacactggcatccttcactcaaggccgagactcctgggagctggagactagcgagaaggaagccctggccagggaagaacgtgcaaggggcacagaactatttcgagctgggaaccctgaaggagctgcccgatgctatggacgggctcttcggctgctcctgactttacccccacctggccctccagaacgaactgtccttcatgccaatctggctgcctgtcagttgttgctagggcagcctcagttggcagcccagagctgtgaccgggtgttggagcgggagcctggccatttaaaggccttataccgaaggggggttgcccaggctgcccttgggaacctggaaaaagcaactgctgacctcaagaaggtgctggcgatagatcccaaaaaccgggcagcccaggaggaactggggaaggtggtcattcaggggaagaaccaggatgcagggctggctcagggtctgcgcaagatgtttggctgattaaaagttaaaccttaaaagagacaggaacttgtgaattgtggtctgtgctgtgagatttgggggtggggggccagagggaaggtttcagcccatatcccattctcagcttttggcttcctaggggaggtagcagtggtcacagtgcgccccttttgaggggcttatctatctccgaggacacatagaagctgtctaaactaaacttagtagtggctgggggagatggtggaccttaatactgggtactacatctcccaggcgctttatcactggagcctgtttggcgcatgcgcttggcggtatggcactgtctggaagttacttcctgctgctgtgctcccattgggcccgcctacacagtcatccgcatctgttgattcacgtgctcagcacccaggtctcttactggtcggtagagcttccgggacgcccccttttttgaaagagtcaactgattagttggtgatggggagaggcgggccttgggaaccgtctcctggttggggggtgggggggaaagatggcggagctgatgctgctyagcgagattgctgacccgacgcgtttcttcaccgacaacctgcttagcccggaggactggggtctgcagagtgaggcaccggggaggggagagggctgtggcaaactgtccctgaggcacgcgggaaagaagcgggggcctaaagaggaagtctgggcaaatacggaatccgccatctgaaggagagcggagcagggggctcgttgtgcattaagggggatacaaaagtcagggaagaactctgctccctgctggaacgtcgagttgttccggggtcggggaaggaggggctgaagcgccctggttgtatcacttttcaagtgggcgggcggtgggtctggccgagcggagccaatgagggatggggcgggggcttgtgtgcgatctgtaggctggggccaccgaacgaccccccgacgctcagcatttcttgcagacagcaccttgtattctggcctagatgaagtggccgaggagcagacgcagctcttccgttgcccggagcaggatgtcccggtattgtgtccccagcctttctctaacccttggtgggtggaaagtgagcccagaayctggacccattcacaggccataactcatctggagtcacccctactttctcatcctttctcacactcctgccctcttgtatcctcccttatttagtttgacggcagctccctggacgtggggatggatgtcagcccctctgagcccccatgggaactcctgccgatcttcccaggtaaggtagtctttgtcgttccctcagatttccagaaaccctcatcttcccactgtttcccagaaactacgtagcttcctatatcctcacgcttctacataagtgcctatcctctctccttcaatcccctatttttktttcttctcccttgctgcggtacaggaatccccaccgacatgtccttgggtactttttggactcttcttaagctctgcttcctgataatttctaactccctttcctccagatcttcaggtgaagtctgagccatcttccccctgctcttcctcctccctcagctccgagtcatcgcgtctctccacagagccatccagcgaggtgagagagccatatccctcttactctctgtgacggggactctgcttcattcccttcacccgtgggtgacaaagaaatgatttaaatgatttgtgtgctatgagtcatgaggtgtgtgaggtgtggggggccttctccactacctttgccgtttccttaatatcttcattttccacatcccctttggttatctagcagtgaagatttttttgtttgtttgttttttgttttttgcttttttttgagatagggcctccctctgtcacccaaactacagtgtagtgacrgggtcacagctcactgtagccttgacctcctgagctcaggtgatcctcctgcctcagcctcctgagtagttgggaccacagacacatgccaccatgtctggctaattttttttattgtttgtaaaaatggggtcttcctatgttgcccagagtggacttaaactcctgggctcaagtgatcctcccaccttggcatcccaaagtgcttggattacaggtataagccaccacgcctgatcttgggtctttttaatataaagagttatgtggggctgggaagaagagagttattgactgctgagaattctggaactgttcttgcccaagttgtccactctgaggccatatttgaagtcatgagacttcatcaattctcccagaaataaagtagaaagaatgaacaggttagaaagatggtcagtaccattcagaccagaatgtcaaataattgatggcttgtaagccctaaacttctaaagcttttgttctcgctcttactgtcaacatctcccttgttttttgcccttctttytgccccctgccccacaccaactctcacccaggctcttggggtaggggaggtgctccatgtgaagacagagtccttggcacccccactgtgtctcctgggagatgacccaacatcctcatttgaaaccgtccagatcaaygttatccccacctctgatgattcctcaggtaataaaacagcctgcccccaatccttggctctactacgggagaatgtgttatgtgtgtgtgtgtatgtgtgtagatggaggggaagtgcaggcagcaggacagggagaaaaaggtggggaggggaaatggcagaaaaccaggagggaaggcaggaaggagaggaaacatttcagggaaccacagcaagggcagtgctgaggagatggatattatttttctctctttttcttgttcctagtattctgtcatgccattcaacttactttttaaaaacttgtgagcagtttagggcatatgtatctgtgtgattcccctccacccaacattttattataaacatttttgttgttgttgagacagagtctcacactgtcgctcgggctgaagtgcagtggtgtggtctcagctcactgcaacctccacctcccaggttcaagtgattctcctgtctcagcctcccaagtagctgggattacaggcacccaccaccacgcccagctaattttttgtatttttagtagagatggggtttcaccatgttggccaggctggtcttgaactcctgacctcatgagtcgcctacctccgcctcccaaagtgctgagattacaggcgtgagccatcgcgcccagcccataaacatttttaaacatacagaaaggctagaacaccatatactaaactagattctacaattaacattatttgttctatttttaaagtgttcccaagtttatttactcgtagctgtgtatttagtaaatgtttattgatgtgatcatatctgaggtataataattataaaaaagaaatatttattaagcacctactccatgccagatactgagcagcatgctgggaatgcaaagatgaacaagacctgaccaccatgctgactttcaaaccctgtgatttggtaatgggagaaagacaagtaccagtcaatacaggtgtggtcattctaggatagaaatcactagaggtggggctgggtgtggtggctcatgcttgtaatcccagcactttgggaggccgaggtgggcrgatcacgaggtcaggagattgagaccatcctggctaagatggtgaaaccccgtgtctactaaaaatacaaaaaattagcctgtagtcccagctacttgggaggctgaggcaggagaatggcatgaacccgggaggcggagcttgcagtgagccgagatcacgccactgcactccatcctgggcaaaagagcaagactccgtctggaaaaaaaaaaaaaatcactagagggtaccatgaaagctcataagaggggacatttcatccacattggcgctgaatctgggatgtgcccctggaagaagggtttcctgagagttttaaaggacacgtagaaattagccaggaggacagtgtgggggttgacttgtgtctgaggaccctgcatttcttcagagtggatgtaagaaggatttggggagtgatgtggaactgcaggggctacagggccaggtggggcccctgctaaggggctcttagcttttatcctgtggataggtgggggccwttggagaattaagcagggaagtaatatgattaggaagatgattctagtggcaaagtagagaatgggttgcagaggggcagggccagaggcaagagaaccaaggaagaagcttatgcagttgatcaagtaagatrttcggatgtcatgaagaaagcagacttgagaaagaatgaagtggaatagatgagttgtgacctcctggacattggagagaggtaggagtcaaagaggtttgtggctaggatggctgtgggtgggtgatgttactgttcactggatggagactgcaaaagcaggggctttctggtcagggaagatgatgaattcagcgttggacatgttgattctgttgttgttgttgttatggagcttcactcttgttgcccaggctggagtgcaatagtggtgtgatcttggctcactgtaatctctgcctcctgggttcaagcgattctcctgcctcagcctcctgagtagctgggattacaggcatgctcyaccacgcctggctaattttgtatttttagtagagacagggcttctttcatgttaggctggtcttgaattcccgacctcaggtgatccacccactttggctcccaaagtgctgggattacaggcgtaagccaccatgcccagttgacatgttgattgttgatttcaaagtaccttctggatctcctggcaccatctctcactggctgaactccaaccagggagcccgctgatgcagtccattcagattctccctggatctcagggagcacagcagggagggatggaaagtggatttggagggacaaacagattatatctagcagattaatacatgttataaaaaagatacacaaaataaggattgaaataccattagcaggccaggcacagtggttcacacctgtaatcccagcactttgggaggccaaggcgggcagatcacgaggtcaggagatcaagaccattcgggctaacacagtgaagcgccatctctactaaaaatacaaaaaattagccaggcatggtggcaggcacctgtagtctcagctactcgggaggctgaggcaggagaatggggtgaacccgggaggcggagcttgcagtgagccgagatcgcccactgctattagcagcaaaaggattgtaaggattgttggtggctttgcattgcatagtgttattagagtcagattctcctccatacttaggtattttttgagggcctgtactttaccctcaatggacatgagacatagttcttgcttttggagagttttgtgagggttataatacatcatggttaaatagttcccttttttttttttttttttttttttgagacagagttttgccctgtcacccaggctagagtgcattggcgtgatctccactcactgcaacctccgtttcctgggtttaagctattgtcctgcctcagcccccctaatagctaggactacaggcacgtgccaccatgtccggctatttttttgtatttttggtagagacagggttttgccatgttgttcaggctggtgtcaaactcctggcttcaagcaatccacctgcgttgggtgtcggcctcccaaagtgctgggattacaggcgtgagccaccatgcccagccatggttaaatagttctgatagtggttatctctgtgtagggaatctgagtgactggaggaccgggaagggaagttttttttttttttttttttgagacagagtctcgctctacccaggctggagtgcagtggcgcaatctcggctcactgcaagctccgccccctgggttcatgccattctcctccctcagtctcccaagttgctgggactacaggcgtccgccaccacgcctggctaatttttctatttttttagtagagacggggtttcaccgtgttagccaggatggtctcgatctcctgacctcgtgatccacctgcctcggcctcccaaagtgctgggattacaggcgtgagccaccgtgccccgccaagattttttttttgacttaattttcctttgttcgtttggatttgtatcatgactgtattatctattcaaaaatataaattgaagttttaaaaagcaatcttagtgatcatataattaagtaccaaagtgaacggtatggaccagaggtagtggtggactgttgacctgtgggctgaatctggccctcagaagggttttatttcaccgacatggggcctagcattttctttcatggagtgatcaacaagtcataaaggcagatttattggaggccatggaggctcagaggtgactgaggctttgctgtttggtgcctgggaggaaaacttgtgtgacggggcaatcaggaagcctcatttatggccagttagatttgggtgactggtgaggcatgagaatggaagggaccagcaggcagcttggaagtcagaatctggtgcaggtgagcagccagggggagatgcacacttggcggttgtcagcatggagatgcattgggcagggataaggtggaaatccagcaagataggaatttgggccatgtgaatgctggagacccccctgccacttcccctgctcaggcctattctatgtgaatagacaagttctgtgaacaagaaagagggaaacgcagaagggcaaagacagctttgaggaacatggagcagggatgagaaaaatcagaggagccactaaaggagaaagggaagcactaggcgaaaagcggggcggagagccagcaggtgagcagctctgtgactgcccctcctggatggcctgtaatctagggccagaagagttttattttcaggttcaaagagaaaggacccatttccccatcttaaccctcttttttatttttttgagatggagttttgctcttcttgcccaggctggagtgcaatgrcgcgatcttggctcactgcaacctttgcctcccaggttcaagcgattctcctgcctcagcctcctgagtatctgggacacagggatgcgccaccatgcccgactaattttgtatttttagtagagacggggtttctccatgttggtcaggctggtcttgaaytcctgacctcaggtgatctgcccgccttggcctcccaaagtgctgagattacaggcgtgagccaccatgcccagcctcccatcttaaccctcttaacccttcagtgtttacatgatatccagcttttgcctmatcctgcctcccacagatgtccagaccaagatagaacctgtctctccatgttcttccgtcaactctgaggcctccctgctctcagccgactcctccagccaggtgagcaccaccttccttccttcctccaggttttccagtgagttcctcctgrcctagaggtatgagagctttcccttcttcagctccttctcctcgacactcttcctgactaatgtatctctggaatgccccacataggcttttataggagaggaggtcctggaagtgaagacagagtccctgtcsccttcaggatgcctcctgtgggatgtcccagccccctcacttggagctgtccagatcagcatgggcccatcccttgatggctcctcaggtaatggagtctcctgacacttggaatccctagtgagaggcctttggtcctgacatttcttgttcttttctctcaccttccttcaggcaaagccctgcccacccggaagccgccactgcagcccaaacctgtagtgctaaccactgtcccaatgccatccagagctgtgcctcccagcaccacagtccttctgcagtccctcgtccagccacccccaggtactgaagaaggagaaaagggccgggcatggtggctcacgccggtaatcccagcactttgggaggctgaggcgggcgaatcacctgaggtcagaagtttaagaccagcctggccaacgtggtgaaaccttgtctctactaaaaatacaaaaattagcgtggagtggtggcaggcgcctgtaatcccagctcctcgggaggctgaggcaggagaatcacttgaacccaggaggcggaggttgcagtgagccgagatcatgccactgcactccagcctgggcgacaaagcgagactttgtctcaaaaaaaaaaaaaagaaaaaagaaaaaccaaaaaataaaaataaaaattaattaattaattaaaaaaaaaaggccaggcacagtggctcacgcctgtaatcccagcactttggcaggccaaggcaggcggatcacaaggtcaggagatcgagaccatcctgactaacacagtgaaaccccgtctctactaaaaatacaaaaaaattagccaggcgtggtggcgtgcgtctgtagttccagctgctggggaggctgaggcaggagaatggcgtgaacccgggaggcggagcttgcagtgagccgagatcgcaccactgcactccagcctggtcgacagagcaagactgcatctcaaaaaagaaaaaaaggagaaaaggaggcgggctgcattgaccctgtcagagagcttgcagccattgaggctgcccaatccttgggtgctcttgtgtgggtgtggacacaaggaccccacccagcgcacagccctctgacctctgctcacttgccccagtgtccccagttgtcctcatccagggtgctattcgagtccagcctgaagggccggctccctctctaccacggcctgagaggaagagcatcgttcccgctcctatgcctggaaactcctgcccgcctgaagtggatgtaagtgttggggaggagagaagtagggcgagtgatgggaagggaagagggaagtcttgccatagagagaactgtgggatgaggagggagtcgatacctaggagaaaaaagtgaggaaacggacccattagatcattctgagggtcagaatggactcctgtttctatatgaatatcaactccaggtagttttagggtcctttaggtttgctgtcactgcagatggagaaatggggttggtctccataaattaaaggcaaggaagtcgtactgtactatacgactacggtcatggccatagttggggagggaggctgcctcctaggggaaaatcaggtaaactrtataagcagtataacaaggttaaactttgaaccctacaaatgtgggctgacaggaagaaagagttacgaaggaaagagtttccaccagcatggagaaagttcttcccacactctaacctttcccacctctgaggagcagtagcagggaatgtttgaaagaagggccccttccctagcgtgtttgagtagagaggaaaaacstctctggctatgtaggtgggtcaggaaggcaggggaatggccatgtgagctttgggtaaatcattccttggggtttgagagcatagtctccttctgccaactcatctgtcattcttttttgaccttccgggtgcctaggcaaagctgctgaagcggcagcagcgaatgatcaagaaccgggagtcagcctgccagtcccggagaaagaagaaagagtatctgcagggactggaggctcggctgcaagcagtactggctgacaaccagcagctccgccgagagaatgctgccctccggcggcggctggaggccctgctggctgaagtaagaccagtctgtccctgggagaccaacaggaatacagcctccttggaatgattcccctttttcttgtctccttctttgtaccttagaacagcgagctcaagttagggtctggaaacaggaaggtggtctgcatcatggtcttccttctcttcattgccttcaactttggacctgtcaggtgagaccttccttgcttcactagaaccttccaggtggagcccacgttacagcctcctagctgcctgctttggcccaggccatttccttctgcttatatacaaatggttctggtgtccttggcaccgatgatgtgtctggccagccccttcctgctccattatttgtctttttttcttggagatggagccttgttctgttgcccaggctggagtgcagtggcacgatctcggctcactgcaacctctgcttcctgggttcaagtgattctcctgcctcaacctcccaagtagctgggactacaggcgcacgccaccatgcccggctaattttttgtattttttagtagagacagggtttcactgttgttgcccaggctggtctcgaactcctgagctcaggcagtctgcccacctcagcctcccaaagtgctaggattacaggcttgagccacctcgccyggcctcctgctccattatttttccagtggagagtagatgatggtgataatgctggtagaaatagtgactattaagtgcttactgagttctaggctctaggtgatgcactgtcttttttgtatgtagggaccatccttattcccatcttacagaggcagactcaggcttgtataacagattgcaactcaagcagtccatctgcagagtctttattcttacctagatacttgatacagctgaaattcttcattgtgctcagtccttctttatccacagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagcsccacagaccagcccagtttcaggtgaggagagagagagagggccccctctcgtttgaggrtatgagttggtcttctccccgctttcagtgagggggacccaaagctttctcttgccgtcatcgccttctttgttgtgggagtgctgggcagtctccaagtgttgtctccttcctgcttcactccagcaacctgacagccttccctgggggcgccaaggagctactactaagagacctagaccagctcttcctctcctctgattgccggcacttcaaccgcactgagtccctgaggtgtgggattcattgctggggcatccagctcccccggcctcccaaggccttctgcagtcagcctggctggcctgtgtactaaagcgccagtgctccctgccctctcctcactcctgtgggtgggcaaggagggtgggaatcttggcctggcatggaggtcctgagctcctccatttccccaggcttgctgacgagttgagtggctgggtccagcgccaccagagaggccggaggaagatycctcagagggcccaggagagacaggtagggcgggtggctggttcaaggaaggccacttgaagacaagggctaaaggccttgtctggggatttctagtgggcatctcgctgtggaagtttgagggatcgtttgaaggaagtggagggttgagtgggaggtggcatcagcttccaggggctgtttgtctctttcccttttcccttcaccctctccaagtccttagatacttctccttccagaagtctcagccacggaagaagtcacctccagttaaggcagtccccatccaaccccctggacccccagaaaggtgagtgtggggtggggtgcttacttattaagtgaaattccactttcaagagctgtacccccagtagctgtcctgtgcctgtcattactgtcaccagtgggattatacctccctcctccactgggggtctcctgtctttttctctcatcctacccgcttccctggtagaaactgagcattgggcttagttcccctcaaatcctgtttccccacctgcctagggattctgtgggccagctgcaactatatcgccacccagaccgttcgcagccagcattcttggatgcaattgaccgacgggaagacacattttatgttgtctctttccgaagggtgagtttctcctgcccttccatctctgtcaccccaggttcccagcagtctgtcttcagtggggggatgtagagtagggctggggagcttgttggcatctttgcctccacccttctggcctggcccatctgttccccaggaccacctgctgctcccagccatcagccacaacaagacctcccggcccaagatgtccctggtgatgcctgccatggcccccaatggtaactctttccctgctgggtatgggggcagttccaacagggagatccagcctgggagctgagggggaagggggagaggagcagggcatccagagagctgctggacccacaggtgagaagcagcaggaagtaggtggagggaagagcaccatgcaggagacttgggagggagacaagggtgagggtccttccctggtgaaggtgcttgggtagatgactgggcagaggcggggggccgggaacctgctagactctcacttacttttttctcttgatgtcctctcctgtgtgaccccacactcaatgcccttttcttttcctaccctctccttgcccctgcaccaaactctgtccctgccatcctgtttaactcccgctatggatctgcctcctcactattgccctttctttttctctctgctcacctctacttttctgacctcctcccctcctccctgcaatccctgtttgcctccccatctcctcttccttaactctccccttctcacagagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtccyggcttctttgtttgaggggattgtgtgaggttcagttgtggggtgggtggtgagctgctgcatattttttattttgtttctctagtgttatggcagtggaggtgggaatttagtccccaggtggnacaagggaagttttttcattttggagctagttactgggagtaagggagggtggggtgggggggagttcaggtttatgtgtgtgcatttcttttttattattattaaataaacaacttggagggagttgaaggaatggtggctgccttcctggctcgtgatggggagtttgggggaaagtggcttttccagagccagcatcaaagaatcaagcactgaagacatagctggctctgaggtggggtgggtgcgggatcacagaccgcatgtcatccccttgcccccacccctgcaactctggggtatatctgtgtctagcaacgatgtctcatggcgtgacagactagaggatacgcatccctggaatgtgagtcaacaggaaagatggggccccacgcccttcagggtgagcagcctctgggtctcctgctctcgagcaggttctccccctcttcttgctgtccaggatgagcagctcaaacaaacaacaagagctggggccagaggctcagagcccaggaagtgggggtctcggtgaagaaggggtgatatttggaagggaagggggatgtggcaggatatcctctaagccctaaactggaggggactgagacttgagagtccagatgaaagacaaagacaagagtggggcaggcagaaaaagctgtacattcttatgtttttaattttttttttttttttgagacggagtcttgctctctcacccaggctggagtgcagtggcgcgatcttggctcactgcaacctccgcctcttgggttcaagtgattcttctgcctcagcctctcaagtagctgggactacaggtgcacgccaccacacccggctaatttttgtatttttaatagagatagggtttcaccatattggccaggctgcccacttcggcctcccaaagtgctgggattacaggtgtgagccaccatgcctggctaggctgtgcattctaattaggaggaaggggagcaggacaaagtgagggattgagtctgaggccaacctggaagaatccccctccagctgctcctgttcagcagtgcctcaggcctgaccctgcaggagtgtcctgggtcagctggagggtgtgagctgggcctgggctcaatgcccagatgactggacaggggctgcctgggccataagcccaggcctgaaggagggaggaagaacctcatgtgtccagccaggcaacccccacacccctcccactgccctcacccattactgtgtttggggtgaaaacagaccaagtaactatggcaacctggaaccagggatcccaggaactagacctttcctccctccagagggcagcccagcttctcagctatgctttctatcccagagtccttgagccttatccaccgtatctctggagggggtgcagtgagaacaaggattttggaagcacatcacctaagctggattccctaccctgcctttcgttagtagatgtccttaaacattctgagccttagtttgcttatctgtaagatgggatgttcctacctcctaatcagggttgatgacaggatgaaagacgacgtcctcagtgcctggtccataatagatacaccttttcctcatcccttgcccctttctgtccccatctctgttgtccttctctcttccacttttatcccatttgggttcattactgtttcgttgtcccattgtcttcctccttcctgcccccagttcgggaaagtacttgaagtgctggcatctcaggggtcaccctggggtgggacatcctgctcctctgctgattggcaagggacagctggcactttggtgtggatgagacatcagacctctcttggctgagggattgtggtggcaggaaggattgagaaggacggtgagtgggtacctgatgcagggtgaaagccgggcaggctctgggctgctgccttctaggcccatgtggatctccattcctctggccacacccccaaggccactcagcatgccaggtcgctgtcactcctgcacctcattggcccctcctgccctatgcccactttgtctttctgttctgctttccttgtgccaccatctccttcatttcttcctcaggatcccaccttttgttctctctcatccctgacctcatcatccctcccttcctctttctagacttctttcctgcctttctttgctctctacctcattagcagttatcacaacctctttttgaaccattattcatcactgtttttttcttcttttgtatcttccccaccccatccactgcttcactgtcttaaattttttttttaatttaaaaatagaagtggggtctcgctatgttacccaggctggtcttgaactcctggcctcaagcagtcctcccatgttggcctcccaaagtgctaggattacaggcatgagccaccgtgctggccttatttaaaaatatatatatatttttaaattcactgtctttttcctttgtttttcttggtcttctcatctgctgctgctgctgaccctgtgcttgtctcctccctttctcatgccgccccctttctatttcccattctgctccctcgtccacatttcttgcccctttccattatgtcctctcttttcccccactttggtcctctcctcctccttccttcccccactccctttacttcccacaccagttctccatcctcttcccagctgtgggggccagcactggggagcctgatgtttgcctcatcgttctgctatggcttctggatacagcacatctggattccggggcccagatgtgtggttgccacagcgacctgggtccctctggtaaatacaggcgcccacccgcctcagagcagagaacaaaacaattgtgtgactttcttttgtcacgagatagaaatgtccttcctcctcccttctccccacacccatgtctctaggcaaaggaagttttaagggtccaaacccttccttctgaggctcccttgcccccttttcagctgtagcctcttagttctctcccatctttcatcctgcgctctgtctttacattctgtgttccccatcctcacccgacccccagttctcaataatggaatgttgaccacccccttccccatctgatgccatttcttctaagtgaatctacacaataactggatgcagaaaagtttcaaaaatctggattctccacccttctttgtacaagtgcttcaaagaagccacttcatttgttccctaagtcttcaatcctttcctttcctggagttgtttggggagaagagcgaatacaggcttaggaatgagaacacctgggtgagacccaccttcaccactactgacttagccccttgaacaagacccttaatgtctatgagcctccgtttcctcagccacaaagtgggattaatgcccgcactgtgtaggaaactgttttgtaaacggaagcccggcacaagtgttttctatctttcccctctctgggactgctttcttggaccgcagcccctggcatctcttgttcccctgtcttcatccttcaggtccttgccctcaattgcccttactcttatgtgtctgccttctctcctccctatctttcctttccttttctctatctttcatcccttttcctcctgaggtcaggacaggaacttggaggatcattcaaggagggaggctcagagctgaagacacagggactgaggttacagagaacagccggagcttgtggacagttctggacaacactgacctttctacccaccaccacccagacacctcagtgaagccaaccccagctctgaccactgggcttccctgccttcacgcctgggctccttaccctttccccctcctctctcccagtcctttcacatttcagtgttgacttgcatttattggtcacctacactgtgcaaggcttggtgcttttcttacaagatgtgaacatacaagacatgagcttctccatgagcctggaaaccaaagggtgaatcaaatggtaaacaaagataatttcagaacctgaaactatatctgctaagcttccagtggcttccccaaatgccttataagcttgtgtacatctggaatcccacatttctctctgagaccccaacagtgggcttccagaacatcccaggaccatccttcttgctgtcttctctgaggtccctggccactctctgtgccaaatgtacttatgttgaccattcttcctaaataataaagccaggacatagggcataggcacacgcgcgtgcacacacacactaaaggatatgaccatggaacagaaatctgaaggtgtcagaggaaattcataccctgtgttctgccctctgtgtgatactgtctccagaccctccctcttcctatcactgcagggctccccacctcctgccaggagatccttgggaagctgctacctactgctggctctgggggcttcaggccaaggcagaggaaggaagctgagcctggctctgtccaagatgctgacttcatcctccccatcaaagccaggaaaaaaacagccacacacacccagacacacggacacacacggggacacccacgcaaaagcccatgtgtgcctttgccctcggccacatggagcttactgggcatctggccacagccacatgcagtgcaggcacgccctgacccaggaacaccacacacctgccaccatggggatctgacctggtgtgcagacacctgggccgtcacccatgtggcagaatcaagcacatatgggctccctcacgtacctttcacccgtgacttggccaagttacacctcagtggtgaggtctgtagcaggatagagagacccagtcctcactgtgaagctgggggtagtgggttcccactcagctgggatatttctcctctgtagcaaagtctctttttcagctccttgtcagggcagcacatggggagatgaagctagggaaacacccaacagacttatgtggggtgtgtctgtctccctgtcccccctgtcctctggctgtcagtcttctgcctgggaccagagacagcgtgtccgtttcctccagcccctacctctccccgcctctgttcctgctcccccgcagcacccaggcaccagccccccaccctgctttccaccacttcaccctctattcaggtgacccacccttatatttgcctcctgtctctagccctttcttcaaccctaaaccttcctcctaaccttcaggctttccttccttgtccgccccaaccccagcttcctccccaaggcttgtatgtcccagtgttcacccaagcccttgccctgccagtgcccaagcctcacctgctctttctctagggacttgctgaggtaggagaatgcaaagggggcagtgacaggagagggactgaacagaacagacagcaggagtggctcggggacgggataagccgagaagatagaaatggtgggactggagcagggtggggacttggggtcccagagacggtcccagttggagaaagaggttgcctcttgcctcctgccctctgcccctgctccctgccccagactgccaggggagaactggtgagaggatgagggagccagcactgggtgatagacatggggtgcgatccagagatccaagctagagcagtggctgggaagagatgggagaggagcatgggggagggaggggaagggggctggccatgaggaaggatataggctgagaggaaaccactggggtcagagaggaggggcagcaggtggagaaatggtggggaaaaaagaaatggcaggaagggtggggggtgtcaagttgggcaaaaattagggtgagctaaaaatggcatagggaaaggacgtgggaggtaagaccggggctgggggttgagatgagggtatggtgagacagtgatgctagacagggagtgggggctggggtgggggcaggagaagaggaggggtggcatgtgggagggcctgggaggggtgggaggacctgccctatctccgctcccctccctgacctcatcctggtcctccccttctcctcccctgctcgctgcagactccctcctcactgtcgctgccgagatccacagtcggttgtggctcagcccctgttgcaggggacaagtgagggagactt

SEQ ID NO: 10904 - DNA, 13592 bp, Homo sapiens
gcatgcctttttttcaattaatgttcatgacaaccctgtgatgtgggtgctattattatactgagaaaacggcctcaaaaagagacagtaacacagccgggcatggtggctcatgcctgtaatcccagcactttgggaggccaaggtggttggatcacttgaggtcaggagttcaagaccagcctggccaacatggtgaaaccccatttctactaaatatacaaaaattagccaggcatggtagtgggcgcctgtaatcccagctactcgggaggctgaggcaggagaatcgcttgaacctgggaggcggaggttgcagtgagctgagatggcaccactgcactccagcctgggcgagagtgagactctgtcttggaaaaaacaaaaaaacaaaaaacagagacagtaacaggtccatggccagcaagtgatagaaccaggactgggggagtggtgggtaaggatgtgcagaaggaagatcagactaagaaaagagaaggggagggccagggacagagttgggaaggaaggaagcctaggtgggtggatggggtggggaggtggacacaggcatgccaggtgcccatcctggccgattccctgcccattcccacccctaggtaagatgtgggttttctccaatctgcgctgtggcacaccagaagagccctgtcaggaggccttcaaccaaaccaaccgcaagctgggtctgacatataacaccacctgctgcaacaaggacaactgcaacagcgcaggaccccggcccactccagccctgggccttgtcttccttacctccttggctggccttggcctctggctgctgcactgagactcattccattggctgcccctcctcccacctgccttggcctgagcctctctccctgtgtctctgtatcccctggctttacagaatcgtctctccctagctcccatttctttaattaaacactgttccgagtggtctcctcatccatccttcccacctcacacccttcactctcctttttctgggtcccttcccacttccttccaggacctccattggctcctagaagggctccccactttgcttcctatactctgctgtcccctacttgaggagggattgggatctgggcctgaaatggggcttctgtgttgtccccagtgaaggctcccacaaggacctgatgacctcactgtacagagctgactccccaaacccaggctcccatatgtaccccatcccccatactcacctctttccattttgagtaataaatgtctgagtctgataaaatgtacatttattataagaagacctaagggtcaggtcacctcccaggaaataatactctcaatctccctcccttacacaggaatccttcagggaggttccctgggaggctgggctggggaaaatggagaaacaggtttttcaggtcttcatcctcccttccagtgtctccaggtggcacacaacaactcatatcctaaatttaggccacacccctgatgtattgccaagaagaaggtgcggcctggcttgagggctctccagaaaggataggagaggtacatggagatggggcctgagaccctgtttcttcagtttctctcaggttagagtcaaaggcctcacctagcctagttagtaagtagggcatcaagcagtttttacctatcacagtttttacatttcttttctcaattcaaaatagtcctattgggagccaacttgcaaatgggaaataggggagcaaacccagactcaggctcacaaaaccctggcaaccccactcaatgaatctcattgctaaggaagattcaacccagcaacaggatccaggagccacagaaggcagataagccattgccctttggggtttagttggttaaggagtgcaccactgtaattaagcccgctgttgcttggtaacccccaaactagaacctggatgccccatattacgcttttagccctcccatcaaccaaagatagatgtaattttccagtcagctgtagagtggttcatagattttaatgactcacagaaggatgtttgtcttctcacattagatgttcagatgtcccttgttcccttgctcccttgttcccttctctactcctactccccctatccgctccacagtcctggcaagagacaggtcagggcggtagctgctgcagccaaaatgcctgcaggggccacatggcttgccacggcgctgttgcacaggtctcccaggtagcagtccctgtgggctggataagtcacgtctcccaccgactctgtctccacttgattgcaatgatgggctgcgacgcaggctggatgttggtgaatcaaggtcactggggctgagagagagaatgaaactggggtgttggactcctggcttcaggacttgccttctggggcagagcagatgtgatttcaaggagcccaaagggattttcagccccctcaaaaaacacctccctgaaaccaagtgatcaaagttaatgcattgaccttgtaaactcctgatgtgatgcagcaagaaggatgcaacatcacttctgcagtattcttgcttaaaatgcatgacctcaatctcatcatggcaaatatcagataaataaatatcgagggacattctataaaataatttttagtatttcaagtatctgtaattttttttttttttttgagacggagtttcactcttattgcccagctggagtgcaatggtgtgatctcggctcaccgcgacctccacctcttgggttcaagcaattctcctgcctcaggttcccgagtagctggtattacaggcgggcaccactacacccggctaattttgtatttttagtagagacgagatttctccacattgatcaggctggtcttgaactcccgacctcaggttatccacccgccttggcctcccaaagtgctgggattacaggcgtgagccactgcatccggcacgtaatttttgtttaatctaaaaatgattttatttaattttagagaaaagatcttgctctctcactcaggctggagtgtggtggtgcaatcatacctccctatagcctcaaactcctgggctcaagtaatcctcctgcctcagcctctcaggaaactgagattacaggtgtgtgccactatgcctggctaattttttaaaaacattttttgtagagatgggggtctcactttgctgcccaggctggtgtcaaactcctgacctcaggtgactcttcagccttggcctcccaaagtgctgggattacaagtgtgtgccaccaagcctagcctaaaaattattattattattatttttgagacagggtctcattttgttccccaggctggagtgtagtggcgtgatcatggctcattgtagcttcaatctcccaggctcaagcgatcctccctcttcagccccctgagtagctaggactacaagcatgtgccaccacacccaactaattttttaatctgtttgtttgtttgtttgtttgttttttgtagagacagggtctccctatgttgcccaggctggtctcaactcttgggctcaagtggtcctcccaccttggcctcctaaagtgctgggattacaggtgcgagtgactgcactggccctaaaagtaattttttaaactccaggtataaaataatttatcagggctcttcaaatgtgtcagggtcatgaaagacaaagaaaaacagaactggcacagatcagaggagactaagaagacatgagagctaaatgcaatgtaggatcttgctaaatcaaataaagtctgtagattagttagtagtattgtatcagttattttgtgattttgataattgtgctatggttatgtaagatgttagcattaggagaagttgagtatttctgcaacttttctgtcaatccaaaattatgttaaaataaaatattaaaaacatgtacacacacacacacacacacacacacacacacacacacccctccctggtccttaactaatgccgaaaatttgaagtttggttttaactttggcctttcagggccagagctcttcatttgtgagctaatgggcctatgagattcttttaggagaataaggaggtggggaagtgggggcacaaggactgtgggcctctcaggggctccgtgccaggagccagaaggggtacagactgctctcctctaacagctgcaccatctgcccagagccagactgagcctggagggttctggaagccagaaggattgacatggggctggaggcagggaaaggctgctggaagagggagaaactgaggactcacggtttccaggtagcttgatctgttccaggcctggctggggtctgccctcgccacaggtggtcacggcctctttgcaagaactgctggggcttccaccacagttgtagcaccgcattcggtttcctggcaggagaaaagaggcgctggacctgggccctcggtggagccggctggcagaaggcctgtgtgagaagctagctggccgcctccttacccaaggcagcccctagcagggagctgagcaagatcccaacaaactggggtttcatcgcagtctgcccgtgtcaggaccgcctctacctcctgcccacccccctccccagcccggctctgcctgccttatatcccccgtgccttgagctttatagggctataaaaaaggaagaaagagtctcccccagcaggcaccaagggccccagtggggacagggaggggccccacagcatgctctcagcatcctctggagtcctcaaactcctttatcctcagcagcagtctgtggaccaacaagaacccctgaggatccctgataccctttcacagggtccttgagggtcctccttttgcaactatctgtgtaaggtcagattttcttcatatactggacttcaacgaaaacaacatatcccaacagactgaatgcagaagcagataggaaaacccaggcatctcccacgaagcctgacactagattcacaaaaatgtaaagcaatgctcagcttctcactgtgctgtggagaaataatagttatttttcacaaaactgtattttgttagcatgtaatactttattatttttattgtttaaataaatcaataaatacctactttaaattttctgttttaatttttaatgtagtaaatattgatataacctcataaagaaaagctcttcagagtcttaagtaactttgaaaagtgtaaagaggtcctgagatcaatatttttgaaaagagctgctctcctgggcacctgtgtctcccctatcttcactccctgttcctagtcttactcctcctggtacatgctggctctgattccccagatgggccttcctccttcccagtctcttcaaccccagccttccaggctgtatcaccacccccctaccccaaatcccatccatgccttcctttctagtgatttctccccagtgcaagcacatcagcaggccctccagccccacccgtggttatttctttcctccaaggtagtaaagctggcagggataattacagggtaggaatgttgaagcttggggggatcaaagggatctgaagctgggtggggtccgcccttacacagctgggctttgtgtgtgcatgtgggtgtgtgggtgggggtattgttgattctacactcaaacagatccacgccggggctgtttaggagggtgactttgagagacatgaaagcactgagggggaaagacagagaaaacaaagacagagagaagctgagagagccagggagcagcttgagacatggggagggagggggaggagtaggagggaaggcgacagacacaactcaggagcaggagaggaagctaagttacagagacaacatgctgagagagcagaggagaccctccaggcaagggcagactccttgcaggggcaggctgggggcccccgctgcctgctgggtcaggctggtgaatctggtcatggttccgccccccagattcactccctaggtgtgtttgtttactggttcctcactgtcttgctcaaatgctccaactctacaaatcccgggatctcggggtgcagatcacctctcccagattcctgagcctgtgtctggccatgggcacctccagcatcttcctctgcgtgctgttcctctgtggggcactgggtaagggtgggctggggaaccttcagtggtcagggggctgggggtggggacaagggcatgtggaggaacctgagggctggggaggagaggggtgtgggtgctggaagaggccaagaagagagctgggggagtgggggacttcagggagaccagccactgggaaggccagcctgatgaggtgggaaaggaagagtttcctttcaaggcatttgagaataactgtctcccccttgctgcatctttgatccgcccctgtctcccctatcccttatttcacgtgttgcttctgtgctgggccctttggtcaatgtcaatttctattttcctatctgtctctggtgccatttacttaactttttcactgaccccctcaacttycctgctgctgggtctggctttttgtctcactctttttatgttggtctctgattcttgtggcttctgttcatgtctgcgcatctctcaatccctgtacccctcttgcctccatctctgtttcttttcctgcatcgtctccctctttttttttgagacagagtctcgttctgtcacccaggctggagtgcagtggcatgatctcggctcactgcaacctcagccacccagattcaagagattctcctgcctcagcctcccaagtagctgggactagaggcatgtgccaccatgcccggctaattttttgtatttttagtagagacggggtttcactgtgttagccaggatggtctcaatcttctgacctcatgatcagcccgcctcggcctcccaacgtgctgggattacaggcgtgagccactgcgcccagctattttttctacttctgtcagctttcctcccttattccacagctttcctctctctgcttcatgtgtcacctctctctgtgatccctctccggatctggcctctgcctgccccacagggagggtttgcctctcctgctctcctaatctctgctgcctcaacaggtctcaccatgtcccctgcccggggarggctccgctgctacatctgtggcttcaccaaaccctgccaccctgttcccaccgagtgtcgggacgatgaarcttgtggcatcagtattggcacttcaggtaggactctggtccaatggcccttctccaggaggctccctacctccatccatccrgcctttcctgtggcccccgcctcagcatgcctctttcatcccacagaccagagtgagatcactgagtgaaaaagctgcctctcaagggcccagtgccctctgccaggctatgccacctactggctgcactcctacactctgtggcaccactgctgcgagcaggacctgtgcaacatagccgcttccccacagcagctcaccagcctcctcgcctccctgcccctctttgtggccagcttcgctgggagaggacacctcctccactagcttccgtggatctgcagcccccaacccaggataccccccgccatcactgcggccctggaaacacctgcacagacactttgagacatgcccgagaacctaattttgtacagagaccccagatctctcagcagacccctcacagacccctcacaaggcctggggaggcacctgcccagagtccaacctcataaagaacacctattctgcgtcttttgtcttttctagatgcccattgctgatgccccgtgtcagcccaggtcactggcaaggcaggcattttgatgacactgtggatctcaggcaaggggatcaaaggagcatcaggtatggtaaggaggagagtcttgctaggaaagactaatgtggtaggtcgggaactcaggatggagggcttgggggactatgaagagtacctttaataaaaggtctatctaggagtccagtaatactgcagatactgcagtgtgtgtgtgtgtgtgtgtgtgtgtgtgtgtgtgtgtgtgtgtgtgtctgtgtgtgtgtgctctaagagcaaactgtagctgcttggtgggttgggctggagctggaacctggaccacggcactcccctcattctccatctgtgtcattttcgtcctttttcttgccaatggcttagtttaagcccctgcagcctgaagcctttaggtgagacttctgagaaagcttttttccagtaaggcccaagcttgagcagagacacaaaagggcacccagtggagctgcttgtgagggtgtggctggagctcagctcatttctgcctgagactagggaatggccaagttgggagcatcaatatcctccctcgcttcaccagcccagactcgcccatggttcacagacatcccagcatggccccggcccaataaataacatacccccactgggcctgccagcctgagtagacactccctctgcccccgagaaatagggtgtgacctcagggcagcaggaaggaagtgccagagtggcgatagctgctcacatgctctgaatgccccggtaaggcgccacagggaagagtgtgtgcctaggataaggaaggataaggagggggccccgggtgggagctgagcacaggcatctctatcctgactcagttccctccccttgcatgtgaggaagtctggggttgattaaatatgcctgttccctctcttctttgtgaggatgagacatggggtagtgggggtctggcttaatttagagatgggttgaggctttccattttctctgtccctccatcctcccactttgtgcttctatttttctccctctgtccatctctttccactttctctgacttgagtctcttcccttctctctcttcccccgttttccccatttgtccttcagctccactgcaatggattcctcaccattgctcaagtctccagattcctgtctcctccctgtgcacacccatcctccttgcccccaccagcaacctcaggctcccctcaaccccacagtactatgggctcagggccatccctccactgctgctacaagacaggagaccaaacctttttgtaggttacatcacagaataatgctcctcctttccttcagtcccccacccctccccatacacagcttggtggctgctggaggccagctggatggtgaagtcgaactctcagtcccgccccccttgctaaggttgtcgaggaatcttccaggtgccagatggccagcgagacagcaggtcacacttcccagcagatgtcaccaaaatcacctgggcttgtgggcaggtgggctgtggggttttccagagagacagattaaggatacctctacttttcacatcctcaggaacgagggcccatccccaacccaacccgtgtttcctctccatccccagtcccctccaggatttaagcctctgttccctagctgttcctcacccaagacgggccaaatggatgttctcatagacctggatttcgggtttgaactgaggaatcgaggcatctggggagaaggagccatcagggatacagaagagaagtcagcagacaacttagagccgtgttcctcgccccctcccctagaggaggtggggtacagaggcggggtgtgagcctagccctttgcctcccacccatgtgccctcttctttccccggggagggagggactcacctctgcctggagccccacggaccctctgcctccagagcacgatgctgagggccaggatgacaactccctggcccattgtgagcagcagcatcagaatccaaggcatgtcccagcccgtggaaggggcacagagggcaggagaagcatcgatggaggctgtagtaagggccagaccagagggatgggagggaggtagtgaggggccctgtccctgtgccccaaagagaggcttcccctccacagtctggtgggctcttccaacagaagactttgtaagcttccctgcccacaatatcctccaccctactctgcccctttccaggcctctcaccctgacccatagagaatggcggccaggcacagtggctcatgcctgtaattccagcacattaggaggccaaggcgagcagaccacttgaggtcaggagttcaagaccagcctggtcaacatgatgaaacctcatctctactgaaagtataaaaattgaggccaggcgcagtggttcacacctgtaatcccagcactttgggaggccgaggtgggtggatcacctgaggtcaggaggtcgagaccagcctgaccaacatggtgaaaccccatctctactaaaaacacaaaaaagaggccgggcgctgtggctcacacctgtaatcccagcactttgggagaccaaggcgggcagatcacgaggtcaggagattgagactatcctggccaacatggtgaaaccccggctccactaaaaatacaaaaattagctggacgtggtggcatatgcctgtaatcctagctactcgagaggctgaggcaggagaatcacttgaaccagggagtcagaggttgcagtgagccgggattgcgccactgcactccagcctggcgacagagagagactctgtctcaaaaaaaaaacaaaaaaacacacacacacacacacaaaagttagccaggcgtggtggcaggcacctgtagtccagctactcaggaggctgagatgggagaatagcttgaacccaagaggcagaggttgcagtgagccaagatcgtgccactgcattccagcctggccaacagaacaagtctccatcccaaaaaaaaaaaaaaaaaaaaaaaaaaggccaggcgtggtggctcacacctataatcctaacactttgggagactgaggcaggcagatcatgaggtcaagagatcaaggccatcctggccaacatggtgaaaccccgtctctactaaaaatacaattttttttttgagatagagcttcgctcttgttgcccaggctggagtgcaatggcgtgatcttggctcactgcgccctccacctcccaggttcaagtgattctcctgcctcagcctcccgagtagctggggttagaggcatgtgccaccatacccggctaattttgtatttttagtagagacagaatttctccatgttagtcaggctggtcttgaactcccaacctcaagtgatccgcctgcttcggcctcccaaagtgctgggattacaggattgagctaccatgcctggcctaataataataaaataaaataaaataaaataaaaagtagagaatggcaatgccccctgctcacgcatgggcaaccaactacagagcagaccaccagccataaccacactttcccctcacaccctttatagtaattcaccctttctttcaagaaaaaatagccagatgtgatggctcatgcctgtaaccccagcactttgggagaccaagataggaggatcatttgaggccagtagtttgagaccagactgggcaacatagcaagatcctgtctctacaaaaaatttaaaggtgcggtggctcatgcctataatcccagcactttgggagactgaggcaggcagatcactagaagtcaggaggttgataccagcctggccaaaatggtgaaatctcgtctctactaaaagtacaaaaaattatccaggcatggtggcgggcgcctgtaattccagctacttgggaggctgaagtgaaagaacatccctttccgtctccttcctcagtttacctgccaggctaaagctgacccctttgttgtgagtcatgaggcagcggatgattcttggtcttcggctcctgggctcagaaagcccctccccaggacacaccaagagcagggcagcctcactgccccagaaggactgaacacggcccctcacgggacccttcccttcctgccaggtcacagagtccatgcgtctgctggggaccacagagcacaggaggacattgcagggggatccatctgcagcccttgcagataactgggatcctgtaggggagagagggattcctcagttcttcacctggacttcctgggccacagtagcccctggtctgcatgcccccactcacctttgagcaccaagacgtcgtacaccctccagttctggtagttgtggtgctgacctagcacagcgcaccagtaccgcccggcatcttcctctttggatccctccaaccacaaagaatagttccccagcagtctgagcctggattcccttcctggttttccagggtctggggctggcctgcccacttggacttgggctaccagggtggtgaaggagcctgctgcagggctgcagaaccatgacaggtgttcgtccccatgtagagtaggtggtgagggacatggcagctctactgcctcccccaaggccacatagatggcctgcatgttgtctgtgggaagagggttgtatgaggccagagacctccatcagatcaataaccccccatttgatcttcaaccctggcttccttcccttctggggtcccccagcacaggcctggctggtgaccacatttctcaagtgacagctacaaaaataagacaggtggagagaagagggtaagggctttcctcctctctcccccagccagtgagggggtctgagggcaagagggaaaaggctgaaagttggcaaatgcccacatctcttctactcatttctacttttctggaagcatttactcattcttcttattttataaaggaaactgcataacctggaccctcgttgcctctgggtcttccctagtgtcagaggcaggaggaggttggttggggtaattctatcttcttgagtcagatgccttcgccaggctcctaggagaaagagcagtagtccctccccaaccttgcaaatagctaaggaatcccgtacctcttgccccttacctgcagcctggggagttccacataggaacaggaggaggaataagactgccatggggagagcctgccaagttctcttgctccaagacctggtgtccccagggaggaagcagagtccagataaaggcccacactcgctggtctggagtgacaaggggctctggaggggatgggaatgctggggcgataaagcccagcagcatgtctactagggataaagtgaccaccacttttctatcctggagagaaaaggacccagcccaggccactctgaagatgacctttttgctcttctgattccacatcagctaaggggctcaaataaagactttccatgcaaaaaaccatgcagagaagtggtcctgcctgtctagctcttgtcagtctggaagtacattctgaggtctctttcactcctaagaaaggtcagccatgagttgggtggatcacttgaggtcaggagttcgagaccagcgtggccaacatggcgaaaccctgtctctacaaaaaatacaaaaattagccaggcgtggtgacatgtgcctgtaatcccagctacttaggaagctgagaggcaccagaatcgcttgaacccgggaggtggaggttgcagtg

SEQ ID NO: 10905 - DNA, 15091 bp, Homo sapiens
tgtggagaggttctgagactcgaacacttcctctttcctctaggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggtgagagagggcaggaactccaacaccaagcaccatcagagaaaagagtttcaggctttcctagtgggaggaaggaagggtaccttctctagaagcctgggtggggccactctgagctggctggaagagtggcctggctcagcctgaggtctcactcccctctccccactccatgtcttccctgtgcaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttagactgggctgtgactggtgtcttactggggcaaagggatagggcagggctgaaacctgagtttggggtcagtgcagggaagaaggcctcttattcaaaaatcttgttaggtacttatcaactcattgcccaaccatgtcataggtacttgagcacaagatgaacaagacagaatttctatcatgggaagtgtgtccagggcagagaaaagagtgtatgggtggattgctcactgaatttatctaaatgttagatgattcagagactggtagattaccagtccacccctatttgataaagaaaaagaaatgacacttccagggacattcattttcattcattcatttaatgaggcttagcaatgatatcaaaagggtcagtctcctgacgttggggagctcacagtacatgcaaatttcttacaaattgaaatacaggttgtcatggaacaatttacagaaggctgtttctatgagggaaataaagggggtgtgccctagggcatcaaagtatatgcaaggggtggccaaggagggtcaccttcccagaaaaggccatacttgaactaaggataaataagaattagccaggcagatagtgtgaaggagggaaaggggtaatacaggaagaaggaattgcactgggcaaagacattttggggctagggagaattctctaaggctggcattttctaagatgtgcatgtggaatgacacaggtaagcctggagagtggacaaagtgctgtagtaccttgtatccaaagccaaggcacgtgggcacagagctgaagctaaggagagtacttcagttctgtaataagggctgtcaggagcagttatctcttgagtaggatctctctgacttcagggaggaaagcaagggtaggaggatgaggtggggctatgggtaatccaggaaggaagtgagcagagtacattcacgtggcagcgctgggcatggaatacagtgtgggtttgacagtgatgttaagatagaaagactggacttcatggctcattgtgtgggagtaagagagaaaggaggtctgcgtgactcccagtttctgggttgggcaactgggttgttaaagagaatacagaggagaattaagtgagcagcttcagagatgacaatgagttgggtttgacattcagagtgcgaaatgcctgaggtcagtcaggcagaatgtctaagtggaagtttgttaatcccaaatctgagatctgagccagagagagttctgagtgtcatttgcagaggagggggctgaggactgactgttgatgagagtgtcccagaagaagagaaagggacaaacctagaatggtgggaaatactgtagggatatggagcaaggaagaggagtccaaaaagaaaacaccagcaacaaagaaaaacagcttaaagaatcaggccgggcgcggtggctcacacctgtaatcctagcactttgggaggccggggcgggtggatcacgaggttagcagatcaagaccatcctggctaacacagtgaaaccccgtctctactaaaaatacaaaaaattagctgggcgtggtggcgggcgcctgtagtcccagctactcaggagcctgaggcaggagaatggtgtgaacccggcaggcggagcttgcagtgagggagatggtgtcactgcactccagcctgggcaacagagcgagactccgtctcaaaaaaaaaaaaaaaaggagctagggcttgattgggtatagagaggacactggtggtgagggagacatggaggttataggagagatgggagtaagtttagaagtaagaccagtggcagagacagcctggaacccaggtctcccaactcccagtctagcacttatttctataccatggtgccttcctcttccaggtgaggaaccaaggaggggagagggattatggggagctgggatcccctagcttgggaggtttggagtaagggcttcccttcaaactacaactgcatagatggtggaggcatcagcagggtccgctgtggacagccggcggggcctgctgagggctagatggtccagatccgcatagagcaggctctggaggaggaaggggaggaagacaagatggtctccacagtcttccttggggttcaggcctttttttttttggtccattttcctcagagattctggctatccccttcccatccccatgcccttaccggttcctggtccaggtcccctggaatcttgggctcttcctcctttactggcctctggggctcggttttcacaagtggagctatgtgggggggacagagctgaaggatggagagaaggtgaccaacgtgtctgctcccagcaagggctcagactcaggaattgaggggtggggagtgggcatgtaggagaaagaaaatggggtggaattagtctcaccaaatctagggagtggtcgaatcggttgcgggggcaggcgcctgtaagggacatatgagtctttgagaaccaccagtcttgtctcactggttctcctgggactcgccacgccaaggacagcccagcaacttgaaggctcagaccggaaacaacttagactctaccccaccgacagtccagcccaggctctaactctgctgcacttccagctcatctgctctggtggggctctactcaccagccagcggcctcgctcccacctttgacctctcccattcttcgccaagccaggaccagagctctaggtctagctctttcttttgcgaaggttctggtcctgccccttccacctctggtcactccccatttaacgaggccgggtccctcctgctcacctgtgcagccaccagaccaggcccaaagctcccagtccgagcaccaacccagcgcccagcagcgggatcaggagctggggatacacggaccctgggggaaaggcgtggcggggagggatgctgaggtcaggggtttgacgagggacagccagcagtcccgctcaagaacccccagccaaggccctcttccctcctccgggtatgtgtcggagttaagtacccttgtgcgcacaggcctgcacctaccatgggtaggcccgggggccttgcaataggtcctgtcccccagcacgtgaagcactgtacggctctcgtcctcgtggcggcccttgcagaaaaaagtgcccgagtcccccgcgctcaagaggagctccagccgccggataccagagtccagggagcgtaggcggccgacgaaaggctggaggggaggcacggtgggggtcccgctcgaagaggcccacaggatcggtcggcgtcctttggacaggcccttgcaggccgggaagctgggtgcccagacccagcggatgggatgagagactcctccgcaggagagattcacccggtccccagggcggccgtccagagaagctaggagaggccggaggctgtggttagggcacgtccacagggcaagacgaccctccatcccgtctcctctttctcttctctgttctgcactccagccatcctggatcttcccacacacaacccaccctactaggcggcccttatcttgcttcagcccctctgcgtctatcacaactctcccagggatcgcttacccccagggttcccttgggccctcgagagcagcagcggtagcagctgcagaaacacagccatggttaggatgtggtgaggagaagctgcgagcgaatcagcggcgtggggccggttggggggggaccggagggaagttaggcgtggggagaacggaggggctggggggctccgataagagagggggcggggccaccagctgcccagatccctttgggaatcctcgcaggcaaactcggagtcttcaaatggttctcacttaaaatgtgtgctcgggccatttacacaaatgctttggcctgcttaacttttcaggtgcgcctgtaatcccagctacttaggaggctgaggagggaggatcgcttgagctcaggaggtcgaggttgcagtgaactgtgatcaggccattgcactccagcctgggcgacagagccagccagaccctgtctcaaaaacaacaacaacaaaaactcctgttttgtaggggattgtgataacgaaataaagtaatacatgtaaactgcttagaatacataggatcactatgtaagtgcttgccattattattactatttctattcttttttttttttttttttttgagtcagagtcttgctctgtggccaggctggagtgcaatctcgactcactgcagcctccggctcctggattcaagtgagtctcctgtctcagcctcctgagtagctggaactacaggtgcatgccaccacaccgactaatttttgtattttcagtagagatggggtttcaccatgttggccaggatggtctcgatctcttgaccttgtgatccacccacctcggcctcccaaagtgctgagattacaggtgtgagccaccacacccggcctactatttctattcttattttagcttctacctcacctctctgtgcccatgctgttcctcctggcttggtaccctgcccaagttggcaggttttgactggggaggtgctttggagcaggtgcacacagccacacctaggacaattgctgctgctggactggagcaacaaggccacaccaagcgcaagtggagcacgggtgacatcctgagaaccttcatgggagcctgaggcagccctacttagcagacctgtggtggctctcctggatgagtagccccagcccctgcctctgctgctgtggcatcacagaagccatcagtgagtcacttattgctgagcaggcattggaaagaccgagtgggggctgaatggagattaatttgacccattcctcccccaatttccaccagcatgcccctatcaatgcccagcagggacccagggacccaaattcagcaattaatttgggccacatccttttgtccattttccaggaaccagcagaagctgccaccatggacactgtaaatcacagaggcctttgatgatgctcattcagaggactgagcagcaggactcttagctggggaccaggaagggcatcttggcctgaaaccaagaaccacaatggcattggccactagtggcacctgccttcccccatccctctctcccatccctactccccactcagtcctgctcagtgccttcccaccccttgtcttttctctggtcagctgcgtagtaagtgagaagggaggggctaccagaggcagggaagggaggagcctttgggtttataaattccaaaaaggccactcaactcctagagctggatccttgaaaatctactctatcagctgctgtggttgccaccattctcaggaccctcgccatgaaagcccttatgctgctcaccctgtctgttctgctctgctgggtctcaggtgagcacctgggggccccaaagacctggtttgcctggtcaggacctttacaccctgctctacccacttcccggccctacccaccactcgggatcccaacacccccagccccaactggctcagctctcctgtgccaccaagaccaggcttccctatgacagcctccttgctctatttctcaaaaagccaggtctccatccatcctccccacctccaagaaagacccatttctctcacctgccagggctctgggtcccctgttccccactccaaggtgtctcctccttggaaactctggtatccagttccccaaccagccccacttcaatatgcaactctccagagtctagcttacctgccttctcctctatctgctgtgctcagtaaggtgtcctctcgaagacctaggcatccagccccaggctccttttgtaacctaccctccccatctactccatcagggactcacatgttcagtctctcagccatggcctttcctagataccccctactcccctcctgggttgcatacctcctcccatacaggggatacaaactttctagatggttgcagtgacatctaagagcctccatggaaacagagcgttttcttgagccttctgaagaggggacaactgggccacttacctccagggtgaagtggatttcactgaggtacacttaccaggctcttccaccctcggaccctgcgtcaccaaatcttgcctgcccaaaccttgaattaactgaagcaggaaacttggggtgccaccttctgtatccaccctctccattttgataaggtgctaagatggaatctggtgatctgtctctcaggtatcattcctttctgctgaagagctactggggtgagaggattctattcwggtctggttcctcttgccacactcttgccagctccaggaggtgaagagtaaattgtaaattgctaaagctggccacagatggctttctcgccagcctcaagttccaaggcatttctgacagtgttgtaaccctcatgattttcatttttattatttctccttctttcaagtttccatctcctccttcaccatccacattctttccccatggtatcttcctcacattccatctatctccagccccatgtttttcttcatagttctgtccctcttgactcacctccaaacggggtggagtgayggaagatatgtagggcrtgggcctttcacaaagcaacagctctacccttacctgccgcccactttccattttccctgcatcactcacctgctctgtgcttgctagaccaaacagccaaacaggttggagcacctacgggatgggctcttctccaccctccacccctgcccccagctcagcttatccccaggtaagtcagagaccccatcacctcagcctgacttgtgtcttcccagctgacattcgctgtcactcctgctacaaggtccctgtgctgggctgtgtggaccggcagtcctgccgcctggagccaggacagcaatgcctgacaacacatgcataccttggtaacatccccttccttagtggggtgaacagggaggtgggagcctctatgaccaggactgaggcccaaatgggtctaagactgagatggagaagcagaggattatagcaatgataatatttggccaaagatggttgtgtgccaggcaacatcctatgtctttgcatgcctttttttcaattaatgttcatgacaaccctgtgatgtgggtgctattattatactgagaaaacggcctcaaaaagagacagtaacacagccgggcatggtggctcatgcctgtaatcccagcactttgggaggccaaggtggttggatcacttgaggtcaggagttcaagaccagcctggccaacatggtgaaaccccatttctactaaatatacaaaaattagccaggcatggtagtgggcgcctgtaatcccagctactcgggaggctgaggcaggagaatcgcttgaacctgggaggcggaggttgcagtgagctgagatggcaccactgcactccagcctgggcgagagtgagactctgtcttggaaaaaacaaaaaaacaaaaaacagagacagtaacaggtccatggccagcaagtgatagaaccaggactgggggagtggtgggtaaggatgtgcagaaggaagatcagactaagaaaagagaaggggagggccagggacagagttgggaaggaaggaagcctaggtgggtggatggggtggggaggtggacacaggcatgccaggtgcccatcctggccgattccctgcccattcccacccctaggtaagatgtgggttttctccaatctgcgctgtggcacaccagaagagccctgtcaggaggccttcaaccaaaccaaccgyaagctgggtctgacatataacaccacctgctgcaacaaggacaactgcaacagcgcaggaccccggcccactccagccctgggccttgtcttccttacctccttggctggccttggcctctggctgctgcactgagactcattccattggctgcccctcctcccacctgccttggcctgagcctctctccctgtgtctctgtatcccctggctttacagaatcgtctctccctagctcccatttctttaattaaacactgttccgagtggtctcctcatccatccttcccacctcacacccttcactctcctttttctgggtcccttcccacttccttccaggacctccattggctcctagaagggctccccactttgcttcctatactctgctgtcccctacttgaggagggattgggatctgggcctgaaatggggcttctgtgttgtccccagtgaaggctcccacaaggacctgatgacctcactgtacagagctgactccccaaayccaggctcccatatgtaccccatcccccatactcacctctttccattttgagtaataaatgtctgagtctgataaaatgtacatttattataagaagacctaagggtcaggtcacctcccaggaaataatactctcaatctccctcccttacacaggaatccttcagggaggttccctgggaggctgggctggggaaaatggagaaacaggtttttcaggtcttcatcctcccttccagtgtctccaggtggcacacaacaactcatatcctaaatttaggccacacccctgatgtattgccaagaagaaggtgcggcctggcttgagggctctccagaaaggataggagaggtacatggagatggggcctgagaccctgtttcttcagtttctctcaggttagagtcaaaggcctcacctagcctagttagtaagtagggcatcaagcagtttttacctatcacagtttttacatttcttttctcaattcaaaatagtcctattgggagccaacttgcaaatgggaaataggggagcaaacccagactcaggctcacaaaaccctggcaaccccactcaatgaatctcattgctaaggaagattcaacccagcaacaggatccaggagccacagaaggcagataagccattgccctttggggtttagttggttaaggagtgcaccactgtaattaagcccgctgttgcttggtaacccccaaactagaacctggatgccccatattacgcttttagccctcccatcaaccaaagatagatgtaattttccagtcagctgtagagtggttcatagattttaatgactcacagaaggatgtttgtcttctcacattagatgttcagatgtcccttgttcccttgctcccttgttcccttctctactcctactccccctatccgctccacagtcctggcaagagacaggtcagggcggtagctgctgcagccaaaatgcctgcaggggccacatggcttgccacggcgctgttgcacaggtctcccaggtagcagtccctgtgggctggataagtcacgtctcccaccgactctgtctccacttgattgcaatgatgggctgcgacgcaggctggatgttggtgaatcaaggtcactggggctgagagagagaatgaaactggggtgttggactcctggcttcaggacttgccttctggggcagagcagatgtgatttcaaggagcccaaagggattttcagccccctcaaaaaacacctccctgaaaccaagtgatcaaagttaatgcattgaccttgtaaactcctgatgtgatgcagcaagaaggatgcaacatcacttctgcagtattcttgcttaaaatgcatgacctcaatctcatcatggcaaatatcagataaataaatatcgagggacattctataaaataatttttagtatttcaagtatctgtaattttttttttttttttgagacggagtttcactcttattgcccagctggagtgcaatggtgtgatctcggctcaccgcgacctccacctcttgggttcaagcaattctcctgcctcaggttcccgagtagctggtattacaggcgggcaccactacacccggctaattttgtatttttagtagagacgagatttctccacattgatcaggctggtcttgaactcccgacctcaggttatccacccgccttggcctcccaaagtgctgggattacaggcgtgagccactgcatccggcacgtaatttttgtttaatctaaaaatgattttatttaattttagagaaaagatcttgctctctcactcaggctggagtgtggtggtgcaatcatacctccctatagcctcaaactcctgggctcaagtaatcctcctgcctcagcctctcaggaaactgagattacaggtgtgtgccactatgcctggctaattttttaaaaacattttttgtagagatgggggtctcactttgctgcccaggctggtgtcaaactcctgacctcaggtgactcttcagccttggcctcccaaagtgctgggattacaagtgtgtgccaccaagcctagcctaaaaattattattattattatttttgagacagggtctcattttgttccccaggctggagtgtagtggcgtgatcatggctcattgtagcttcaatctcccaggctcaagcgatcctccctcttcagccccctgagtagctaggactacaagcatgtgccaccacacccaactaattttttaatctgtttgtttgtttgtttgtttgttttttgtagagacagggtctccctatgttgcccaggctggtctcaactcttgggctcaagtggtcctcccaccttggcctcctaaagtgctgggattacaggtgcgagtgactgcactggccctaaaagtaattttttaaactccaggtataaaataatttatcagggctcttcaaatgtgtcagggtcatgaaagacaaagaaaaacagaactggcacagatcagaggagactaagaagacatgagagctaaatgcaatgtaggatcttgctaaatcaaataaagtctgtagattagttagtagtattgtatcagttattttgtgattttgataattgtgctatggttatgtaagatgttagcattaggagaagttgagtatttctgcaacttttctgtcaatccaaaattatgttaaaataaaatattaaaaacatgtacacacacacacacacacacacacacacacacacacacccctccctggtccttaactaatgccgaaaatttgaagtttggttttaactttggcctttcagggccagagctcttcatttgtgagctaatgggcctatgagattcttttaggagaataaggaggtggggaagtgggggcacaaggactgtgggcctctcaggggctccgtgccaggagccagaaggggtacagactgctctcctctaacagctgcaccatctgcccagagccagactgagcctggagggttctggaagccagaaggattgacatggggctggaggcagggaaaggctgctggaagagggagaaactgaggactcacggtttccaggtagcttgatctgttccaggcctggctggggtctgccctcgccacaggtggtcacggcctctttgcaagaactgctggggcttccaccacagttgtagcaccgcattcggtttcctggcaggagaaaagaggcgctggacctgggccctcggtggagccggctggcagaaggcctgtgtgagaagctagctggccgcctccttacccaaggcagcccctagcagggagctgagcaagatcccaacaaactggggtttcatcgcagtctgcccgtgtcaggaccgcctctacctcctgcccacccccctccccagcccggctctgcctgccttatatcccccgtgccttgagctttatagggctataaaaaaggaagaaagagtctcccccagcaggcaccaagggccccagtggggacagggaggggccccacagcatgctctcagcatcctctggagtcctcaaactcctttatcctcagcagcagtctgtggaccaacaagaacccctgaggatccctgataccctttcacagggtccttgagggtcctccttttgcaactatctgtgtaaggtcagattttcttcatatactggacttcaacgaaaacaacatatcccaacagactgaatgcagaagcagataggaaaacccaggcatctcccacgaagcctgacactagattcacaaaaatgtaaagcaatgctcagcttctcactgtgctgtggagaaataatagttatttttcacaaaactgtattttgttagcatgtaatactttattatttttattgtttaaataaatcaataaatacctactttaaattttctgttttaatttttaatgtagtaaatattgatataacctcataaagaaaagctcttcagagtcttaagtaactttgaaaagtgtaaagaggtcctgagatcaatatttttgaaaagagctgctctcctgggcacctgtgtctcccctatcttcactccctgttcctagtcttactcctcctggtacatgctggctctgattccccagatgggccttcctccttcccagtctcttcaaccccagccttccaggctgtatcaccacccccctaccccaaatcccatccatgccttcctttctagtgatttctccccagtgcaagcacatcagcaggccctccagccccacccgtggttatttctttcctccaaggtagtaaagctggcagggataattacagggtaggaatgttgaagcttggggggatcaaagggatctgaagctgggtggggtccgcccttacacagctgggctttgtgtgtgcatgtgggtgtgtgggtgggggtattgttgattctacactcaaacagatccacgccggggctgtttaggagggtgactttgagagacatgaaagcactgagggggaaagacagagaaaacaaagacagagagaagctgagagagccagggagcagcttgagacatggggagggagggggaggagtaggagggaaggcgacagacacaactcaggagcaggagaggaagctaagttacagagacaacatgctgagagagcagaggagaccctccaggcaagggcagactccttgcaggggcaggctgggggcccccgctgcctgctgggtcaggctggtgaatctggtcatggttccgccccccagattcactccctaggtgtgtttgtttactggttcctcactgtcttgctcaaatgctccaactctacaaatcccgggatctcggggtgcagatcacctctcccagattcctgagcctgtgtctggccatgggcacctccagcatcttcctctgcgtgctgttcctctgtggggcactgggtaagggtgggctggggaaccttcagtggtcagggggctgggggtggggacaagggcatgtggaggaacctgagggctggggaggagaggggtgtgggtgctggaagaggccaagaagagagctgggggagtgggggacttcagggagaccagccactgggaaggccagcctgatgaggtgggaaaggaagagtttcctttcaaggcatttgagaataactgtctcccccttgctgcatctttgatccgcccctgtctcccctatcccttatttcacgtgttgcttctgtgctgggccctttggtcaatgtcaatttctattttcctatctgtctctggtgccatttacttaactttttcactgaccccctcaacttccctgctgctgggtctggctttttgtctcactctttttatgttggtctctgattcttgtggcttctgttcatgtctgcgcatctctcaatccctgtacccctcttgcctccatctctgtttcttttcctgcatcgtctccctctttttttttgagacagagtctcgttctgtcacccaggctggagtgcagtggcatgatctcggctcactgcaacctcagccacccagattcaagagattctcctgcctcagcctcccaagtagctgggactagaggcatgtgccaccatgcccggctaattttttgtatttttagtagagacggggtttcactgtgttagccaggatggtctcaatcttctgacctcatgatcagcccgcctcggcctcccaacgtgctgggattacaggcgtgagccactgcgcccagctattttttctacttctgtcagctttcctcccttattccacagctttcctctctctgcttcatgtgtcacctctctctgtgatccctctccggatctggcctctgcctgccccacagggagggtttgcctctcctgctctcctaatctctgctgcctcaacaggtctcaccatgtcccctgcccggggaaggctccgctgctacatctgtggcttcaccaaaccctgccaccctgttcccaccgagtgtcgggacgatgaagcttgtggcatcagtattggcacttcaggtaggactctggtccaatggcc

SEQ ID NO: 10906 - DNA, 19486 bp, Homo sapiens
ttatgtctgtttccctctggtcagccattggagggaggagaggggctgtggatttcttgaaggcgtcccactcacctgagggctggggtctaggaggttgtgaaggcagcattgggagccatgcccccatccccacagtgcggggctagcaggagaggaggaggtagatctcattgtacacatccgtcttctggagagaacaacctctcctaccatcccttccttctacaccttctctgcctgtcataggtggctgcaggaggggtccacgttgggagggacaggtgagctggcctttggtgctgacacactcctgactttgccctttctcctgcagggggtgccattcccgcagaatgaggctaatgccatggatgtggtggtccagtttgccatccaccgcctgggcttccagccccaggacatcatcatctacgcctggtccatcggcggcttcactggtaccagcctccctcccatcccccactgtagacacattcatgaccacccagccccacccgggagaggtggggaaatggggtggggtggaggctcaaggaagaagagagaggaagtagaatctctgagtgggcctggaagaagctatcctatttgcatacacttcacctttccttcccctcttgtgcccagtcattaaaaggaaaagcagacccaggtcctgggtggggagatcagggaaagtgaatgtttcctgcccattatcttcagtgcactatctccagtgttctatccccatcctctccagatagttccctaaccaagtgaagtaggttaagaaaaaaacaagggataacatagggggaatggggttggcctatagggtcagtgggatgagagcatgggtggtggggagaaaggagcctttctcagttcttactcttcttccctgccctggtaccagccacgtgggcagccatgtcctacccagatgttagtgccatgatcctggatgcctcctttgatgacctggtgcccttggccttgaaggtcatgccagacagctggagtgagtgcagctcccaggcctgcccttcctgggaaggggtgggctggaactgggaactgttctgagatggctcccttttcttgggtggggagtaagtcgccccattgttggaagcaggaggactcctttgtctgggggcctcagttttctttctccgtgaatagtgaggacctttatgttgggcaagggctttgtctctgccatcccttcacctttatcccactctagggggcctggtgaccaggaccgtgaggcagcatctcaatctaaacaacgcggagcagctgtgcaggtgagggccggccagcgtccggcattgaacacctgccccccatacagctctgctgggcgctcaaaccctgaaactagtactaaagtgcaagttggtaaaaggccactggctcacatcctgagtgaccctgccaccacctcaactggcctaacccctcccaggtcccctgggactctggaccacctcaggatctggcaaccaaagggttaaggcctggcacggcaggggtctcccagcagggccagactgaaccatgccccttaaataatcccctctcacccctgagtgaagggctaggtcaagggctgtgctatagcaaggggagggtaagaatgctaccagtgcagggataggggtgggccagttgtcacccgtctccctctgagctctcccttcccactgctctgttctctgaagataccagggtcctgtactgctgatccggagaaccaaggatgagatcatcaccaccacgtgagtgcgtgggaatctcggccctcaggaaccccagagatggccaggaacttgtcccttctacctctgcccaccagaaacctgggtatctagacccttcctcctaacctccagcccctccagggtacattcttctcacccccagggttcctgaggacatcatgtccaaccgaggcaatgacctcctgctgaagctcctgcagcatcggtgagagccagggtgtgtgcgcgctgggggcagtgtacacacacagatactgataccagcacagggaaggagggaggaaggttcagggatggtgaatgaaaaaaaatcagccctgacctgtcctggcacttcctccgtaggtatccccgggtgatggcagaggagggtcttcgagtggtgaggcagtggttggaggcctcctcacagctggaggaaggtgagaagggatccagtgaggcttggggcgggggcccagcaaggtcaggttgctgactggctgtcatctctctccctgaccagcctcaatttatagccgatgggaggtggaagaggactggtgtctgtctgtcctccgctcctaccaggcagaacacgggcccgacttcccctggagcgtgggtaaggagctcctggggcaggagagagggtgggaagggcctaggaaggggatgaatacccagatgtgtggcctattttgagcgcctcctctctgcaggggaggacatgagtgcagatggacggcggcagctggctttgtttctggtgagctaaggagtgggaagtgggaagggttcttgaatggccagggctcacatagggggactggggataccctataagcattggaagtggcagcttttgtagagtgggtggtggatgcggaagtggagggtggggagggagtccagtggctgcccctcccaacagtgctctgtaccccacctgtcccacctcctttcctcaggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtggaaagtgggggaccatcccccttctcaccactgttcctcttgcacgtttcccctcattcatgtggctgtacttaaccttctccaacatacatcctgcattacatgaatggattattcctaataattaataaaaaggtattttttctactatcaggctaattgtataacttctcaagtgtccagggagccaggggcaggtagtggggagagcagaggccccaaagagctgggctttgggaaaccctaactctagacaatctagctaatctaacccttcccatctctgtgtccccctaggccttcagcccctaacctgagctttcctcaggcagcaggtccccaaacctccccggtccctgatgtgcctactgttatcacaactgtgcagcctccctggcccctcccgcctccttcttcagttcttcctgcatacaaccaccccaggagcccatggttgccccctcctgcttacggctcatgagctttctaggatccgatttcacctacccagtgcttctgctggtttccaggttcaacctgcatggtgttactagcagtacccccaattttcattgctcacctcttgttatcttggtgaagagtgaggaagggcctgctccccacgtcttatgcagcaaaccctgcacacccaccttgccatgtcatcaagtctctgtcctcacagcctttttgcagttcaacaaacacaggccctgccagggacggagggccaggtgccaaggactcatgtcttctcagagccatactttgccttttggacggctctgttaggagaagatgcttaggttgtacctgaggaaattggttccctataactgccatctatctctaactttggaccttgtggaacacagtgaataaatccctcttccacccattggtttgttgcctggcagttttttttatttttttggagatggagtcttactatgttgcccaggctggagtgcagtggcacaatctgagcttgctgcaacctccacctcccaggttcaagtgatcctccagcctcagcccctctagtagctgggattacaggtatgcgccaccatacccagttgatttttgtatttttagtgaagatgaggtttcgccatgttggccaagttggtctcgaactcctgacctcaggtgatccaaccgccttggcttcccaaagtgttggggattaaaggtgtgagccactgcgcctggccgctggccactttcttcatttggaaacttctcttttccagatgaaagaccccaaagtttatcgccctgagtccatttttgttttgttttattttgttggggatggttttttgtttgttttttgagatggattctcactctgtcgcctaggctggagtgcagtggcacgatctcagctcattgcaacctctgcctcccaagttcaagcgattctcctgtctcagcctcccaagtagctgggattacaggtgtgtgccactacacacagctgatttttcgtattttagtagagacaggtttcaccatgttgcccaggctggtctcaaactcctgagctcaggcaatccacccacctcagccgactccattctttttttttttttttttttgagacggagtctcgctctgtcacccaggctggagtgcagtggcacaatctcggctcactgcaagctccgcctcctgggttcacgccattctcctgcctcagcctccctagtacctgggactacaggcgcctgccaccacgcctggctaattttttgtatttttagtagagacggggtttcactgtgttagccaggatggtctcgatctcctgacctcgtgatccacccgcctctgcctcccaaagtgctgggattacaggcgtgagccaccgcgcccggccaactccattcttttgagcaagatacttaacgtgggcgacaatgttctaatgtcctagatggagtctctggctaaatttctgtgtcttctccaaacccagtgcatgaagctcttcttgaaaccccagggcagaggctgtgtgtgcccccattagcgctgcaactccttaagggaagatatactgagtctccactggaagtggagatctgagacttaatcaggtgatgtgatgcctgaaatttggagttagaagaggcaggtgaccacagctccataatgctccaccgttagcaaacaggtggatagctgatactggtgccctctcctctatcccattccaggggggcaaacgatgggaagtgtggaacatgaagctctggagccagctgcacagttctgaatcccatcctcccagatccaacagaagagttaatcccctgaaaactaaatttttgttcagctaagggaagctccttaaatgcaaagaggagctgggcatggtggctcacatctgtaatcccagcactttgggaggctggggcaggaggatcacttgagcctagaagttcaagactggacagggcaacatagggagactccatcagtacaaaaaatttaaaaattacccaggcatggtggcatgcacccgtgttccaagctactctggaggctgaggtaagaggatcgcttggctgaggatcacggtaggttgaggctgcagtgagctgtgatcgtgccaccggactccagcttgggtgacagagtgagactctgtctcaaaaaaaaaaaaaaaaagcaaataggggtgcccagtctcacctcccataccctggggacaaaggacacccctccctggacatggccattagggactctgctgaactgcccctactgccactttcccccatcttactgcatgtaattgtagacaacagtggatgacctgaggggcccttagatacctgaaattgggtagggaaagaaaggtaggctcaacatgtgaattctgaacccccccatccaggggcctcagcctacttcagattactccctatgcaataaggttcagagcagctgtgtttgttttcagaactaatccccacccaggggtggaagcaggcccctgtccactcctcaccctatatagcaaagttccagcagttccaggggatgatcagcagagatgcagaccttcccagttgctggggcgctggaccctgctatactggacacaaggtgaggcctgaaagtccaggcaccctgaggagctgggcaaactagcagaaaagatggcgctgggagaaaggaaagttagactctggacgggaaatctggaaagaagtggttcccagctgggccaaaaagcctcatcctacgccgtctcatcgacctgggctccaccctgagtgcctccagtgtgaggtgctggactggctctgtgctgcctgtttgggttgagggtttgctcctaggagaggcatgtatttctcgtacagctgtcacaagcgagtgagggctccggaggtggagggcccaagagggtggggagctcaggcgtcagtgatagccagatttccatccatcggtccgtccgtccgtccatccatccatccatctatccaatcaacaagccattccggattcttcaggaatccagtcattcatttatatttaggttaaagaccctctctctggttcctctctagaacgcaatctcgagccgctcccccaacaaaccgtggccctctcccgaccgggtcatctacagccccgcccctcgtttgcctggctccattcccctaacctkggcgttctgtcctcaggccccgccttctttgtttcgtcactcggttgcttaccctcaggtatcccttaactctaggtaggagcactcagaagggacaccgtcatctgctgctgtcgccatggcgattattcaacgccctgcctcttcaccccaggaaaaccttcgcggaacccgtcaccatggaaacgaactctctggactcttagcgcgccctgggctggccctgctgggtggacaggagaggagcaaaacgcaacaaagacgggattaattactcggaggccgcgccccctccgaagaaggccccaccctgccccggcctcacccctccccgaaataattcgaggaaatattccgcgaatgctgggtgggtgtcttgccccccggttccctcaaggcccacggtcgcttgaattccacagcaagtcctcccggacctctcagggcaatcccctcccgaagcccagcctcagcctcgcaaagcctctagtcgttggccttttcgttgcgattatattcgagagggagcttcagagggcgccgcgaagttcccctgtgcttcccctttgccctttgccctcttcgcttcaagaggagccctggctctctttttttttttttttttttttttttgagacggagtcttgctctgtcgccaagctggagtgcagtggcgcgatctcggctcactgcaacctccgtctcccgggttcaagcgattctcctgcctcagcctcctgagtagctgggactacaggcaggcgccaccactcctggctaatttttgtatgtttagtagagacggggtttcaccatattgtccaggatggtctcgatctcttaaccttgtgatccgcccagctcggcctcccaaagtgctgggattacaggcgtgagccacggagcccggccctctgattctttttgtctatcactctgtgcactcattcattcaagacatttatgtaggtgccccgcgttcctctgcagttctccactactctggcttttctctaatacaatttattttgtgttattatttctttaagacagagtctcactctgtcgcccaggctggagtgcagtggtgcgatctcggctcactgcaacctctgcctcccaggttcaagagattctcctgcctcagcctcccgagtagccaggactacaggcgtgcgccaccacacctggctaatgtttttgtattttttgatagagacggggtttcaccatgttgctcaggctggttgcgaactcctgacctcgaatgatcccccaccttggcctcccaaagtgctgggattacaggcatgagccgccacgcccggctaatttttggtatttgtagtagaaacggggtttcaccatgttagccaggctgggtgcgaactcctgacctcaggtagtccacccgccttggcctcccaaagtgctgggattacaggcgtgagccaccgcagtccggccctaatatagtttttaaattcattcattccaaggcttttgggaggcgctcagtggcgtgcagtttcctctcgaatttctttcttcccgcagtctttctgggcgggcgtctcccgtctgtttcttcccatcttcccccttatcatcctgggactggataattcttgaatagtctgggaggtagcagggaacccgagttcggagcctcgaccagaacctccagacgggaaattggagcaggtggtgtcgttccaggacgctgaggaccacctcctcccctaacgcacagcccaacgatcctaaaagtaaaaaccctgagtttctgagtcaagactgagctggtggggtggggaccgagtaggcgtggatggggagcccagcgggtccccagcggagaaaatgggtgagacgcctggggccgcggtctccagaattcgcctgggagggagagtggcgctacggcgccgccttcctggggagccgcttcgggctccggatgtccgctggggcccgacgcttgggtcccgacgcgcggttcgcactttccaggtttcttccccagggaacagagcttgagcggggggccacccccccgtcctaccggagttctgaggtgcggtcaggcgcggagagcggacgcccagcgccagattctgtgggctccggagttcaggcccactgagccgcagctgagcacaggcggggcaggaaaaaggatgaggtgagggaaggcgctgggttcctggaaccccaagggagcactgagctgagtacgtatcgcttgggatccaggtgtccttgttttaggatgtctgacaggtgtccccagggtatgagaagtgggactgggcaccccctatttgctttttttttttttttttgagacagaccacatgtttcctatcttggaaaatggtaccacttccttgtgcaagcctacccctgttccctcacccctcgttcagtccaacagcaaatctgtccagtcttctaactgtatctcaggttcattagccccgcttcctcgtccctgctcgtcttctgccggaccagtccgccatcttgtgaccggactcgggaatagcgtcctacttcccggcggcctccactcttgacccaaatgcaatgtgcagccatggcaatcttttataaacagaaatccgatcaagttactcctctgccgaaatccctctggtcagtggtttaactgtcgaggtgctcctggcagcactctgccctccccacatcattgctggtggacttgtctcccctactagactgtgccctgtgagggtggagactttgtgcagggttgtatccccarcatctgatgcagtgattcaataaacatctgtccaattaataggaaagacagttccttttctcattcccctattgctggtcccctgccctcaagcaggatgttatgccccagagtggctgtgggtgcgaacattctgcccctctggctggtctggcactgatttccaccctgagctggtgttgcctctctccttcctcttggccaacctctcttccaccaatataagcccaaactggaggccagcaggcagtcatgcgttttatggcaggccctgcagggagccagagtctgggtcccctgtgcttccacagcagcccccaagccctctacacggtcctcttaatagtgctggtcatgatgagcttggtgtttggtaagtggctccaagggttcagaagggtctcctggcctggatggagaaacccacagacaccaagtgtctgggtacacctgtccaggatgctcaggtaaacccatgcaggaggagagatgggacagatgggtttggtagggaatgcctgctcatggactgatgtgcaatctgaagatttttaaaaatttattattattattatttttgagatggagtctcgctctgtatcccaggccggagtgcagtggcgagatctcggctcactgcaacctccacctcccgggttcaagcgattctcatgcctcagcctcccgaataactgggattacaggcataagccaccaagcccagctaatttttgtatatttagtagagayggggtttcaccatgttggccaggctggtctcgaactcctgacctcaggtacctgcccgccttggcctcccaaagtgctgggattacaggcgtgagccaccgcacccagcctctgaaggagatttctagtgaccaccccagggctgtctcacttcacagcagtgacctgaatagagatactgaaggaatcctctctggatctgagggcaacatagaatagggagggttagggagtgtgctggatgagaaaaccagaatccacaggatagaacaagactgagtccagcctgctgggctccccacttggctgcaaagcaccagccacagagacacaggattcaaagtgttggtttagcactttcctctgcctaacaccaagtgctctgctgggtctggggatttgttaacatgtggtctggccttaggaccagaggaaaagggggatgtatgtgtatgcagttggggaaggaagcagagaattggggctttgatggttttctgagacaggaagggagggaggagtggggctgagtggcctggaatcaggcagtggtagggtgtgaggtagaatggggtgtgagtggggtcagcacttctctgtgttctaggtaagtttgttcctgtcaattgggaaccccctcaaccacttccattccccaaatacctgygctgctaccgatgcctcttggagaccaaggagttagggtgccttctgggatctgacatctgcctcaccccagctggcagcagctgcatcactctccacaaaaagaacagtaagtggccttctcctgtcatgggcccagcactctcccaaacggaaactctctcagcctcctaagctgcaccccaagtcttgttcccataatcccataagacattgctccratcctgtcttttttttttttgctgctctgtcacccaggctggagtgcagtggcgcaatcttggctcactgcaacctccacctcyccagttcaagcaattcttgtgcctcagtctcccaagcagctgggattaaaggtgcacgccaccacgcccagctaattttttgtatttttagtagagatggggattcaccatgttggccaggctggtctcgaactcctgacctcaggtgatccacccaccttagcttcccagagtgctgggattacaggcgtgagccaccgtgcccagcctctcttcccttttcttcagagccacactctgtctccacttccactaaccttctctcctcaatctgtagctgaatakcttctaccctatcaaggtgcgcagctttgacggggaccctccagatctccaggtgcccttgcctgtcctcaagctgtctgcttccgcatctgtctgcagttactgctggtgttgctcttctcctgcatcctccacggcttcttcagtctccttcatggagcgttttctctctgacccttagtggttcatgttcaccaaggtttggtccttagctgtcttcccacttcatatactcaaaagcagaggattttatctgctttgctggcttcaaccagcagccacataccacttccttctgaatctgaatgttatgtcaaaccgctctcctcatatcccgttgaccactggacatctccctcgctgaaaattgactccttcccgatgcctgctcttccaccgaccccccacctttcttaagttagcaaaaacgtaacacataatatgtgctaggcactgttctaaacacttgcaatccgctgaggcaggtattattactatgtgcattttacagatgaggaaacaggtgcagaaaggtcataaccttgcctgagtctcacagatgctgagccagaatttgtgatggctccagagatggtgctctcaacaaccactgcatgcagctgcctgtgttcaagtcctcttactacccttttaacatagccgatgcacagatgtgggtcaaatatcagagtatacaataccatcaaaccaaagtctcccgctactaccctaacccacctggctcccctgcacatgtgaccactttttttactttctggatgatccctcctgcaatcttttatgcacattccaccctgcacaaatatgctgtttactattttttcacctcttcccccgccccaacccaagatagtagcatcccactgtaaacattattccacatttaagttaggggaactgaatgttccgatatcagtttgtaaacagcttccttgttttattgacctgctgtatactactccatagcatgcgcatatcacagctgatttccccatcccactattgatgggcattttggtcatttctctcaagcagggcagcagcaaacatccctgaacatgacttcttgggatgcaggcacaaagatttttctctattatgtataacagcagcagacatcatcttattctcttttggtctgaaaaataaataacaatacacctccttcctgccacccaatctccaaaacatttcccagctttttctcacatggtcctatggtgctagttctcctcacttggctcagtaactcccaactccccctccaaccattacatttcatatggctcttttcctccagccttgcatgggaacttcagtggagttccatggctggtgaacactgggcatgtccacccatgcctaactacaggaatcttttctttttcttttttttttgacttatgagtgtggggatgagaggatttggggctcttcctggggacttccgtatcactggtgcccactgtccctccccaggcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcayaccagccctccttgcctccctccagccactggaccccagccttggctcttcctcttggttgacgcccttcagcacacttactgctactctgtacccccagccctactgcccaccaggtttcctctcttgtcccctagtccctggatgtttctcccaaataaatttgtgtgtaaactgtttggtatgtctctttcttctggtggaggtgaaggctgagggaggtgcacctgcctaactgccctaccatgggtcaggtaagggacccccagctctgctgagctgtcctcttgtcctgccttggtatgtgatttgctctagacacaaaaagagaaagaggaaatgaaagccctcctatggtgaatgccagaaagttagtgggcatcctcggcagtgctgtcagaccagagctgtgtgggggctaggggcgtttagagggctatgttggtgggaagggggctgcgaaaggaccaggcccaggtagaaggaggtgggtgagaaggccactctttttttgagacagtctcactgtcacctaggctggagtgcagtggtgtgatcttggctcattgcaacttctgcctcccaggttcaagtgattcttctgcctcagcctcccgagtagctgggattacaagcacatgccaccacacctggctaatttttatattttattagtagagacggggtttcaccagttggccaggctggtctcgaactcctgacttcaagtgatctgcctgcgttggcctcccaaagggctgggattacaggcgtgagtcaccccgagccgagaaggccactctcaaagagatgttagaccttattggagtcctggtctcttcaattctgggccaagttcttcagcctctgagggtgtcttccaggttgacctgctataaacctgggcctttctctgtcttatactgacgtcagaggtcatggagaagggtggacttagcaaggtgggggttggggggcacattaagggtttgtacctctctttgtacgccaactgcctcatgacttaattatcattggtttggtattttccgtcagagtacaggccacacagatttgttaacacgtgtgcaaaacactatataggtaaaagcagatgcgtacgatgccatttccatcaagcacagacagaactcatctaagctactaccagtcaggacagcggctaccccagagctgggaagagcacctgggagaggggaacagaggcaggcttggctgcgggtaaaggtcttcacgctgatttggtggctggttacacagatgtgtggtttacaaaaatccatcttgtgatatgtgcaagcttctgaatgttttaccaaaaaggtttgaaaataagtaaatcagccaggtgagcatggtggtgtgcaactgtagtcccagctacttggaggctgaggcagaagaatctcttgagcccaggagttcaaggccagcttgggcaacatagtaagaaccttagaaaaaaaagctgaacattgtgtatgcatttgactctagggcaaatatatttttttgagggggaaaaggccttaacttctacttgtgtatgcacatttacatgtgttttctcaatcatctgaggcactatccctacttgacaggtgaccaaggtggggctgaagagactgacatatccaagtggtagaggggctgggattggacctcccagccacaaagctgcactgcttttcagaaaaaggtttcataacccaagcactgggctgcaagacttggaagggcagacacctggctatactcatctgggagtcctgctgctcaataccaagcctgactcagagcagcgttatgtccagcatgtttatccagtgtatggaaaaggctgttgtatccatccttgctttctatacgtttgcactatttcaaaattaaaatattagcatgaagatccaaccactgcagcccaacatcagtgctctcagcactttgcccctcaaattgggcccctcgagagggcatcctggatgccagaatccttgaaaagaactaaggaatggcaggagtccagggccccagcagcaggtaactctggcatgtggctctgagttcctgagtctttctggtttaaagagaaagtttcttttttttttttttggagacagtctcggtctgtcacccaggctggagtacagtggcacgatctcggctcactgcaaactctgcctcccaggttcaagcgattctcctgcctcagcctcctgagtagctgggatcacagacacgtgccaccatgcccaactaatttttttttttttttttttagtagagatgggctttcaccatgttggtcaggctggtgtcgaactcctgacctcatgatccgcctgcttcggcctcccaaagtgctgggattacaggcaagccaccgcgcccaggcttttttttttttttttaagacagagtttcgctcttgttgccctgtctggagtgcaatggcgtgatctcagctcactgcaacctacacctccccggttcaagcaattctcctgcctcagcctcccaagtagctgggattacaagcatgagccaccatgcccagctaatttttcatatttagtagagacaagatttcaccatgttggtcaggctggtctcaaacccgacctcaggtgatccacccacctcggcctcccaaagttcagggattacaagcatgagccaccgcacctggcctaaagtttcttttcttaggtgaaaagacctggcatcatcagggtctaactttccaggttttgtagggtatgtttaaggctgggaagaatcacagtccccatgctttgatctccagctaagcagagggtggggagggatgtgtgccctttacaggaggccgagaggaagcgacaaacgccaagtgcaatggagagggctctgcaatcctatttggatcccaaacctcactaaccctttttttttttttttttttttgagacacagtttcactcttgttgcccaggctggagtgcaatggtgcaatctcggctcatcgccacctccaccttccaggttcaagtgattctccggcctcagcctcccgagtagctgtaattacaggtatgcgctaccaagcccggctaattttgtatttttagtagcgatggggtttctccatattggtcaggctggtctcaaactcccaatctcaggtgatccgcctgcctcagcctcccaaagtgctgggattacaggcgtgagccactgcgccaggcattaaccctctttaatctgtgtttacctgcccacacctgagcctgaccccacaaacaatgtgacacagttttagcccagtcccagtttattgtggaggaaaatgggggacatggagctgagcagaacagacccttccctctcctctcacaggcccctagggagatgggtgtcaggactcagtgaagtgaaatggggccgaggaagccagagactgacaagagagcaagagaggacaggaggcagaacaacactaggacaggcgggggttggtggagacagtgaggcagggacacaaaattgccaagtcaggacatctgcacagaattctattcctcatccttttttttggagacggagtctcactgtgtcacccaggctggagtgcagtggcgcgatctcggctcactgcaacctctgcctcccgggttcaagtgattctcctgtctcagcctcctgagtagctgggattacagaggtgtgccaccacacccagctgatttttctatttttaatagagagcgggttttaccatgttggccaggctggtctcaaactcccaatctcaagtgatccgcccacctcggcctcccaaagtgctgggattaccggcgtgagccaccatgcccggcctcctcgtccttcttgctgctagttcagtctggtactgggtcttagagacatggacaagacaggggaaacagagctagatgtcaataggcaggtgactggattgagagggatgggggatactggaacactcagatgatggggaaggaatggaggaaccactgtgcctttctcaggtcagcctgtctgggcagaatccacactagagattcttttctagggggaagaacagcaccagagctcagacaggcacagtggctcacacctgtaatcccggcactttgggaggtcgaggagggcagattacgaggtcaggagttcgagaccagcctgaccaacatggtgaaaccccgtctctactaaaaatacaaaaaattagccaggcgtggtggtgcacgcctgtagtcccagctactcgggaggctgaggcaggagaatcgctggaacccgggaggtggaggttgtagtgagcagagatcatgccactgcactccaccctgggtgacagagcgagactttgtctcaaacaaacaaaaaaacagcaccagagttcaagagagaaaattacacaaaagtcatatagatgctagtggtacaacagacggaggcctaagaaatcacagtgaccaaagaatgtgggtgttttcagagagggcagtgcaggatgctgagggtgttacagaaagatatttgcactgtggaattcaggaagggtgaggtgtcaagagtccagcctggggaagaaccaaaagtcctgaactattgaggaacaagtacatgcggcgcagctcagcaaaagacaagcccaggttcagggacagtgtgaccatggggtccaggccatcaggctccgtcccagcatggaaattggggaggggcagggagaggttcagggcctggtagaaccactgaatctgggagtcagacagaggcagggccaggggcctgtcatggggctccggcagagagctctggagttgggggcttgaccaggagttgcaataatcgtactgacagcactgggcctgataccagtactctgcaaagtaggtgttgcgtttttcttggcagcggtaggaaatgtactgtccacagcctcgaacgatgaagcgaaccttgacatctgagggagaggggaaagctgataaccccttccaatagcttcccatagtccaagaacccctgctactgacttttcccatccttcacccagacctaatttacttctaacccagagtccttcaagaggctagaaaagtgagctctgctggccccctagaaccttagacccctccttccaagattcttctggttttttttgagacagggtctagctctgttacccaggctggagcatggtggcgcaatcttggctcactgcaacctatgcctcctgagtttaagagatctcccacctcagcctcccgagtagctgggactacaggtgcataccaccatgcctggctatttttttgtagagacagggtctcactatgttgcctaggctggtcttgaactctagagcttaagtgatccacctgcctcagcctcccaaagtgctagggttacaggcatgagccattgcactcagcccctcctctcttcttgtaccccatgcccggagcagccctgatctgtgagaggagagaagaccaagccattggctgccccaccagcagccccttcctgggaccttatttaccataatagatggtgatcaccatgcacagggatgagctgctgatggtacacttctctgagcctgaaatgcatcctacagaagggtcttctacgaggcagaagtggcacgtccggatgtcgggaacaggaactggggaggcagaaggagggatggaggcactgggtcactctcaaataccctgggccagtaggaagcccgattatccatggccacgctccacccccttcctggactcagttaccccttcctccctccctgcccctgggccccacttaccctttcctactgtgaagcccaccatgaccagcacacctacaagcatatggaccttcattttggaattctggggagatgggcagttcctgaggggatgccctgaaaccccaccttcctgtgaccatgctccttaatcctaagctgcagggtggttttgacaaggtctgagcaggagctgctgtaaatgcagagctatattcctacttggggcaggatcctggctgggaaggaagttattacttggcaggagggacagcatgtcctcacccacaacgtctggttcctgagtgtgggagtaatggcccagatggggtaatacctgggcactaccgggttctttatccagtgtctacctttgtcttgcataccctccaaagacctattccctcccttggaaagtccatgggttagtatctatctctgccaccatgtgctgtcttcgtcatacaacaggg

SEQ ID NO: 10907 - DNA, 13731 bp, Homo sapiens
gattgaggtcatgcattttaagcaagaatactgcagaagtgatgttgcatccttcttgctgcatcacatcaggagtttacaaggtcaatgcattaactttgatcacttggtttcagggaggtgttttttgagggggctgaaaatccctttgggctccttgaaatcacatctgctctgccccagaaggcaagtcctgaagccaggagtccaacaccccagtttcattctctctctcagccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatagggggagtaggagtagagaagggaacaagggagcaagggaacaagggacatctgaacatctaatgtgagaagacaaacatccttctgtgagtcattaaaatctatgaaccactctacagctgactggaaaattacatctatctttggttgatgggagggctaaaagcgtaatatggggcatccaggttctagtttgggggttaccaagcaacagcgggcttaattacagtggtgcactccttaaccaactaaaccccaaagggcaatggcttatctgccttctgtggctcctggatcctgttgctgggttgaatcttccttagcaatgagattcattgagtggggttgccagggttttgtgagcctgagtctgggtttgctcccctatttcccatttgcaagttggctcccaataggactattttgaattgagaaaagaaatgtaaaaactgtgataggtaaaaactgcttgatgccctacttactaactaggctaggtgaggcctttgactctaacctgagagaaactgaagaaacagggtctcaggccccatctccatgtacctctcctatcctttctggagagccctcaagccaggccgcaccttcttcttggcaatacatcaggggtgtggcctaaatttaggatatgagttgttgtgtgccacctggagacactggaagggaggatgaagacctgaaaaacctgtttctccattttccccagcccagcctcccagggaacctccctgaaggattcctgtgtaagggagggagattgagagtattatttcctgggaggtgacctgacccttaggtcttcttataataaatgtacattttatcagactcagacatttattactcaaaatggaaagaggtgagtatgggggatggggtacatatgggagcctgggtttggggagtcagctctgtacagtgaggtcatcaggtccttgtgggagccttcactggggacaacacagaagccccatttcaggcccagatcccaatccctcctcaagtaggggacagcagagtataggaagcaaagtggggagcccttctaggagccaatggaggtcctggaaggaagtgggaagggacccagaaaaaggagagtgaagggtgtgaggtgggaaggatggatgaggagaccactcggaacagtgtttaattaaagaaatgggagctagggagagacgattctgtaaagccaggggatacagagacacagggagagaggctcaggccaaggcaggtgggaggaggggcagccaatggaatgagtctcagtgcagcagccagaggccaaggccagccaaggaggtaaggaagacaaggcccagggctggagtgggccggggtcctgcgctgttgcagttgtccttgttgcagcaggtggtgttatatgtcagacccagcttgcggttggtttggttgaaggcctcctgacagggctcttctggtgtgccacagcgcagattggagaaaacccacatcttacctaggggtgggaatgggcagggaatcggccaggatgggcacctggcatgcctgtgtccacctccccaccccatccacccacctaggcttccttccttcccaactctgtccctggccctccccttctcttttcttagtctgatcttccttctgcacatccttacccaccactcccccagtcctggttctatcacttgctggccatggacctgttactgtctctgttttttgtttttttgttttttccaagacagagtctcactctcgcccaggctggagtgcagtggtgccatctcagctcactgcaacctccgcctcccaggttcaagcgattctcctgcctcagcctcccgagtagctgggattacaggcgcccactaccatgcctggctaatttttgtatatttagtagaaatggggtttcaccatgttggccaggctggtcttgaactcctgacctcaagtgatccaaccaccttggcctcccaaagtgctgggattacaggcatgagccaccatgcccggctgtgttactgtctctttttgaggccgttttctcagtataataatagcacccacatcacagggttgtcatgaacattaattgaaaaaaaggcatgcaaagacataggatgttgcctggcacacaaccatctttggccaaatattatcattgctataatcctctgcttctccatctcagtcttagacccatttgggcctcagtcctggtcatagaggctcccacctccctgttcaccccactaaggaaggggatgttaccaaggtatgcatgtgttgtcaggcattgctgtcctggctccaggcggcaggactgccggtccacacagcccagcacagggaccttgtagcaggagtgacagcgaatgtcagctgggaagacacaagtcaggctgaggtgatggggtctctgacttacctggggataagctgagctgggggcaggggtggagggtggagaagagcccatcccgtaggtgctccaacctgtttggctgtttggtctagcaagcacagagcaggtgagtgatgcagggaaaatggaaagtgggcggcaggtaagggtagagctgttgctttgtgaaaggcccacgccctacatatcttccatcactccaccccgtttggaggtgagtcaagagggacagaactatgaagaaaaacatggggctggagatagatggaatgtgaggaagataccatggggaaagaatgtggatggtgaaggaggagatggaaacttgaaagaaggagaaataataaaaatgaaaatcatgagggttacaacactgtcagaaatgccttggaacttgaggctggcgagaaagccatctgtggccagctttagcaatttacaatttactcttcacctcctggagctggcaagagtgtggcaagaggaaccagacctgaatagaatcctctcaccccagtagctcttcagcagaaaggaatgatacctgagagacagatcaccagattccatcttagcaccttatcaaaatggagagggtggatacagaaggtggcaccccaagtttcctgcttcagttaattcaaggtttgggcaggcaagatttggtgacgcagggtccgagggtggaagagcctggtaagtgtacctcagtgaaatccacttcaccctggaggtaagtggcccagttgtcccctcttcagaaggctcaagaaaacgctctgtttccatggaggctcttagatgtcactgcaaccatctagaaagtttgtatcccctgtatgggaggaggtatgcaacccaggaggggagtagggggtatctaggaaaggccatggctgagagactgaacatgtgagtccctgatggagtagatggggagggtaggttacaaaaggagcctggggctggatgcctaggtcttcgagaggacaccttactgagcacagcagatagaggagaaggcaggtaagctagactctggagagttgcatattgaagtggggctggttggggaactggataccagagtttccaaggaggagacaccttggagtggggaacaggggacccagagccctggcaggtgagagaaatgggtctttcttggaggtggggaggatggatggagacctggctttttgagaaatagagcaaggaggctgtcatagggaagcctggtcttggtggcacaggagagctgagccagttggggctgggggtgttgggatcccgagtggtgggtagggccgggaagtgggtagagcagggtgtaaaggtcctgaccaggcaaaccaggtctttggggcccccaggtgctcacctgagacccagcagagcagaacagacagggtgagcagcataagggctttcatggcgagggtcctgagaatggtggcaaccacagcagctgatagagtagattttcaaggatccagctctaggagttgagtggcctttttggaatttataaacccaaaggctcctcccttccctgcctctggtagcccctcccttctcacttactacgcagctgaccagagaaaagacaaggggtgggaaggcactgagcaggactgagtggggagtagggatgggagagagggatgggggaaggcaggtgccactagtggccaatgccattgtggttcttggtttcaggccaagatgcccttcctggtccccagctaagagtcctgctgctcagtcctctgaatgagcatcatcaaaggcctctgtgatttacagtgtccatggtggcagcttctgctggttcctggaaaatggacaaaaggatgtggcccaaattaattgctgaatttgggtccctgggtccctgctgggcattgataggggcatgctggtggaaattgggggaggaatgggtcaaattaatctccattcagcccccactcggtctttccaatgcctgctcagcaataagtgactcactgatggcttctgtgatgccacagcagcagaggcaggggctggggctactcatccaggagagccaccacaggtctgctaagtagggctgcctcaggctcccatgaaggttctcaggatgtcacccgtgctccacttgcgcttggtgtggccttgttgctccagtccagcagcagcaattgtcctaggtgtggctgtgtgcacctgctccaaagcacctccccagtcaaaacctgccaacttgggcagggtaccaagccaggaggaacagcatgggcacagagaggtgaggtagaagctaaaataagaatagaaatagtaggccgggtgtggtggctcacacctgtaatctcagcactttgggaggccgaggtgggtggatcacaaggtcaagagatcgagaccatcctggccaacatggtgaaaccccatctctactgaaaatacaaaaattagtcggtgtggtggcatgcacctgtagttccagctactcaggaggctgagacaggagactcacttgaatccaggagccggaggctgcagtgagtcgagattgcactccagcctggccacagagcaagactctgactcaaaaaaaaaaaaaaaaaaaagaatagaaatagtaataataatggcaagcacttacatagtgatcctatgtattctaagcagtttacatgtattactttatttcgttatcacaatcccctacaaaacaggagtttttgttgttgttgtttttgagacagggtctggctggctctgtcgcccaggctggagtgcaatggcctgatcacagttcactgcaacctcgacctcctgagctcaagcgatcctccctcctcagcctcctaagtagctgggattacaggcgcacctgaaaagttaagcaggccaaagcatttgtgtaaatggcccgagcacacattttaagtgagaaccatttgaagactccgagtttgcctgcgaggattcccaaagggatctgggcagctggtggccccgccccctctcttatcggagccccccagcccctccgttctccccacgcctaacttccctccggtccccccccaaccggccccacgccgctgattcgctcgcagcttctcctcaccacatcctaaccatggctgtgtttctgcagctgctaccgctgctgctctcgagggcccaagggaaccctgggggtaagcgatccctgggagagttgtgatagacgcagaggggctgaagcaagataagggccgcctagtagggtgggttgtgtgtgggaagatccaggatggctggagtgcagaacagagaagagaaagaggagacgggatggagggtcgtcttgccctgtggacgtgccctaaccacagcctccggcctctcctagcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactcyggtatccggcggctggagctcctcttgagcgcgggrgactcgggmacttttttctgcaagggccgccacgaggacgagagccgtacagtgcttcacgtgctgggggacaggacctattgcaaggcccccgggcctacccatggtaggtgcaggcctgtgcgcacaagggtacttaactccgacacatacccggaggagggaagagggccttggctgggggttcttgagcgggactgctggctgtccctcgtcaaacccctgacctcagcatccctmcccgccacgcctttcccccagggtccgtgtatccccagctcctgatcccgctgctgggcgctgggttggtgctcggactgggagctttgggcctggtctggtggctgcacaggtgagcaggagggacccggcctcgttaaatggggagtgaccagaggtggaaggggcaggaccagaaccttcgcaaaagaaagagctagacctagagctctggtcctggcttggcgaagaatgggagaggtcaaaggtgggagcgaggccgctgrctggtgagtagagccccaccagagcagatgagctggaagtgcagcagagttagagcctgggctggactgtcggtggggtagagtctaagttgtttccggtctgagccttcaagttgctgggctgtccttggcgtggcgagtcccaggagaaccagtgagacaagactggtggttctcaaagactcatatgtcccttacaggcgcctgcccccgcaaccgattsgaccactccctagatttggtgagactaattccaccccattttctttctcctacatgcccactccccacccctcaattcctgagtctgagcccttgctgggagcagacacgttggtcaccttctctccatccttcagctctgtcccccccacatagctccacttgtgaaaacygagccccagaggccagtaaaggaggaagagcccaagattccaggggacctggaccaggaaccggtaagggcatggggatgggaaggggatagccagaatctctgaggaaaatggaccaaaaaaaaaaaggcctgaaccccaaggaagactgtggagaccatcttgtcttcctccccttcctcctccagagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaatgaatgtccctggaagtgtcatttctttttctttatcaaataggggtggactggtaatctaccagtctctgaatcatctaacatttagataaattcagtgagcaatccacccatacactcttttctctgccctggacacacttcccatgatagaaattctgtcttgttcatcttgtgctcaagtacctatgacatggttgggcaatgagttgataagtacctaacaagatttttgaataagaggccttcttccctgcactgaccccaaactcaggtttcagccctgccctatccctttgccccagtaagacaccagtcacagcccagtctaaaaggtcaattctattttattggttctgagagggaggattcacccagtggatccttttccctacactctcccctcccccaatattgaggctctctcccaactactgcctattcagcattctctatctaaccctccttccccttctacttcctatactatcctacccctggccagcagtaccccaaggccaggccctcagctgtgggggcgtgtgctgagcaccaagcagagggagctgagcccggcgccagccttctccagttctgagcaggacacaggtaccagggtgacatcagagagcttctgcagtgcctgcacagggaagacatggagtggggagaggggagtgagacctcaggctgagccaggccactcttccagccagctcagagtggccccacccaggcttctagagaaggtacccttccttcctcccactaggaaagcctgaaactcttttctctgatggtgcttggtgttggagttcctgccctctctcacctcctggctgttgggcagatccccacctccacggtgcaggaggaaagggggcacaccaggcaacccaggacgaagaaagagacagtcagcagctgcgtcatctgggagggtcagggaggcatatgggtgatctgtcagcactgccattgcctagaggaaagaggaagtgttcgagtctcagaacctctccacagctgtgtctgcctgctcaaccaccactaagggctggggacggactgacatttgtggaaaataatgacagcaagcacatagagcttacgatatgtcagacactaagtactttagttacctttgctaatttccaccttggaatcacatgcagttattttcaaccccctaccttccccagcccctcctatctgtcctacccatccttagagtcacagtttaggtgccacctttggggtttcctgaaactccggaagagcaaattaatcacccctgttcccagtcctgctgttgtaacttcttattttctcctgtgttctttcatgtaagatggacagcccattgagggcaggggttagggctaatttcctaagcctcccagctcccggcctcccgggcccagaactgcgcccactttcgttggccccgccccctcctcacccggacagccttttgggcagcgtcgctgctgcctgccacaacagtgcgaggtccccccatgccgcagagaccgcgcaggtgggagggacccgagactggcacagtggagacggcgaagtcctagggagagcgaagggaggtattcaggggcgcgggaggggtgatggggtatcttcaaacataggctgctctctgcctctcatttcctcagcgggcgcccaggcccttccgacccccacctgcaccccctccctccctaggctggtcccgctccgcacccggaacgtgtccgccacgatctcagctcctcggtgattggtccatttggagaggcctacgaaaaactcccggcctgagtccgggaggccgcggaggtttgagggcgggagtgagttagaaacaaggctccagacggccgagtctcccaaactctacttccctgtgccaagacctatgcctccccccagcctcaccggtgaagagaacgtcagtgccatccagcgtcgcgttctcgtctcctatttccacaattcggagccccaggtcttgcagggctttgcggactccatcgaccttaggataggagaagagggcacggagctgtgacacccccatcctcaattcttccccaaagccccgacatccagttccttctgcctttccccataccacacccgcgccacggcgctcacctctggcctacgagcggggctccagggccgcgtgattagggccgtgtccccttggatcacggccgtgtcgccaagcagcggtcccagcggcaatgactcctcaggtggcagttctagcagctgtagccccagtcgttgcctcagtttacctcccagcaccccgtgctccctttgagctttggccagatccagagcgggaaggccagcccccgcaccttcccccgacgccaggctctctgggactccccggatcagggcatgggagcagcggcccagcccctcccccggcgtccccatcccatccacacagactccccctccaaccgctcggatttcttagttttcttgtttcttcacctgtctgggagaagaaacagaaaaggaggagacagagaaaaagacatgcagacaagggcgttgggggtggttaagagcgcccaggtcttcctcctgccatctctaggcgtccctcccactccgccccacccactccagaccttccgctcctgtcgacctcactctacccagcaccctcaggggtcagattctttaagaggagcctgaggaacaaggctagggtctctaatctccaaaacacctgttgcccctgcttgggggcttgtgaggtccctgtcgggcgcccctcttggcagccactaggatgcgctcactccccaaaaatgcagcagccccgcccccttaaccctcagctgctcgctaccgcagggactggaagtccagcccgcgacccgcaggggttatgggacagaaggagaaagctggagaggcaggggctggggaatggaagtcctgaatacccgaacgagaagggagagaggtgggtaggaagggaggagttcgagcctaaggagttaagcatcctctctccgccctggctggtcacgctgcccctagcacgacctagtataaaccagaccgagtcccgaaggactgggagaggtctaaaacgaaatgcgaggggcggggtaacagggggcgtggttccggggcgctggcactactcccggctccaggacccggttccccgtctatgtcccaaagtccaccccgcctagctccgcgcccaaataccggctccccatactctctgtctggtgcaggcatgggcccggcacccccaaactccggcccccacacggttcagggccccccacgcaagactcacctccagcggccacccccactcctgtcgcgctgtgatctcggctggggccccaccccccgaggacagagttggtggagaagggagtccccgtcttcaagcctcggggactgggagctctggcttttagcgggggtccttgtgtaggcgagctcatatactacgatggggcaggggcgcgacggtctggcggctccggggcattgtctaagcgggacggggcggggcttcttcgggccacgcccattccgccctgctaagccgcgcccattacatccagactgcgccccccttgccagaaatcggcaccgcccagcgagcgctgcccaggcccacccagatctggccggccctggcgacggggctgcaaacgcttcgtagacctcagaacagcgcaacggcggaccggcggaccggcacgaaacatagcagccccaccacaaacatttcccttcttaattcctggcttctgccctgagctcaagatcactgacccacccctcattccatgtcgcccacactttaaacccccattgcgtaaaaacacttgatttttattctgtattttattactgaaatatgttgtcctactcatcccaccccacaataaaaatctgacccaggccccccatttctttccctcatcccctcttccaccacaccatcccggaacaagtgctccaggattccctgcccactggccattttggagtgtgtccattgggtagcaatgtggaaaccaccagggcctttgtggagaaaatggagggggttgagggagtcccaggaggggcttatttgagggcctttgccacttgctcataggcgagctcgatctcctcatcatctggacaggtggaagcgaattcttcccgggcgtaggcattgctcaagtaccgatgcactccccggaaggcctcggggatggtgaatccccggtacttcttacacaccacctgaggatggggagaggagagggaccaacatgttagacccagggaagccaccttggctttcccttctcccca

SEQ ID NO: 10908 - DNA, 24345 bp, Homo sapiens
  misc_feature (1)...(24345): n = A,T,C or G, or insertion/deletion polymorphism (see Tables 1-2)
ccaactgaggaggctgagaaccccatgaagaaacttccagtctctacctccaggccaggcagcccaatgccaggcccagagcccccagttatctccaagtcccagaggagtagccaggagatctgtagctctcagccacagaagcagctccccaatgtctgtgacaataccagctctaatgtgccactgtctgcctaccaagtaacctgccacaagcagtccccattccagtctccgaaggaagccatgcagatccccctctccagtgccccaacctgccagcttcaggaagttgtggaggaccgtgtgctggtatttgatggggctgctgtgccatgaccctgtgggctcacgggcagtgcttgtgggcctcatgcccagccacccatccatctatgtccctgaaaatatgctgtccacccagctgtcggccaaacccatcctgtctcctgacagcaatcactccagcttttggtctatcacacccatgctgtccagcccagtgccctgcagcctctcatctggcagctaccgagaggtagccctgattcccaaggaggccaggctcaacctggagtcatgggactcccctggtactgagacacccatcagggttgggatgctgactgggcctgttccactggggatgcccctccaatttgatgagaggatactgacccatgtccctaatactagctggtccaagcctgatggtgaaaaaaatgaacctagtcataccatctggatgctagacccttccatggcaccctctaggatgccagatgcctccatagtccagaccaagaaactgcagtggatgaactcagagcctgctgcaccagccgatacccaggaagtgcccagatccctcctccaggaagacataggcagccacgaagaggtcattcctgctcaccctgataaccctcaggccaaagatgctggacagactctcctcactgggcagatcctccttgctggacagccacccctacctgagcacccccttactgatcaaccccctctcactgggcagacaccccttgctaggaatccctctttatctaaagaaccccccatcaccaaagagcccactctttcaagatggtcccccaaccctggagaacctggccaggtctccacccaggaagatgagcccttaggcctgcctactcatgtaggggtatttcaggtgcccctgacccctgaggagacctgtatctatatgagtagagacaaggttggcatcagtaatactcagcactccatcacgcatcagcagcaacctggcaactcccctaggacccaggaggagcagcttcccttgatcacatttaccacacctggcactggacgcaaggtcttgcccatggccatggtggccactgagccccagagtgccccattcaagctgacagctgaggatcttacacacttatcagtagttgcacaccttggactgccccacggggcctgctatgaactggtgtccaccatggatgctctgccagttcggtcgccagtgctctgctgccactcactgggacccttccaggacatggcggccgtggtgattgatacaggcacaggattcaccaaatgtggactggcgggagaggaccatgtcctcagtgtcataccctcacgagttcagctgctgcagcacccagcccagggccagccacgatatgcagtgcctgaaaaccaagtgggatcctattcagtgctgaaccgtggtgtggtctatgactgggatgcactagaggtgctatggcagcacctgttctattgaaggctgggtgtgcagcccgagaagctgtctgtgctcgtagccgactcgcccatctcaccactcaccaaccgagaaaaggtggctgaaatactctttgagcatttccatgtcccagccatgcagacagtgcatcaggccctgctggcgctctatgcttatggacgtaccactgggctggtgctgggcagtggccatggcacttcctatgtggcacccatcctcactggggatctggccccacttgacacctaccggctggatgtggctggtgctgaccttactgactacttggcccagctgctgcagagaagtggccactcactgccccaggcaggactgatcaaccagatgaaagaggcctgctgctacgtggccatggatgtggcagctgagagggcccacacccaggcgcaggccgaggtggactttgtgcttccagacaagcaggttatcacgctggggcctgagcgcttctgctgccctgaggccctcttccaacccaatctgataggtctcaaccagctgggccttccacagctggccctcctaagcatcagccggttggaggccaagcagcaggagcagctactggccaatgtggtactggacggtggcagcaccctcatgagtggcttccctgagcgcctgagacaggagctgggccctggtgccactgtgctggggtctccccaccgtgcagttgctgcctggcttgggggctccatcatggcatcccggagctctttccagagcctgtggctcagctgccaggaatatgaggaagagggcccatgggctatctataagtaccagctgtgagcatataaaagttctggttctgctttctttaagcaccgtggcatgtttcagccacagggtggtgtgggaaaagcaggagtccaggcatggggtcatggatgggggccctggctctctcccaaggcatgccctgcctctgcactctggaactccatgggccctggcaacctaccctttctagacagccccggagccccttgactggcattggctctgatctggcctgacctttactgcaccccaagggcaaccacagacagtggctgctgtgggttttgccccgttgccctgacgacaagtgcaattacccttgattgccagcttgttgccatggcaatttcaaacataatgtaataacccacacagcctggagtgagtcacaaggtggggggcggggggcagccccctcccctggctccagaggaaaagactgcttgcccttccccattgtgggccctcttctggggactgaagccaagcaacatggacaacagtcaggcagtttcaaagatggctgggggcctggggtgggagggttctgtcagagttcaggcttcttggggagctgcactggtaatctaggtacctcctagagtctgaacctttgctggagcgctatgctgggttagcaggggcttctatcagccagccagaatctaagggcataggagtgccggcctttggcaccctagagctgggagttgggggcacagataagtcctggatcctgggtaggaggcccaacctgagctgggggatgaagctctgtggatactgcggctcgcaccttattctgcccctctgactttctagctttggtgggagccagaactacgaacttgggccctcttctcctcctcagcctcccaacccaggcagcccctgtcttcagggtacaggcctccttaggagggtcctcataaaggctactaggcaatgctaatctggattgcctctgctcttgttccaaactctggtctgtgctaaagggcctcctgccatcactctggccagtggagtggtgagaaatcatgtcccctgaccccgtctggctttgaatagtggaagtaagaacaaagctcagcattggtcccgtccctgccctggaagagctaagaggatggcattcagctgatgttactatctcctgcctgaaaggcagctggaggttgaagccaaaacattgaagccggtcctaccctgcctgtgccttcctgtctaggggctgagggataagccatggctcaatcctagccctgggttcttgtcttcagattgccctccacaaatggcaaagacttgtctatcttcacatacaccagagatcaaggggctgctctggtggggagcctgaaaacagccaatgatgtagggtcagcacagaccctgcccactgctggacatggtccagcccccttcccatgtccagctctcaaagcctgattcagcctccacaatcctgagacttgtgtcaggcaggaaggggactgataactccagggaccagctacagcgtccacacacacgtgccagcaagcatgcctgggtgcacaaagaatgcagacacacgtgcccctgggcaccactgcatacactgtgctgttgcatctccctcggcaaaagagagcatacacaacacgtacacgtgtgcacacacaccctgccacgtgctctcacccacatgcacagagcgtgcttaggaccaagaagaggtggagtactgccagcagcaggcagggcgctaaggagccaccccttcccctgcctaaaaatccccattccagcttctcattgacccccatgcctggatagccatgaccctcaggaaagacagaaaacatgtatgtggcatgtgtggggtcagcaagctacagcttggctacaccataaaactcagagacccattgtttcaagaatagtgggcagatggcaggaaggactcagtgccaggccattcattcattctgcagacatcagccgagcatactgagatgagaaacgggttctgccttgcagatacccagcctgccaggagattcctacccagtggtggggtgggtcccataacccgagaccactcagagcccagggaccccagaagtggcaccagcctggcctagaggaggtaacaccaagccagggaggaaggtgaagggctcagtaccccctctggaggaaaattttgaggaaccttgtttgaggcggtcatttcctaagctagccttcagtctgagccccagccccagcttctggacttggacagtccctcctgtcatcagccatgggtggccagggcagcctcaagatggctgagggtttggggatgaccccaactccctctcccacagcagggtcaggaggctcactgggaggagtgaggtgggataaaacccagctccagacactgagaggcctgagtctggtcttcagatactggccttaggatggtcctcagggcttgtgaggggtgtgggtcaggctttgggtccgtgagcctcactgacaagggacagagaaatggccaaggacttcctttaaagcttcctcctggtggttctgagcctcctccctctgattagcacccaggccaggtgggataccttggtgccacagttctcctgtgtccccatatcccaggccaggccactagagtgatacaactcatgaagtgtttgacagtgattagactgaaaagaaagcagaggccacaccatgtcacaggtgacttttatagtttgggaaatttggtgccacacaggaaggggctgactgtgctgccacccttgctggtacttatgtttgggaaagactctggccttgcaggagttggggatggggtgggataggagactttgctactacagtctagggccctcactgttttcacactgactacctgcaaacacacacctctgtgtgtttactgctcctagctaggggatgcgtagctaggggatgctaggggatgccacactgactacctgcaaacacacacctctgtgtgtttactgctcctagctaggggagcctgccctagcccgactgcccatctggtttttctaagttggtcctgccttttgggtcgggttcggggagctgggcaaagccccgttccctagagactaatgactggcaagcgatcctatgcagctccaggactcaggctttcccccaactctccactcaccaccccttacattgggcataggaggcctcctccggccccaggctgagggcctaagggagccattgagaaccttggccagggctaagcaggccagtgctcaccagcaccgctgccatcccgcgcgctcctgctctccagtgggattctgcccttaaggctccgccagggtcggggcggggccggttgggaggccccgcccccagcccgcccccggcccggggtgcgaatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggtgcggggcgggccgggctgggggcgcttcccgaacgcaggttgtggggccttgggggattgtttccctggctcgaggtkcgggatgcagagtgcgcgggggcgcagcgagggctcgaggtcctggcggggtcagagcgcgcgggctttgcagatttgggggagggagtgcggggtcgggctaaagttccccattacctcggacggcttgggggttctggggggaagcttctgcggctcggaattgtgaaaagattaaccctcgaagattcgtggtcccccgtgaggataggggccgagagctgagccgtccctccccgttcccagagccgcctccagcccctcccaactgtccccgggccccttccctcccgcttagcagtcactaatttccatgacaacggagagttctttatgggcgacaacccggagggggctgggcggggctgccgcggggtgggggaggaagctccaagcccctggggaccagcagccccccagccaaaattcagcttccaagccttcacctgggtgccagctgggggtccagtgcatggacccacgtgcacggtgggggtgggggcgcacatgttcctgctgggaggtgcggggcttggtgctcacacgtgtgctttccgcatgtgtgttgctgtgccagcgggggcgagccagcagcacttgggaaaggggtcagggtggcagcacggtggggagcagggcccctggctggaggtggctgggatagtgacagcatgagcttctgccttccccagcttgtactgtttggcagagaccctgggctcttgagccccagccccctccccgcatagctctgccaaattgcttttgtccgcacctcccaggcagatcctgctccaccaggttccttcctaaggatcagggccctctgtcccacactaaaagctcagagtctgcagtagtccagtccctgtgctgtactccccttacccccaagtccaggctttgagcccccaggactacctttagagacctggtgccctcccccaccctcagagttgattcctggcagctccagcgacttctgagcctcagtttcctcaactggggaactggtgtctccactcagagtcaggttggtttccagggtggggcaagggtctcccttttctaatatttggtgtggacccttcaggtgctctcctaggctggctgttcacatatctctgatggccctactctccagccccatgccctggccaccattcacaggcaggcaagcagtcctctgccctgggagaaggccagattccatggtttccattaggggaaactgaggcatggggaggtgaagggctgtgtggttatcctgtttctgggttgcttgtggtgccgtttctggcactcatggcaggatctgctgttgggggttggtgagaggggattaagcagagctgtaagaggggctctggggacccaaagcctggaaaggatagcagatgggggaggggttggctgggagggtctaagtacagctgggccaactgagaagagggactataaagggaagcagccaggcatccgagcctcatttccatacccctatgcgtctgccttcaacatgttggacctgctttacctaagctgccgtgatggcagagagacgggctgggaactgtcctgactggggggctgcagcagctggcctcttccccaccaacatgctccaaggagctggcctccttttggctgtgcctcctacaccaagttcagtgtatgtttgggggatacaggagggtgcagtctcgaaggtcccagtaccatggatagctcctggcccagggatttagagcacatcgccatggaggccttagggctctgctgggcacccatccgcccccttcagaactcccgtccacctcccctttcctgccctttgtgcctgtgtcccttttactttgtcatctccttgctcctcttccatcacaggttctgtctttgtctgtgtctctgccccattctcttttttctaaattctctccatctccccacctcccctttcttgatggggacctgggtcacagaaccttgaagaagcagccaggctaaggtctcaggaaattcttgaagaagggacctgaccaacacatctcccctccccctccccttgttttaaaacttccatcaccatagcaaccctttactctagtgccttcctctgcatttcccctcctccacccacagggaagcagagcctccagtggattctccttcaggggttcagagatttggaccccaagtgcttgggaggagacagctggcctttggctttgcctgcatgttgacagctaaactttcgggatgtagcactggactgcatgcccacccccaaaactggagagacctccccacaatactccctcattagatgggcaaaattcagctgtaggaacttctaccatgatttagctcgagccggaggctcagtcagggcagccccttgaccggtcccctgaagcaattggatggtggtctagaagcttggcccttgttcttaacagaccttgagggaggtcttcagctcccctggtcctgtgggtgacacctcagctgtgagttaagcagggcttgggcttcagcatgttcattgcagcaggaaacccagccccagcccttgagagagtagagcagcagagaggagggggtgcctgcaggctggtgttcacagctgccactaaattaggaggtgttgcctacagttgttgggaggcagctggaggcctcttgggcccctcctggcctccctagatttactgcaagctctggagccccacgtggcaggggaccaaggtagcaggaaactctgtttatgtctatgaaaggtagggcctgaaccaggatgatctcagcggaggaggggacaggaccccaatgtggggcctccggacctcttggcctttgtcccgtttgggctttccctgggccagacttacctaaagatgcagcagagtccctgggggaccatttatcaccagggcaccaacagaggacccctcaggattgctggaggctcaattccctgagtccagtggtcaggccctgggagcaggccataactggggagtgcttggctctcaggctccatgagagccagctggagggcaatggccgcaccagggcctgcactccccacaagctccctctgggcagccggtagtgcatactgttcagttcctctgcagagagtggagggagccatgtctccagggaaatggctgttgtggagctcccatgcccttccatggcctaagtgtacctgaggaagagctcagatcctgtgttgctgagaggagagctctccattgttgggtgttgggtctgggccatgggggtgaaaaatacaaaccccttccacttggcctcctctctttctgagagctgtcccttggctgttcctcccaggtctcctttgttgcaagcaggtgcccagggcttggtgcacacacccgaaacctcccagggagcaacagtggatagcagatggtggagtgggtgtgggcagagggaaccaaggtgctaattgaaagccaggcccctctttctcctctctttgccctggggccaagtccagggccccaagccagtatacttagactggtgaggaggaggaggaggaggaggagtgactggctgaaatttgggcagccatagtagggggcaggggagacagatctgttcccatctcagccttgaggcttcaggacatggctccaggctgacattacggggtggaggcccagttttctgtgcctttcatgggacagacccccatgaccagccctggacctcagtgggcacgaatgcatatgcagagccgaaagctggggccaggatcaaggacaggcatgcacaaaacctcccacccacgccacactggcaaagctgggagctgttggagtggggtggggggtggggcatggaggttgtggaaggtatctcagaaaagggccattttgagtctggccttcgagcatcaggattgttttggacaatgtgttgcacaaaccaccttataatgtcagaaatcacaatgaaagaagagattcagttctgctctcagcacctcgctcatgtggcagctgctccacaggaaagccaaggtgggcagagctcttgccagtgcccacacttcctaccattgagtggacacagttgagctggcgagtcacctgttgttggacatttaggtagttgctgaattttttttwatgttataaataactctgccgtgacaaataggaatctgacgggaggcttttgggggaagggcactcttgccagagggaatggtgtaagcaaagcaacagagccagggcacaggtccctcccagccttcttgggagactgcaggctaaggtaccatcctcctgcccagtacacggccctcagactgagatgactgttgcaggccccctcctgcagctgttatggtgtgaaaatgtgtagccggcaatggtaactggctatgcctctgctctcagctgtgaggatgggattctggccacatgcttctccccagtggaggagtgcagggttgtgcccatggtggcagacatgcagtcagtgacgatcttcaaagcctctcctttgtctctgctgtgcytcgcaagayggcttaaaccctgtctggaataatgctgatgaaatgcatttgtattccctgagcccaagcaacccagatgaaggaatgatagagtttgttccctaatgctgaaggcaaatctgagggagaatttccagggctgtgactcctgggaatcacagcctggtggctggcttctgcctgggaggaagcaagtagcagccagggttggctatggggctcgtttgggtcctggtctttgactttggctggcagagttcatcttgccaagctgcctcctttgcctcctcccttctccactaccttgaggctgtgagtgccttcaggtcggggagcatctaggtacccccaggccctagctcaggccctgcacacagcaagtgctaattggcrtggagggaaaacatgcacagtcagcagaggcagagcaatttcagcgcagcctcagtgcagagcttgctgtagccccagtgtcacactgaccgggtattatggaggcacaccctggcgtcagatctgtgaaggtctagtcagtaaccccccacccccagctttgagcatgggctatgagtgccttttcctttggacactggagtcagcccccctagcactacagatgaggattgggctgtaattggcaggattgcagacctgtgggacaccgtgccccaggtggaaagagtgcctagcgctcactgagccagctatatctgttctgtttgggggccttgcacctggacctgacagcccaggtcccctgtgggccccagtgggcatgaatgcatatgcagagccgaaagctgggaccaggatcaggcttgttttgctcttcctgaccagtacacctgcatacctcctggcaaatcttttcctactgagtcctaatgctgcctccaaagctttaccttgcctctccacccagattatccctctgaggaatcccccaagcactgtgcctgagtgcagtatttactaaattcatcgaagtcattatagtaaaatagtaaaaattcgcacagaaaattagtaaacaaaagatatgtctgcctttttgacatccaattctttgcccaggagagaactcttatttccttcagtattcttccagaaaagagtttgtgagggtacatcagtatgtaaactttaaaaaatttacccaagccaggtatggtggctcatgcctgtaatcccagcactttgggaagctgaggtgggaggatcacttgagcccaggagttcaagaacagcctgggcaacgtaatgaaatcctgtatctacaaaaaaatttttaaaaattagccagttgtggtggtgtgcacctatggtccagtcctagctactcaggaggctgaggtgggaggatcgcttgagcccaggaggttgaggctggaatgagctgtgatcattccactgcattccagcctgggtgccactgcattccagcctgggtgacagaacagctgggcatggtgcgggtgcctgtaatcccagcwgcggtgggaggatcgtttgagttcaggagctctgggctgcagtgcgctatgccagttgggtgtctacactaagtttggcattagtatggtgacytcctgggagctagagctcatcaggttgcctaaaggaggggtgaagcaaccaaggtcagagacgaagcaggtcaaaactcctgtgctgatcagtagtgggcttgtgcccatgaatagccactgcactccagcctgggcaacatagtgagacttgtctctaaaaaaagaaagaaagaaagaaaagaaaagaaaagaaataggtcttccagaatccccccatgtgtcctgaatcaatcataacccctccttttctcttagaagggaccattatctgactctgcttatttcctagcttttctttatagctctactgctgtgtttgtatcccccttacgggtttgttctgcctgtttgaactctatcaatagactcatactatatgtattcttttgtgtctttttgcacttaacactgtgtaagagtcaccaggtggttgggtatagctgtagctcctttgtttccattgctatataatattccattgtgtgactctaccacaatacatcctgttggtggtggtatttggtctgttttcaatttttggctattatgtatatggctactatgagcattgtatgactgtcctgatgcacgaatatgtgcacttctgtaggcacgtatttaggagtgcaattgctggttcatagggtatgtttgtttgactttagtggttttaccaaactgctttacaaaggggagtttgccctctcctagcagtgctcacgttcttcatatatccactaacacttgttagctctagaccttcagagatgactagcaggtgggtgggtggttatagcccccttcatctgtaaaatagctgaaatttaaataaactgtttgataagccttttttttgaatgtatagaatacaaaactattcccttatatatcagcttaatacattttttcatatgtaggctgttgcacttcaggcagccaagctgagtagctggatgtctagccagaaaagcaggggtaggatctaagcctgcctatcctctagccccycctggtatggtctctgcccctagcttggcctgagccaggttggggtctcccaaaagcagcccctatgttgtggggaagtggagagtagtacagctaagccagaccccattgtgcccgcaggttagagcctggcaatgccgtttgggtgtgtgactctgggygacaagaagaactataaccagccatcggaggtgactgacagatatgatttgggacaggtcatcaagacgtgagtgccgggcctgtcaggcaaggctgggtgggctggtgagcaggggctagggaagtggcagtggagtgcagctgatgctaaggccaggcctgagtgggtgcctgtcggctgcagtgaggagttttgtgaaatcttccgggccaaggacaagacgacaggcaagctgcacacctgcaagaagttccagaagcgggacggccgcaaggtgcggaaagctgccaagaacgagataggcatcctcaagatgtgagtttgaggcctgggattggggcggggtgggaggcagcagggaagggcttagagggcaagtggcctcaggcagtcccagcctctggccaattagtctgctgtggccactgtggtgaccacagcctctcccaggggttcatccagccctaactactggctcccctccctgtcgccagggtgaagcatcccaacatcctacagctggtggatgtgtttgtgacccgcaaggagtactttatcttcctggagctgtgagtgtgggtctggggacccaagattccccagcgcccagggctttcacctgtcccaccctctgcagctaaggaaaccccctttctggacccttggcgtcccaggtccctgtgccttgctcagccagctgcctggcgtaggcagctcacccaagtgctcctgccctacccctgattctgcccacgccaggctcaggggctggtgtccctcagggccacggggagggaggtgtttgactggatcctggaccagggctactactcggagcgagacacaagcaacgtggtacggcaagtcctggaggccgtggcctatttgcactcactcaagatcgtgcacaggaatctcaaggtgagggcagagccagagtcaaagggccagttggcagctgggctggtgctggggtgggcagcacctcagggccttggtctagcctccaaggtcctcatggtgtcttctgctcacccacatgctattctcacaccacagctggagaacctggtttactacaaccggctgaagaactcgaagattgtcatcagtgacttccatctggctaagctagaaaatggcctcatcaaggagccctgtgggacccccgagtatctgggcaagcagggggtggggcaggggcagggggataatggggggcagccttcagggagctgctctgggcagggggaaaatgtgctcatctcaggaagctggtgtggatggtactggacctggctaggcctgatactgaccagcagatgggcgctgtgtttgtagccccagaggtggtaggccggcagcggtatggacgccctgtggactgctgggccattggagtcatcatgtacatcctgtgagtggacagatggacaagcaggcttgcagtcagatggggtgggggcatgtgtctstggcctttctgtgtgacccttcccccatgcaggctttcaggcaayccacctttctatgaggaggtggaagaagatgattatgagaaccatgataagaatctcttccgcaagatcctggctggtgactatgagtttgactctccatattgggatgatatttcgcaggcaggtgaggaggtgcctgcccagcacttggtagaacgcaagggagtggggagggtgtcctgctctcatcttcctctgtggtattctgcttctgtcccccagcccatttatcacctctagacattgagatggggtgcccatgactatcccctycttggttttgtccacagccaaagacctggtcacaaggctgatggaggtggagcaagaccagcggatcactgcagaagaggccatctcccatgagtggtgagcagggtccaggggagggtgggagaggccagggtccccctcacacccagcagccccatctttgaggcctrgaaggggtgcaggtacctagagctcagggcagcccagaggctctgcctggtagtccctggatgccacatagaagggctgagcagagtctccacaaaggctcattctctcagatccagacacacttgcaccctttccaggatttctggcaatgctgcttctgataagaacatcaaggatggtgtctgtgcccagattgaaaagaactttgccagggccaagtggaaggtaaggcttggataactcccttcttggctctatcccaagtattgcttctggcactcagtttcttgcctgcatcacacccctgcagccacacacaagcttttctcaggccatcaggtgtgggtgtagccactgtgattaccttaagtaggagtgctgagcagctgagtacttggccctggggtggatggaggtggccgggggtactatggaaggagtttggtttggtcactgccaagcaatggatccagcaagcctcacccttagcctttctccactgtgctcctttcagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcatwactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctyacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcctctggccaccctctcgcctttgcttcctctgtcctactggggaggagcccctggaaggcagtggggaagggagaggctgggagcaggttcacaagtagtggctgggagtagtagtgaacagtgccctgtggatttcttgggctgagggtgaagatcatcctcaccacagtgtattcctcaatggtggtggtggtgggggtcctctgaactctagaaatccatgtgagtagtgggtcttgggctgcatttggaccaaggaatactccctgggctgagagctcaagtaagggctgctgtttttgactcctgttgaccgaggagccttactcttgatttaggcatagagctggaatctacctgggccagccascgcaaggacagaccctgctcatagccaaagatagcttccctgagctagggagagggtgtagggtgagcaatgcacaaagattctatgctgctctgtgttgattccttctttctgtgaacacctgtgctttccacctatgccccaaatgaaatctcactctgggtctatttcagctggagcagatcagctttatattatgggactatgcacagggtttcttctgggtagagggagtaacactgccacagatactaagcctaaaaacccaaaagttgacttactccagcccaggtgggcctgggtgaactcaccagggatgctgctctctgggaggacctcaaagataacctcctcaaagataacttctctgatgtgggaataataaaaaggatttgttagtctctagtctttgaagcatctgggcctccaaaattccaaccctactacagtctcaagcataactgatcctcctgagagctaagagctaaagtcagggtactggccctagtgtctccaaactcaaggatagtcatatcttacttggatgaagccaaggttggcctggggtgacctgagggactggggcctatgtgtccatctttctagaatcgcccggaactgaggactgagagggtagggtattgtggtctatgggaactacagaccatagcgcatggtccatcactgtccagagcccaagggacccatcgggaccattgttctattcccttgcggctgcggttttctctgccttggcccagcctgcctcgcgccagctctggcatgggaccacaatgcgctgccttgccctggaaaagggtccagctggcagcctcgctgctccccgccttgatataatgctgcgctctcaagtggcaggtcgagtctccccagaggacgcctgagagcgaccgcgctccgcccaggattctctacggcctcggggccgctaagccccgcccatagttccgcccatccgagaatttgtccaatccaggcgaagtattcacgctccgcccaaagttttgtgttgtcacttccggcccgctccaggaagtcgtgctgcggagccaaatttgaagcaagcggaggcgcgggggcgcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtggtgagtgactgcagtgttggggcccggtgtttgcccgggtaccgcttcagggccttgaggtgttgggcctccaggcggtccaaccccggaatccagacaagtgatgagaaccttcctcctagacgaggccccacgggagcttcccaacctgggcagaagtgggtcaggacaggctttctggtagaggtgatagctgagctaagcctgagggggactaagatggctcagtgaagatagatgcttccttgatcacctatacaaacagatgtgatttcaaaaccgttagcctgggcaagggtgagctttcaccacatcaacaagtccttttatttcttccagatagaaacctgctaggcttctggctacccaagagagtttgctgtgccttacttgatggtttggaattattctacccagagtcatctcactgtccagacaccccaatgtattcgccatgtcagcaaacccgtttaacatggggaaggcaaggagatgctcccctatccaggggtcctgctgaccgtgtagggccattctgttgagtgtacagctagtggggaaagattcccctagcagatgtggacaggccggtttggacctcctagcaaaagagataaggcagcgttacccctgggaatggtgggtgataataatcacagggtcttgtggggctaaaggccctaggaagcagaaaggcaggcatgacactgatggctgctggcttacttgcaaagctttgtttaggcctgtgttgctgacagcctgagccccatgctgagggagccactgctgtttggttagactagaaattaagctcgcctctaagcgtactctattttctgtttgcctactctattttcttctatccttttactttatttatttatttttattttattttatttttgagatggagtctcgctcctgtcgtgtaggctggagtgcagtggcgtgatctcggctcactgcaacctccacctcctgagttcaagtgattctccttcctcagcctcccaagtagctgacattacaggcgtgcgccaccacgcccagctaatttttgtgtttttcatagacagggtttctccatgttggccaggctggtctcgaactcctgacttcaggtgatccacccaccttggcctctcaaagtgctagggcctatccttttactttaaacttttctgtgtccttgtgttttacatgtatcccttgaaacagcatttatttctttttttgtatattaaaaagtactttagcttactgcaaagatctttattttattttattttgagacagggtctcactctgttacacaggctgcagtgcagtggtgccatctcggctcactgcagcctctacctcctgggctaaggtgattctcccatcttagcctcccaagtagctgggactacaggcgcctgccaccatgcttgactatttttttttttttgtatttttagtagagatggggtcttgctatgttgcccaggctggtcttgaacccctggactcaagtaatccacccacctctgcctcccaaagtgctaggattacaggtgtgaaccaccgcacccagccttggaaaacaacatttagttggacttttaaaaatccagtctgataatctttgtatttaactggaccatttagtctacttaaaattgttgcaattactgattaaataaagagtaaacatattgtctttagtcgattctgttttgccttgcctattatatcttattgtctcctttcttgccttggtaggaattggttaaatattctgtatttctccatttttccctcagttagttgggtcgttatataccccatttccatttataagtggttatcctagaaattaaggtatgtatccttaacttaccaatttcaaggttaatcagcacctttctcattttcccaggcaactcaaagagcttagaatactaacattcttttcccacttctacgttattgttgaatattttaattgtgtgtatgtgtggtatttttttcgttggtgttatttttgagacagagtcctgctctcttgcccaagctggtctgcagtggtacaatctctgctcactgcagccttgacctcctggactcaagcgatcctcctgcctcagcctcacaactagctgggactacaggtgcatgtcaccatgcccagctaatttttgttttttgtagagacaggatttcgccatgctgcccaggctggtttgaaactcctgtactcaagtgatccaccctccttggcctgccaaagtgctggggtttacaggcatgagccaccacgaccggccaattgtatgtttttaagtaaagtttttgtttggaataatttttttttttttttgaaacaggatcgtgctgtgtcgcccaggctggagtttataattgtttcttcttgcaggattgaactttttttaaatgttcttctttgtccttctttgtctcttgtaactttaattcaaagtctgtcttgcctaattttttttttgagatggagtctcgttctgtggcccagactggagtgcagtggcgcaatcttggctcactgcaacctctgcctcttgggttcacgtgattctcctacctcagcctcccgagtagctgggattacaggcacacaccactgtgcctggctaattttttttgtatttttagtagaggcagagtttcactatgttggccagactggtctcaaactcctgacctcgtgatccgcccacctcggcctcccaaagtgctgggattacaggcgtgagctaccgtgcgtggcctatcttgtctaatttaaagtccattttatctgctattagtatagccacttcagctgtcttttggtgactgcatggtatatcttttttcatctgttttattttattttattttattattgtttttagagacaaggtctcgctatgttagccaggctggtctcaaactcctggcctaaagcaatcctcctgccttggccttccaaagtgctgggaatacaggtgtgagccaccacactcggcccttatccaacttctagcttccgttgtagctattgaagtcagattttagtttatcagttactcctttaagcatactttggaactttatcctcagactctcattacctttagaattttctctgattttggctttctgcagttttagtatagtgtatccaatatgaatttctttttacctttttcttttcttttttttttttttgagacagagtcttgctctgttgcccaggctggagcacagtgggacaatctcaactcactgcaacctccacctccctggttcaagcaattctcctgcctcagcctcccgagtagctgggactaaaggcacgtgtcatcatgcccggctaaattttgtacttgtagcagagacagggtttcaccatgttggccaggctggtctcgaactcctgacctcaggtgatcttcccaccttggtctcccaaagtgccgggattacagccatgagccattgtgcctggccgaatttctttttacaaattctgctcgggattcattagatttctttaacgtgtagagcaatttctttctttctttcttttttttttgagacggagtctcgctgtgtcacccaggctggagtgcagtggcacgatcttggctcactgcaagctctgcctcccgggttcacgccattctcctgcctcagcctcccgagtagctgggactacaggcgcctgccaccatgcccagctaattttttgtatttttagtagagatggggtttcactgtgttagtcaggatggtcttgatctcctgacctcatgatctgcctgcctcggcctcccaaagtgctgggattacaggcgtgagccaccgcgcctggccgtgtggagcaatttctttaatcagttctggaaaattatcagccattatctcttcatatattgcctctattccattaacttttttatcctgtgttattatttatttttgaggtagagtctcgctctgtcacccaggctggagtgcaatggtccgatctcggctcactgcaacctccacctcctgggttcaagcaattctcctgcgtcaacctcccgagtagctgggattacaggcgctcgccaccgtgcctggctaatttttgtatttttagtagagacggggtttcaccatgttggccaggctggtctcgaactcctgacctcaagtgatctgcccctctcagcagattgttgttgttgttgttgttgagacagggtctcactctgttgccaaggctggagtgcaatggcaccaacacagctcactgcagccttgacttgggctcaagcagtcctcccatctcagccttcccagtagcacatgccacagccagctaattttcttttcttcttcttctttttttttttttttttgagacggagtttcgctgttgttaccctggctggagtgcaatggcgtaatctcggctcaccgcaacctccacctcccaggttcaagagattctcctgcctcagcctcccggggtagctgggattacaggcatgcacctggctaattttgtatttttagtagagacggggtttctctgtgttggtcaggctgctctcgaactcccgacctcaagtgatccgcctgcctcggcctccnnnnnnnnnnnnnnnnnnnncccgcctcggcctcccaaagtgctgggattacaggcgtgagccactgcacctggcctacctaaagtctttgtgg

SEQ ID NO: 10909 - DNA, 24054 bp, Homo sapiens
  misc_feature (1)...(24054): n = A,T,C or G, or insertion/deletion polymorphism (see Tables 1-2)
ccaggctggtcttgaactcctgagctcaagtgatccacccaccttagcctcccacagacctattattttttcagaaatagggtctcatgggtcaggcacagtggctcacgcctgtaatcccaacactttgggaggccgaggcgggtagatcatgaggtcaggagtttaagaccagcctagccaatatggtgaaaccccgtctctactaaaaatacaaaaaaaaaaaaattagccaggcatgttggcggttgcctgtagtcannnnnnnnnnnnnnnnnnnncaggcatgttggcggttgcctgtagtcacagctgctcaggaggctgaggcaggagaattgcttgaacctgggaggtgaaggttgcagtgagacgagatcgcaccactacacttacagagcgagactctgtctcacaaaaaaaaaaaaaggaaaagaaatagggtctcactctgtcacctgggctggagtacagtggcatgatcttagctcactacagcctcaacctcccaggttcaagtgatcctcccacctcatcctgctgagtagctgagactacagcacacgccgccacacctggctaatttttaaatttttttgtagagacaggatctccctatgttgctcaggctggtctcaaactcctgagctcaagtgatcctcctgcctcagcctcccaaagtggtggggttacaggtgtgagtcactgcacctggcccatccttcaggtctctcgaaggtaaggctagagctagtgtcatctgctctctaccctgaccctatctctcctctgcagcctgtgcctgtgacccacagggctccatcttgcccagctgtgattcacacatgggcacctgcttcttcagagagggcatcttagggctgaggtgccaggcatgtgctcatggctccagaggtgccttcccacactgcacctcctgtcccacctgcttcaccttctgagaccaactcctggctctgctcccactgcagctggaagctgtggcccaagaggtggccaccctatgctaggggatgcctggtgggggtgttaggggccagggtggacacctgcaggtcctagattgggtactgtagcaggcacaggctgctccctccaacctgggaccctgcccactgttcagtgggctcttgttgccttccacaactcctcccatagcctggacatagagtcacagccttggagcagcatcaacaacaggtacacagccagggggactgtgggtgggagccatgggggagtcacaggaaaccatggcttggacatggtgttgtaggcaacatattccacatctgacccacgcccaccagctgcagcaaatccaggccatagcaagctccacaggaatccaggcacaggagacatggtattgggaaaggggaccttggggcatgactgccatgacccacatgcaagcagccgtgcagatcatccagcgcttcctcatgggtacatatctgcttgttgcatgtctgttcacagccaagggcagggttaatagggtatgcaggacactatcatgatactccttccagaatgaggaatattcatcagggctgaccaggggtcaagtgggaacactagtgtgtgcgtaaattttttttttttttttgagagggagtcttgctctgtcacccaggctggagtgcagtggtgcaatctcggctcactgcaacctgcgccccccgggttcaagcgattctcccacctcagcctcccaagtagctgggattacaggcacactgtaatttttttttgtatttttagtagagacggggtttcaccatcttggccaggctggtcttgaactcctgacctcatgatccacccgccttcgcctcccaaagtgctgggattacaggcgtgagccaccgcatctggccatgtgtgtagataaatttttaacaactggctgtgagtcaggggaaactgatttttagcatttgtcaatatccatgatgtaagtaatgctatcatgattgatttcagtccataccatttgacaacttatttgcaaaattcctgaaaatttaacaattggctctttttattttagtattattattattatttttgagagggagagtctcgctctgtcacccaggctggagtgcagtggcgtgatctcgggctcaccacaaccgccacctcctgggttcaagcgattctcctgcctcagccttctgagtagctgggattacaggcacccgccaccacatccagctaatttttgttatttttagtagagatgagttttcactacattggccaggctggtctcaaactcctgaccttgtaatctgcctgccttggcctcccaaagtgctgggattaccctttttttattatcattttattttttattttttttagagacagagtctcgctctgtcacccaggctagagtgcagtggtgtgatcttggctcactgcaagctccgcctcccgggttcaagcaattctcctgcctcagcctcctgagtagctgggagtacaggcacatgccaccatgcctggctaattttttgtattttagtagagatgggttttcaccgtgttgctcaggctggtctggaactcctgagctcaggcaatctgcctgcttcggcctcccaaagtgctgggattacaggcgtgagccactgcgcccggccaacaattgcctcttgtaagcctccagcacaccactggatagttgtgtctaaggcaggatcagtgagaggctagggtcagggtttgttggctcagagttcagggttcaggcctaagatccctaccctcttccccacagacaaaggtgtggacaccacaagtgtggagctggctgtcagtgccccttccccaaggtgggggcagtaggcattgctcttctgctgggtcagatccagggtgctctccctgtaccggatgccatgggccagaagctgcccaaagctgaaggcatcctccatcaggcagagtgaaccaggtgaagggccaggaggctggaggtggaagtcagagggtggccagaaaagggatgcctaactgaacacctgtgttcttcaaggagggtacaacctgggcccagcaccaagcactggatgttcagggggtgctggctgaggggggaatggaactcatgcaggggccgcagagcaagggctacaggaagtgaagctggcacttgaaggcctggagggcactgtacaggaggtgataccctacttgtaccctcagctcctttacatcccttgttcaatgactgctgtgatttccattctccctgagatccttgactcactatgataccacagtgctaccaagtaccttgaccgtgataacactcagcctagttgctactgtgctgtgtcctctctgtgaccccctaacctttgccccaggtagtagggcgcctggcccagatggcactggcagttgaggtgaccccagtcccagggcgtctgtccagtgtagctaaggtgctcagggcatgttttgtcctgagtcagcagcaggcccaggaggcagaagaatgggcagcatgagtcgtaggcagggctgagggcctgggcaagatgaaatggggaagagtgggcactggggtctcagggacccctctggaacagtggaaagtggggtttgggctggggctgggctatactggactgaggcgggatctcagttctaaattctccttttctccaggaaccttaggcagtaatatatttgaggcaatatattctgggtggggtggggattcaggtccagccctgccctaggagttgtaggtggcccctttggctgtggccgagctgcaggaggacacatatggcctggtagccactgtgcaggatgcaaaagaatgggtgcagcaggcttgagctgaggcccaggagctcctgaagaaggcataaagcagcttcagctgcctgcatggtgcatggctggcctgcaatagggcaggcacagggaacggcttagggtcagatggaaaggtcagggccagaatagggatgttgtggaagggttaaggctgggtccagatcagatcttgactcatgtagggatcagggctagggtcaaggtttagaccagggatcaagtgttgattaggttcagggtttatttaaggttagggctgggtcagggtcagggttgtgatagagactgggaccaggatcagaggttagagccaggggtcagagcctggctcagatgacctgaccccagggttggagtgccgcctgacacagaatgcacaggcactgggcaagaaggcagccaccctgcaggccctggagcagcaggcagctgagctgcttgggcacatgatgtgctttgccaccaataagtatgccacctgctaattactgtctatggaagccattaagaaggactgtgggatcacctgggtaactcaaagtggccctagagtgatccaggaatctcctggccttgggagaccaaagatcctactgagtgcccactgaccctgagtgacccccccatgtggccccacgatgtcccccagtggccctctgaccttgagaaagcagacagatcatgtaactccctgaggccatctagtgtcccagaccttgatacacctttatctctgagtgatctaaaactgtgagactacagtgctggcattctccactcaaaataaatagatggggcctggcactatttactggctcatgcctgtaatcccagcgctttcggaggcagaggcgggaggatcacctgagatcaggagttcaagaccagccaagccaacatggtgaaaccccatgtctactaaaaatagaaacattagctgggcgtggtggtgggcgcctgtaatcctagctacttgggaagctgaggcaggagaatcgcttgaacctgggaggcagaggttgcagtaagcggagatctcgccactgcactccagcctgggtgacagagcgacactctgtctcaaaaaaaaaaaaaaaattaaaattctcagtaatttctagtatccctgatcccccaggttgactacatgatcctcagggtgactggagacctctactccggatatccagaataactcccagcgatgcctaaagtccaacggattgactgacccccacccaaccctcacccaacccccacccccgccgcccccatgctcctttgtgaagtggggtgattcccctgaggaactatcatcagctttcttccctggatggcagctcagggcactccctgccgggactgtggaggcggcaggccagacccagccctaaagaccggaggaccccatgtttcccccagcttcccgttcccagggccctgggtggggcgcgccccatatcccccacccactttcctccttctctccccctccacgccgccgcgcacattccaaccccaggctcctgcgatcccggcaggccaaaaagtctggagcggataaatagccacaagatccggagtcgctcgccgtagctctggtccaccacccagagcctatttccatacagggaaacccgcagcacttctcgtgcctacttaccgtagtgactagtgggggaggcagtgacccccctggagctgtgcttcgggctgggtgtgcactttccccatctctcccccagccccattctgtccagtccctaggactacccgagagccccccacagccctgaataggggcatgtgttgctcctgcttgtgccctccagcctctctgttgatgctggagccctgggatcaaacggctgagttgatggtaatttccacggcgcccatgacgctgaggggaaaaggctacggtctccttggtccagagttggagatcccgaagatctctcatttgctcctgccatgcccccaacttcgtgagccctcttccaaggatagtttaaagcaccaaaccccttaccttcccctggccctcgtataggtgtgggcttgggggcacaataaagatttgtgggtgaagtggtctgtctctggttcctggggcgaaggcagtttccggagggaaggggtagggttggggtgggggcgctctccgcccggtgttgcgctccttcccagaatccgctccggcctttccttcctgccgcgattcccaactttgctcaaagtcgctggactctaagctgtcggagggaccgctggacagacctgggaactgacagagggcctggwgggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcggtgagagggcctggtgggggctgggggttgtggaatgtgatggtaggtcctggtagttgcccttggggcacatgaggtggagccactggataggaactcagcggaactgactgagctactgtccccagtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggtgtggctggggacagggtgtgacgccgagtcagggtggggctggcactgcctgaggcactgattctaatccccatccaacccaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtgaggccatgggtggggcaaaagtgagcagggctgcccaccagtagctttgagtccttgacttccgattcctgtcccaggtatccctgcggtcaccatccagctggacctggaggctgagtttcatttcacacacctcattatgaccttcaaggtgcctgcatatctgggagcctgcccgaatcaccctgcttggctctccattgcccctggacagagcctcagctccttaacacagcctccttgagcatggatgcaggaggctccttcatcccttcacaccttccatttgcctccaggcctttgcacatgctcttctgcctttccaatcccaggctgggtcaggcgctgtctccctgagccccatgaaccctgagtctccccattagaggtggctacctttgctggtcattatctggcttccaccagtcacccccactctctgtgagctatttgagggcagtcttgggctgagcagggctcttgatggctctgggttgggcttgggtcctggtgcctgctgatcagctatgcccccctacccagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtgagggctggcatctgggctgggggctggaagctggggatgatgggcctgaggcaaggtccagtgtgactatgaactccctgcttctccaggtcatctatcgtgtgctggaccctgccatccctatcccagacccctacagctcacggattcagagtgagtgctccaccctttgagtctggcacagtccgtgtccggctagggactatttggggcctcagtaactattttgggtgcttcctarggcaggtgccaagcccagtttagctcgggtggcagtgtataggaggtctttcaaggtgaccttggcagctgagcccctgggtggacatggggcagcaagggcctgcctggtcagttggccccccttcccccgcctcagacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtaaggggcttcagacggttgggatagggctaggggcaggggcggacatggctgagcagtgctgacaacctacctgccaacctctataggtgcacggagcttgcatctgcaaacacaacacacgtggcctcaactgcgagcagtgtcaggatttctatcgtgacctgccctggcgtccggctgaggacggccatagtcatgcctgtaggagtgagtgagatcttggcctccatagctccagcactctgcagcctggctgtgccctgggtagaacctagagctagttggtcaagcccctaaaacccaggctgtatccaaagagtatgcagaccttgatgccccttgggaccccctcaatcctcctctgcagtctgctctgggtagggaaccagtatgatgctgaggccttgaagtccctgagcccctacccacaaattctggcctgtgatagggatctaaggtggcctacttcttacccttgtgacctggttcctcatgtggcctttgccctgcccttcctcccctgccagagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctgtgaggctgggattgggcacggggagagaaagctgagcctggggcaggaactagagagctggactgctgtctaaattgcaggaaattggggttaggggcttggratagaacttgaccagggatccagggtgggatcccttaggcttaggagaggactggcagtgagctagttgagatagggtgagtgaccctgtatctctttttgccgtcagcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgtatgtgtctcctgccctaacttctatgctgacctttaacccctgtcctcttactcctgactcagctgaacatgagcactgccacagtttcccaaagtgctgatggttctccttccctgcaggatgtcaatgtaatgcacggggcacagtgcctgggagcactccttgtgaccccaacagtggatcctgttactgcaaacgtctagtgactggacgtggatgtgaccgctgcctggtgcgactggaaggggctggagttctaggggcatgatttgtccttagagcacagggctggggtgtcacatctatgccagtgggtgggtgctgagagcttaggatccagtcctggctgagaagcctcaggtctgggaggccaaggatgtgggccagtggtctggggggcatgttttcactgaggggtgattgaggctaagacgtgtggttgggatttcctgctgggtggtgatggggtctggaggtctgtttctggcccccagcaactcctttcgtgcagcctggccactggggcctgagccacgacctgctcggctgcygcccctgtgactgcgacgtgggtggtgctttggatccccagtaagtgttgtaaagggggcctgggaagggatggggaaagatcctgagcagaagagaaggttcttcttgagtaaccacagagttccctccaggtgtgatgagggcacaggtcaatgccactgccgccagcacatggttgggcgacgctgtgagcaggtgcaacctggctacttccggcccttcctggaccacctaatttgggaggctgaggacacccragggcaggtgtggggcctccccctaagcagagggctggatgtgggtggacacgtctatgactggagaggtggggttatgggcagtaccttgttgaggggataggggtgatatctagctttggcaggagaaatggggtttggggctggctgtggcagaagaggcaaagcctcacctgagcctccatccctggctgcattatctcccaggtgctcgatgtggtggagcgcctggtgaccccyggggaaactccatcctggactggctcaggcttcgtgcggctacaggaaggtcagaccctggagttcctggtggcctctgtgccgaaggctatggactatgacctgctgctgcgcttagagccccaggttagaccctgttatctaatctggrgctgaacctctgggtgtgggagcatctcctccatcatcccgttttcccaggtccctgagcaatgggcagagttggaactgattgtgcagcgtccagggcctgtgcctgcccacagcctgtgtgggcatttggtgcccaaggatgatcgcatccaagggactctgcaaccacatgccaggtgagggcactggtggtagcactcacaatggcagggggttgtggggccagccctaagctccctgcagggcacctggaagaccccacagctcattcatctgttccttctttcaaatacctccagaatgctggttgccaggccctgttgggcatggctctgttcacagaaaggaagtagacagatcaaggcctgctctctcaggggtctaaggcccagaggccaaggcaggaattaatgggaaatcacctggtgtcactatcaggagggtccacagtggtggtggtagagggtggtagtggtggggttgtggcatcagagcactctgagcagggatgtgcctggtctgattaatgttttattacattttgggtagtatttgtttcatgtttcatgtttcttttttttttcttttcttttccttttttttttttttttttttgagacggagtctcgctctgtcaccaggctggagtgcagtggtgcgatctcggctcactgtaatctcccacctcccgggttcaagcaattctcatgtgtcagcatcccgagtagctgggactacaggtgcacgccaccacgcccagctagttttttgtatttttagtagagatggggtttcaccatgttggccaggatggcctcgatcttctgaccttgtgatctgcccgccttggcctcccaaagtgttgggattacaggtgtgagccaccgtgcccagccctgtttcattgtttcatgttttgtttgtttgtttgtttgtttttgagatggagtcttgctctgtcgcccaggctggagtgcactggcgcgatctcggctcactgcaagctccacctcccaggttcacgccattctcctgcctcagcctcccaagtagctgggaccacaggcacccgccaccatgccttgctaattttttgtatttttagtagagacggggtttcaccatgttagccaggatggtctcgatctcctgaccttgtgatccacctttctcggcctcccaaagtgctgggattacaggcgtgaaccactgcacttgacctattgcttttagtttttgaccatgtaaatattcaaacagaaggaaagagaataacatattgaacctggctgtgcccattatagacattttgccaactgtgacttgtgtttagaaaaaaaattcctctagaccaggcatggtggctcatgcctgtaatcccagcactttgggacactgaggcaggaggatcacttgagcccaggaattcaagaccagcctaggcaacatggcgagaccctgtctctacaaaaaataaaataattagctaagcatggtggtgtgtgcttgtggttccagctgcttgggaggctgaggtgggaggatatcttgaacccaggaggtcaaggctgcagtgagccaaggtcacgcactgtactccatccatcctgggcaacagagmccgcatctcaaataaacaaataaataaataaatcagaaaataaaaagaaaaaagatgagggattgaagaacaatttttgggatgggataaaagaacccaagtatgagtttgcagcacaatgggaaaggaaagccttggagacaaagagagagggggcgacatagtgttgatgaagaggagcagccattgtaggttgtaggtcggggtcagaggaagcgtgaggtggttgttgaggagaattggcaagttcttgggatttccaggctttatgagtatttccagtgagtctgcacaggtggatgtatgattctagagggccacctttatgagactattctgtgcagattctttgttgggctgcccagctgtttgttggcctagcgcagcccaacgcaacccagccatagtctctgctttggccaatggcctggttgctgggagaaggatgggggaggcccagatgatttgtacagggcccctagatgacccactgcacctgtccccactcgcccccaggtacttgatatttcctaatcctgtctgccttgagcctggtatctcctacaagctgcatctgaagctggtacggacagggggaagtgcccagcctgagactccctactctggacctggcctgctcattgactcggtgaataatctcctcttgcccacaccaaccaagatggcagggcccgtggtgtgggacttgagggatagcaggggtctgtggcagaagaggcaggcccatggtggtgccagggtgggcaggcttgtggcagtgctaaggcaagtgctctggcaatgcctacgtggtcccaggtctgaactgcgatcttccttgctcactccttcagctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgcgtgagtgtctgtgatgtgggttgatggggcagaggtggggacccagcctgacttggcccaaccctcctccccacagcatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaaggtactcttctgccccttgttccctcctatgcttctctctccttcccattactgttctctctcctccttctggacctgctgctggtttcctcaaactaagtcttggaccctctactctcaacctgggtcagttgtagttctcttccatttcctgaccttcccacctagactcccactactcacactcccctgagaccctcccccacccacactcccctcagaccccctcccctggctctggctcagctctgccttgctcctagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgagactggagcagctatgagtgggttggttggtgggcaggcttcccagggatgacacatttcttcttcctcctccctgcaggtgcattgctggtttccacrgggacccacggctgccatatgggggccagtgccggccctgtccctgtcctgaaggccctgggagccaacggcactttgctacttcttgccaccaggatgaatattcccagcagattgtgtgccactgccgggcaggctatacgggtgagtggatgggggcaggcrtgggatcagggtgagttggctgggctgagcactcacagcttcctcttaaccgtgggcagggctgcgatgtgaagcttgtgcccctgggcactttggggacccatcaaggccaggtggccggtgccaactgtgtragtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgtgagtatgagtgtgggagggcatggctgaattggggttctgcttcttggcctcctcttgactactgtgctcatcttggttggcacaggctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgaggtatgggaccctcctgcagatccctggttagatggggccaggtgtctgtcttatctccagggcttagcctctkatagaggctctgaccctgccttgttcccaccccagttcacagggcagtgccactgccgtgccggctttggagggcggacttgttctgagtgccargagctccactggggagaccctgggttgcagtgccatggtgagggagccagcggggccagggtagatggaggacttcccagaatgccccacagtgaccctaactctgtgctctgctctttcttgcagcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcrcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggtgcggaagggcctaagaatacatggtgggatggggcagaggcccagtggaccagggctgaagcctctctaaacacccccctctccatcattgcaggcgtgaaattggggaggccactgagcacctgactcagctcgaggcagacctgacagatgtkcaagatgagaacttcaatgccaaccatgcactaagtggtctggagcgagataggcttgcacttaatctcacactgcggcagctcgaccagcatcttgacttgctcaaacattcaaacttcctgggtgagttgttagccaactaggcaggtggaccagggtcagtcttcagctgactgtctgcctctgcccaatttaggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgaggttgaagtgttgggtggggcaggtgggtgtagatgttcctctcacagggccctgacttgttctgtgcctggcaggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccgtgagcctcccacgtgtcccaggccatgtggttgtcccctttggcaactcccggtgtctgtatctcccttggttcatacttgagcctcagggactacactggattagtgtttatgatcccttgactggctcctgagttattgcccatatgtggtcccaggtccatgttcttgagtctgagccccttgtatagtccctgtccttgtgattatatccttatgcctggtaacaaacccctatcccatgtacatgtcctgagtccataccccaaaactgtatcctcatgcccatgctggagaatctatgttcttaagttcttgctgtgtccctatagaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggygggcaaggtctgaccccatccctggcccctatccctgacacctggttttgatacctccaggttctgattcccccttctccccaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtgaggtcttcctaggacatcagtgggacaaggttatgggcatgaaccgtagatctgtgtaacctttggctcacccatggcaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcaggtgggttgaggcagagccagctggagaaggtaggggtggaagatgggcctccactgagctaccacgctaacctaaccctctacatctgcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacagggtaagaaatggggcaccagagacacaagactgcgggaaaccccccctaaactgacacctgcccttcctagaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaacccccactgtgttgtctggactctgatttggggcgggcgggggagtctccaggggaacctcgaggttgcccccagcagaacccatgcaccgctaagccacccgagcaccgcctccttccgctcgggcccgccccggagctgcgggtcgctccgagcccattcccgccggaagtgcgtcaccagcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggtgagtggagcaggctgcaactcgctggcttggccgcagcggggaggccgcaacgcgcggccgcggcggcctgttcaaggtcacgggccgtgccagtccctacccctagtgccccgcagcgtgccagcccactgatgccggcagggccgttacgctatgcctgtggccagcctcccacctgggagaggactggcggccagcgagggcaacttcgtgggagaggtggtggcgggctcggggttcagaggctgaagctgggtcgcagctcgaccggggcgctgatctgtggtcagtaaccccgcgctgccatttcaggccggctcgggtctctaaacagccccttacccgcctcgacgtccctggggcatgggggagggacgcgaccttcggctggggcctgggtgcaagaaggaggcgtcggtggcaggtgtcattaaagatccagcccaccagtaccacatctgacctgtagaagggtatcctgccatccctccttcctcctttacacacttaggggaacacagactagtcattatctgtcctgctactggttcaggccaggcttgaggctgccaggagtcctggatctgtggtcctccccagcctcatctcagtatctagtttcaagaccttcattttggaggaggaaacagtccagaatccactggtgggtctgtgggaaactgtagtggtccttgtggctcagagctcatgagtgaaggcatctgggaaggaaggtgataatttctgttccagtctcaaactggatgcccatcctgccttagtactggagcagggttgctgctgaagaggtagcgtgacatctagatacacttttcagtccctttctgcttgggacagcagctggggagaggactttctcttgaaatgaagaaggaccaagcagtacataggagcaggttcttgccaagggtgggagctggcaggaggcaggtggagtgccttagccccaggactttttctgggcaatggtagaacctgggttgagcctgtttacagccacagagcctggttctcctgcggcttgtctcctgtcctgccttcctcctccaccttctatttctccagtggtgactaagcagccagtgagagtgaaggaaaagtgagcaccctgctcggagtgccagccctgtgggctggagccgtggctcctctccagattggtggagtagcctggtcccaggccatgacttccttgacctggtgccccctcagtgaggctttcacctgtgtgggactgttatggtgggtatctatgaggcttggccagaagtggttgctgctacttgcattatttattacctcttcagaatatcctgagagtgtccaggggtacttaagagatgagaagatacagctctgtagcattagtgtcctgtgttgctgagccctgggtgtagctaaagagcaagttgttgggtcttggcagtgatcactggcttctttccattaggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaagcatggagatcctaggaaaggtgggagtggcattcccagagtaattgtggccttctctgcctcccatcttattggtatacagattggggtttgggagatgactttcttgttcttctctctgtcctggtttgatgatgagagaagaaggacccatgataacctcagtagagcctcagctttgaagcctgagtacttggctaagatccagaagatggtgctgttggggggcttgccttctttcctttttaaacttttttcttttttttgaacctgttctttttttccttttttttttgagatggagtctcattctgtagcccaggctggagtgcagtggtgcaatattggctcactgcaacgtccacctcctggttcaggtgattgtcctgcctcagcctcccaagtagctgggattacaggtgcatgccaccacgcaaggctaattttttttttttttttgagacaatgtctcactctgtcatccaggctagagtgtagtggcatcttggctcactgcgggctctgcctcccgggttcaagtgattctgctgcctcagcctcccaagtagcctcagcctcccaagtagctgggattacaggtatgcaccaccacactcagctaatttttgtatttttagtagagacggggtttcaccatgttggccagactggtcacaaactcctgacctcaggtgatccacccacctcggcctctcaaagtgctgggattgcaggcgtgaaccaccgtgcctgtcccttttttttttttttttttaaaggcagggtctcactcttgcacagattggagtgcagtgcaggtgtgatcgtagcttactgcatcctcaaagtcctgggctcaagcagtcctcctacctcagcctcctcaccatgcttgactaatttttcttattttttttttagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggtcagtaacgaatgggctttttgttgctagggaaggggagggggcacttgcaatttggctcccatctgaagcagtttcattaggctgggtctctgttacctgcttatcaccatcaggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtgtgtccatctgccctgagcacagtagtatgtttgaatcttctgatatctcctatcctacctcatggaccctgctctgtccccaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggtgagttctagtagtacagggttgggtagggataccagtgtagtcgacagggcctgactgctgtatctttggcagaagaaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggtaggcgcaggggctggccccggggcccaggcagggcccagcgccaagagggctgtgcatctctgcagagggccagagggggacgggtccagggatgaccctggaccccggggtgatgccccacccttcgtggctgacccagccacccaggtgagagctgggcacctgtttgggtgttaggagatggggggaaagggtgtgcactggagtgggagccacctggcagacccagggctgattctttccacaatcttgccattaataggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatggtaaaggtgggggtgggcaggcagagccctaggttgggttgcaaagtttgtaggtggatagagagtagcaataggctggaacctgtcctggttggggctgagccatggtctcaatatagagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccaggtgggtgggtagatgatggggcaaacaatgcctcaggtgggacagtatgtctcatgctcttcctcttgtccttcctcctatcctgctgtgcctctgcagggatggaaacttcctgaggctgcacccgggctgtgggccccacaccaccttccgttggcaggtgaagctcaggtgggtggtgcccggccccaccactgtgcctgtcctaccccgtgggctccatctccctggctcatctatcctgatgctcattcctcctaagtccctgagttcagccttttcccacaggaatctgattgagccagagcagtgcaccttctgtttcacggcttctcgcatcgacatctgccttcgtaagaggcagagtcagcgctgggggggcctggaggccccggctgcacgaggtctgcacacgagctcccttcattgcccagttccacgtgaccaggacccaaacccctgtcacatgctgctaaccaccagccctctcattccccctttttaaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcggtgagaattctggggtgggaaggacgaagaatggaggctggagagtcttggggctgttctctcatgtcgtctttgctcctgcagcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatggtgagggcagggcctggagcctgggttatgggcagagagagtgcctttgttcctcacacctttgctcggctactattcctagaccgctcctttgaggctgagatcaactacaacaacccactagggactggtgggcgtctggccattggctttgccgtgctgcttcgggcgctgtggaagggcacccaccatgccttccagccttccaagttgaaggtgatctgtgaccactgtcacccttggctggagggggcggggagggccagccagctgggtgtgcagtgggtgctagggcttcatgttcacaccttggctcctgtatccaggcc

SEQ ID NO: 10910 - DNA, 21190 bp, Homo sapiens
  misc_feature (1)...(21190): n = A,T,C or G, or insertion/deletion polymorphism (see Tables 1-2)
gcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtgagaacagagcagcaagtagataagggggcaggatggagaagagagagacttgctggtcctgacccaatctctgtccccaccaggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggtaagcagtggaccttggtaactgtgggtggggtgtgaggaccaggatgggcatcctgagcgcctgttgcctgtctcacccctccctgactggacctgacctgcaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggtgagggcacacacagccagcaggataggtggtaggggtggtggtgcagactttgttcacactcttcccaccctgctgtaggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccaggtgaggcatgtgggaggctttacagaatactgggggacagttcacagactggggccgggttgggggatatagcttcctctcctccagccacaggcccattgagccttgggattcatgagaattgcagagttctcttaacatcaaagctttagccagaggcatccccatgccttggggacactaacaaacatacaagtacactaacatgctgccactggcaagcacattggcacctacttggcacaggtcaggcaactgctctgaacctcactgggcactatgctgtgaatgaactatacctgacactctcctagatttcctctgcacattccccacatgctggcccacacaccctcacttgtgatgtccctgagttctagtgtgcactcaagacaaggcctatttgggctggccatggcctctggtggctgttatactctttgaggtaagcatctgtctttgctgagccttcaggatcttctctttagtgacatggtgtgccataggcccagttagtgggcgtaggcacatctcttttctggactggccgtctcctttctggctccatcctctcttgagccttctctgtcaagcttagagaaatccttgcagaagactggtcaggatctgggtatgggtgggaaggagcaaggagattgctctgggattggcagtcctgttctctatgaatcggtgtcctttggggaggcctggactgaaatactaaccagataactcccctcccacctccatgcggagctgcatgtggattgagagctgtttagggtaggccaaaatgctgtcaagattctcttacccttgtgctcttactctggacagccctgaggttggctgcctgccttcctccttgctgtttgatctagaatgcagggtgttagccccagtcaccccaggtgggactgtcatggctaagggtctcagggacactgggtcctccccacccccggggtgctgatggccgtttccacataccctaggcttcccggatttggcaggagctggaggctgaggaggagccggtgcctgaggggtctgggcccctgggtccctgggggccccaagactgggtgggccccctaccacgtggccctaccacaccagatgagggctgcctccggtactttgtcctgggcaccgtggcggctttggtggccctcgtgctcaacgtgttctatcctctggtatcccagagtcgctggagatgagctcgcctgcaggcagctgctgtgagctggcctacctgcctgccccaggccatgcctgcctttgttgtggggaacacctctgggctttgggcctcagcttatgcatctggtgggagagggtggggaggttgtggcccctgcaggggcagagtatcctagggtgtgtatccatctggctgtctgtccattcatcctgctgctctgacccttggcctcaggcttggccctgcccaagctacttcctgtacttaaaagtgttaataaaaccagactattcaggcccaatctcgtctctctgtctcaacgccgctgctgtctgcgcctgccttgggaccctcccttgggtgccagggctccaagccagcacccccgggatgccaggcggcatgctgggcagcccccaacccctgtcctcgtattctgttgcagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcagtgggaagctgaggggtatgatttgggtgtggagacctctcaggttgggacttcttgtcagcttggacccctgaccagtgggctttggcttctccagccgcctccagtgctgcgtgatttgattctgttgtaccttcaattcttctgacccgcattataaacattataattttattctaaaaattgtaattttttttgcattttggaagtgactgctgctgtttaaatatattttaaaaataaataataagtaagtagacttagtgactgtgatccaccacatgctggggccacctcccctccccatcatttgcggtgtgtatgtgtgtgtatgtgtgtttatatatgagagaccctgaaagtgccctagtctgaagggagatgatggggtcccagctcatgtcctatgggtcatgaagcccccagtgctatcagctctttggagcctacctgctgctctttcatcccactggttctggatcctacataagaggcagcttggtaggcatcgtcaggatctcaatatagccaagggacagaggagtatatgaagcactggagctgacagcgtggagtaaaaggtgcattcaccagagcagcctggggctgacaagtcagggaggacttgggggacagaagtactgggagatcttcctcctcctctcctgtcctcagctttttctttgctgtaacttgaacactaactgcatccctgcaggtaacagagcaggaggaaaactgctgtggggcagatcttgctgccctgaaaagaggacaagcagagaggaccagagtgaatcttgtctgacttctattggagggagggtgctggggcctgccagcctgaagagtcttcccttaagagttcctgaagccttccttctttggccaggcatggggggctcacacttgtaatccccgcactttgagaggccgaggcgagtgggtcatgaggtcaggagttcgagaccagcctggccaagatggtgaaaccccgtctctactaaaaatacaaaaattaggtgcagtggcgggcacctgtaatcccagctacttgggaggctgaggcaggagaatcgcttgaacctgggaggcggaggttgcagggagccgagatcgcgccactgcactctagcctgggcgacagagcaagactccgtctcaaaaaaaaaaaaaaaaaaaaagttgctgaaactggccaagtgtggtggcttatgcctgtaatcccagcactttggggcgaggtgggaggatagcttgagcctaggagttcaggaccagcctgggcaacatagtgagaccctgtctttaccaaaaatataaaaattagctggctcttatggtatgcacttgtagtcccaaatatttcagaggctgagatgggaggatcgtttgagcccaggaggttgctggaccctacctctgtccattccacgactgggccttgctggctgctgcctggtttttccacttggtcatctttgtcttgacttttcctggaagcagtgccaggggcttatgcaggcaagctaacctccagactgggcccatacaatttaacatttctgctttgtgcaagtcgtagacatctagggcactagctggatatcgactggtatgctaccacttgtggcattcttggtgacactggtggggctactgcctcattctatgacttgtagccatggcgtccacagtgtaccatgaagtaaccagggaagggagtgcagatcttgatctcattgagggagccatcactagacctgtaggacttggtgatggtgctacagtgaatctattggcagcatcaggtactgaggaaatagtggcagtggcaggcactctgcatggctttgctcaccatgggcacctttatggtgggctgggtacttgcagcttcaaatttggtgcacggctggtgtggctatggctctgcttcttggtacctgtccttagcaccactggtctgcatcccctgcttaattcctgcacctggcctttctcatgcagtacactgcagggctaggcatctggctggggccacggggccatggagatgtgggaagccccaggacagcattggacctggatagcgatacagcatgtggccctggtctgcacctggcatgtgatcattaggtggtatccagatgtaggcccagacttggaggttggtcattaataatgggatgtgggcacaaaagacacagaatatagataaagactagtcaggatcctgcctattccttgaaggtccagaagtatgagcatcaccaattcctgcaagagctccaatctcaaatttggggatttccaccatcccaccaccagctgctcattctctgcaaccccctacctcagtcccttactaccttagtcccttttctcacacacacacaaagtctctgttctgtttcagccagcaggtcctggaagtccagtgagactgtggaaagatccccaagcacaacagctataatcatgaagctataaccatctcatttgtcccaccctctcacaagctcaataaaatatcctctcaaaggcctgcagagggatttcaaggtctaatttgcttgtggttttcctgataatgctttggcaagagggtaagtgtgggatgagatttttttttcttttctttttttttttttgagacagtcttactctgttgaccaggctggagtgcagtggcacaatctcggctcactgcaacttccgcctcccaggttcaagcgattctccagcctcagcctcctgagtagctgggattacaggcgtgcgccatcacgcccggctaatttttgtatttttagtagagacagggtttcaccatgttggcgaggctgatctcgaactcctggcctcaagtgatccgcccgcctcggcctcccaaagtgctgggattaaaggcctgagccactgcgcccggccaagattttaaaccaaatcatcatagaacttatgtgaggtccctcctggcccagacccgtcccttccctttcctggccagctgtgtccaagtgggcacctgaaaaccggcggacttatggggcccctggatcggtcattccacacattctctacgatggagtctggatgagggatttcctgggcttcatttgttcaactgtttccatgacaactccaaagctgtggcgtcaaaagcgtgacagggactcgcatttgcccccgaggacaattactatattgagatggagttaccagggctgaagtagaaaagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgmtcttcactagcytcggcctgagcgagcagaaggcccgcgagacgctcaagaactcggctctgagcgcgcagctgcgcgaggccgctactcaggtgcgagcccctctgcccccggcctggtttgcagaccatgctgcaacgcagcgcggggcggggtccagatcccgacctgccccrtttgtcccgccctttcctctcactgagcgcggggcttctctcttgacccctctgacctcaggctcagcagaccctgggttccaccattgacaaagctaccgggatcctgttatatggcttggcctcccgactcagggatacccggcgtctctccttccttgtaagctacatagccagtaagaagatccacactgagccccagctaagcggtgagacccctacctgtcctgccagttcgcaccaatgcctcccttcagccaagacccctgtcttccctttttgccaagtcctccagtttctttctagacacctagttctgcacaggcactgaggcatggaaggggtggcctatggtgagactgacacgggaactgtcagggtctgaggggggatccactctcgacacgtgcttctttcttccctgtgttctctagggtggtggtgccagggcttaacttttcaggaggccagactatccttggagtttcatgagattaggaccctgtctgtccacttcttggagcagagatgccacaaactcacgggctctttcttctcagctgcccttgagtatgtgcggagtcaccccttggaccccatcgacactgtggacttcgagcgggaatgtggcgtgggtgtcattgtgaccccagagcagattgaggaggctgtgagtctttccccaggcatcgtctgcctccccagtcctggccatggaaaggagtggctcagtttccctcctcaggaagacccagagtgagggtgtgggttcccagaatatctctaaaggtggctttcctgaaccacatggtttggctttctgcaggtggaggctgctattaacaggcaycggccccagctcctggtggaacgttaccatttcaacatggggctgctgatgggtgagcagggcctggaacggggctatattgttctctctggtcatgccttttcttctgggcacgagtgagaaggaggtgggggaaggaacaggagtgacttaaagtggtctggctgggctcaggctctggttctggtggtcagccaggacctttccttgggaaagaggtggggggagtactcttttttgcctttctgcagctccttgtgcctatgcttctaggagaggctcgggctgtgctgaagtgggcagatggcaaaatgatcaagaatgaagtggacatgcaggtgagcgtgcttcactaagctgaagctggcaaagactctggcatgaacagagcctggaatccactaagggataaaaggcaggaagagggctgggcatggtggctcacgcttctgatcccagcactttgggaggctgaggcaggaggattacttgagcccaggagttcaagaccagcctgagcaacatattgagaactcctctctacagaaaatttaaaaattagccagacatggtggtgtatacctgtagtcccagcaatttgtggggctgtggtgggaagattgcttgaatctaagagatcaaggctgcagtaagctctgattgcaccactgcactccatcctggagtacagaatgagaccctgtctcaaaatcaacaacaataaaaaaaggtgggagggggctgggcatggtggctcacacctgtaatcccaacactattgggaggctgaggtgggcagatcacctgaggtcaggagtttgagaacagcctggccaacatggtgaaaccccatctctacaaaaagtacaaaaattagctgggtgtggtggcgggcacatgcagtcccaggtactcagaagggctgaggtaggaaaatcgcttgaatccaggaggcggaggttgcagtgagcggagactgtgccattgcattccagcctgggcaacatgagcaagactccagtctgggcaacaagagcaagagcattttaagctagcagacccacatgagaagagatgggatgggctaggtaggttttttcagtcagtgctggtagataggccaggaagccttgggttggtgggtaggatnagtcaggggctccttgaaagaggatactcctgcctctgcctgattctggtctctgctcaggtcctccaccttctgggccccaagttggaggctgatctggagaagaagttcaaggtagggatgggcatggccctgagtccctgagggtgaggtgaggtatggtgagacttcaggctggggaaggaagtgtctgaccacagggatcccaagaccctatccaagagaaaatttgatgccattttctgaagcacctggggcttctttcaggtggcaaaagctcggctagaagaaacagaccggaggacggcaaaggatgtggtggagaatggtgagaagcttgagactcctgtcacagcattcagctccctgacttctgaacctcctcagaagagtccttacaggctcctcaggcccttggcttactcagtaccctgacttctgtctcaagactgggattcctggtgtttcttttgttccctttgcccagagactggcatgagaggcctcagatgtctggctctagatatcttgtctctggaattgagggaataggggtctaytcagttctgttctggctgtaggatatggtaaatgtatctagaggacaagttttccttgttttgttccccacaggcgagactgctgaccagaccctgtctctgatggagcagctccggggggaggcccttaagttccacaagcctggttagtgggcatgtcaaaaccctggggagggctggatcttggcagcagctcctatagtcaggcccctggggtcagaggctttggctgcagcctggtccttaggcttattctggtcctggcaggtgagaactacaagacyccaggctatgtggtcactccacacaccatgaatctactaaagcagcacctggagattactggtgggcaggtgtgtggggatgtggccatgtgagcttgtgccatcaaacacctgcctgagtgcctgggctgcgtccatactgccccatctcacccatcaccatggccttcctgggagggaacatctgtttctttaaggtcatctgagctcagactttatttctcttttcccatcccccttattttaggtacgtacccggttcccgccagaacccaatggaatcctgcatattggacatgccaaagccatcartttcaactttggctatgccaaggtaagcatgtgtctagggacctggcaagcaagatgaccacttgctgttcccatgagtggataccatatccctgccttgctgtctgctcccaataatgtacccaggtgggcagaggccatggaaaggaaccacatgtgtgacagatacctaggaatctattgagcttattggaataaatagctccctccctctgaggagtcagtgagttcaaatttgggggagttgccagtgcagtccctaggcttagaaagatgctaggttagatacaggaaggtgagagaagctcttgaagacatttttaattctgacatgagtccgggttgggtggctcacgcctgtaatctcaacacttcgggaggctaaagtgggtggatcacttgaggtcaggagttcgaaaccaatctggccaacatggtgaaaccccatctctactaaaaatacaaaagttagctggccatggtggcacacgcttgtagtttcagctactgggaagctgaggcaggagaaacccaggaggtggaggctgcagtgagccaagatggtgcaagataatcaagactccatctcaaaaaaaaagaaaattctgacatgagagtgctctgtgaatatcctagtttgataaacaggattgtggggctgatggatgatgtgggagttcacagatggtgcaactttcctaggccaacaatggcatctgttttctgcgttttgatgacaccaaccctgagaaggaggaagcaaagttcttcacggccatctgtgacatggtagcctggctaggtatggactaggcaaagcctagaagggctggtggttagtgggcctctccttgggccatggcctgcccactgggtgtttgtggctggctgctcatactttgtttnattttgccccaggctacacaccttacaaagtcacatatgcgtctgactaytttgaccagctatatgcgtgggctgtggagctcatccgcaggtaaggccagggccatgacgtagagccaggcagactgactaggtcacagccatgctgggcactcacaccgcttccccacaggggtctggcttatgtgtgccaccagcgaggagaggagctcaaaggccataatactctgccttcaccctggagagaccgtcccatggaggagtcactgctgctctttgaggtggggtcctagaggagcatctgggtttgggtgggccaaggtgctgagaatgagatgctcctgtgcttasagacagcctgagtccttgttcccctcaggcaatgcgcaagggcaagttttcagagggcgaggccacactacggatgaagctggtgatggaggatggcaagatggaccctgtagcctatcgagtcaagtatacaccacaccaccgcacaggggacaaatggtgggtgtagaatggggtggggtggtggggctgccgagcagggcgatgggccatggggtagggcagagtagggctggatggtagggcccactgcctatgccccacaggtgcatctatcccacctacgactacacacactgcctctgtgactccatcgagcacatcactcactcactctgcaccaaggaattccaggcccggtgagggagctgggtccatggggtggtagggccagtggaattccagcagcccttcctgtggtctctgcctggttccagagctggccagtgctaaccctactctcccaccccagacgctcttcctacttctggctttgcaatgcactggacgtctattgccctgtgcagtgggagtatggccgcctcaacctgcactatgctgttgtctctaagaggaagatcctccagcttgtagcaactggtgctgtgcggtaggtgcggctgtttggcttatgaaaggttaatggcatatgctcccaaaggccttctcaccaccttcttatccacagggactgggatgacccacggctctttacactcacggccctgcgacggcggggcttcccacctgaggccatcaacaacttctgtgcccgggtatagcccagcaggttgggtagatacattgggggttgagtgtggcagtttgtgattgtagctgtgactgatgstgaactttcctgccaggtgggagtgactgtggcacaraccacaatggagccacatcttctagaagcctgtgtgcgtgatgtgctgaatgacacagccccacgagccatggctgtgctggagtcactacgggtcatcatcaccaactttcctgctgccaaggtgggcctgcctcaacatgtgtgtcacatgtgtgtgtgtagctgggggtacacttggctctgggcatgggggtcctaatgctgagtatgactcatacctgtctcctgtctcctgctatagtccttggacatccaggtgcccaacttcccagctgatgagaccaaaggcttccatcaggttccctttrcacccattgtcttcattgagaggactgacttcaaggaggtaaattgtgggggtggagggtcccgtttgctgctgagtctggtactgggaacctttcatctcctcatctctgtcagtccatctacttcctgcttcagatgaaccaatctttgccagacacgggggtagggaagcttccccacttgtttgacccttgcagcctcatgtgtctaccccacttcctatctctaggagccagagccaggatttaagcgcctggcttggggccagcctgtgggcctgaggcatacaggctacgtcattgagctgcagcatgttgtcaaggtgagagccagctgcagccttcctactgcagtgcctgctggggccaagatgtgagtatagcctgcagtcctsgttgtggttcccgggtctaattgctgctcccctccccccacttccagggccccagtggttgtgtagagagtctggaggtgacctgcagacgggcagatgctggagagaagccaaaggcctttattcactgggtgtcacagcctttgatgtgtgaggttcgcctctatgagcgactgtgagtgaacagagctggggtgggggcaggtacaagatgcacattgcctgctatggctgcccagctgggggtatgaccttcactttggctgcagattccagcacaagaaccctgaagatcctactgaggtgcctggtggatttttaagtgacctgaacctggtaggttcatgaggtttggggtgagggaggtaggcctccctggttggatggttgcctgagttccctgcctgcaggcatcactacacgtggtggatgcagcattagtggactgctctgtggccctggcaaaacccttcgacaagttccagtttgagcgtcttggatatttctccgtggatccagacagccatcagggaaaggtgcttgactttactcacctgccctcatctgcagcagtgacagtggctgccgttcattgtgccaagtgctctgcatacattcccttagttaatcctcaccacctgagggagttggtattcatattctactagtgaggaaactggcactgaggataactccaggcacaaaattttgtatgaaggctgcctttttttttgagacagtcttgcactgtcgcccggggctggagtgcaatggcaccatctcggctcactgcaacctctgcctcccaggttcaagtgattctcctgcctcagcctcccgagtagctgggattacaggcgcctgccaccacacccggctaattttttgtatttttagtagagatggggttttcaccatgttggccaggatggtctcgaattcctgacttcatgatctgcccgcctcggcctcccaaagtgctgggatcacagtcatgagccactgcacccgacctcttttttttttttaattattattttttgaggcagggcatggtggctcacacttgaatcccagcactttgggaggccaaggcaggctgatcaccagaggcagggctaccaccagnnnnnnnnnnnnnnnnnnnnnnnnnnnnnaaagatattatttttaatatctttcgttaaggcagctaataacctttctttttatttattttagagacggggtcttactcttgcccagggtggtgtgaagtggtgcaatcatagctcactgtggcctcaaactactgggctcaagctattctcctgccttagctgagactacatgtgcacactaccatgcctggctaattttaaaactttttgtagaggcaagttctcactatgttgcccaggttggtcttgaattactggcttcaagcagtcctcctgtctcagcctcctagagtgctgggattataggcatgagccactgtgcccagccaccctgccatccttttttttttttttttctttttttgaaacagtatctcgccctgttgcccaggctggagtacagtggcacgatctcggcccactgcaacctccgcctcccaggctcaagccattttcctgcctcagccttccaagtagctgggattacaggcacatgctaccacgcccggcaaatttttttttttttttttttttttttttttttttttttttttttttgagacggagtctcacatgtcgcccaggctggagtgcagtggcacaatctcggctcactgcaagctctgcctcccgggttcacgccattctcccgcctcagcctcccaaatagctgggactacaggcgcccgccaccactcccagctaattttttctattttttagtagagacggggtttcaccgtgttagccaggatggtctcgatctcctgatctcatgatccgcctgcctcggcctcccagagtgctgggattacaggcgtgagccactgcgcctggcctaatttttgtatttttagtagagacggggttttgccatgttggccaggctggtcttgaactcctgacctcagattatctgcctgtctcagcctcccaaagtgctgagattacaggcgtgagccactgcaccagcccaccctgtctttcttactccttaaagtagggggcaaacatggtggttgttataatccatataaaactataccctggacccccacggtggttgttatggtccatataatactatagcctagagccccattcagtcccttacccaaagtcacaaagttattgaggacccgggcctcctgacccttagtccctcggcttctttggcttaagaaggatgttagggggaggtgtctgtggtgaaacctgcccaggcctccctggccttgttctgggttggtggtcatccttttccctctgccctccagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagagtctgtgtgttatctctgcacttctagcatctgaaggccctgaagacatgctggcggtggtggtatgattgggggatggagatgtgccttttgcacattttgtctgtgagaatggactttcccagaacagagtggtactgacagctttgaaagcaccggtgcactttttggtgcttaaaggcaggggcctgggtaggattcataccctccgcacctggtctgagagaatggagggccctggggtgtttgtccatggttaggacccctgtgccagagggatctaaaaggtttgtttctgctggtgtggagaggcctagctcccagtctgatcattcagcatataatttttttttttttttttttgatacggagttccactctagcccaggctggagtgcagtggctcaatcttggctcactgcaacctctgcctcccgggttcaagcgattctcgtgcctcagcctcccaagtagctgggattacaggcgggcgccaccactcctgaataatttttgtaatttcagtagagacggggttttgccaaattggccagactggtctggaactcctgaccccaggtgatctgcccgcctcggcctcccaaagtgctgggattgcaggcgtgagccactgcgcccaatcagcctataattcttttttatttttgagacggagtctcactcttgtcccccaagctgcagtgcaatggtgtgatctcagctcactgcaacctctgcctcccaggttcaagcagttttcctgcctcagcctcttaagtagctgggatcacaggcatgcaccaccacactcggctaattttgtatttttagtagagacggggttcaccatgttggccaggctggtctcaaactcctgacctcaggtgattcacccgcctcggtctcccaaagtgttgggattacagacttcagccaccgtgcccggcccattcggcatataatttttgagtgcctactacgtgccaggcaaagtgagatggggcatacgtgctgtggtggccttccaagttcacgggaggggaaatgggtgaccaagcactgtatgggagcggtctccctggggcctgtgcaagactggaagaggttcctgacccagcctgggcctcagaaaacattactctaacgaagtgacttctgaagggaatcacgaaagactacggggagtttgccaggataagaggaacaagggcaaaagctccgaggcaaaaagagtctacagcaggctggaagccctctgggggcagtgtaggctgctgctgaggcccgagtgtgcctgcagctttaacgccttccacattttccctgtatacaaacactaggctacccgggggcccgctttaaggtggacccaactgcggaaggctgaactcagatggcagcagacagcgggagtaccagatgctgactcctccaggaggtgagcaacctagaggcttcccaggcagggcacggctggggacgccaggcccaggacagaagtttgtggggtccaccttaagcgagaggccgagcctggccaggccccgccccgcgtgggcgtgctcgaccaaaggaggctctggcgggcgacggaaggtgggtccaaagagctagcttggagccctagccttccgagactccactactaggccaagccacggccctagctccgccccacatggagaggcgtccatgggcggagcgagccgctccataccctaggatccactatccgctctagcggccagaagcgcggccaccttcccctgctgaagcgttcactttaattttggccggtaggcagtcccagatctcgcgggatccgacgccccgattatcgcgagaggagcaatcggctcctattggctgtgagggttgaatgtaagatggcgcccagggagctgtgaggagaaaaccctgtcggtcttggagcgacgacggcagaaccagggtccctggcggtgcggcggggccggcgggtgcagcggaggcggcggcggcggcggcagtgacgtcgccgggtgagggctccagtgcgggtggggatgcggcgaagctgtaggcctgagacggggggcccaccccacacaacggcgggcgggggcgggcgggccactaccgctgggccctggagagttcggggcggctccggagccgaaaacgttcctgggctagcgcaccccgccctgtggatgggggaggggtggcccggggatttgggtgggcgcggcgcgagatggcgcgccggtgcgggcgcgcggctgagcctgtttttacgcgcgcgcgctgtgcggctctcggtgcgcgtggccgccgacgtgcgcgttcccggcccggatatctctgctctaggagctgtggcccgtgggcaaccgcggctttctggagcgcgcgcccgtgacgacccccagttttggggcgcgcgctctgatatcgggtggcggtgctgcctcgagagcgcgcaggaggcttctgctgagcagagggccggccgcggctcgttgcgctgggaaggttgaggattgggtcctttctggtctggtgacgttcccgggcatccgtggcctcggcctggagagaaaccaaccagctttgctgtctggcttgcggttccgctcctctgtgaggggggcgagattgcccgttctcctcgaagaatgccgttacttgaggcccaagtacggtgcgggtgcttgggtagggtgtttctctgcttcggaaaccaagccctcttggtttgagagggcagtgagccccttcggatttcctcaccttgtactgggctttctgccgggcagggaaggttaatattagaaggcccttgagtggtacctgcttatctttcattagaaactaatacgtccataagcgtaattcatacacgtcacctctgtgcgctccggaagggaattcgcttatgtggcccatgtgaactccgagctctaaaatgccagtttaaatccttaaacgcagcttttcttttgcgtaagtgggaggggcttactttattatattaaaggcccacctttgcctcagccaaaaagttggccttaaacaaaatggaacaacctgagaatcagtgctttaccttttttgaaattgcagaaatcccagcagaaattactaaaatctgatagtgtatcactgtaaaagtcacttttggtgtaggatttcagtccttttcagctctttttttgaccctgccgctgtgttttggtgtcaaggaagttctaggtttgttctagagaaataggcacctcttttttctaatacaaaacatctgctagtttgatttacagtcttgctcaattaagcttaaggaataggaagctaagaggaagtaaaattagccatcaaatttgataatggtggggtagttctttctaatgtactgtattgtttttaagaacaaagttaaaattattaataaaaagaggctgaggatggaaggaacttttttgttctatcttcttcagaatattagaagtcttaagaactcaggacaagcagcagaaatacatgcaacatggtgactggtgagttaaaattgttcatatcctggaagtatctgtgcacagttttttttctggtaatactgaagcattacaaatcctgtcaattctgggtgctgtcttccagaaactattaggtgctgtaaaatgaagatgtgggagaacggcatctttgaattcagccacagttcgctacttgctcagttttctcctcttaggatataagtcagtggaacccgcagatttaagcgtttgcaggctcagcttttaaacggacctaaatggttcaaagaaaagctgtaaagtttttctaggatacacttaaaattttgactttttttttttttttgagacggagtctcactctgtcacccaggctggagtgcaggggtgtgatctcggctcactgcaacctccgcctccctggttgaagcgattctcctgcctcagtttcccaagtaactgggattacaggcatgcagcaccacacctggctaattttttgtatttgtagtatagacggggtttcaccatgttgatcagactggtctcgaactcctgacctcgtgatccacccgccctcggcctcccaaagtgctgggattacaggcgtgagccaccgcgcccgaccaaattttgattaattttttaggcttgcttgttctgggttatctttatttttaactattaagcttgagatcttccttttaaattggtgtttataaatactttttctccaagtttgtcaactaagatttacttattagatgtcttccttcgggtcctctctgatgaatttttcctataactcttcgagaacctctgcagttccacatcctctctccagcttatgttgccatttcaaactaaagatcaaatagtggtttaattttcttgtaaatttgaattgctctaggaaagtaaccaaagtcaggggctctggatgtggctgcctttctttaaggcagcttcagaatcagggatgtctttccttactttggatatgcttttttttttggatatgctttcttttagtttaattagttgtggtttatacttcatgtgccatatttctttcttgtctgctttttaaatggccactcttgatctgtaagggtctctgatttctgaattagccttagaattaggtgttacatgaatacctgttcttttctttttatttttattattattttttgagacggagtctcgctctgttgcccgggctggagtgctgtggtgcaatcttggctcactgcaacctctgcctcctgggttcacgccattctcctgcctcagcctccggagtagctgggactgcaggctcccgccaccatgcctgtctcattttttgtattttttagtagaaacggggttttactctgttagccaggatggtctcaatctcctgacctcgggatcctcccaccttggcctcccaaagtgctgggattacaggcgtgagccaccgcgcctggcctattacctgttcttttctgttattctgttgtactgcattttgttccagatgttttaagtcctcttcagacttcacttaaatgcttcctttgtattttttcctagttattacattagattgtgatttctgttattaaattgatgtggctgcatgaagaaatggtagattaatttcttcctttgctgaaagagggaaggagtgctcctttggtctcactcttcaggccagggcaaaactgtaggtagaaatggtggctgtgtcagaaggctaatatttttctctttttctcttttctcttttttttttttttttttgagatggagtttcactcttgtcgcccaggctggagtgcagtagcacgatttcggctcactgcaacctccaccttccgggttcaagcaattctcctgcctcagcctctggagtagctggaattacaggtgcccgccaccacgctgggctaatttttttttttttttttttttgagacgtagtctcgctctgctgcccaggctggagtgcagtggcacgatctcggctcactgcaagctccaccttctgggttcacgccattctcctgcctcagcctcccgagtagctgggactgcaggtgcctgccaccatgcccggctaattttttgtagttttagtagagacggggtttcaccgtgttagccagcatggtcttgatctcctgacctcgtgatccgcccgcctcggcctcccacagtgctgggattacaggcgtgagccactgtgcccggctgatgtctggctaattttttgtatttgtagtagagacggagtttcactatgttggtcaggctggtcttgaactcctgacctcgtggtctgcctaccttggcctcccaaagtgctgagattacaggcgtgagccactgcgcccgcccatgtttttctttgttttaaaatttgtgaaatatttatccatccatgtaaatttaggcgatctctgtacaatttaatgacaaattataaagtaaatg

SEQ ID NO: 10911 - DNA, 40000 bp, Homo sapiens
ttccctgcaagctctgcctcccaggttcacaccattctcctgcctcagcctcccgagtagctgggactacaggagcccaccaccacacccgactaattttttgtgtttttagtagagatggggtttcaccaaagcctagtcttaagcagtcaggatcttcctgatcattcagggtctgaatcaacaggtaagacagaaaggcaaagatttaatcttggatactcaggaataagccataaacaatcatttgatactattaaagcaaaagaatacactaacacttgttaaactggtaagataggtgttattcagggctaccttgaaaagtgtagggactgctgcaatgggatttttgtagtggggagagagatggagctcaattcctaatgcaacaaagaaaagaggaaatttatagccaagaagaagaatgtggagggtcagtagtttaaaaactactgcaagggtaagataattcttgataagctgacctaacaagattcttactgaagacaggccacagtgatcccatattacctgggagatggtgagagaggaagaatttggtcagatactgaaggtgatcagatattaagggtggaggattctgtctaaactgatttaacaggattcttgctaaaactggactcttgcggacattcccaagaatgggctctagttgggttcagaagagcctgactagttatagttaggtcaaggggaaagtctctgtcaatattcattgtcagtctggacctagcagaggtagaagaccatgaattagttacagcccatcagtggcctataataattatgggacatcatcaagtgaactaacctccatataacaagaattcccaggagacaaaaaagagaagggcctagaaagcatatttaaggaaataatggctgaaagtttccaaaatctggagaaagatgatgccrtccaagtacaagatgctcagaagtcactaatcaaattcaacccaaagaggaaatccccaagacatatcataattaaattaccaaaaattaaagacaaagcaagaatactcaaagcagcaaaagaaaagaaatatatcatattcagtgaagccccaatacaattttcagcagaattctcagcagaaactctacagaccgggagagaacaggatgctatattcaaagtgacaaaggaaaaaaggaattgccaaacaaaaattctgtacccagcgaagttagccttcaaacatgaagaagagataaagaatttccagacaaacaaaagctgagagaattccttaacagcagacctgtcttacaggaaatgctaaagggagttcttcaatctgaaagaaatggatgctaatgtacaagaaaacatctaaagtaattaaactcactgrtaaaagaaaaaaaaaaaaaacagacaaattcagaatactctaaatgtcttgactgcccatggcaggatccttgattttctcctgtgctggatcacacgtgtccatgagtggactcagactgtctacttacttcaactgtaattgaagtcagtcagtcacttatattttaagaataaagactaaaagaaaaatttattaaaacaataactaaaacaattggttaagagataggcaatataaaaatgtaaattgaaacatcaaaaagtcaaaaaatggggaggaaacagtgttaaaaaatagtgttaaatagtgttaaagaaatagtgttaaagaatagtgttaaaccctctgcagagggttttttattgttgtttttgttaktgttatttttcttttctttgctatgaagttaagtcattatcagcttaagataacctgtaataacataagatgtttttgtaggccttatggtaatcaaaaagcaaaaacctatcataaatacactacaaataaatagcacaaaatcaaaacatactatgggaaaaaaccacttaactacaaaggtaaacamgaagagagagaaaactctgccaaacaaccagaaaataagtaacaaaatgccaatagtaaacccttacctatcattaataacttttaatataaatgaattaatttctaaaattaaatgacatagagtggctgaatggatttttttaaatgaccaaactatargctgtctataagaaacttagttcacctataaagatatgcacagactgaaagtgaggagatggaaaaaggtactttatgcaaatggaaatcaaaagagagcaggagtagctatscttagataaaagaggttttaattaagaatgattttagacatgaagtccttgcccatgcctatgtcctgaatggtattgcctaggttttcttctagggtttctatggttttagttctaacacktaagtctttattccatcttaaattaatttttgtataaggtgtaaggaagggatccggtttcagctttctacatatggctagccagttttcccagcaccatttattaaatagggaatcctttccccattgcttgtttttctcaggtttgtcaaaatcagatagttgtagatatgtggcattatttctgagggctctgttctgttccattggtctatatctctattttggtaccagtaccatgctgttttggttactgtagccttgtagtatagtttgaagtcaggtagcgtgatgcctccagctttgttcttttggcttaggattgacttggtgatgtgggctcttttttggttccatatgaactttaaagtagtttcttccaattctgtgaagaaagtcactggtagcttgacggggatggcagtgaatctataaattaccttgggcagtatggccattttgacaatattgattcttcctacacatgagcatggaatgttcttccatttgtttgtatcctcttttatttcattgagcagtggtttgtagcactccttgaagaggtccttcacatcccttgtaagttggattcctaggtacctaggtatcttattctctttgaagcaactgtgaatgggaactcactcatgatttggctctctgtttgtctgttattggtgtataagaatgcttgtgatttttgcacattgattttgtatcctgagactttgctgaagttgcttatcagcttaaggagattttgggctgagatgatggggttttctagatatataatcatgtcayctgcaaacagggacaatttgacttcttcttttcctaattgaatgccctttatttccttctcctgcctgattgccctggccagaactcccaacactatgttgaataggagtgttgagagagggcatccctgtcttgtgccagttttcaaagggaatgcttccagtttttgtccattcagtatgacattggctgtggaaaaaaaaaatgtatgtatatatatatatatatacacacatatatttatatataaaattatataaattatatataattatataaaacacatatatataaattttttwaaaaagtttttgtattagtctgttctcacattgctataaagaactacctragactgggtaatttataaagaaaagaggtttaattgactcacggttccacaggttgtacagggagcctggctagagagacctcaggaaacttacaatcacggcagaaggtaaaggggactaggcatgtcttacgtggcgggggcaggagaaagagatggggggaggtactacacaattttaaacaatcagatctcgtgagaactcactcactattatgagaacagcaagagggacattctacccccatgatccaatcacctcccaccagaccccacctccaacactgagaattacaatttgacatgagatgtagggagcggggtggacacagtcccaaaccatagcagatttttctaatttgccttagatccctcccctccctccatcccagcaccacaccactccaatctacttccagtctctattgttttgtgactttctagaattttatgtaaatacaattatgcaatcttttgttcaacttttttctcctaatgttttgagatacaaccatgttgttacatgtattaagattttactgattaatattaattattaaataattatattttgttccctaaaaaaataaataaataataaaataaaataaaataaggaagagaaaacatacgattcatcaagtggaagtggatcatcataaaggtctttatccttgttgccttcatgttgagtaggctgaggaggaagaggtagaagaagagctggtcttgatgtctcagaggtagcagaggcagaagaagaggtggaggaggtagaagaaaaggcaggaaggcagacaaactcagcgtaacttttacagaaaaaaccaatgtataatccctctctctctctcatatataaatataaataaataaatatatatatatatayatgcacacacatacacgaaggcctaagaactctgagagtaagtcctagtccaagttctgaaggcctatgaaccagaagtgcaatgtccaagggcaagagaagatgcaagtcccagctcaagcagaaagcaaattcttccttcctctgcctttttgttctattgtggccatcaacagattggatgatgcccagctgcattggtgaaggtgaccttttctattcagtttacggattcaaatactcatcttttccagaaacattcttattctgtttctggtaaaacagtgagaaataatgttttaccagctatgtgggactcccttagcccagtcaagttgacacataaaattaaacatcaggatttctttgccctttggcttctagttaggttcagccaatggggaccctggtagcagataaaaggaaaggaaaagtgtgaggtgggatactgagtgtrtcctcagcctcttccacaacctgtatctgtttctcagaagtcacaatgcctttctagtaaagtccttcaactacccattggaatgtgtggtgtgtttcctgcaaggccctgagtgatacattgtgggagcattaaatcctgtggggattccagaaagacttcacagaggaagtagcacttgagctgggtctttatggaggagtaggagttcctgagggcacaggggagaagatccaggggcttcagcagagggcaagtagatgaaaggaaagaaaaaactaagatgactttgggtgtggattggaagggctgtttggactgaatataaagaatataygcaatagggtattttggtgaatttttaagcagaaggttactgataatagtaaaaagtggtgcttctcaaatataattattatgttaacccttccaatgaagatatttttgcagacatttccaggattgacttaaattgtttttattgtaatgtgtatcctgtatgtgtcagttttaactagttatatataaattcatttcccttgtaatttttacacaactgaagaaccaaaattaacttacataaaagataaaaacaaaaccatataaactctaaaatccaaattaatgttaacttaatacaaaggatgatgttttgctgaaataaatgtgtgaaaaaataaaataaaaaataaaaaacgaatgattttgaaaaaagacaaaaaacaccattacataatgatataaaggagtcaatacaaccaaacaatataacaattttaaatatatgtgcacccaacaccagagcatccaaatatataagtcaaatattaatacatttaaaagggagattcgctgcaatacaatatagtggggagcttaaacatgccaccttcagcaatggacagatcatgcagacagaaagtcaataaacatcagagttaagctacactctagatcaaatggacctaaaagacatttacagaacattccatccaatagctacagaatacacattcttctcatcagcacgagaaacattctccaggatggatcatgttaggataaaaaacaagtcttaataaatttttaaaaactaaaatcatatcaagtatattttcagactacaaaggaataaaactagaaatcaataacaagaggaacttgggaaactgtacaaatacatggaaactgaacaacatgctcctgaatgaccactgggtcatgaaagaaattaacatgagataaaaaatttcttcaaacaaatgaaaagtgaaacaaaacataccaagatctgtgggatacagcaaaagcagtgataagaaataagttcacagcaataaacacttacatcaaaaaaaaaaaaaacagaaagatctcaaataatcctaaaatgcacctcagggaactaaaaagtaagaacaaaccaaaccccaaatcagcagaaagaaagaaatagtaaagatcagagcacaactaaatgaaatatagactaaaacaatgttacaaaggatcaatgaaatgaaaagttgttttttgaaaagataagcaaaatcaataaaacacttgctagactaaccaaggaaaaaaagaaaaaagacccaagtaaaatcagaaatgaaaaaggagacattacaactaatatcacaaaattacaaatgttcaccagagactattatgaactatacactaacaaactagaaaacctagacgaaatatgtaagttcctggacacatacaacttaccaaaattgaatcaggaagacagaaaacctgaacagtcaattaatgagtaatgagattaaatcagtaataaaaagtttcccagcaaagaaaagtccaggacagatggcttcactgacaaattcaactaaactttcaaagaacaaaacaagtctttacaaatttttaaaaatcaaaatcatatcaaatatctttccaacaatggattaaaactagaaattaataatagaaggaacaatagaaattgcacaaaatcatggaaattaaacaacatgctcctcaacaatgaataggtcaatgaagaaaataagaaatttgttgaggaaaaaatgaataaacaatgtatgaaaatctakasaatatggcaaaagtagttctaagaggtaaagtcacagcaataaaggcctacatcaaaaaaagtagaaagactccaaataaacaatctaatgaggcacttcaagaaactagaaaagcaagaacaaaccaaacccaaaattastagaaaaaaagaaataataaaaattagagcagaaagaaatggcattgagactatatatataatcaatgaaaaaatgacattgagcatatataatatacataatcaatgaaaaatgacattgaaactatatatataactatatatataactatatatataactatatatataacwatatatataactatatatatataactatatataacwatatataactatatatataactatatatataacwatatataactatatataactatatatatataatcaatgaaatgataatttggttttttggaaagataaacaaaatcaagaagccattagttagactaagaaaagaccccagttaaaatcaaggatgaaaaaaagacattacaactgattactgattccacagatacatacaaaggattattagagatcataatgaacaactgtatgccaacaaattggaaaacctagaggaaacagataaattcccggaaacatacaacctaccaatattgaatcaggaaaaaaaaaagaaaatttgaacagaccaataatgattaatgagattcaatcagtaataacaaatttctcaacaaagaaaagtccaggaccagacagcttcactgccaaattcaaccacacttttcaagaagtataaacatcaattcttctaaaactgttcccaaaaattgaagaggaaggaattctctctaactcattctatgaggccagcattactctgatacccaaaccagacagaaacacaacaaaaaaagaaaactacaggccaatatgcctgatgaacatagatgtaaaaatcctgaacaaaatactagcaaaccaaatttaacaacacattaaaaagattatttatcatgattaagtggggttcaccctaggaataaaagcttcctatgcatatgcttcaacatatgcaaatcaataaaagtgatacatcacatgaacagaatcaagaacaagagccatgatcatttcaatagatgctwaaaaaagtactcgataaaattcaacactgcttcatgataaaaactctcaataactgggtatagaagaaacaataaaggccatatatgacaaatccacagctaacatcataatgaatggggaaaaataaaggctttcctctaagctctggaacaaaacaaggatgaccactttcacaattcctattcaacatagtactggaagtcctagccagagcaattaggtaggagaaaaaaacagagggcatccaaactggaaaggaagaaatcaacttatccttgtttgcagacaacatgatcttgtatttaggaaaacttaaagactctaccaaaaaattcttagaactgataaacaaattcagtaaagttgcaggatacaaaatcgacatgaaaattcagtggtatttatatacaccagcagcaagcaatctgaaaaagaaaccaagaaatccatcttataatcccatttataataataccaaaaaaaaccctaaatgtctaggaattaatttaaccaaagaagtgaaagttctctacaataaaaactataaaacactgatgaaagaaactgaagaggagacaaataatgggaaaatatcccatgctcatggattagaagaattaatattgttaaaatgtccatactactccaagaaatctatagattcaatgcaatccctatgaaaataccaatgacatccttcatagacatagaaaaaagcattcctaaaatttgtatgaaaccacaaaagaccccaaatagccaaagcaatcttgagcaaaaagaagaaagctggaggcatcacactacttgacttcaaatatactacaagtcacaccaacatggcacatttatacatatgtaacacacctgcacattgtgcacatgtaccctaaaacttaaagtataattaaaaatatatatttactacaagtctattataatcaaaacagcatggtattgacacaaaaacagacacataaaccagtggaacagaatacagaactcagaaataaatccacatatttatagccaaatcattttcataaatgtgccaagaacatacattggggaaagaatatctttttcaataaatagttctgggaaaactggatatccatatgcagaagaatgaaactagacccctatgtctcactatatacaaaagtcaactcaaaatggattaaagacttaaatgtaatacctaaaaccaggagactgctgacagcaaacattggggaaacactttcagacattcatctaggcaaattttttggggggtaagacctcaaaaggacaggcaacaaaagtaaaaatagataaatggaactatattgaattaaaaagttctgcacagcaaaggaaacaatcaacataatgaagagacagcctgcagaatgggaagaaatatttgcaaactatccatctgacaagggattaataaccattacttataaggaaaccaaacagctcaacagcaaagaaaaaaattaaaaagtgagcaaattagctgaatagatatttcacaaaagacatttaagtggtcaaaatgcataggaagaaatgctcaacatcactaattatcaaggaaaaccacaatgaggtatcatctcagcccagttaaaatgtctattattaaaaagaaaaaaataacagatgctagcaaggatgcagaggaaagagaactcttatacactgttggtagcatatatattagtacagccactatggaaaacagtatgaaagttcctcaaagcactaaaaatagatctaccatatgatccagcaatcccactcctgggtgtttatccaaaagaaagaaaatcaatttattgaagagatatckgcatacccacatttattgtggcactgttcacaatagtcacaatatggaatcaatctaagtgtccatcagaggatgaatggataaagaaaagtggtatatatacacaatggaatattatttagccattaagaaagaatgaaatttgcagcaacatggatgaaactggaggacatgttaagtgaaataagccaggcacagaaaggcaaatattgcatgttcttactaaatgtgggagctaaaaaagcttatctcatggaagtagagtagaatgatggttaccaaaggctgggaaaggtaaaaaggaggaaggataaagagagattggttaatgagtacaacaatacagctagaaggaatagttctagtgtttgataccatcctatggtgagtatagttaacaataattaattctttatttcaacatagctagaagagatttggaatgttcccaacacaaataaataataaaagttagaggtgataaataccctgattgccctaatttgattattacacatcatatgcatgtatcaaaatatcacatgtatctaataaatatgtayaattattaggtatcaattttaaaaattaaaaaaaagctaagtgtatctaaaacagagccttgcaaaattccaacaccataaaaagaagcaagcaaaaacaactggaattaacatttttgctaatcaaatagtaactccatatttatattatataacttaggttagtaaattataattataaagcctattattatcattaattatgatagttttataagacatgtataattacacaattccacatacacaatactgttgattcagactaacattctgcatgtgttaaatattcttgcccagtgtaattgtcactttaagagttgagtcttttaagagttaagagtcctaatttaaagtcagaaacctgagttcaaattctacttctgccacttagtattgatgtgattttgcaagttaattaacatcgtcaaacctcaatttcactgtctgtaagacagaaatactaatatttcacctaaggatttgaacagttaatgtctaaatatctataaatcacattgacatgtacacagaagatactaatttaaaaaaaaagctctgtggcaagtaacaatgaaagcaagcaaaaacaagtttttactattttttataacaatgctacactctaaaaatatatcgacaagcaatgtgaccattaccttaataagtgagacaccaacaggagaggaactaactcaaaaaccaagacgagaagaaaaacataaaaaacaggaatttattgtgacaagttctttctgaggacaaagttatctggctctaaccttttctttaaaaatgtaatcctaccttaattcttctacttaatattgatcttcttttaaaggacagtgcatacttgccctcctcagttagcatatgtaagtggtgtaagtttaaattttaatattaaagaaaaattttgttgttgggtttcaactagagcattaaatatgaaagttcaagttttgaagtttctgccaaattttatattttacataacttgtacagaaatgtattaagtcttatagtatcatcagatcactgtgactgactgcaatatgcttgagtttatagacagagcttctaacgctctagttttgacattccaattgcataaatattgccaacaaaaatttatgaattaacaatgtgtcttgtctctattctgctccattaccctactttataaatggtaagactggaaactgatccaaacaggcaaagagctaaggatggagctttggagagtaaaaacatttaagcacagaccatggaagaaaagcccttcaaaaagcctgaaagaagctgtgaaaatcaacctataaagtgttgaagagtaagtgaaagttacgggagtcagagacaaggagtgctgactgctcttttaaggagttcagttattaagagatggaaatggatgatagaaataaattagatgataattcatcattatttcccctcatctcataccttctctttctcatttattgctttgctttttatttatttmtttactttgagatggggtcttgctctattgcccaggccggagtgcagtggcaaaatctcagctcactgcagcctccacctcccaggttcaagcaattctcccacctcagccgcctgagtagctgggattacaggagcatgccaccacgcccagctaacctggccaacatggtgaaaccccatctctactaaaaatgcaaaaaatgtattgctgttcttcgtgaatgttaccaccatacatactgccatccaagtcagaagccttgattacttccgttccttcatctgtcttctgactcatcttccttattctatcttacctctcagtctagtatcaacatagcagtgagtcagatcatgccactcctctgctcaaaaccttacctagtaaataagccaaccatatggtatgttagaagtatatatcaaatagaagggtcagggtaggctttattgagaaggtggtatttgagcagagacttgaaggagataagtgatatagccaaatggacatttaggggaagagcatttctggcaaaaattcttttaaaaagaaggatgcctggaggttttggagaatagcaaggaagctaatatggcttcagcagggtaccacragggagagagtggtgaaagatgaggccagaaaggaaacagaggtctgatcagtttgctactcattacattcatactacaatgcctcactctcccttctctatctgctatcccaccactatcccctgccacacacacatgcacgcacgcacgcacgcatgcacatcgaaaggcaaatgttctggatttgatttccaacaatcaaggtccttatatctcagcttttttttttttttttttggtaccatttctaacacttgaagtgtttgtgagaatsgcttccagtcactcttctccatttgtccactttaatggaccaggtctgcatgctgaatgtttcaggtagtaggaactaagggatagagactakgaataccaagccagtaagagcatcaaacatcaagataagaacacacagcctaagtaacacagtgagacctcatctctacaaaaaaatgtaaaaattagacagatgcagtggcatacacctataatctcagctactcgggaagctaaagtgggaggatcacttgggccctggagttggaagctgcagtgagccatggttgcaccactgcactttagcctgggcaacagtgagacccaaaaaaaaaaactatatatatwtttttttctcatatatatatwtatatatatatatatatatatatatattagagaaagatactgatggaataaataaaaggatacatgtatgaatgagctctggattcccagcatttgragcattttggagttctcggaagagaaaatggaggatattaagggagaaagaaacaactcaataggcagaccagtactgaagcagaatatattccagggtgtgggtctgaagctgaaagatatgtcaccatgcctgtctcatccccagggaatatatactaagctgtaaaattatatcgaatccattttttattttttgagataacagtaaaaaggactcaaaagaggatatagaaggaagcactatttaaccagtttcatattatagctaacttcttttgattccatttacccaaaatcatgaccatcaaccttctcttatatacatacccctattttttacatagtctcctcatttatagagactaggctacaaagaactatagaaattccatgaaataatttctgtaaggaaaaagggcagaaaaggcaatgaagaaaagatctgctttagaatttccctatgacccagcagatggtgcaataggcacattactctgccttccagacaggcagaaaaaaatgagtgcacacagatggtactggaacttcactgtttatccttgctagttttgtttgtttgtttttcctaggtgaaacactccattcctgaagaactgtttccaaaacccttcctttaccaagacatgaatatttccctacttgctgactattcctaggaaaaagcagatttgaatttgaattctgtcttctccacttaacagctaagtgacttgaaacaagttacagatttcatctgagcctcagttttctcatctgcaaaatggaaatataatatctagataacagggttgttgtaagaattaatgaaacaatgtacacccacacacaaagcactgtgcttgtcataaaaaggaatgtaattttcattcttctgccaacacacagagaaaggcactcaaaaacctagaacatggcacataccatagaaaagcttttctcctgaaacctrtcatctccaagtggaaaaaccactaaccaaacccatgatggaggaatcttcatgtccaactctgttactatggagcacacactctaaaaaaaacaagaaactgttttgaaagtgacttttgtgataatctagtcctactcttaataagtaattctcaatggggagagaagagaccaagacgcatatgtaatatgcttcttattttcatgatacaaacgaggaaaaaaagcccaacaaaattctagttggtgagcatatccagaaaacaacgtaatgaaagaattaattttttctttaatagtaaaaaactattcatatgatacttgacaataaattcagttacttcacaaagagctcactgcattttcagtcaatgcaaatattaaatatttctcccttacatcaaatcaaaatttatctcccttttacgagcagccaaaggtcccttgttctgttccctttccccaccaccccacacatgctgatatttacaaattcaccttcactcttgttctctcatgcaagagttagtggttctgatgtcccacacttttcagcccttcttttctctcagatcctcctctcccagagaatcttcctgaaaagcaaatacagaagaggagcaaagagtggtaaactacagcctgcagttcatagctagcttgtcatccatttttgtgtagcctacaggataaaaaggttttctacatttgtaagyggttgaaaaaatatatgatatgtgaaattatatgacattcaaagatcagtattgataaataagttttactgaaacatagccatgctcatttgtttacatatcatctatggctgcttttatgctacaatagcagagttgagtagttgcaacaaaaactatctgtcctgcagagataatattttgtaccatctggccctttacaaaaaaaaaagtttgctggcccctatttcaggagaacactagccccaagagcacgttcacctggaatagtcttctctcacaaccctctcctcccttcgtgacaacagctggttcctgcaggaaatcagtcttcactcagcaaattccacccccctttactcccacagtctcagccacacctttaaaaagtcattgttctgatgaagcatgaaaacctggcccaatcagatgtccagaggaaacacggctacagaatggatactgactctgcagccctctgggcaattcttaaaagaaaacacatagcctaacaatagttgaatttggaatcatgtaatttatcacttgccaacagttgctaccacaccttctcaaatcctgatgaccatattgcacaagttttaagtccatgtaacttcacacaccttcagtgaaatttgtgttatatgttcacaatggaagaaatgcagagcgagggcctcagaaaaaagcagaaagccactcattgattctcaatgctaagattccgtttatattcaggtaaaatcatgtcctctgaggcaaagatggcaagagagagggcagaccctagtcctcctgtgaaaagatggaagttggccaatgcagaggactatagtcttgatccttgcttctctttcaaatgaattcaaactgacatttattggagaccgttatgtgacaagcagtatactaggtctccaaatgacataaggataaataatgtccattccttattctcaaggagctcatagcctagaaatgaaataagcccatagacaaatgtgtgtgtctgtgtgtgaatgtgtgtgtttgtgaaaggcaaggatatacaacaaataactaacagtagttatttttggctagtggctttaaaggtattttgattttatcttatttgcttatcaatattttctaatttttatattaaacaataattgtatagtaaaacaatttttaaagattacaatatagtatgattgatacaacaataaatatgaataaggtacacaattacaactccctcttgagtaattcaggaaagattttctatgggaagcctaaattggattttgaagaataattagttcactaggcagacaatgaggaaagacattctaagaaaaaatatgaaataacatatcccatggtatattgaggaagtttgaaatattactagttaattactgttggagtacaaagagaaatatggaggggagaaatggagctggaaaaaagccacagcccagatcatgaggaaccatggataccatgctaacaagcacgcatttcttcctaaggttatatggtgtttgaaatgaaagctrtggtgatgaatggccaataaggggtctggtaarttgaggtacttaatgagttaaaggatggcctggagccattatccatttcaaaaggtaataacaataccaaagatgacactttggctggaataccatttaagaacatttagcttagaatgggagagtttgactagatgatctttacagtccttttaatcatcaatttccatgattttttgacatttgggccatgatgtccctgcacacactccattcaacttctattaaaatccacacaatttgttgtcaatatattgtgctagatagtttgatgaatacaaaaacaggcctttctgcagtgtcctgaccctttggcaggtggggctgagagtagcccagatttgggaactgctaatgcaatcttaggtgaacctgtaaggaagtcaggaagaaggtaaacacctgggaggtggagatagaggtggagatgggcttgtttaggagtaaattaggacatctcaaaattagcaactcctccctaagagggaccattattccctctataaaaaggccactctgcccaactcgcagcaccctgaaagctgtttctgtctctaccctacttgttcctctggtgagctaggtaagtgagcagttcaactccgctcaagggtacttagggctataaattatgaaagtccaggatgtgctctaaggcaaagaggcactagatacaaggcttctttttagtatactctggggaactttggtataagtttaaatttactgaaaagaaaaatgaaacaaagactaggactatgtatattatctcctttctttgaggtcgcttcccttataacatggatatcatggggttctaattatccacaggcaggttgccttctttacaactgagcttttcctctctattgtgtaataaggtctgagggtcacttcctgcttggagaatgagaacagaagctggatctaatagcagttacccttagcttcatatcacctaggcttgttggctttgctcacattgtctattttctctgacctagaagtcttgagagttcagttcagccattgatgctccttaggttgagtaaggcatgtcatgtagatgatggacctatgcccacagtatgcttcgaacctagaaagaggaagcagatgaagtggaacactcaggacttctacagctccagaacaaagctaatattatccctggtaatggcaggaagccaaaaacagaaagtcatttttcctacattcattcaggaatggaaataagacctatggattatattcctaatttcatcactctcttgctacatggcttgaacaagtcattcaactctgaattggttcttgattacaacagaatgaatttaatcatgactgactaattctgaacaattattataaataattagaactatttatgtgtttaaacaagaaataagaatagtaaggggttggtctctctttttcctccctttaggttactcaaacttgcaaaaaaaaaatgcctaaactcctacaaggcgtcatcactgtcatcgatgttttctaccaatatgccacccagcatggggagtatgatacgttgaacaaggcagagctgaaagaacttctggaaaatgagtttcatcaaattctgaaggtaagaactccacgccaggatggagttatgcaggaattttcttctttatccctttccaccttcttgtcacatatgtcaaacatcctagaggattgtccttacttggtgagagagaacagggtttggtaaaagtttgagataaggtcaaaagcagatccgtgatkgtttccatagcataactaacggaagtgaccttactaaacaacaaacaaaacccacaggttaaataatgycctatctaagtgactaattcctacaaacccagacagtcctcagaaaaactstgaagtagatttctgagttcaggaaattggcatttactcctgaatcacaaaagaatgtgtccaccaccttaaaactgtcaggtctagatttgatagcttagatatttgggaccttatatcagactcctgagtttcaattccttaaatttggatttctgtggatttcagatatgatattcagatatcagatgtcagatattcagtgtgtcagctatgaatctcataatcttccccactaacctttttccttcatctttttgcccaaagcaaaaayctggtgtcattttttattgtctctctctcagcagacaccactaccttctaacctccatctaactcatcaataatctctcaaaacaacccatttctcttcatcactattattagtcctctggttcaggccacctactacttctactctcagcattggatgcaaatataatcatttcactcctcagctaaaaatccttcaatagttcccaattgctcttaaaatgaagtacaaagttccttaacataacttaaaagtcataatctagtccctatttgtctctctatccacatttcttgactcttcaaactctaaatctagcaatcctgaatttccttcagttccttgaatgctccataacttctctcacctctagccctttgttcatataattccctctgcctagaacaatcttttccccttctctttctcttcytacttcttcatttggctaatcctaatccatccttcaaaaggcatcatttcctctcattaacctttctaggacccccaatgtttcctctctgatgtactcttgtagaaaccttaccacaataaattataattttaagtttgtatatctggccaactaaactttaaattccattttttttcaggaagcaaacttgttcacttctttatactctcatatgacataatggtaggcaactagtaaaataataaatctttgttcagtgagtaaattaagtagctagttaatttaattggataaataaagttgatataattaatgtaggtataaaaacatattacttataaattagctaatcattcatatttgacccattctttaccaaaaataatcagccctcttgtttcctttcatcttccagttgcatcctattctagctgtttcccaccacattattcattccatattcctttttctctttctgctcaggatacagaaatgcagcctaaaggactgtgtgaatgagttccatataaataacccaaacatttacattttcacatctttccttcagttcgttagccagatgtattgtccatactaacagagctactctttgtacctttctcttatacagaatccaaacgatccagatactgtggatatcatcttgcaaagtctggatcgagaccataacaagaaagtggattttactgagtatcttctgatgatattcaagctggttcaggctcrtaataaaatcattggcaaagattactgccaagtttcagggtcaaagctgagagatgacactcaccagcaccaagaggaacaagaagaaactgaaaaagaggagaacaaacggcaagaatcctcttttagtcattcaagttggagtgcaggagagaatgattcctattccagaaacgtcagaggaagtcttaaacctgggactgaatccatatccagaagactgagttttcaaagagacttttctgrccaacataactcctactcaggtcagtcttccagctatggtgagcaaaactccgactctcaycagtcttcaggccgcggccaatgtgggtctgggtcagggcagtctcccaactatggccaacacggctctggctccggacagtcttccagcaatgacacacatgggtctggctcaggccagtcttctggctttagtcaacacaagtctagctcagggcagtcctctggttacagtcagcatggatctggctcaggtcactcctctggctacggacaacacggctctaggtcaggacagtcatctaggggtgaamgacacagatctagctcaggttcgtcttccagctatggtcagcatgggtctggttcccgtcagtctttgggccacggccgacaagggtctggatctcgccagtctcctagccacgtccgacatgggtccggttcggggcactcctccagccacggccaacacgggtctggmtcaagttactcttacagccgtggccattatgagtctggctcaggccagacttctggctttgggcaacatgagtctggctcaggacagtcctctggctatagtaagcatggttctggctcaggtcactcctctagccagggacaacatggatctacgtcagggcaggcatcaagctctggccaacatggctccagctcacgtcagtcttccagctatggtcagcatgagtctgcctcccgtcactcttcaggccgcggccaacacagctctggatctggccagtctccaggccacggccagcgtgggtctgggtcagggcagtctcccagctccggccaacatgggactggctttggtcgatcttccagcagtggcccatatgtgtctggttcaggctactcttctggctttggtcaccacgagtctagctcagggcattcctctggttacactcagcatggatctggctcaggtcactcctccggccacggacaacacggctctaggtcaggacagtcatctaggggtgaacgacaaggatctagtgcaggttcatcttccagctatggtcagcatgggtctggctcccgtcaatctttgggacacagccgacatgggtctggatctggccagtctcctagccctagccgtggccgacatgagtctggttccaggcagtcttccagctatggcccacatgggtatggctcagggaggtcttcaagccgtggcccatatgagtctggctccggtcactcttctggcttaggtcaccaagagtctcgctcaggacagtcctctggctacggtcaacacggatctagctcrggtcattcctctacccatgggcaacatggttctacatcaggacagtcatcgagctgtggccaacatggagctacctcaggtcagtcttccagccacggtcagcatggctctggctcaagtcagtcttctcgctatggccaacagggctctggatctggccagtctcctagtcgcggccracatgggtccgattttgggcactcttccagctacggccaacatgggtctggctccggttggtcttcaagcaatggcccacatgggtctgtctcaggccagtcttccggctttggtcacaagtctggctcagggcagtcctctggttacagtcagcatggatctggctcaagtcactcctccggctacagaaaacacggctctaggtcaggacagtcatctaggagtgaacaacayggatctagctcaggtttgtcttccagctatggtcagcatgggtcgggctcccatcaatcttcgggccacggccgacaagggtctggatctggccactctcctagccgtgtccgacatgggtccagttcagggcactcctccagccacggccaacacgggtctggcacaasttgttcttccagstgtggccaytatgagtctggctcaggccaggcttctggttttgggcaacacgagtctggctcaggacagggctatagtcagcatggttctgcctcaggtcacttctctagccagggacgacatggatctacgtcagggcagtcatcaagctccggccaacatgactctagctcaggtcaatcttccagctatggtcagcatgagtctgcctcccatcacgcttcgggccgcggccgacatggctctggatctggccagtctccaggccacggccagcgtgggtctgggtcagggcagtctcccagctatggccgacatgggtctggctccggtcggtcttccagcagtggccgacatgggtctggctcaggccagtcttctggctttggtcacaagtctagctcagggcagtcctctggttacactcagcatggatctggctcaggtcactcctccagctacgaacaacacggctctaggtcaggacagtcatctaggagcgaacaacatggatctagctcaggttcgtcttccagctatggtcagcatgggtctggctcccgtcagtctttgggccacggccaacatgggtctggatctggccagtctcctagccctagccgtggccgacatgggtctggttccgggcagtcttccagctatggcccatataggtctggctcagggtggtcttcaagccgtggcccatatgagtctggctccggtcactcttctggcttaggtcaccgagagtctcgctcaggacagtcctctggctacggtcaacatggatctagctcaggtcattcctctacccatgggcaacacggttctacatcaggacagtcatcgagctgtggccaacatggagctagctcaggtcagtcttccagccacggtcagcatggctctggctcaagtcagtcttctggctatggccgacagggctctggatctggccagtctccaggccacggccagcgtgggtctgggtcaaggcagtctcccagctacggccgacatgggtctggctccggtcggtcttccagcagtggccaacatgggtctggcttaggcgagtcttctggctttggtcaccacgagtctagctcagggcagtcctctagttacagtcagcatgggtctggctcaggtcactcctctggctacggacaacacggctctagatcaggacagtcatctaggggtgaacgacacggatctagctcaggttcgtcttcccgctatggtcagcatgggtctggctcccgtcagtcttcgggccacggccgacaagggtctggatctggccagtcccctagccgcggccgacatgggtccggttyggggcactcctccagccacggccaacatgggtctggctcaggtcgttcttccagccgtggcccatatgagtctcgctcgggtcactcttctgtctttggtcaacatgagtctggctcaggacattcctctgcttacagtcagcatggtagtggctcagggcacttctgtagccaaggacagcatggttctacatcaggacagtcatcaacctttgaccaggagggatctagcacaggtcagtcttccagccacggtcagcatggctctggctcaagtcagtcttctagctatggccaacagggctctggatctggccagtctcctagtcgcggccgacatgggtccggttccgggcactcttccagctacggccaacatgggtctggctccggttggtcttccagcagtggccgacatgggtctggctcaggtcagtcttctggatttggtcaccaygagtctagctcatggcagtcctctggttacactcagcatggatctggctcaggtcactcctccagctacgaacaacacggctctaggtcaggacagtcatctaggggtgaacracacggatctagctcaggttcatcttccagctatggtcagcatgggtctggctcccgtcagtctttgggccacggccaacatgggtctggatctggccagtctcctagccctagccgtggccgacatgggtctggttctgggcagtcttccagctacggcccatatgggtctggctcagggtggtcttccagccgtggcccatatgagtctggctccggtcactcttctggcttaggtcaccgagagtctcgctcaggacagtcctctggctacggtcaacatggatctagctcaggtcattcctctacccatgggcaacatggttctacatcaggacagtcatcgagctgtggccaacatggagctagctcaggtcagtcttccagccacggtcagcatggctctggctcaagtcagtcttctggctatggccgacagggctctggatctggccagtctccaggccacggccagcgtgggtctgggtcaaggcagtctcccagctacggccgacatgggtctggctccggtcggtcttccagcagtggccaacatgggtctggcttaggcgagtcttctggctttggtcaccacgagtctagctcagggcagtcctctagttacagtcagcatgggtctggctcaggtcactcctctggctacggacaacacggctctagatcaggacagtcatctaggggtgaacgacacggatctagctcaggttcgtcttcccactatggtcagcatgggtctggctcccgtcagtcttcgggccacggccgacaagggtctggatctggccagtcccctagccgcggccgacatgggtccggtttggggcactcctccagccacggccaacatgggtctggctcaggtcgttcttccagccgtggcccatatgagtctcgctcgggtcactcttctgtctttggtcaacatgagtctggctcaggacattcctctgcttacagtcagcatggtagtggctcagggcacttctgtagccaaggacagcatggttctacatcaggacagtcatcaacctttgaccaggagggatctagcacaggccagtcttccagctatggccaccgtggctctggctccagtcagtcttctggctatggccgacatggggctggatctggccagtctcttagccacggccgacacgggtctggttcagggcagtcttccagctacggccaacatgggtctggctcaggacagtcctctggttatagtcagcatggaagtggctcagggcaagatgggtattcttattgcaaaggaggaagtaaccatgatgggggaagttctggctcatattttctcagttttcctagtagcacttcaccctatgaatatgtccaagagcagaggtgctacttttatcagtgaataataaacataaatgcaatttactcaagtagcaatttaagaaataggaaastcatctatgaattcatcatgaaagacaagcaatccatcatgaaattcgttctaaaagtgaatcaatgcatttctgtctctttctttagagcctaaaactgtagcatatatcttgttatggggttccttccaaagactgttaggcatttgtgctactttgttagaaaatactgagtggaataacttgttagaatgagggttaaactttgaggaataatgaaaagcttttaaagagctttgggtttagttggagttgtctttttgagagctcatcattcatttatagatggtgccaaagctaaccttacatttcttaraagcaaaatattacaaatgcattaccagtcctagatacaaagctttgttttacagcaattagtgtaccctaatttttagtgtgccccawgtttggtgtgtcccaatttttggtattgtggcagaaggtgaaggctctgaaagcaaagatgcagcagcggtagtgtctttacttatcaaaaccatcaagtcctttttcttgggtatatatttaatcagtaagttaattagtggcmtaaaaaagtagcatcagggtcttttcccaagccagtgagcaagagcattatttcataaagaatagggatttatcatttcaggaaaaaaaaaaacattcaaatgtgggctttagcttgttttcagcagaaagatcttgctccctatttctaagaggctgctcaatattgggaaatatattgaggagttattccatggaaatacaatgctttccacctactactgtagttcaataacgtttccacctraaaaaatatcatccatgcccagatgaaaaggaagagtatctgtcactgctacatagttccttaatttgactgtaacacatytgtttcaagtctttggattcaaacaaccggattgtattaaaattgacaataaataaatgttgattaaatactaagacttttctcatctstgcttcatttcacttcttacatacagatggtcatcctagaaaccaamccaaacagcgatttcccaatattctatttttcacaatgaagaatagataaagcattcttaaaactcaataagacaaactacttcattttaaaatgatcaaaattccatcacactggtattggcaatgatttttttgatatgacaccaaaatcacacacaataatgtggagstgtcagctccatacattttattgtccctgaagcccttagagggagacaacatatggaggtagaaggcgatatttgtcttggtttaacaaaaactttttagtgttagttttaatttttaacaaaaaaagttttttaaaaaaatttaaaacagaaaaaagcctacagaataatgatgtaaagaaaaaartatttgtgttcagctatacaatgtgttcgtgctttaagctaggtgttaattaagagagtcaaaaagtttaaaaatgtaaaagtctataaacctaaaaatttacagtaagctaaagttaatttttactggaggaagaaattcttttataaatttagtgtaattcaagtgtatagtgtttayacactctacagtagtatacagtaatgtcctaggccttcccattcactcaccactcactgactgacacctacagcaacttctagtcctacatgctctattcatggtaagtgccctatacaagtgtaccttttttatcttttatgccatatttttactgtaccttctttatgtttagatacatttagatgcacacttaccattgtgttagttgcctacagtactcagtacagtaacatgctgtataggtttgtagcctaggagcaataatctataccatatagcctagttgtttattggctataccatctatatttgtgtaagtacactctctgatgtttgcctaagggtgcatttttcacaacatatcccccattgttaagcaacacgattgtgtactttactatagggcctagcaattccactcccaagcgaaatgacaacgtatgtctacattgaagatttttacatgaatgtytatagcagctttaataatagccccaaacttgaaacaatccaaatgtccacgaacagatgactggataaacaaattgtggtatggctatacaatggaattctatttagcaaggaaaaaaagaataaactactgatacatgtaacacagatgaatctcaaaaacaygttgatcaaaagaagccatccacaaaagagtacatatttatgattccatctatatgaaacttactaaaacaaacctaatctataaaaatagaaagtagatcagtggttgactagggctgggagtagaacttgtgaactgtctggaagagtcacaaaggaacactctagggtgatggaataaatctatatgtagattataatggtagttacatatatatatacttttgtcaaaacttacataatcgtacatattatgtggaaattatatctcaataaagttgattgtttaaaggctttctgtgcaacttgacacacgaattttttttgttttttgttttttgttttttgttttgagacagtctcactctgttgcccaggctggagtacagtggcacaatatcggctcactgcaacctccatctcgtgggtgcaagtgattcccctgcctcagtctcctgggattacaggcaggcagcaccacatccagctaatgtttgtatttttagtaggcagggtttcaccatgttggccaggctggtctcgaactcctgacctcaggtgatctgcccgcctcggcctcccaaagtgctggcattatgtgagccaccaagatacagaaggggaggagtttcatctcatcagatatcaaaatatattacaaagttatatgatttaaaacagtgcagtattgttgtaggaacagatatacagagcaatgtgactccagaaacagatccatgcatacttgatatacaagagcagtggttttgcttatcagtggagagaggcaactctttcaataaatggtgccaaggtaataaattttccataggaaaaaaattatctctatttcacaccatttacaaaaatcacttccaagtaaataaaaacctaactgtgataagccaaacttttaaaaatttttaaagaaaatataggagaatatctttatgactttgaaataagtgcagattctttaaacaagaaatatacaaaccaccaaggaaagactcatgacttttactataattaaattacaaatgtctgtaaatccaaagacaatctcaaaaagtaaaaaggacaaaccacagagtccaagaacatttttgaaatgcctataaacaacagatgatcaatagccrgattatgtaaataacttataaaaattaaaaatttaaaaaacagcaaaacttagaaaattcaccaaaatttataaaaattaaaaattaaaaagaaacagcaaaacttataaaaagaaaattcaccaaaggtaatctgaatggcaaagtgacatttttaaaacaatgctcagggaaatagataattaaaacacaatgaaattcatttcatacccatcggatcagaaaaaaactaaagtctggcaatatccagtgtcgggaggatactgagcagcaggagtctgaactgatacctaattaagaggaaatctggcaaccacagacaagtctgtaacagcaaaatgttacaaacaacctaaaagttcaatagaagaatggataaattgtaatatacccacacactaaaatgctatatagcagttaaaattcatgagctacaggtacgtatatatcaacatggacaaattccaaaagtgtaatgccaagtgaaaaggttgyaaaacaagtatacatggtgtgataccatttatataggtttacaatatacataacaataccatatattgtttgtggttaatacatatttggtaaatgtaaaaatctttatgggaatgataaacagcaaattcaaracagtgtgtacctctggaaggatggaagaaaatggaactgagatcgagtaaacaataccaaaagttttcttaagaagatggtattcattatatcattcactgacttgtaaatctacacttacttgtaaatcttaaattattttgtaagaaaaaggagaacacaaagaacaatgttagaatgcccatcaaggactgctcaagggagagtgttctgacaagctagtccactggtgtatctggtccagcatgtcctagtcttttaaataaatgtctcaccacatgagtgcctaatgatattcatcagctgaaccacacaacacrccctctgccayagacttcaaacacaccaaggggccttctagaaaatttggctttctcaaaattgacaaatgggatctaattaaactaaagagcttctgcacagcaaaagaaactaccatcagagtgaataggcaacctacagaatgggagaaaatttttgcaacctactcatctgacaaagggctaatacccagaatctacaatgaactcaaacaaatttacaagaaaaaaaaaaacaaccccatcaaaaagtgggggaaggatatgaacagacacttctcaaaagaagacatttatgcagccaaaaaacacatgaaaaaatgctcatcatcagtggccatcagagaaatgcaaatcaaaaccacaatgagataccatctcacaccagttagaatggcaatcattaaaaagtcaggaaacaacaggtgctggagaggatgtggagaaataggaacacttttacactgctggtggaactgtaaactagttcaaccattgtggaagtcagtgtggcgattcctcagggatctagaactagaaataccatttgacccagccatcccattactgggtatatacccaaaggattataaatcatgctgctataaagacacacatacacattatgtttactgcggcactatttacaatagcaaagacttggaaccaacccaaatgtccatcaatgatagactggattaagaaaatgtggcacatatacaccatggaatactatgcagccataaaaaatgatgagttcatgtcctttgtagggacatggatgaagctggaaaccatcattctcagcaaactattgcaaggacaaaaaaccaaacaccgcatattctcactcataggtgggaattgaacaatgagaacacttggacacaggaaggggaacatcacacactggggactgctgtggggtgggggtagaggggagggatagcattaggagatatacctaatgctaaatgacgagttaatggatgcagcacagtaacatggcacatgtatacatatgtaacaaacctgcacgttgtgcacatggaccctaaaacttaaagtataataataataaaattttttwaaaaaagaaaatttggctttccataattttcccaaaaggagaaagcattcatcagcaagattaatataaatacccagtgtttctgataatgcatttctgactgtaaattaataaaatggcactctggtttttatacttcagtccctgatgagttcagttacaatgaaacagttttcctgagtctgatcaactctggggcactgatatgagtgcatttctgggtatataagaatgagaaccaaaccctgaccctttttctgggcaacaccccaaccttattctttgccttccaaggggtaaggggcaagaaaatttttctaataagagaaagcaaacaaattcccaataaatgcttagttatatagttaagccaagtttttcacaatgtttctcttttccttgttatgactctagaaacttaagaaccataatgttacagctaaaataagaaaagagaaagaggtgggctgtttcaggcaggatcttacagaatcccaatacctcatccccagatggatctcacttttgttagtttttgtctgtacattcaaatgtgatcaagctctgggagacagattcactctaagcaaagtcttaagggtccaattgatttatttactaactacaagataataaacgtattcagaacaagaatcagctgtttaacatggggtattccctgtcattggatagattcatttgagagatatcaggttattagatgagcttcagagcaaaagagttttattctccaaggttgtgctatggtaatctgatgattcaaaaatttttcctaaaagggatagaaaaatacaaaagcagcattgttattgaacatcttatgaactgggaacattacattatgtgctatatacttgacatatatttatttattgtttaatttcattctcatagcaaccctgtggttataaatgttattttactyaagagcaaactgagactttaaaaggtcaagtatattatattagtaaagtcaggttttatacctaaatctgtctaactccaaaacatatgtgtttgctaacataacactgtcttgtgcttcagtaatatttttctctaaacaactacagtcaaacaactaggactggtgcaatccactcttctggacactgctggagacacaccaactagtactcatcctcagactccccctttcctgcttcaatgcaaccaaacttaatgtcttgagagagacttgaggaacaccctgctcattagcagcacttaatttccaagggtggactcctgctgcagataactcatctcttcacattttatttatttcatcacatttaacagttctcattagtttcaattccagagggtggcattttctgacttgacctccttaatgcatgccttactttgtaggtcaccagggactaataataaacaatcacacacagtctggtatcttttgaaagataagtatctgatacccaattccttcaatagcctgtctcagccctcttcctctacccctcctgttctctcagactccctgactctgtgtgctctaccctagaaacaaagggytcctkagcatcaccacccaccttggtttgtccttacctacaaattcttgccagaacactccagatgttgaagacttaaaattgtgacaaatcagccatgcaatattcatagacttcacaagcagagaagtgaactccatgtgcaaagacactgaggaaatagtgttctcagggatcaaagagtatatgtctttggctgaagcatgtagaaaaaccagtatcaggaactgcagctggaaaagcaagttggaggcaggctgtaaagggctttaaatagaatcacatgaaggaggcggagaagaaaggtcagtgaaggacactgataaagatgaatcaaagttggaggagaggcagagaaaatggtgttctagaacccaaagagagggaatttcactaagtaatggaagataaaatgcattttataaagttattataaatactcttctgccagatagcatattggcagaagagtasataatacagatcaatataacaataaatagcccagaaacagatcctaatatatatatttttaattaatttgtgaactstctgctacatagttaatatatatagtgtacttagaaaagtgtctggtccacagtaatcatctaataaatattagtggctatctttattactacttgttgttataattcttattaaatatcagtgtgaaaagattctttaaaaagtttgtagtaaagaggaaataagagagtaggcaaggaagaaagaaaaatcctttataaaggaagaaattaaaatatatgctggaaacacaggcagcatgcaataaaaatttactgaatgtgaataacagttctaagtcaagtggaaggtgatttatagaaagtaagaatctgttgatacagagaaaggaatcgttgttggatcaaggacctagaaggaatgacagaaattgaatcaaatatacacatagagaaatcagtcttggaaaggaaaagaatacctcatatactcttgaaacaaaaaggagattaaaattcagcaaaaatacaattacctccatgtttttaaaagaggttcctaggatgagctgcatcagaatcacctatggtaattatttaaaaagcaaactgatggcctctatcccagatcaactaaatccaaatttctagtagatgggacccaggaatctgtatgttagtggtccatgacctagttgattccttttagaaacaaagttaggagaattcacatccgttggcccctatggagacaacaaaactgactccttgcccaaccaccattatgamtaagcatataaagtcgcaccattggagaggaaaaacaaaaatctttacaaccctgagataagctaaaaatgaggaagaagattctacctagtcttccaaatcaatgaagccttgagccctttcctataaattgctaactctctaatgtaaacaacttcatccctgacttttgcaacactgacacctacaagtatgataatgayatggaggaaattttttcatccacatgaatagactaactgtaatcttggtagcctgactcctcattctttttgaatcacttcccaatcttaacaaagaaggaagtaaagtgatctactaaaaggaagatggggagggagtgaagcaggaggcttagaaagatctgaaaagggaaaggtctgaaaattccagctgaggggtctggtaaaagaaaccrcctaggtatgatgaaagggaytkccaggcaatattcagagtgtgggcaaggttaatataataaatgtgtagaaataagctaaggcaccatgtatgtgatatttgccatcttaacagcctggcagaagaagccaaaaaaaaaaaaaaatggaattaggttaatcccaggtttgagactggcagggcaggtacaaggaaaaatgaagggtccaaggacacataatggtctgtagagaaggttataggtatgggaggaaaaaccagaaacccttacagcaggggtccccaacccctgggctacagactagtactagtctgtggcctgttagtaaycaggccacacagcagtaggtgagtggcagcccaccgtgcattactgcctgaacttcgcctcctgtcagatcagcagctgcattagattctcataggaacacgaaccctattgtgaactacaccaggagggatctaggttgcatgtgccttatgagaatctaatgcctgataatccaagatgraacagtttcatccctaaaccatcccacccccactgttctcccatccatggaatagttgacttccatgaaaccagtccctgctgccaaaaaggttgggaattgctcccttacaggccccctccttggcccaaactatatgtgtgtgaagggacggataattttatagccaaatttcccctaggcaagaccttacactctcgactccattattgtaggaaagatgggccttgttagcagtagcaacttttcaggtaaaataaaactaacaatatggaatatactaggagctatgtaccaatgtctcattacttaccccttttttrccttcacaataactctttgatgcagagatccttaaacttctcctcagtatgcaaattgaggttrtaaatccaaggacacacagctcacctatgatgtagttcagatttgaactcaagtgtgactatgaactcattctcaatctactagcccacagtgacttcaccagaacagccaggctccacttcacagaaaaaggaaaacagcatcattaaaggaaaaccagatttctaagagcaagggatggcagggagtaaggatatagggatatttcttggcaacaaaaccaaagagaatgaaacataatgtaggataattagcagtgagagcacagcaaataaaaggcaataagtagctgtaaatattatatctgaaggcatgtgtgcatggggagtagtggaggtgaagctaagagccaagtggagaaggaagtgagaggaagaaagtgaatttagcccactcaccatcattatctctgacatctytcaaaggaagtagagtgggaaacaaaaggagattaaagcaagtttgtctagataggaagattcatcatgcctggcaggagggggtcactgttattgcaacctttaacccaatccttttctcttctgcccactttggggagtgatctgggtgayttggtttgttcttttttgagatgcttaccaattyctgacaacaatcacaatgcattataacatgattgaggcccacaatttcaaaagtgtgatgatggaatcctagatagatatgaaagaaggcaggaaggggactggcagactgaaaaaatagagacaggataaggaacagatttctttgaaatgtgcataccctgtctaccagcagttctactcctactcgtatacctcagaggagtttgyatgcagacatacttcattttattgtgctccactttattgtgcttcacagactgtgtgttgtacaaattgaaggtttgaggcaaccctgtctggcaagtccatcggcaccatttttccaacagcatgtgctcccttcatgtttctgtgtcacattgtggtaattctcacaatatttcaaactttttcactattattatatctgctatggtgatctgtaataagtgatctttgctgttacacttgtaattgttgagggcaccacaaacctttcctatatgaaacagagagtttaatcgataaatgagtgttcttactgctccagtgatcagctgctcccctttctttctccctctagtcaggcctatctattccctaagatacaatattgaaattacgccagttagtaaccagacaatggcttctaagtgtttcagtgaatggaagagtcacatgtctctcactttattttatttatttatttatttatttatttatttatttatttatttgagacagagtatcactctattgcccacgatagagtgcagtggcaagatctcggctcactgcaacctctgcctcccgggttcaagcgattcttatgcctcagcctcccaagtactgggattacaggtacagacaaccatgcccttctaatttttaaattttttgtagaaatgggatatcattatgttacctaggctagtctcgaactcctggcctcaagtgatccacctatctcgacctcccaaagtgctgggattacaggcatgagccaccaggcacagccacatgtctctcactttaaataaaaaataagagctgggcacggtggctcacacctgtaatcccagcactttgggaggccaaggcaggcagatcacctgaggtcaggagttcaagaccagcctaatcaatatggtgaaaccctgtctctactaaaaatacaaaaatttaccaggcgtggtggcaggcacctgtagtcccagctactcgggaggctgacacaggagaattgattgaacctgggaggcagaggttgcagtgagccgagatcatgccactgcactccagcctgggcgacagagcgagactccatctcaaaaataaataaataaataaataaataagattaaacttagtgagaaaagcatgtcaaaagcagagagaggccaaaagctargccttttgtgccagttagccaagtttgtgaatgcaaatgaaaaattcttaaagaaaattaaaagtgctactcctgtgaacacatgaatgataagaaagcaaaacagctttaccactgacttggagaaagttttagtgatctagatagatcaaacctgccacaccattatcttaaaccaaagcctaatctagagtaaggccctaactctcttcaattctatgaaagctgagagaggtaaggaagttacagaagaaacgtttgaagctagcggaggttggttcatgaggtttaaggaaataagccatctccagaatataaaagtgcagggtgaagcagcacatgctgatggagaagctgcagcaagttatccagtagatctagctaagataattgatgaaggtggctacactaaacaacagattttcaatgtagataacacagcattctatcagaggaagatgtcacctaagacttttatagctacagagatgtcaattctctggcttcaaagcttcaaaggacaggctgactctcttgtaagggactaatgcagttggtgactttaagttgaagccgatgctcatttaccattctgaaaatcctagggcccttaagaatcatgctaaatctactctgtgctgtataaatggaacagcaaagcctggatgatggcacatctgtttacagcatggtttactaactatttaagcccmctgttgagacctactactcagaaaaaagagattcctttcaaaatattactgctcattgacaatgcacctggtcatccaacagctcggataaaaatgtacaacgatgtttttcctgtgcctgctaacacaacatccattctgcagcccatggatcaaggagtgatttcaattttcaagtcttcttatttaagaaatacattttggaagattacagctgccataaatagtgattcctctgatggatctgagtaaggaaaattgaaaatcttctggaaaggattatccattctagaagtcattaagaacatccacgattcacagagaagtcaaaatatcaatattaacaggggtctgaaagaagctgattctaaccctaatagattactttgagagattcaagacttcagtggaagaagtaactgcagatgtggtggaaatagcaagagaactagaattagaagtaaagcctgacatatttacctaggtaacaaactgcacatcatggacacataccccagaacttaaaagtcaaataaaaaacaataaaaacaaattgattaaaaatttttttttaaaaagtagagcctaaagacttaattgytacaatctcatgataaaacttaaacagatgagaagttggttatgaatgagcaaagaaagtgatttcttgagatggaatctacacctggtgaagatgctatgaacactgttatgatattccataaacttagttgataaagcagtggcagggtttgagaggattgaccaattttgaaagaaattatactgtgggtaaaactgtatcaaacagcactgcatgttagagagaaatctctcgtgaaaggaagagtcagtcaacacaggaaccttcactgttgtcttcctttaagaaattgccacagccaccctaaccttcagcaaccaccaccctcatcagccagcagccatcaacatcaaggcaagacccttcaccagaaaaaagattacaacttgctgaaggttcattagcattttttagcattgaagtattttcaatgaaggaatgtatacttttttagacataatgctattgarcactcaatagagactactctacagtgtaaacacacatttatacacactgggaaaccaaacaattcatgtaactcactttattgcaatattctctctaatgcagtagtctggaactgaacctgcaatatctccaaggtttatctatatttgtgataataatatctaatagttatataaaacatactatgcactaagcactactatgtataactctctcaattaccctaggagatagaccattccagatcaccattttactgatgaggcacagaggttaagtaatttgctatggtcacatagctgctactgaaaccaagcaatgagactctaaagtttttgttcttaacccagggcaccacatgtggctatgcaattcattcactgtcccagtggtgccaagaggaagcaagttggcacagaaatccaatccatgtcccagttaataatccatgcatacctagttaaaagctacatccayctcagtacttttatctttgccccaggcactttctatttgccaagctgtgagctcagaggactaggtccataaaaagaggaastctttcttattcacacaaaggtgccatatagtctagctgtggtgctaccttagccatggcactacactgacctattttgtttgggaagacatttacaagggtgtttaatacagcattgtttgtaatagtgaatttggaaaayggataaagtatactatattctkatattggaaagctacagtgcacctagaagaaaayaactattatatatacacatagattttaaaaacataataactttgagtgaaaatcaagttgcaaactattaatatgtacactacattacataaattttaaaatgtagttacatattttatacatatatatacacatatatttatacacatacatcacacatatttaccaaattaattttggtggtacttctgataagaaaaaaaaaagattagaacttgggggtgagaaacacaggagacttaaatttacctgcaatgttttattcattttaataagacctgaagcaaatacaacaaaaagtttactactgtcagctctagatggtagccatgcaattactcaagataaaaataaaaagactattttttaagaacaggcttagtgggaacttaagagt

SEQ ID NO: 10912 - DNA, 40000 bp, Homo sapiens
ttaagcctgggaggtggaggatgcagtgagccgtgatcatgccactgcactccagcctggtagacagagccagaccttgtctcaaaaaacaaacaaacaaacaaacaaacaaacaaacaaagaatgatgatgacacatggagccactatataaacgtttgctcttcttattagtggttaaaatgtctgaagtcaagtataggtttaaatccttgttttaccacatactggctatatgaccctgggcaagtatttaatctctctattaaaaaggtaacggttgcaccaactttctgtggttttcagaagattaaatgagacaaagtccataaattgcctagcatgctgcctgatcttaggcagcaaatggtggtgatgacaattagatgacagcaggtcagttctggaatgggaggccctcacccagctcctacagtgaacggtacagcctgggctgctgctgcttgccaagccccaggtctttcaggtgtagcctcccctgggggtccacaattaccagctgaatctactctgtttccaggacctttgacttatgatggctcagctgggcctgaagagcttttgagcataacttattgtatggtttgagtgtttagaaagatgagcatctactctatgcctgatcagtgatgagtcttgaaccccacccttctccaacttcccttggcagcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatggtaagcacagcctgcagcacatggaaagagcgtctctgctttgaacagagccaacttcggagccagctggcaaactgctgacaagcacacatgctcagaaaggcaggcaagatgaggggaaaagacattgctgactcacaagtgccaaattttaacaggcatttggggacactgacaataggaggaaaagatgttttataaaatatattaaaagtgagcatagcttggtgagtaagaacatgggcactggagtcagactgattagcctggctatgatttctctgtgactgtgtatgccaccatctctaagcctcaagttcttaatgtgcgaatgaggataatcattagacttatttaagagttcagtgagagttcctaaaggacgtgaggcagtgcctggcacatagcaattgttcagtaaatattaacttctgatgattgtggcttttattaggtagaatcctgaggcagggaaggacctkagttctggtcctggctttttcactgactcactgtgggatcttgggcaagtcagatgacttctgttttaattttcttcatgttagatgaagaggtggcccatctgagccctggggctctacctagctctgagacttggttggaaaacattgactaggagcataaaatgaactggatctttgtcctggaggactacacagtcctgtaggagaggagtcatttgtttcttcctgagcttatttgttcacctagccaacaaatatttaatgagcatctactatgtcaggcattggcctaagtgctggaaacaacatggttagtgacagaaacacaaaatatatatattgttatagctgctataacagcccaaagccctatgtgagcatggaagcagcagcagcagttaattttacatgagcttttagaaggaatagagcaaagtcttgagagatgtgggtcttgaaataacatatacattttgagcataaatgggggagaaggacattcagaaagagggaaggacataagtcaaaggatgaagtaccccggtgtacgtgtggactgacgaatggtcttatttggtcagtgggttgggtgtgtggggcttggcagtgagagaggagactagaagggaatggggttcagctgtgaagagccttcagggccaagctctggaggatagacttaatcttagaggaagccactgaaggattttaggatgacaagtgccaaaattgtttgggaagacaatattctatggctttcctaaaaagtaacaaaagcacggatcatcatctttgtcctacagwtgcctgaaataatgtcaaacaaacacccaagacaaggagttttagtatctcttggggtggacccaaatgcctcccacatggctctgctgagagagacagagagcctcatctacccaaaagcaaccaactggcaacctctcctatctggaatcaggaagaaagcaaaaagacactgagacttcaaaataaatatggctgttctcaactctgcctttgtgacacatgaaaatgtcttgattttttttaaaatgaaaaagagttgtagctccaactggggaaaattacgcataatgcagtgtatgcccacgagagtgagtcttgcatgtgtcacagtagagaatagttggaaactgctattttccccacagagaagctcccaaggccttcactcagagttttttttttttcaaacatatatttccaaaaagtttgatatcttcttttcaaacccagaaggatagaaatcacatttagaaggtgcacatgaggctgctacagacgggccctctgagcgctggacaacggtgagaactgtagctggggctaacacacattgagcattgctgactgccaggtacatgctgaagtgacttttacatggtgctttcctcacaatcactccataaagtagacttgattatttcctgattttatagatgaggccattcaggcttagagatttaaggaactgacctaaggtcccagcatggcaaggttgcaaagcaaggtttgaaccaggactgtgggactccagagcctggattcttacctgtaactttcctgcgtttctaatgagttggagcaagtaaggaaacacagtagttcttaaaagcagaagaaatattttttttaaacgatagcagtcgggaagcatttggtggagtggcaaacagctgtctagttttctattacaccagaacgcagcacagcaaccgacattcttaatggtaagtcccatcaacaaaaagaggagagatactgccgcagaggaattcaagatgaaaagaaaatgtattctcatattttatattcactaaaataaaagaaagacaccacactaatggagtaccaatgctattgtaaacatatcgaattagtaattgtgactattataccattactttccatttgccatcccttaactgagagaaacttttcaagagttcctctcacacaatttcaatgatgttcttataatgtgtttggctttgtcgcacatgatatgcatacaaagaggcattttttctgtgtctggaatttggaaaagattgtgctttgcatatgcttaatttgaatgatgcctataggaagtaagctagacttcaaagggggaagattggcatttggagaagtacagcatgcactgcatttaatgtgtatatcaggacaaaaaatattaatgagagaacacacacagttttcttcctccccgaccagccaaattctccaccctccagccccattcaaataaaggagagaagagtctttcttggtggataagaagcttgattgttttacataatacaagaatagagaaaaaagcgggaggtggggaggtgagagggaaaggagagcctgatgagctcaacaggaagtgagtatagacagagaagagaagaccaaggactaagccctgggaccctcctttggtaataggtcagagagaagaagaaaagcaaagaagcctcagagaagtaaccggtaaggtaggaggaaaaccaaagagcatggtgtcctggaagctcagtgaagaactggatcaaggaggaggagtgaccagccaggtcaaaagctactgatgcatcaaggaggatgaagaccaagaactggccgttgggatttaacaacatgaaggtcattgctggtctcaccaagcagttttggaggagtgatgggggccaaagctgattggactgggtttaagagagaaagaaaggaaaagaattagagacagtgggtgctgacaatttttttaaggatttttgctgcaaaagggagcaggtaagtgagatggaagctggagggagaaatgaggtcaagggagggatttttaaagtcagagacatacagcatttttgcatgctggtgggagagacgaatagagagaaaaatgtatcatgtaggaaagaaagagcagaattactagaacaatgcttttgatttggggagagaagatggacctggcatgctaagtggagggatgagcctggactggatgcacagaggctcgtctgagggaagaggggacggggaagatgggtgcagatgctggtaggtgaagagaggtggtggtgggagtctgtggaagttttcttctgactgtcttctcagtaagcagaatggtaagtgatagcagccacagaaggggcatttctcagaaccttatcaaaaagtgaaagagtgagtttggaagcaactaaatcataagaatgcaaaacatgttctttattccaacagaggactaccaggaactcattgaagacatagttcgagatggccggctctatgcatctgagaaccatcaggaaatacttaaggtgagtgcctggctcaggtggacatggcagttatccacagagcttcccgagtactgttggagaaggcttctcctcctgctccttgttgccacctttcagacacggagcctgtcctgggccaaggtcagttttataccttcaccagacttaatttttaaaaaaatcaggttgctgtctttagtgttgtcaagtgaagttgtatttttcaatttggaaacttgtggaggggcagggagaaatttgcttataaatccaaaccaacagcaaataatgtttttctattaattccaaatagttgaggatccttggctctttatgtatacttcaagcctaaaattcaccaaagtttaaatacttataaataattagcaataaacacttgtggtatcactaatcctacaaatactcccaaatcccagtgttgcattcatctggttgggaaaaaagaaaacaggattttacatattaaagttttatttataaaagtaattcatacttcttaaaactaattaggaaaaataaaaactggaaagaagataaaaatcagaggaaacaatttttgcaagtgtttttcagctaagcaagctacggcctaatactgggtcattatagttccatgggcaaaatgtcagcatatttaaatattttggcccagtaacaaaaattctgttctttttaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatrcaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcamgggctggctgagctggactttggtcagcctaggtgagactcacctgtccttctggggtcttactcctcctcaaggagtctgtagtggaaaggaggccacagaataagctgcttattctgaaacttcagcttcctctagcccggccctctctaagggagccctctgcactcgtgtgcaggctctgaccaggcagaacaggcaagaggggagggaaggagacccctgcaggctccctccacccaccttgagacctgggaggactcagtttctccacagccttctccagcctgtgtgatacaagtttgatcccaggaacttgagttctaagcagtgctcgtgaaaaaaaaaagcagaaagaattagaaataaataaaaactaagcacttctggagacataataatgtacatttattgccagccttcctcgttgcaagcttccaccctgcagcaaatgcactatgctgactctcgcaccttcagctgtgccctctgacactctgctggccattgcctgagggactggggagttcaggtgaaatgtaatttcctcagtggatgagaatcatcaattgtcatgaaaaggcgatttcaccaaccctgagtcggtattgccaagggttctactccccaagtgggcttcccatcacaagggatctgaggtccaggtgggtgtggtgaggcccagcctgtcatgtatgccttccttccccagtctcaaatgtgagagacggactctgctccgtggacatgagcagccccttgaagggtggtctcattctctaacagtaacagcactgccagaaacaccccctgaatgccacacgatcatctcactttgggtcaggccagcagggcctcacgatcatttcttgaacttgaattttcagtgttattgaatctttaaacatttaaatccccaagcaaaaatctcattacagtgaataaaaaggaatccaatcaaacaagccaccacttccctaatggatggactacctacaactatagtgttttgttatttcaataacaattctatgcacagccaattctccataccaaagtactaaaaaaatgtttaacaagcatttttgaagaaaacaaagagaacttcattatggttaaacttgcttttcatctcagtgttgctttttttaacctgttaataacattgattcttaaaaagtcctaatcaaacttctttatttggatgggccctaaatattcattttcagatttctcttcaaaagtttgaacatcatcattaaaaaaaaaatagcattaaaacaagcacttggactttgttatactggagcttggcctatatttctgagtctaaccataagatgaaaattcgaatgtcacataaacccgagttagtgaccgcactgatgtgaaggtgagatgagctgagctgcaccattctgtccaggcatgttagcaactttgtgctcatgactgtgtgatcctgtcttgctgatttcacaagaaggctagggatgggaatactctgggggttggaaggaggctgcataaacccggtcactatggaggagcatcctccacggggcagccccatgcaccagagctgtgttgctggtacacgcacaaaccactgacgcacaggaggtataaagaggagcttcctctctattccctcaactaccttaagagatgctgtgatcctgttgggggctggctatctggagatactatttctacctgctacatcaatatttatcaaacttctgcctggtactctaggccctggggatgcggcgataagacagacaaggtccctgccctcatgaagcttacattttagagggaagagacagacaaagaacagataaatcaacatgaaaagtagcagctagtggtaagagctatgttgaaaattaaaataggttactgtaacagatgattgtgtggctactttaggattggggattatagatggcctctatgcggaaattacatttcaattgaaaactaaatggcaagaagaaaccagtcttgggaaaattagggggaagagctttccagagagaggaaaaccaagtgcaaaggctgtcaggcaggagcaaccatttgtgtatattgtagtctagtgagaaggcaggtcgtacaagatgaggctagagaaccagacacggccagatcacatcgggctttggaatctataatgaggggtttgagttatttctaaatatgttgcaaacttttgaatggatttaagcagaggagtgagataatctgatttatgttttaaaagggtagctgtggctactgtgtgaataggaagccagcacggaggcagagagagttattcacagactactgcaacagaacaagcagccatccagttggcagatgaaggtattgtctggattagggtgttgtagtggagatgagagaagtagaaggattctggatgtgttttgggggacagtcaacagaatttgctgatggggattgtatggaagtgctgagggaaagaaggaagtcaaagatgactcctagttgcctaagaaactggtagatggaggagactaggaggagcaggttcgggatatgcagcagttttaaaacatgtttgcaaattctttgaggttccttccatggacagttggggtctgtgtcacctccccttgactctgggctctgtgactgcttgaccaatattaacatggcagaagtaatgctttacgaggcccagggcttaagacactagcagcttccacttcctctccttaggacactcacacttgaaactcagtcaccacgtcatgaggaagcaagccataacagcctgtggagaggccatgtggagaggaaccacagtccctccacccaccggccaggctgagcttccaggcgacagccagcaaaacttgccagctgcgtgagtaagccatcttggaaagggattctccagctgctccagctgacacttcatggagcagtcctcattgaaccacagaaaaattagagatttgtgtgcaaaattaatgattattatcttaaatgattgataggttttgaggtgacttcttatgcagtaatataacagtgaaaaggggagatggttaagagttccattttggccattctaggttctaggtgcctatcatatgtccaactggagggttcaaataggcaaatggttatacaaagccccaggagaggtcagggctggaatataagttttaatgtcacagagtaaaggcatgagactttaccccggttaaggtcacctgggaaacatgtaaataaaagaagaccggggaactcttaattctgggatttcctgtgtgggcacaggaaccaggactttgaggagctgcgtattaagtaaacaggaagaggtcagagctgagcttccatcttccctccaagagagctagttctatgggtgaaccctgaatgggcatggatctgtacagtccttccttctagctgtagatattgttctttagccatttactgaagtgctgcatctatggatttaacaacatctcccttgaatttccaatgctaataaaaaagtgtttgccttttcacactaacagacaattatcttcactttggaaaattgcttcctctgaatcatgccctgagctgttaagtgtgtcgtctgtaggcactcactggatttaggtttgcaggtgatattaaaatgtcatgtggcaacctggaaaaggcagtggctgcacagcacagtgcaaggacttgcttaccctccggcagatctttgcaggaagatgcaccggagctgttgcctgcagctgaccaccacagctggtgggcctatgtgctggaaaacccaggggtcattccaggcccagctgtaatcttcttagccctgaagagatgcctcttactgtcagcatctctgcttcttttcacacagcaggatacgtcttggagccttacccaagtctgcrctacttctagccagcatttgggaggcaaatggactagctgaggctggagtaaagcagttcctcaccaagttgagggaatcttgttgcatacggccctctagctaggcaagccatcagctgcctacaatttaaggtcctgggagtggccagtaggggcccatccacagaaacttagaggccttggtgaggcttcatttctgtgaccatcttccattccaggggcttgtgagcccagctcagaggtgtcctaatatttgtagtgccctgcctccttctcccttcaggcagtctcgatcagcctgcaggagaccacccttagggacctgttaacacagcaaggctgctcctgtgatccatgtcagtgatatagccatgaagatatcactactcagcagggagcactttccagagaacacagtggcatcaaaatagatttagaaaatgaaaccactctaatataggcagtttgccttagttgaataaaagcgatacaaattaaacctacctactgcaagcaatgacagtaactcagtagtgcttggttttcagagtatctcataaaggggatgcaactacagaccttagttactaataatttcttattatgtttttggtcattcattcatttatgcaacatatatttatggagagcctattaagtgctagacattgtaggagccagggatactgcagggagcaaaagaagctccctgctcttgtggaatttaggttccagtctggggagacagacaataaacaaatgaacatatactgtaaagtcaagtagtgatgagtggtataaataaggaagggctaaaggacagagaatgaggaggtggtgggagggagctgctgtcttaggatgagctcatcattagagtcatgaatccaggcccctcctagagcactggctcctcaaaccaagcctggcagcactggccctggcaagctcctttatccgcccagcaagaccttggcatttcatgtcaagccaagctgaccaaagcttcaagctgtgaacaagccatttggcagttcctcgaacaggtgccacctagtggttgcaatatggagtcgacctgtgtttctgtctcccgtcccactgcctcagaccttacatgcccataattcaagacaagatcttacccaaggggccctggggactagggctgtgatttgacaactgattggtcgcatgttgtttgacacagccctcggagtttattttgtttagatattttccttttttctctgcttggcagagaaaaactagtgaccaagtccaaactcattgatctaggtcatttcaaactatcaacaacgctctgaatctcacatacaaacaccgcatattcatgcattcactgttacggtctaggcaccagggtaggctggatatatagtcctgagtcagaagggaaaaggagttgaaggaatgatgaggacaaaatctactcctcaattataatcttgcatgttttaccactttgtagttccaggagctccctaccacactcccctgccttggattgttctctgatcctacacagtatcctaggactgaaggataattttgggccacaggttgaagttttctgtcttttccctacaaaacgcaaaaagtagaaatacaagcctacctcaaatttgagcttcggtgctggctttgccttattacatgtgtggcagttgaaaaaaattaacagctgctaagcaggaattggaaccaatgccccagagaagacagagcccagtaatgtctgaagcagcatgcacagcagaacagcatggaggtacagagtgtgagcttgtggtgaaccctggccaagcctgctaagtgcggccctctgcagccttgtgggtaacctatcctgtgtgaccacaaattggtcatcagcacacactgtcaatgcagcggtgtgtgtgtgatgcctgatcatgctataaaactgtggacagtgtagcacattggaaccccaatgttacttccaggtgacttggcttgaagaagtcagcttttagcagccacatcaggtacctaaactggagttttaagtaatgcaggtgccaagtataagaggcttgatagggccaggcacggtggctcatgcctgtagtcccagcactttgggatgtcaaggcgggtggatcatttgaggtcaggagttcaagaccaggctggccaacatggtgaaaccctgtatctactagaaatacaaaaattagccgggcggtagtggcgcatgcctgtaatcccagctactcgagaggctgaggcaggagaattgcttgagcctgggaagcagaggttgcggtgagccgagatcgtgccactgcactccagccttggcaacagagtgagatgctgtctcaaaaacaaaaaacaaaacaatttaaaaaaagaggcttgataaaccatcactaaggctccccatgaggaactgggatgactcaaacagcrtcactcacccagtaccccccgggcccagtattcctaatgtacttctctgaaaatgcattatctacatttatcacactgataggtgccttctctaagatttatgattcataatgctcatattctccaagactcccattatgtcctttacggtacctggatttgtatcccagttctgccacttattagctatgtgaccttgtggaagttatttaacttctctgtgcctcagtttcttcatgtggtaaataaagataatgatagtacctacaagatagagctgttttgagaattaaatragttaatacctggaaaactcttgaaacattgcctggcatgtagtaagggcccaataaacgttaactgtcatcctcatcgttacatttcacttcttgagactttagaagttaaacccaagaaacattctttaaaggggttcactctctgctgggtttccccatttcactgagatggaaagttctttagtcacagtttttctagtggggtatgtcctagcaacagaaaaattaaagcttgaagtaggaatgaaaggctatgatgcctgatttgggttctcacacaaggccttccaaacacccgtgtcctcctgagctgggaaggtaaaatgagctcttccaatcgcctgagcttctcttaggtcagggacggcacagacacaagtgcacatacacagcgcagcctctcaatccttcattttttctgagttccaatcctcagcccctggtatgtgaggatcacagtacatctccttgctgagcccagaagcacatgttttccagaactgcctatttctattcgatgtttccagcatggcaacatccaacttcagagtccaagaaggcagtactcaggtctctaggcaggcaaggtcaatgaagacactyactgtggcaaggtgtgaataatttgcatgaaacctgtggtcattgaaacaaagcccctttttgagayatgaggacacaggcctggccaaggtgggtctgaccactgtgcagcatgtgccagggagagtacagaactcaaagtgcaatgtgctaacggagtgtagacagactgaaaagagtgaatttcatttttttaaacatcatgaatgagataggaaaaaagccagtaattatacagcagagaaatcaggcaataccttgaccagatgatcaaaattagcatgtccaataaaggacagatggatatcatgtgcctacagatgtgatagcctgagaagaacgtaccatcacctatactgtactcaagccaaaaatgcatcacctcaatctcaatacaaggaaaatgcagacaaacacaaaatgaagaatgctctattttaaaaaggggagggaagttgaaaaacaacttgcacatcagtgaaattttaaagcttgtgtgcttcaaaagacactattaagaagtgaaaaggtagcccatggaatggtagaaaatgtttgtaaatcatatatctgacaagagactaatagctacaatatgtaaagagttcttacaagtcaataataatgagacaaatcactcaattaaaaatggacagaggaggctgggcatgttggctcacacctgtaatcccagcactttggraggccgaggcaggtggatcatgagatcaggagaccgagaccatcctggctaatacagtgaaaccctgtctctactaaaaatacaaaaaattagccaggcgtggtggtgggcacctgtggtcccagctactcgggaggttgaggcaggagaatgccgtgaacccagggggcggagcttgcagtgagccgaggtcacgccactgcactccagcctaggcgacagagcgagactctgtctcaaaaaaaaaaaaaaaaaaaaaaaagatggacagaggattttaatagacatgtttccaaagaagacaaacaaatgaccaataagcacctgaaaagatgcttaacatcattagtcatcagggaaacacaaatcagaaccataatgagataccatctcaacctcactagcatggctataataaaaaagacagatggtaaaaagtgttgaagaggatgtgaagaaattggaaccctcatacactgctggtggagatgcagaatggtgcagctgctttggagagtagtctgttaattcctcaaaggtcacacgggctaccatgtgacccagcaattctactccaggagatgaataaaaggcacaaaaagatttccacatgagatttcttagcaacattagtcgtaataccttaaaagtggaaacagcttacatatctatcaactaatgtacagctagacaaaatgtggtagatccatacaatggaatattatttggccatagttaaatactgatagatgctacagtatggatgaattttgaaaacactgtgctacgtgaaagaagccagtcacaaaagaccatgcattatatgattccagttacatgaaatgtccagaataggcaaattcatagagacaggaagtggattacaagttagttgtctagggctggagaaattggtaggcaatggggaatgattaatgggtaccaagtttctcttgggacgatgaaatgttctagaagtcattgtggtgatggttgcacagctctctgaatttatttaaaacttgaattgtacacattaagtacaattgtatgaattgggtgaattttatggtatgtgaattatatcacacacagaaaccagtaactaaaaagggttaactggtttttgtgttamccagttaaccctttttaatgacactgacagttttgaattttaacattttgaatgtcaaaaatgtctgtgtcatggaggacaaagaaagctgtggaaatgttccagattaaaggaggctaaagagacatgacaaccaaatacaatacctgctcctagcctggatcctgtactggaggaatgtgttataaatggtcaactgacaaaattggaacatgaatagtagcttagataaaagtattgtatcaatgtaaatttatcaagcttctatctgtattgtggttacataagagaaaaatctctatttttaggaaatatacaatgaagtattagtggtacaggatcataatgtatgagtaatctatcctaaaatcgttcagaaaaaagtgtgtgtgtgtgcatgtgtgtgtgtgtgtgttttgcagggaagcaaatgaaattgaacatttttatgagtcaaaggaagccatcaagaaagtgaaaaggcaactcataaaatgggagaaaaattttgcaagtcatgtgtgacaagagacttgtagctagaatatataaagaactctccatttgtttgtgtcctctcttatttccttgagcagtggcttgtagttctccttgaagaggtccttgaagaggaagaatcaatattgtgaaaatggccatactgcccaaagtaatttatagattcaatgctctccccatcaagcgactattgactttcttcacagaattggaaaaactactttaaatttcatacagaaccaaaaaagagcccacatagccaagacaatcctaagcaaaaagaacgaagctggaggcatcacactacctgacttcaaactatactacaaggctgcagtaacaaaaacagcatggtactgataccaaaacagatatatagaccaatggaacagaacagaggcctcagaaataacaccacacatccacaaccatctgatctttgacaaacctgacaaaaacaagcaatggggaaaggattccctatttaataaacggtgttgggaaaactggctagccataagtggaagtctgaaactggatcccttccttacaccttatacaaaaattaactcaagatggattaaagacttaaacataagacctaaaaccataaaaaccctagaagaaaacctaggcaataccattcaagacacaggcatgggcaaagacttcatgattaaaacaccaaaagcaatggcaacacaagcccaaattgacaattgacatctaattaaactaaagagcttctgcacagcaaaagaaactatcattacagtgaacaggcaacctatagaatgggagaaaatttttgcaatctatccatctgacaaaaggttaatattcagaatctacaaagaacttaaacaaatttacaagaaaaaaacaaccccatcaaaaagtgcgcgaagaatatgaacagacacttctcaaaagaagacatttacgcagccaataaacatatgaaaaaagctcatcatcactggtcattggagaaatgcaaatcaaaaccacaatgagctaccatttcatgccagttagaatggcaatcattaaaaagtcaggaaacaacagatgctggagaggatgtggagaaataggaatgcttttacactgttggtgggagtgtaaattagttcaaccattatggaagacagtgtagcaattcctcaaggaacaagaactagaaataccatttgacccagcaatcccattactgggtgtatacccaaaggattataaatcattctgctataaagacacatacacacgtatgtttattgtggcactgttcacaatagcaaagacttggaaccaacccaaatgcccacaatgatagactggataaagaaaatggggcacatatacactatggaatactatgcagccataaaaaaggatgagttcatgtccttttcagggacatggatgaagctggaaaccatcattctcagcaaactaacacaagaacagaaaaccaaacactgcatgttgtcactcataagtgggagttgaacaatgagaacacatagacactggagtgggggcatcacacactggggcctgttgcagggtagggggctgagggagggatagcattgggagaaatacctaatgtagatgatgggttgatgggtgcagcaaaccacyatggcaagtgtatacctatgtaacaaacctgcatgttctgtacatgtaccccagaacttaaagtattaaaaaaaaagaactctcacaattcaataataagaagacaaagaactcagttaaaaatcggcaaaggatctgaatagacatgtttccaaagaagataaacaaatggccaataagcacctgaaaaacacatggagtaaaatgttagtaacaggtaatctgtgaaaaggatatacaggtgttttttctactattcttatgtttgcaactttttgtaagtttcaaattttttttacaaattaaaagtttttaaataatcctgaatgacttttctctttgggcagtgtagatctgtgcgaaaactggtcagacggaacactatgagtgtgagcgcgtgcacatgtttgcacacctgggagtctacacatgttccacagagcacttcacctctctgctgtcactggcccccagcccctgtggcttgcccagcatgcacaccatcacatctgagcaacatgcttagttaactggggggaaggaggtagagccctcagtgctcctgaggtagacagaagttacccatcagtgtgagccacgctgcaggcattgtcccctttggctggggctgacataaagagataaggagcaggtgggttaggcctatgctttgctgtattctgagagacttgccatcttcagagttcttgtttctatactgcagagtttcccactaggctcagaagggccactctttttctgggttctctacctatgttggagaggggaaggaaagaggaacaggacatatttattgagagcccactttgtgcctttatatattatttcactcaaatgagacagaaccctgcaagatggataaactgaggctcagagagcttcagtaacttggccaaggtcccatagcaagcaaggggtggaaccagattcaaagctaagcctagactcctcacttccccacttccaccagacacacrtccttcagatactggtgtttgttttctttccattatttctcctcttttgctgtctgagttgaggtcaaagcctgttctcatcccgggaaatgaaaccaaatcactggtgactgtaatggatccaaaagacccaggcaactttggaaaacaccagcagggctgccatcagccctgtttcttgaggtcatggtgatgttggcaatcactctgaaggaagaggacagaaatatctcttatctttgctttaactgccaaagcagacacagtttttagagctgggtgccaagtcaggggtaccatgtagccagagatcctggcacacatctggatagctgttcgaagaatcttcctgccaaagggggttggggtagtggtgaggacatctgaggaggaaagggatcctacagctataaggatggggtggtgcatgatgagggtcctaggagtggccattctgacttcagggtatggccaagggcaatatgcatgggtagggagggaatggggaggaaaatttcttggcagtctcccctttatcctctgctcttctcctctactttttaggcctccaagsctcagcactcatcctgtttctcattcttaaaggcctctctgttagctgaagacccaaaagagggttgctaggagaataggttgtaagcctagagtcacaaatagccatcagacaggaagggtctgcctacaggggcatcagctcagaggaaagcagagctgaaacacagtgataatgtcatttgagtctttggatccagccatgcctgaagccctgcacttttaaattaaggggaccaaaaatttgcattttcacataagaaattttcaactgggtatctgtcacttataagaagaataacgtgaatagcattctaacactgaaacagtactggattttctagtatgattttcaagtacaggtcttctataacagccaagggaggatgcagagaactttaggatagagccattgcacatggaaagtccagaatctggagacactgaggagaggaagagagctggccagcccctgcctcagcaggcctctgctctagggatagggtaagatactcaagtctggcttcgtgtctgaagctctgtagggaagcctggagaaaggataggccagccccaattcgagggttctgcaacctacagtttttcctgaagttgttccaggtaatgatggttgctaccttctgctgagcctatgctacatgaccaatgtattacactgtctatcgttttatttctcacagcagccctgagaagtagagatattggcacaattttctagatgaagaactgaaagctcacaatggtgcagtaactaactagtcacatagctagtaagcagcagagcagggattcaaatctagtgtattagactccaaaacctgtgtttttaacaaccatattgtatgttacttcctccaagatgggtcaatgaggcaggggacgttgattggctatatggagaattaataataatcttttctgttggtacagccctagagagtttacaaagcacaattgtatatgcagtctcactacatccattttacagatatggaaactgaggctcagaggtaggaagtgatttactcaaagtcatttgggcaaacaggataaaccacccagagataactctccttaaattaagcaggcagtctgtagtctgcgaatactcataatgtgtggggggaggaaggagctggcctcaccacactgaaccttgagggcagtgatggtatcagtctgtccaaggaaggtctcagacaggtgaggggaccaacaggtattgcagccacagacccaactgcagaacacaaatcccactacaccaaagggctctgaattcacaaaaagattcccagttccagccgggcaccatttatttttcagcaacacttgayatgggcaaattccagttcaactagagagattcagcttcctggtgttcccagggggatctagctctgaaaagagcccctttcttctgtcaggacatcctcagcaaaraaggctgcaggtctgagctgagcagcctggagagtggggattccaactccccccgagagtgtctacctgcctggcttcctccctgaggaaagtcactgtcccagcccaagccctaggggccctcactgttggacctgccctgatgctttgccaaactcagaggcacctctcctagacggacaaggcaaagctgactttcactgttccctgggtgatctgcacctggaggagtgatcaggcagggatccaggtgatgggacagaaggggccagggcagccactgttgttcactgctggaagtgtgccaggggactggaaggtgaacagcaatcccacctgtctcctagagactctgtcctccgtgtgtaggggaaagtaggggatgggcacacagggaggaatccagccctggggcttccttgaagccaagtgagcagccttctgtatttgttttcccacaaacagtctttgaaactggggcaagtgttgaaggcagaacagagtaaaagaagcagcttcatgaggccaaacccagtctctccaggtctaggtagtccagcacaggttctgggagtaaatgccagctttaccacttgatttctttggtacgaccttaactttttgccatcctttcactagtatttattgagaaccctctgcatattagggcatcaatgctaagcaaaaaatgggttcagtcaccttcctggaggttccaatcagtggaggagacaaatattaatccaacaaccagtacccccctacccctacccccacagaaagtgtcaaatgcccaagagatagatagtatataattagagagacttcactctctctggaaggtcagagaaggctttcctaaagaaatgataatggagctgaggtctggaagaagcataggagtttcctgaagagggtaggagggggcactgcacacagagggaacaggacagtcaaargcaggccatttggcaacaggtgactggaaggaactggaagaaggcccatgaggctgaagtacagagtgaatatgcagggtctaggcagaccatgcaagaatgtgggtttctcctaagagcaataggaagccttttgaggtgctcttagcagggaagtgagatgatcacacttatcgtttgagaagattactctggcagcacagtgaacaacgtattggaatggaaccaaggagcattcaggaggccagacagaaggtatcaggtatttgcctgtaaaatgggggtgatgagaatactatcttacaagctgttgccaggatccaatgagatactgcattttaagtgtctagtctagtacctggcacatagtaaaggctcagtaagcgtcgatattgttacttttatcattggttctttgcagagtgcacatatttcttatccaggtctgctcctgcgtgatggggtggagggagtagttgtggtttccagagtgaaaacgtgatttgtgtcaaatcacaatgtcgagaccagaatccaggatgcctgaaggcccgattagaatggcttaaaagtatggattattcaggaagaaaaacgggttccaatcgctcctactaaggacgctggagggatggtgaacgatcctttagatggtaagccctagcacttattgagaaaaacaggtgcttctttggtcggagagcaggtgtagggctcgcagccgcgtgcgctcccgcggaggcgggggaccctcgccactcccccgccccacgcccacccgcgggcttccgactgcacctgctcccccggctcggaaacgcgggccgggtgccgggctgcaggcagagggtgcccgggggaggaggtcccgaaagcctcctccacacgcctgcaccggctgccccctccccagtcacgtggcccggtgggtggggaccgacctgaagttggagaaatccggagcgctcccaacctcggagggagtcgccagtcctccgggcccggacggtggaccctggagccccggctggcggcgtggaggtgcgtttctgagaagccgagcagcggcgcgggcggcgggactcgaggcatggcccggctgtcggtgatccccgggtcggccacggcgtggacaggtgagcaggtacccgcggccagcggcagagatggccggggctgccagggcatcgggccccagagcccacgccagtccaggggatgcggggcccccacgcaggagggggcggttgggtgaaaaggccgcggtggattctcggactgccgggtcagtccccaccagcgccgccgcctcctcgccggctttgccaccgggtgagcaggrgacgcgggacgcgggacgcgggacgcgagggagccgcgcggggcgtggactctgtgccggccccgccccccgcgcgcgcactggctgctccccgcgacgtcacgctcggctataaaaggcgcggctcggggcccttgcggcgctggaggagctcgaggctgaggctgccggggggctgtgggctaccgggccgccggcgcctcagcgatgttttactcagggctcctcactgagggcggccgcaaggagaccgacatgcgggaggcggcgtcactgcgacagcagcgccggatgaagcaggcggtgcagttcatccacaaggactccgccgacctgctgcccctggacggcctcaagaagctgggctcgtccaaggacatggtgagcccccgccgccgttctcgccccggccccggcggcttcgcgcccgccgttttccgaggcccggccgttgcggctttcactgagtcacggcccggcccgccgctgcccttggctcgcggtcgctgcgtcgcggattcctccccttccagtacccctgctgcggtttcggtggggattccgtcgtagcttttctagcttgcgctcccctcggctgtgcctcctccctggatgtctcttctccagtagaaagaagaggtcctgccctgccctcttgccctcgggtcttctttctttttccttattcttaataccgaattttgttcacggggcttgtgcctcctatgctgtgtggctgttcctatgacccagacagaggtgattcctaatggctttccgtgagggggaaagaagtggaaagagggttttttgacagttgccggatccagaggacttttgttgaatccattgtccccctatgcaaaacccacttctctagttttggtcctaactttgaccttccatcctgagtggggagagagaaaaggggccaaatgtgaaggtttcctgaacccccaacatctcttcatcattctcctcttccagccccgcccccaaggagtgggtagagggaggaagccaggctgctgcatctcaccgaccagctaatgtgtgcatctggagctggggtgggtgcagtctttttttctagcacagttgttcctggcattaagtagaagcacctcaggacagggggcctggggtcaaagatggtactgtcctctttctatagaatgggatggatggctaagggttaccaatataaagaactgtatttgtcatccctcrgccactgtagtggtcctgggccaagtttatgtttaactttgtagttttatctggagttttcttgtagtttgattgttttcttgaatttcacaatcgctttattcatttgggtggtaatatgtgaaacactaattaaatgtcttttaacaaatgaaataggtgctctgcataatttttctagtattttttattttaagcttttgaaatatttaattttggatgtggttgtcggccctagttcactgaaattgccatttctggccccaggagggcagagcttctgcatccatttcctttttttttttttttttttttaatttaacagctctaatgatacacaggtacattatattatacacagtataatataatatacaaaaattatacacagtataatttttctcctccctgccattagttacttctgtgcagagtttgtctacttcagttatcttgctctgttttttttacaagttgtgtttttttgttttgttttgctttttgcacaacccacaggatagtttatctgatttatgctaacccagagtgataagtgattgaaatgtgctcctgcaaaagagataactctcttttcccttctttcactttaaagcaatctcgattcatttaacaaatcaggttcgagaagtattctttccttcaggccaaataatcctatcctagttcctagaatgctcagcaatcaataaagaaggaagtattatattaagagaagaattaaaatacagagtttttaaatgctggatttggttgtccctcgttgtcgaggagtttcctagccctgagagctacctgaacttccttctgcctaggatttcttatactacttcatgctgtgtaagaattccatccgcttttctgactctagtctgtctcagttgagtcacaaagggctgatagcatacagcacaggcagcaggctgcaaagaggaaggagcctcaagaagcaggatattgccttgagtatgacacatacacatgacagttgactgtaaggctctgaatcatggttcacgctttctgtgccccaccgtcatggagttgatttccctctctcactgttttcacacctataatgtacaagtgattgcacagaacagccaggttacagaaaccaaggcagaccgaggtagggctaggagagccgcaagcgctggggtgaggcagcatgcttaaactctcttggaactgttrttgcagccttagtacaatcttagaagtgaccttagaagtacattattattcttttactttataaatacatgtgggatagaccagtgttgactcaattttctctcactgcaagggaaatttggaggatgttaaaattaattgaatagttcttacttggagtagtttatagtataatctcgatagaaggagtccaagaaaagggagaggatagcatcagagggagataaggaagagagaggagaaattagttgttattgacttttgggtttgtgaagattgtaggttgtttttcctcataccagcaacctatatttgaatataccgctgggatttctgaattatctacctcttactatgctgtttctgtaatgttcactgcttgataccagcctgccagctcttttaggactggcagaaggcaaccataggaaatcaaagggggtcatgttctcttggccccaggaaagtgcctttgcctattcctgtgtatctggagttggctgatacaaagtcttctgtggaaattatatttttgtctgccccttttgcttttatccttttatcttgtattgttcattctgtattagattaagaactaaaaccagagatatgagtgagtaatattatatttgattttttttttaagagacgggttctcactctattgcccaggctggaatgcagctgcagtcacatcttactgcagcctcgacctcgcaggctcaagagatcctcccacctcaacctcctgagtagctaggattacaggtgcacaccacaacaccaatctaacttttgtattttttgtagagatgggattttgccatattgcccaggctggtcttgaactcctggtctcaagcgatctgcccactttagcctcccaaagtgctgggattacaaacatgagctaccacacccagccctgatttttttttttaactcagtgaagctggagaaaaacatctccgttcttggaaatttgcctattgtaatttatcttgttttagctaccaggttcataaaagtttttctcattgtgctaaggactttttaatttttaaaaacagtcatgttatgtggtaatatgctgtctttcctaaatgatattatacttacctgtaggcattaggccatattcttacttgtctggcaatagagtttttctttcctacatatgattgcttctgatcatagctaaatgctttttcaaaactgactagaattaggaatgatgctgggggaaagatggttgaacacagtaaagcaaacttaccataaaatacctgaacagaatctctgtctattagagcaggtctgtgtggtgtgccctatagattagctatccatatcaccacaaatcatgggctggagaatttcagaggcttagaaragaagcgtgaaataccagtataacaccaagatctggcacaaactgaagatttgcagagtcgtgattgcatcctcgtaatagcaaacattatttgaatacttgctgtgttcaggacacagtctaggggctaagacacaaataggaagacagaaaagtttctcattataaacaggtttataggttgggggcagggaaggacagatcagttaatttaatatacaaatatttattgagtacctactacacatgtcatgcaataatttaagctttggagatataatagtgaaccaaaactgagttyctgccttgacggaactttcattcttgtgggaggaaggaggcagaaagtaaaattaagtaaatgtatataaggtaataataataaatattttctatggagaaaataaatcagggtaaggggaatagggaaggcagtgactggggtggggtggagtctggctattttgtacagggttgtccggcaaggcctatctgataagattacatttgaggagatactgaagggaattaaggagcaaagtttctcagggaagagtgttctaggcagaaggaacagcaagtgcaaaggactgaggtgtcactgtgcttgatataactgaagaactgtaagaggaccagtgtagctagatcaaaatgagcaagggggagggtgatagaagataacatcagagatgtagtaggaggccattgtgcaggcatttgggtggttttttaaaattattattttttttattttccactcttttcagcgcatacctatgcatttgggttttaacctgagattggaaacgagtggaatattttgagcagaggggtgatatgatacatacaacttattttacaaaaagactactcaggctactatgtgggttacactgtaaaggggcaagagtagatgaagcaggaagactgattaggaagctattatacagtaattgaagtgagaggtgatggtacctcagagcagtgtgataagctgtgaaggagaggaggaaggatcaggttctggatatatgttgaaggcagagctgacaaatgtaattgatgcattggattaagagtgaaagagtaatcaaggaagaccatgaggtttttaacttagccattggaagaacagaattatcacttgctgaagtggataagacttgcagcggggagcaggttgaggatggcaaataagaatgaagagtttgcgggctgggcgcactggctcatgcctgtaatcccagcagtttgggaggccgaggcgggcaggtcacgaggttaggagatcaagaccatcctggcaaacacggtgaaaccccatctctactaaaaaatacaaaaaattagccaggcctggtggcgggcacctgtagtcccagctactcgggaaactcgggaggctgaggcaggagaatggtgtgaacccaggaggcggagcttgcagtgagccgagatcgtgccaatgcactccagcctggacgacagagcgagactctgtctcaaaaaaaaaaaaaaaaaaaaaaaaaaatgaagagtttgatttttgaacaagtttagggtcccaattagttacttaaatgtagatgctgaatagacaattctagaagaagataagtaacaccaccagaaagcctgtgctagttgccaagatgtaatagtcagatgtgccagaggagtccagcggaagaagtgatttctctaacctgatgtgatgataaggatggagactggcatctatttacacctttaccattccctttgagccagctgactgtgagatggtatggagagaaggctgcctctagagtgtgctttgtagaacctcagagtaggaagaattttacaggttatctggtctaattccttgcccatttgtgaatcctttctaacaaaatgcagcctccgtgagcagctgagaaaccattatctcagactaatccacaaaacagataataatgaggaataggttgtttgttgggtcatgagcaaaggcaaagaaatagaacacagaaggcctggggcagtgtaacagcctgccttatgtttttgagcaactgcaaactgaagaacaatctgtgtttccatggggtagaatgggtcacgtgttatatactcagctagtaagcaaagagaaggcacaaatattggtgaccttttggatttccaaggtcagagatagagacatgtatactgggcttgactcaggagtccatgtttatctatagactgtatatgaggactaaaatggagtagaatgatttcaggcccttttggggtaaaagaaaaagtgaatggtatccatgacccttgttctaactaagctctagttgtggctctgttgctagctagtgaccttggatttctctcttgggaataaatgctacaaagaaagcagacccctaccatttcctctgttttctagtttggttcattctgtggaccacagaaatccattagtttctgtctgggtagcttgggtaaagggattgagagagtggctttaaagttcttgctcaaattatgattctatggtatcctgcactatagtctgattcctctcacctctcttttcttcaaactctatagtttggttagaagagatgtttaagcagtgtgggtgccagattgaggaactgtagctattttcacccagaatacagcacttcccaaagcatttcctttagaagctcttgatggcgatggaggcagaatatttgaacttgcctggttagagtttagatgcctctagcagccacatttcaggaagagtagagaagcagggactgcttaggttagtagctgccttgttgaagtttagcataaagcagaatccacgtcagaaagacgacttaaaaattatgtctaaatggccaccagggtatctgcagcatccatctagcaaattagtactgtgtatccttttttctttctttctttttttttttttttttttgagacggagtctcgctctctcaccaggctggagtgcagtggtgcgatccgcctcccgggttcaagcgattctgcctcagcctccccagtagctgggattacagacacccaccaccacacctggctaatttttgtatttttagtagagacagggtttcaccacattggccaggatggtcttgatctcctgacttcgtgatccacctgcctcggcctcccaaagtgttgggattacaggcatgagccactgtgcctggcctccttttttctttttttgagacagagtctcactctgtcacccaggctaaagtgcagtgtcgtgatcatagctcactgcagccttgaactcctggcttcaagtgatcctcccacctcagctcccaaatagctgggactacaggcgtgtgccatcatgcccagctaatttttaaatttttaaaatttttaattaaaaaaaattgtttttgtagagacacaatttcactgtgttgctaggttggtctcaaagtcctggcctcaagcattcctgcctcagcctcccaaagtgctgggattataggcaagagccagtgcacctggtcagtactgtgtatcttgaaagacaggacagcccttggaaagccaatatgtcaataaacaaatgagaaccacttaaccatatttataaaacagtcatagactggggatacaaatagtagaaactctttaatatacaagtattgaagggattctgaaagaaagaattcaatgatattaatcaagaaaggctttttggctgggtgtgatggcccacacctgtaatcccagcactttgggaggccaaggcaagtggatcacctgaggtcaggagtttgagaccagcccggccaacatggtgaaacctcatctccactaaaaaggcaaaaattagctgggtatgctgctacgcacctgtagtccagctactggagaggctgaggtgagagaattgcttgaacccaggaggtggagatttcagcaagccaagattgcgccactgcactccagcctgggagacagagtgagactccatctcaaaaaaaaaaaaaaaaaaaaaaggaaaaaaaggctttttgaagaaagaaggggtagagatttctttcagtactatgtcaagagctgaggatatagctgaaatcaagacagtcatggtccctgcccttgtgcagttaacatgctggtagggcaggggtgaaatataaacaagtaaatacacaaaataatttcatattgataattactatgaaagaaatagtgagatttgttagtaactaaaaaggtgacctacctactttaagttgtatggtcaaggamggtatctctgaggaaatgacatttgaacagagacctggaagataagagggacctaactattagaaatgttaggggaagaacatttcaggcagaggggacagccrgtgcaaagggattggaatgggaaagaaattttgagcaaggaagtgagtgtggatggtgttgaatctgaatgaataaagggagagtggtttgtatatggaaggagaggcaagggccagttggtacagagctgtatagagaagggtaaaaagtttggattttttctgaagaacaatgggaagccattgaagggttttgagtaaagtactgtattacctgacttatgttttaaaaagcttactctggtttccatgcaaagaatggactggagaagggtaaaagaagaggcagaatgcaagttaggaggctgtgacagtacagataagaaattatagtggtttggattagattggaggtagtaaagatggggagaagcagatcaattccaggtgtgtttcagagtacaatatcacttttgatgggaggtcaggaaatgaaaaaatcaagaatggatgtatggtggtgccacttaccaaggttgttggaaaggaattaacccaatatgttaaaactgaacaagtctttggagctcaaacctcctttatgactgatcaagagagtaaggtttggagaaaagtaatgctcatagaggttagtgatttgcccaagctaatatgtgacaagtggtaatttgctgaaagcagaaagccttcatggagtagtaattaaaaagatgagattgggaaggaggatgaatggtagtggaaggtcttgaatgytaaattgaggatttttctttgttacaactagcaagagaaccactgtgggggaagaggaccatgaaagtaatgttaggagattgggcttagcagtaacgtaaatgaagaagaaaataagaggaggcagaatttcacccaccgagatagggaataagggagaatgcgcaagtytgatagaaaatatcagtgggataatttacatttgaagtgcctgtggaatatctaagtagagaagttgaaaaaggcagttggatctatgggtctagaattgaggtgacatctggacatgagatagagtcatcatcataaaggtagtaatttatgcaatgaaaacagataaaattgccctgggagtatatgtagagtgacaaaggaccaaagatagagcgatgaggaacactaacatttaagaaatgaacataggcaaaggaaccagtgagagagacaggaacagaataaacaggtggttttagaggccagtggaggagcgtttcaggataaatgaaatgttgagtttattgcagcattgtttctaatggcaaacatatgaaaataatctaaatgcccattagtaaatagttaaggtatgcttataccacaaacttgtctgtcaaggatgtgctgttttaaaatgcagaaagtagggcagacataagaaaatagatgctaagctggttataagataacctggcattatacctgcctaagttacattgtgtgtgtgcacatgctttagtttttgcatctggcagacactgttagttggctaaattatcacccatccttagcccttttctttatgctgaactcctctatagagattataaaagctaaattctctcccaatgtctgttagagctaggagtggccatatgagttctgaccaagaagatatgggcaaaaaactgctgaaggaacttctgggaaagcttttccttttctgataaaagcaattgatggtgttagtgtagtccctcctccttcctcatttcttgaatgtggatataatgcctggagctggggtattcatctgtgaccatgaaggaatgtccaagagaattaacagagtcaatagccctgaagttgttaagctgctgagttagtatcagcagcttctatgtctagacttcttgttatgtgagaaaaataaatctccatttaaactacggtaagttggcttttcttgtggctgaactcttttctgctacatggggtatatttttatttaaaatttttaaaaatgtaaataatttaaaacttttaaaaatttaaagctgttgcttgtgttagggatctccatatctccaagtaaatggtgatactgctatttcttaattaactgtyttcatcactatctatctagtcttactttttttttttttttttttgaggcagggtctcgctttgttgcccaggctggagtgcagtggtgtgatcttggctcactaccacctccaccttctaggctcaaattagtctcctacctcagcctcccaggtagctggggctacaggcgtgcactaccatgcctggctaatttttgtattttttgtagaggcagaatttcaccatgttgcccagtctggtcttgaactcctgggctcaagcaatccgcccrccttggcctcccaaagtgctgggattacaggtgtaagccaccgcacccagccctgattttctattataatggataaaaacttaattctcttacaccttcccatcatattcactcttctattatactaacattctgttaaataactattttgggtcaaataagcatttattgcttacattattatgactatgttcttgttatttacagctgagtcaaatgtactatttcttttctcataaaaacatttttctcaaaattaataatttccttggtgtttaaaaaaagtttccatgtaaaatttaattctccttcaagtaacttaaaactatagatggtctagcaagtccattgttttcttggaggatccttcctagagccccctatcttttcatttcattttggactggctgcttttaaggcctgtaggcaacctgtatcctggacttttccttcaacaccattcttagaactgcctttgcctctctattggattctttcattcttagatctcatgtttttctccttgttgtttgtttcccttgctttggtgaagcatgcatatctttcagtagcttcttgagaagacacaggaaataactttcttgagtcttgattgatagtttgactaggtttacaaattatgtactatcaaattttttttttttttgagacggagtctcgctgtgtcacccaggctggagtgcagtggcacaatctcagctcaatgccacctccacggtgagttccagtgattctcctgcctcagcctcctgagtagctgggataacaggcacccaccaccacgcccggctaatttttgtatttttagtagagatgggatttcaccatgttggcttggccaggctggtctcgaactcctgatctcgtgatccgcccacctcagcctcccaaagtgctgggattacagacgtgagccactgcgcccggccccagatttttgaaggcattattctattgtcttttagctttgactgttactgttgaatagtcctctactattctgattcctaatcctttgtattttgatcatctttttctctttggaatcttgtggaatctttgtcatcaatgctattccaaaatttcacagtgatgtgaaatcttgatgtggatcttttttccttcattatggtaggctccatgtgggccctttcaatctttaaactcatgtccttcagttctggcttagtatgataacccacactacccttcagctgttctcgaaatctgaaagcctagccaagctatcaactaatcagtctttttatttactcttacaagaagagtaaacttttggcattctcctcagttctccagatcaagtgagtctcatgaagactttagtctatttccaaccctaattgcatccttcaactgtagaggttctgatacctgtaactcctcagccttttaattttagtttgagtagtacaactgcttttacagctagatgcaaatatataacrgctcaaacaaaatagtttattttttcttaagtaacagtattagtggaaaagtcagcaagacagcctcttccatatagtcctttagagactcaaactaacagtagctcttctgtcttcaacatgtggcctctgagaaggtaaccatagtggtcatctccactccagccagtcagaagaggaaaagaatatagagaagtatgcacaggagatttttatgggccaggcatagaaatggtgcatgtcacttccactcacattctattctgtagaactcagtcatatggctatgcctaactacaaagagggctaggaaacagtctaggtatcttctcatgaggaagaggagaattttaaagaggattttaaagagcaactggcagcctctgctgcttcagctctctgtgaagtgaaatggtataaagcacttagctttctctagtccaggtcattaattgctgcttttctgcctgctattcagattccagaattttgtcaacatcttttttttcttctttattgttctttttgttttgtgggtttaggacttattcttttactgtcattttagtgaaattttggctgaaagcagaggtaaatatgcagctatattgttacttaagatatagtatatgtaggyataataaaatgaccagagaaaaacatctctgaggttcatatgggtttgttggctgtaaattttctattcctgaactatattatgagtactttttaattatcaaagagaatgaaaagaattatgtatattgacatagaaaatgcctttttgttttgagacggagtcttgctctgttgcctgggctggagtgcagtggcgcgatctcggctcaatgcaagctctgcctcccgggttcatgccattctcctgcctcagcctcccaagtagctgggactacaggcgcccaccaccacacctggctaattttttgtatttttagtagagacggggtttcactgtgttagccagaatggtctccatctcctgacctcgtgatccacccgccttggcctcccaaagtgctgggattacaggtgtgagccaccgcacctggacagaaaatgcttttatatattaaatgaaaatagaaaatttcagaacagttttatagtatgattagtcttttatatgtttataaatgtattaatattttttgaaagatatatttctaaatttaatggtcattatttgttgggagtgggactgagaagggcttgagagattggggaggtttttgcttttaattttatttatttatgtatttgttcatttatttattgttttgagataaagtcttgctctgttgcccaggctggagtgcagtggtgcgatctaggctcactgcaacctcggcctcctgggttcaagcaattctcctgtctcaccctctctagtagctgggattaaaggtgcatgccaccatgcctggccaatttttgtattttttcttttagtagagacagggttttgccatgttggacaggctggtctcgaactcctgagctcaagagatccgcctgcctcggccttccaaagtgttgggattacaggtgtgagccaccgtgcctggcctttgctttttattttatatatttcagtgatacttaagtattttacattgagcatgtgtttgaaccttttttggttactaaagaacaagtaaaggaatagtcagcagggccaaatgcactagaaaagtctggtaaaattaaggctgaaaatgtctattgtatttggaaatcagaggtaattattggtatgggataagaagtgatctcagtgaagaaaatatgggatatcagaaaatagatgtcatggtttagtctttttttaaaaagaccattccagataaggagggtgattaaaggaggctgtagagtaaaggcagcaggatctgacattttgtggaggagtttgctccccaatatctaggaacttttagtatgttttataacttttggaagaagaatccagtagaaagaggaaaatacagaaaagggatgaattcaagcataatgatttcagaacttccctcgtttgtctcatctgtccactaatgattaggttcctttgcaagattaagaactagataaagtgtttagcaagaccaatgtaggaagacatccccaaactttaggtaagagggctttgtttaggtggtctttgaaactccttccaatcttcacttctacaagtccagttttatctgagttggtcctggtaagcatggatgtaacagaaacaaacaccctgctttagtatggcttgagctaggaatccattcttattggtgagagagattcgaatgaaacattttcatttcttttgagaagcaaagcattatcccagtgttgcatcacaaaatctgacagagttagcacttcctctagctcctagtcaagctaagaagctctcattttctttacaagtgcctctccctccacttttcccaaagataccagtttagaatgtgctttgccaagaatcagtgtattttgggaatccatttcttcatctcactagggttacaatgagtcatggctgtgactgcattcttccttaggaatctgaaaggtggcagatacactgaagacctccagtgccagcccctccccttgaaaggttctaggctctgggcttctaagagtgacttccttccccatagaatgaaagtgtcatctggtatatgttagatagaaacttggggtgaaacactctcctttgagggattttaggttaaacactctcctttgagggattttaaatggtattgtagccgggacataagatatttgtgtatacaratttctccagtcaaaggatttcttttcaagagatatcttaaactttctggaggccactttgaatagaaacagtggagcatgrttatatctgccctaggaactctcctaagctctatcaaagtgtagacttaaactcacacttctcattctgcttcttaayattaggcatcctggcatgcatataaggtctaattaagtcccctgcttcttggtcagtgtctttccccttcatacctccactttttgggccattgaagggaagggaaatggatgacaagatagggcaggagaaaccagtgttttgaggaccaggggatgccarcatcgatgattcttgtgtgttckctcaggtttcaaagtgtgtctgctgagaggcttgctcagcaagtgtgaattcctgtcttttcaccctatccacccatgggtgactcagtccacaggacagccagccactaaggcttctgcaggctgcatctgaaagataagagagtgagacttgacacagaagtaggcagagcttctgaatacctgtgttagctaagtttcttcagcctatgaaaatgagctgccctttctataaggcagtgatttgctgtcacctaggaagatacagagattacttactctagactaagaccacttttcccttgaaatgctcttgtaaggggaagaaaggtagcaggcctaggttagtccaaatcacaagggttctcagttctcttaagccctagaatatttatcggccctctccacatttcccagtgtcatatcttgcattttcattcattcagggtggcctactgcaaattggtttatggtacctgctctgacaataccagtgaagtcctcacttgaaggaagtataaataagaakcaaagatagagctcagttatgggaggctccttcattatttttatggcacctgggggacaatgggaaagagggatgtggcctgtcactaagaagtctctgctttctatccctcaagcaacctcataatattctgcagaggcgcctcatggaaaccaacctgtctaagckccgaagcggtccccgtgtcccttgggcctctaagacgaacaaactcaatcaggctaagtctgaggggctaaagaagtctgaggaggatgacatgattttggtttcttgccaggtaatgttctgagaacagcttttccagggttttctggaaagtaggatgtggggccctctcctcctgactttatagagtgtgggtctcatggaattcataagtgagttttaaaaggggcactccatgcaacactggaagtgtatgcaacattttgtaagcatgtgcatctttatgggaagaaggaacaaagctttcatcagatttacaaatgggtatgtgatttttttaaaaaagattaagagctatttggtgtatagcatgaaacacctagagtttttgggggatcttctgtcagctctggattcagcaggaacaagagccagtcaaaggcagacttagcagtgggtaaagatgggacactataacccataattgggaggatgctctccaaccctgcctttcatatgacatctgctgcttgctgtctgcatctcctttccctttcgcttctctggctcttattgaacagtacatttcctccccacagtgtgctggaaaggatgtgaaagccttggttgacacaggctgcctatataatctcatctctttggcctgtgtggacagattggggtaagtaggcacttgtgctgagtggaacttagatgtgactgtactcttcgcttgactctattttatggttagagatggtgagggtctctacagcagctcaaagagaagtatgcagagttcagatctcagctggaaccagaatccttagtagaggggaggagtagtgggttatccggcaagtgggagaaatcagtgagcagggaaacctttggctttctgttaactccccctattaagttttgagcaaagacctctaaacttgaatgagagagcctgagacctctggctcattgtgtgccctgccctgatccactagatagcaaattaaaaggagctgtcctgttggtatactccatccagatgagtaaaagtagggatgtggtggggcttagcttactcagagtctttctggaggatgcattgcaggtccccaagaaacatccatcagaactgagaataggactgcagctgctactgggcctgggccatcataagggtaattagccagtagtttcttttgtttgttttgtgtggcggagcctcactgtgttgcccaggctggagtgcagtggtgcaatctcagctcactgcaacctccgcctcctgggctcaagtgatcctcctgcctcagcctcccgagtaactgggactacgtgtgcgccactatgcctagctaattttttgtattttttgtagagagggggttttgccatgttgcccaggatggttttcaactcctgggctcaagcaatctgcccgcttcagcctcccaaagtgctagcattacaggcgtgagccactgcacccagccctgagcttttgtgtggtaaaaatatgaagtatagtgcaacatgatggttccagaaagactaacaatgtcctggtgcataattaggcagcagactgccatgattccagaggaattaataaccatctgtaaaactgcaattatttttcttttggatgggctataacaccaaaagagaggaaatagag

SEQ ID NO: 10913 - DNA, 40000 bp, Homo sapiens
  misc_feature (1)...(40000): n = A,T,C or G, or insertion/deletion polymorphism (see Tables 1-2)
ttgctcagttttacccttcaattcaaaaagcctgtgctctgtatcttagcctctcagaggccacaccagattcttgtacggtctgctcagcctcctcaaactgctgtgacaacagccctggattctcggatacactgacacatgtttctaaccctcaatcctgccaccctctgcttttgctcctcctgctgagaattcccaagggaagagctctgagatcttgaccctcttcaatcccagttcaacacaacatccctttggttaatttctgagaaaatatcccaagtggttatttcagatagttttcttggacttactgcttctgtcttgagttctgaaagtctgcgtatctgtgccctcctgtgtaggctgggagcttcttgagggcctggcttctttctttttgccctggcacccagcatagtgcctggtgcatgtgaatgataaatcacgcgtgtcgaatgcatgagtcagtgggggaatgaatggaaaagcactgcttggacagcacaaatacaaaaacggatctacagactacataaccaaaagacttctctacacacacatcctgagcaccaaggaaacttctgtttgggctgctgaccatgaaatctactctgcttagttgctgtgttcatcttcgtcctccagtctggactctcagtctccctgacccagaactcctcggccccagctctgctcagcccgacctggaccctcggcaacctggtccgtttcctgtctgatgttctttaacatcacccactaccactcttggccaactctggaggtagggggaggagaggaagatcttcttctgccttgcggcatgtcccggcataacagaaagtcattcttatatgctcatctaggcatttagacttcttccaagattgggtggtgcttccattctcataaacgacccacatttgcaaccttggagtcatcgttgaagcccccttcttgtccatgcccttaaacaggtcagattctgagtcgtatcagccccttctttgaaatgtctcatctgctccttctctgctgccatcctggtccagttgctcagaattgggttatcttactggcctgttggcagccttaatcctatccccgccttgttccagggtcagctgcctgacttgccactgtcatcatgggccacactgaattcttggcccctccctgtgcatgagtttctgggcccctggaagtttcatcttatcctatttacttcccatcacgtagacagtccttcatgcttcccaaaatataggatgctaatttctgtctctttgtcccaccgctcatgtccctcctctcaggtctcacttgagtctgtcttctccatgaaaacttccttttccctttcactcccctctgtaaccaccatgcacccctaatccaaatcctaccgctccacacctgcatgcgtactatcttacactgggttcataattgagtgtgcattagcttgaaattgccaaataggctcataagttctttgggaacagaatgtgaatcttaacttgtgtttctcgcggtacctgctggagagaagaacttacatattattatgcttgggttcatgattgactaacctttgctgaagaaaattggggaaagtgttagttcacaaacattatacatattttgcttgggaaaaatgagggcttgcaatggggattttgttgacattggctgctgctgctactttcatttctgctttttcyttctycttctctttctccttttccttcgtgttaatcaaatctctctctctctctccagtccttttgctgtaggctataagactgttggatcataataacaatctaaaatctccagtaccacacacgtaggaggcacacaataaatgtttgtcaaatgacttaatccatgaaatattttatatctagaatccttaaaatcccatagcagtggctgggcgtggggttcacgcctgtaatccgagcactttgggaggccaagggcgagcagatcacgaggtcagaagttcgagaccagcccggtcaacatggtaaaactccgtctctactaaagatacaaaaaattagctgggcatcatggcatgtgcctgtaatcccagctactcaggaggctgaggcaggagaatcgcttgaacctgggaggtggaggttgcagtgagccgagattgtgccactgcactccagcctgggcaacagggtgagactgtctcaaaaaaaaaaaaaagaaaaagaaaaatcccatagtggttaagccaaatacctcctttgtttttaattcctaaacccagagctttcaatgtttgagtatcctaagcactacatccatttctatgtgtttctctattcgctcctctttcttccacttctattctgctctatccaattttctgctatcctcttaacagtgattatttggctttcaaaacatcctctcatgaaataaagttccatgattattaattgcaattgttggacattatcatatttgctatagcaagagataatccatgaagattaatcagtgtgaaatgtgcaatttatgaaatgacctttatataccctaaggaaaaaaaattaacacattaatagagatgagtttgctggtgcatttgttactagactctccaaaggtgatcatacatatttctagaaatcaccttgccttcggaattggagccccagattcaaggtatgtgtggtctctcatgtttcccctaaaccacactgtattgaatttgaataatcaacctgcatgtataacggggctgtcaatgagagttaattaataatgtcacatggcaggacattgcatgttgttgaatcacactgctacctgccacagtagaactgagggacctatgtgagtgccccttgagaaaacctaaataaaaatcaggaagaggaaatagaaatattccattgactatttaggtccatgcatagatagtatgtattttaaaactaaataatttatgttttctttgtgatagcgattccacattttattcagcatagcaatcatgacaattgattcataaaagcaacattgcccaatcaatggactagaaatacagtcactgtgaatataaattctttcctcttctaacgatcccaagctaatcatttcagctcttctggctcgttttcctgattaaaccaggagaataaagacaacagtaacatgtgactcctacattagcaagctaagcatgaagaatgagtataaacccgtctgtaagcaaaggggtttgggggatttgtataatccattccatggcacgtcttaactaatattccctgtactgataaggccaaaaaaaaaaatgtaactctcaaatagcaaaaagaagaaaatgggattagagttagatcagcttcactttataactatawataatttaaagcaagtcgctcggctttgcctcagttttctgttctgtaaaagtgtttcttagaggcggttatgaggattaaatgacccgacagaggcaaaacagctttgtaaaccataaatcattttgttcggagtcaacaggatgactttttcccctcacacaatttagaattatgtacctgttgaggtagcaacgccctcgtttaatcccagccatgtttggtccccaaatgcctctctcactcgcccagagtgatactgaggccacaaaaagctctgctgttttttttttctcgtggtctttctcaattccaacgtggtacacaggtacctggcgtgtgtctgctcagacagtggatggcccttgttcaaagactgatgggaacacctagtgtacgaggtggcgccggggccgcccacaccaacaggccgtgtgctcccatctcactgtgcacgaggaaccggtgtgcttttcggccaggctgcatcaccctccctcccttggctttctgtgtgacgtgcctgtgccagagactgcagtggcagcacagtaaagagggaagaggcctagacagagggcggggtggaggaggcattttacaacttgctaagatgtgtcttcccacctcagttgttggttttttaaacaaaaacaaactacagatcaaaaatctcaaagaaccccctcttctgggctgccccaacttgtctctaagccaccttcttccttcattctttgtccctgccaagccactaatcagaacagcgtgaatcatgcacctcagctctgggtggctcccagcaacatcccagatcccgcagttgtaaagccagctgctaggagtttaatcctgttgaggtgagcactccctgtgtcagagggaggggcaaacagatcagggacaaggacatctgaagtgagcacatgtccaccagccacgaccccactctgccatgctgtactgatactgccctgatatccacacagggaacacccttctttccaggcagccctgctttggaggctgatgtggagtactaagtttatctcccaatatccaggccattcctcagccactgtgcagcaaccatttattgtggtgggactgatcctactcccaattgcagggaaagactcctaactagatgccagtcagggcaatcccatgcctttgccctgggattggttagggcatgggcagacctgagccaatcagagcagagcttttccttgcccacgatgatgatgtcgggactgagccaatcagagggaagcttgggacttgttctaaaaggaatgctctgccctctttcctcttggatgtgaaagagaaagtgcatcatcctgtaagcaggagggaagcctgcctgaagatagtatcaacatagtgaaggtacagacacgagaatcagagagagaagatgcttaaaccttaagcaagtcagacctagggtctacctgactgtagattttattagttcccmgagccattaagttccctttatagtttaagcctatttgagtaggattttctgtgatttttgcccttgaaagcatcgcaactggtagaggygtcattgtctggggatggaaaaggaaacttggaaagtggccatgatggttaatgtcatgtgtcagcttggctaggctatggtgcccagttggccaaacaccagtcgagatgttgccttgaaagtattttaaaatgtaatatttagatcagtagacttcaagtaaagcaaattaccctccataatgtagatggacctcatccaatcagctgaggacctttaaaacaaagactgaggtttcctgaagaagaaggaaygggacctcaagtttacagcataaatgtcttgcttaagtttctagcctgcagattttcagactgaagactgcagcatgaactccacaacaaaattccagcatgctggcctgctctacagatgttagactttccagtctccacaatcacatcagccaattccttaaaatcggtctctstctttctctatcctattggttctgtatattagtcaggctctggagagccctgacttatacagtggcaccaaacttgtttactaggaagggacaggcactggttcaactgatttggtggcaaaatctgatttgggagatgatgggctgggatgaggtgcagcaacctaagctccaagagtctcagacacagtccagaaagtggttggcatcatggagcccaagatgaagtagcagagactcaacaggaagccatagtatggtgacagggaaactggacagaacaccatcccctaggagatgctgggaagaaaacaaggcaagcagcagagtcctcttcgctgtactggggcttatggtagatctccagtcctagaagagacctaaggatgtggggaccgggcaaccaaatagagcctaggcataggccaaggcacagtcctgtcccatggacttgcccgacatgggtccagagagagaagaagtagctaagaggtgtgatctaggggcctggagccacctagaagcctttcctaaggacagtagccctggggcttggcagggaaggaaacccagggagccacaagggaactcagagctacaagatgatcttgggactggaagaggtccctcaaaagtccacttcatgcttgggttagcctggggactggggcggatgtgagccttcatggtgggacctgggagcccaaagcaaaggagtttcagtgtctcttcctctacgaacccgtcccccttgctacctcacttctggcagagtgactatatcttccctatgcccccatggtgtcttataaacgcatttattatggctcaaggaagacaaagcaggtaggccatagctcccatcttagcaatcttacattgagtcttgaccacacattgaaatgagacactcatttgtataggcccccaattagtagcagaggtatttcaaatctcttgtcagatatgcccaaaggaaccagcctccttctgtttctatattcagactttgtctctggtggcctttctatggggactaaagtaaagggcagcaggtcttcccagccttgctaggaggaaggctgtggtctcttctggtgcctttgacctcctggctcccactgtggacctcatggcaaacttgagcagagcatttctgcaaggcagtgcagaaacgtgacccagtgacttataactgcacaaaagccatgagaaccagctcacagaaaaggcggcatcctcaggacgagcttaggattcggaagaactgtgttggatacatatctcaggtggtcagagaagagttcatcagtcatcttgatatttgtaaaaatgttgtgtaagaaaagcaggttcccaacttcatcactaaagcaaagctcgcgtagaaaatcccaagttagacaataaaagtcagcatttttatgttacttaagagttcgcagagcgttttcatgctcataattctataatataagcattagcgttccctccatagctagggtgtgatgagtgatatatacatttagttaatttagcataaaactgaccttagccctggctgccagggagagacggaaccaaaactaaagcagccttcgaatcctccaaaccaacctctctctgactcctagaacatggcgccctttcttgcttctcttccccgtagccaaaaagggaccagagctccccacagtggggcttgtaggagcctgaacagagcagaggcacgcagacttgcaactgaagacttagagcagagtctgcagagcacaaacaggacagaggaccagaaatccattaccactggaagtggtggggttgggttccaccaagtaggggtctggagaggggtctctgaagcttgagggtgttaaatagtcatttaaagaagattggccaggcgctgtggttcacacctgtaatcccagcactttgggaggccgaggcaggtggattgctttgagttcaggagttcaagaccagcctgggcaacatggcaaaaccccgtctctactaaaaatacaaaacttagccaggtgtggtggcatgtgcctatagtcccagctactcgggaggctgaggctggagaatctcttaaacccagggggcagaggctgcagtgagccgagatcatgccactgcactccagcctggacgacagaacgagtctccatctggttaaaaaaaaaaaaaaacaaaaaaaacaaaaaaaaaactatcagaggaactctatccacagaagacctgagtgggaaggctgtgtgagaggaagagcaggtgaggttaagtcaccttcccagaactctgatgcttcctgctttgggataaataataagaccccacatatattatatcacagactcaaggagactttgcacattgcttcatttaaccctcacaatgaatttaagaaacaggtactattattattcccattctacagatgaggagactgaggtttagagacatcaaagaacttatccattgtcaggtgggataatccttacctatgtttggaggacagtattaggacataatgattggagtcacatgatatgattaatgtctgcttcataatcaggtctcacacaccctgattgctcctatctgattcttcctgacaatctcttaaagaacaaaacgtaggccgggcgccgtggctcacgcttgtaatcccagcactttgggaggctgaggcgggcggatcatgaggtcaggagatcgagaccatcctggctaacatggtgaaaccccatctctacaaaaaatacaaaaaattagccgagcgtggtggcaggcgcctgtagtcccagctactggggaggctgaggcaggagaatggcatgaacccgggaggcggagcttgcagtgagccgagattgtgccactgaactccagcctgggcgacagagtgagacactttttctcaaaaaaaaaaaaaaaaagataaataaaagaacaaaatgtatttccaaggacacacagctaagctatggtggagctgggatttgaaagcagtcaggcctttagccatgacactgttctatgtccacttagcagaatctttcaaaacacaaagaactgctgctaacatgctcctaagaccacccaagaagctgttaagtgagtcttgccctacccgcaccgccctctgtctcttcccatgccagaaggtggaagaccacagtgactgatcagatggcagcagcacccacctgtgacccagcaatcagaatcaagtcccaccactgttgcaggctgagcctgagcaaagcagtccctgccacaaggagaactgcttcttgcctactttctcctgctttaccttaaatccccctaaactctgcacctgtaaaagcatctcaagacacwtcacccttctgattgggactttgatgtggttaccatacgccctctgactgcttctttctgtttttttttatccaggtctgtctgtgcggaccctctgtcctggctgaacagcatttgtggggtccctgtgtttgctcaacatcccaaagcccccttaattttagatccgctgagctctgctctttctctatcctgcctggccagccccacctcatggctgctagcctcagcattctctcccgaggtagactgattgggtttccattgtatcttataaatacattgttatggctcttttcttattttccattacttctcaccatatttcccttgttgagattagaaactaaatttattcctttaacaaatatttacagcacacatgatcatgacagtgggtgtactagtccgttctctcattgctacaaagaaccacctgagatgggataatttataaagaaaagaggtttaattggctcacagttctgtaggctgtacaggcagcatggctggagaggcctcaggaaacttagaatcacagcagaaggcaaagaggaagcaggcatatcttacgtggcgggaacaaaaggaagagagagacaagggggaggtgctacacactttcaaacaaccagatctcgtgagaactctatcacgagaacagcaagggggatggcactaaaccatcagaaaccatcccccatgatccagtcacctcccaccaggccccacctcccacactgggaattacaattcaacatgagatttaggtggggacacagagccacaccatatcatttggggtcactttgcccttcctcatagagtttatggcagcagtccccaacctttttggcaccagggactggtttcatggaagacagtttctccatggacctgacaggaaaggggttaatggtttggggatgaaactgttccacctcggatcatcaggcattagactctcataagcagtgcacaacccagatcttttgaacgtgcagttcacaatagggttcatgcttctataagaatctaatgccgtggctgatctgacaggagatggagctcaggaggtaatgctcgctcacctgccgctcacccgccgctcacctgccgctcacctcctgctgtatggcctggttcctaacaggccatrgacccatatggggctgcaggctgggggttggggatccctgctctaccgaatgcagggcctagggtctggggagacaaaaacttacaaattagtaaataatatataacatctgatgagacaaagtactaggaagaaaaataaaagaggaacagagactatagaatgtggagtagcttagcatggataattttatatagtgtatcaaatatattatgatagctgaatagtggccccccaagatgtctctgtcctaatcttctgaacctgtgaatatatgaagtcacatggtaaaagggattttgcagatgtgattaaatcaaccattttgaaatgagatcatcctagaactgcttagctgggccccatataattacaaggatcctcgtaaggaggcaggaagagcagtgatgatggaagcaggaactggagtgattcaaggaagggaccacaagcccaggaatgcaggtggcctctagaagctgaaaaggcaaggaagtggcatctcccctgaagcctcccgaggaaaccagccctgccgacatcttaattttagatcatggcatccagaactgtaagataatcatttggtgtacttttaattcactgtttgtgggacgttgttataggagcaagaggatgctaatagagggtggtcagggaagatcaggggactgatcagggaagatcactcatcaggggaccttggcatagagacctgaaggaaatgagggaatgagctatgcatacatctgagggaagagcattccaagcagagaagagccatgaggtgggagcatgcttagcaaggtcaaggaatgccaggaagctggcgtggctagcatgaacaaggataggagccatgtctgggaaatagcattgccttgatggccattgtaaagactttggatttgactctgaagragatagaaaggcaagaaaaggatttgagcaaaggagaaacaagatcagatgaatatttttagggtttattctggccgatgaactgagaataagttgcagaggacaagggcagaaacgggaggaacagtctggaagactctgcaacaccctagacaagaaatgatggcggtgtctagtaggtagtgagatgtggtcagattctgaatatattttgaaggtagaaccaagaggatttgctgatagactggatggagaatggctgagaaaaaatccaagtgaaagaccactctaaggtctatggctcaaacaactagaagatggaactgccattttgtaaaatgggaaagactgaaaggggactgtggtgcggtggtgttgggcgagggtgggagggagatcagaagttcaacttcagacatayaaatgtgagacgtcaattagatattcaagcgaacaactgagtaggtagctggatataccaggctggcactcaaggacggaggtctaggctagagaaataaatctgagagtaagcatataatgttattttaaaaccatatttctggatgagattgcagggagtaagtgtagacagagagagaggaaaaaaaaaaaccatctgaggactaagcttaggggcactccaacaagtgagacgatgaggaatcagtgaaagaacagccagtgaggttgcagaatgaagaaagtggtctctggmagcaaactgaagatactgtttcttaatacctttatatttaaggttagaaagaggtggagctggaagttaagagtaagccgtctgaccccagaggccatgttatttatcatgagatatatgtggggagtgaaagagcaagtgaaccaatgaacaaataagtgaatgaatgaatggctatggccagatgttggttccttcatgtaatttttcctctccaatctctcaactcttgcacatgccatctcttttcctttcatatttgtttatttaacaataaatattgttatttattttaaagtgtttgtagacatggtgtctcactatgttgcccaggctggtctcaagtgatcctcccacctcggcctcccaaagtgctaaggttacaggtgtgaaccaccacatccagcatcttttccttcttaactgcttacaattcatcttgttcacgaagagtttcaacctaattccatccatgtcctcaacccctcagcaaacatggcctagatgaaggatctctggcttggtctggtcattccttgagactcagctcagccagtatttgttactgagaccttgaatcatttctttccagtgctacaaattttgaggctgacaaacccaactcttcatgacctctgaagacttattcatgaatccagtggctcctgtgtaaagaaatatgatttacaagaaaattaaatgatttttttacaaacacaacgtttttaccaaggccaaaatccaatgaagatgctcttatttcccattatacatcatttttattgattccttatttaaacaaaccttaacaaaaatgaaatatgttcaaacatattttcaacccactcacctccagctgctaccagccacacatataccatccttgcttttaaagtcataaatggagtgaggtagaccattttggtggttcataggcaggctgagccttgagtaaatgaatctgagcatagggtgtttcaagaaaaatatgcatattctttttttgtgatatttttagttccaatgaaactatacatcctccaaggtgatgataacttcgagaatcttctggtactgtgattgaaacccagtgagtactctagctacaagacactggcctgagacaatgcattttctgtgatgacagcagggggagccccttctctccagtgtttcaaagcgatttgctattattctgtttaatataataactgaaagtctctattttgggtggtaggcactcactgtgcccaatcacctaatgatgccctgtatgacagcaccttctcatgtctggttgataaatgaaaaaccagaaatctgtcatagaaattacctaatttgatattttagccccctctgaggcaagtacatcatatatatatatatatatatatatatatatatatatatatatatatttttttttttttttaagacagagtctcactttgtcgcccaggatggagtgcagtgtggcgatctcggctcattgcaaccttygcttcccaggttcaagtgmttctcctgcctcagcctcccaagtagctgggattacaggcatgcaccacggcgcccagctaatttttgtatatatagtagagacagggtttcaccatgttggccaggctgatctcaaactcctgacctcaggtgatccacccgcctcggcctcccaaagtcctgggattacaggcgtgagccactgtgcctggcctatatttttttttaataattgcaaaacagacacaaaagctaattgaattacctgagatgactgcgcaagtcccaagaacatctggagatttcctgacctttattctagtggttttatctgggggcagaactggacaattctgaggtgttttcagaaaaccttgaatttgcatctctcagcatagttccctctcaaaggtctttgtgaaggagcagagccactgaaattgcattgctgctgtgtcaaaaacagccacaggaaaagagcaagaataatttcctaggaattgcatttcaacccggaaaagcttccagattcctcagtaacatatataaagagcagagtgcattgcatgatttccatctcaaacttctaaatggtttttgtgcctattatctagaaagaaaaatatgttggtgaaggaagtctttgggtagggttgtgtctaggaattcacaagcctgaagcaaggcttttttttttttttctagcctcctatccattcaccggttcattcacttttaaacaatcactaaaactattayacaatacttattccacaatctagttgctacttctggtagccagcaccctgcccccccaactccaaggctggtgatggagaaatagtttaatgtcagttttttaaagtgacaggggtcatgctgttcattttttgagaaaatactgcagagtattaaagggaataattaataaaaattagcagttaactaattgggtagaacctcaggtgcacaacaatgctatgatcaaagaaaaacttttttcttcaaatttaaataaaagtttcttgatagaaagtaaactcattttcaggcagtcagttgttaacagtactctgggcagttcccataggggcatgtcctgaggtttgcttaataaatacatttttattagcatgcaccatccattagtgctaacacagatgcttcttaaacacgcgtgtttacttcaccagcacggaacatttggcttattatagctgcagccaaaaaaaaaaaaaaaaagcagcatcatgatttccaaaaagggagtgacatttgatttggggcagctcttgtcatgcgccatctccaacttagaaaatccaccctgtacagcccggcccgcgtcagggacccttgcaggcggcagccacggctgctgctgacgcgcgtttgatcttttctgggccaccgagggctcgccacacccctgctctggcgcgcacgttcctcgctcggcctcgcccagcaggagccagaccttttactttatttggttcaccacgcggtctctgctccagagagcgcgccggcggcggcgcactcgggccctcgcgcgcactcgcacattcttccccgggaacgcgggcggggggcgcgaggaggtggccgggcccgggctgcggtccctctaattatagcccggcagctggcgcgctggcttggcctggcgctcggggccaggactgggcggcggagcggaggggcggggcgcaccgggccgtttcccgtttccgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccgttccgccccgccccgccccgccccgcccggggtcgcgcggctccacgtgcgcagagccgggcgcgcggagactgcgctgctccagcccgggaaaagttctagaatagaggcgcggcgcaagtcagggggccgccttggaaaccgcagcaagggctccttgtgggctccaggctgttggagagtgagggagcgtcctcccctttccttcccgtggagtaaacagagcttggcagggctggaggctttcttccttttaaaaagtgccattctgaacaacgatacaaagtgaaaaaatsaattttttaaaaaagaaagggaaaaactacaatttgaccattctgaccagcctccttgttccaactggcctcttgatttgtataaagataatggggtccggcggcccccttgatgcatgaattgcacgctgggcataatgaacttattgtgcgaaagcactttggacttcggactgtgttcctatgtcagaattttactgtggtttgtaagataaactggaaggaaacaaactcgtggttaactcttgtcaatacgtgtcttgaaccaagcaaagtgacatttcctacctgtggctttgactttaagctgcacaaaaggtaggagctagcctctcagctgttcaaagcctagaatgagatgcctgcttagtaggtgttaaattataacagcaacaacccatatggtgcttattaggagaatagtattccaaaacttctctaatgactgtgaccctcctgtgaaattctgatttcaattgtatatggggtacaataaatctttatcttttatcaccagaaaagctaattgaactgctgtttgcaggcagaaataacaaaatgggggtaatgggctcttagcctgggctaagactctcaacagcttttttctgttttgcagctcacacatacagtcggctcaggcagacggcccaagmcaagsctgtgccaaagaaatgctgatttagtctgacccagacaatctctactcccacatgtcacttctctgcagaactcttactagtatggcaaatactttaaaaatcatacaataaaagaaggcaaaacctcagtaatttgaggttcacttttaataaactctttccatgcattaaaataaattgaggccctgagctctggcgaaatktgtttccgggtttttaattcccaccgcccccccaccccggaggcataaatagccacatacgcaattcaaagtactctatttgaactagtataggaaagatgttttctatagatattgcagataaatttgcaatgacttaaatatttatctgctaaagttgctgagtgcctccacaacaaaaccgaactcattttttgtgcacgatgggcatctgaatgctacctgatggtgatgatatagaaatactaattgctaagtaaaagtggtaagtgatgtgatctacagattatgtaatgtagttcatttcccccaaaatgtaaactatatttagaaatattcaaatgtgacattattaccctatacaggatgtcttatctcagcatcaagggcgtctgtagagctgctggaggaggctctttagattacgcaatctaacttctgacagcccattcaaaggatgagaaccggtgccttgaagctctcaatttaaactaggaatcctgtagtctagtctctagacttatctgacctaggcagaaatcatctcctagaggcttttcatggctgattttgtgatgttttacttgcactgaagatttattattccatgttttgagttagtgttatacagtgccattctatatattttccaaataaatgtttgtcttacagaagaaactgtttataccattctaatagggttgtttaataaggaaattttactcagttgggttttggattaaaaataaaagaacagcttttaagatacaatgtctaaatgattctcaataatgatctgtctatggtatagttactttttgtcctaaaataccttttctgtgggttgtatggattgttttatgttgtgccaggcagatgtgcataattttctgattaaaaccagtgcaaatacagacttcatattctataatcttttaaagagacaagttacacttcaaatcaaacaatcagagagctgtttcaaatcaagcattttaagttaagttgtattgacatggggagggagcagatgacacacctaatgagttaaaacaatgttcactgttaaattaggtataaattaatgtaataactaggggtagtgtgggtatccctgacaaattatggatttatctgaggattaatggaggaatccacagataatccataaatctacccattttctatcttctaaccgcttaacgagtaatttataaattgtctatttgtgtgctttttaagttacagtgaggggttcagacatattaaggaaaatgcaggctgtcaagagaaacagcaacaagggatctatagagtttgtaatctggaaagtcacacccgtaatttttatttgattgtagtaccattgctgtcagaggcctaaccagtggcactgaaggagttaaaacagtccccacccccactcccgatttctagaaccccacgataaattgggtaaatatgtattccattcattggtgcatctgaccttggtctgtgacagaggaaaggcgtgtcttctcatactgttccctatgaacaaaaggcaagcaaatgagggtgactcaggacttctcatggcctacacacaactgaacatttttctgaatgattccacgtatacacttaggaatcaggaagagaaacattttactcttcactaaccaaataaaaccatctataaatcatatgcaaaacaacttttgagtaaagagggacttaaaagtctaggaattaaaraaggatttccatagtttccttttaactctcccccaactcccctttggggaataaacaaagacatctgccacatcaagagtctggtttgttttcttaactgaaaacgaaatgcagtcattaaagtatatctttgggaagaggttttgaaatgttgagaattacttctacaagctgcactattttcaatttcactaaaaataaaatttagcatttttgttacaaaaamatagttcatcctatttcttttaacctagttattacatgaaaaattgtttatcatctgtaacttgctaagaatatggtttcttgaaaaccttaaatggactaataatgaaaaactattaaaatatatatagtgatgggcccctcctagttaccagaccaccctagtgtaaatatattcaagtacacattcactgttgctgtttaatttaaaacatatagtaactctatgtatatcctagcctccaactctttatgagtttcacaacttcctttcatagagaagtctgccaagccattaatcaataaaaagagtaaaagctgcaacatctaggaaatttcttattatatgagagtagccagtaaaatgtgtctcagtgctttctaccttttatctctatttataaatttaagtttcaggatatcaataaagctcatacatggctttggcttttttcattcctaagctttccaaagtataaggctttttttttttttaaatcccttttgtctttagcgcatttcctatggcccaacgtagctgttttattccaaagcttttcaaagagcagctccaggtcttgagagtctttccagtgtcgtcactatcttctctttccaatctaccattgcagaatggctggttctgctgctagttgaaaaataaacaaatgctttctagccgtactttgttcagctcttttatctgtgtcccctatccagttgccctttccgcagtccctggcacttctattttataccatcagttgcctttttgttccatgtcttttatctcctgaagttcaggcaaaccccaaccccaaacccacacatcctttagtcacattgccattagtgattaaaacaatagccattctaagcttgctttagaaaattaaaaaaggcctcagaaaatgttcagtgctcccaattttatttttatttaatgctaaaagttaaagaaaaaaaggtactgtaaatctgacaaatgacagaattcaggtgatatttccatagcgtgattttaaaatataataatgttgrtatctgagattacactcacttcagttgacatgagtttcatcatatatagaaaaagtatcaccttcaacttaaaaaaagtaaaggttaaaaggtggcacacttttaaaatacttggtggccaaggaaaggtatatagtaaaagttgtaaaccatgtgtatgttctcataactttaaatgtgaggccacatgaaagacagtacatctgttaaattctataaattgttaaaagcaaaaaagggaaagcttcaacaccccatcccctaatattttgagtattaaaagcacagctgaaatattaggatttgaaatctgatactgcccatgtacagtaagtagctttgtgacatttttatccagctgtggagaatctctgcactgtcatcaggtacaacaaaagatcaaacccmtgtcccgatgttaactttttaacttaaaagaatgccagaaaacccagatcaacactttccagctacgagccgtccacaaaggccacccaaaggccagtcagactcgtgcagatcttattttttaatagtagtaaccacaatacacagctctttaaagctgttcatattcttcccccattaaacaccagtacagagaaaccacaggttgccctttccacagctggatagacttatccaaaacggcaggatggttctgtattaatctttttggaaagcatgtctgtattaagattgcaaaacatacagatagctaccacaaattaggtcaaaygactgatcaagttgtaacatctgtgaggtcaaattcctataataaagtgcctagatacacatttatacaacagaccataagagctgaattctttacaaatgtctttatgggcatgtaaaattgactctgcatttctgcatgtgtgcattcacataagagagaccagtctgcactgagtcatatatactccaacttgaaaaagtaagtgtaacaactggttaatcatgcaagtctgtttgtaatataacaatgactggtaaaacatgaattctcgcacagtagtaataggtgcactcattaaaaacactacggaaaaacactgtatttggtgcagtatctgattttcaagtgttagtaacttgaccattaaaaaatagttttgaacaatttaaaaaggaaagacaaacatataactaaaaaagaatccaaagttggtaaaaatctgtattttcaaatgtaaatagaagctaggctgtgaaccatacacataaattgtagaccttgaagccataattcagcctaattataaggccaagttacaaacacctgaacgtaaggatttaaaatagtgttcctgtcaatgttaaatcataacagcacaaaagaaaaaccagtatcactgtgagacaactatttctaataattgatgatttattggttttaaaaaaatcattttactgatgcaaaatagtgatcaaaagaaattagtttacaaaaagacttctaaaaatattttgagaggtggggcctgtctattatataaaacccttaatttctttaatttccactagtttatcatttttttccagaacagtattattcacttggtatttcaaacacatgttaagaaggaaattacaggtttcctccacccacatttgggctgtcactgatatgcccaagggcagtcctggcagcaccacgcggctgttactgtcattgtaccatactgtattcagcactcactagaaacagggtataggtgatagtatcaacagcaatagcactacaggtaaatgataaacaaaacaaaacagaaacaaaaccaatcccacaatctccaagttcacctggactgtaacttctcttgcaactctttcaaaataaaggacaacagcaacaacaaacagacctctagggtgtttaaaaagatgaagtggcgctgcagagctgggctctgctcaaagatggcagtgccatcttgtacacaccaccatccattataaccgccttccatcactggaattgtatcttatgtaaccaactagcatgcagcattgtaatcttacaactgatcacgtggacagtgaacagcggtcaactttgtcttaaaaaaaaaaaaacaaaaaaccccaaaagaccacacaatcctgaaaatttcccagcagcactctcagtcatcagtatctcaggaactgaacttttgagcaaaatagagattcaaaatccactttcctactcctctgaggacaatgtttcagggtaaactggtggtatttcccagtggcatgcccacttgacaacatgcccgttcgatcatttcctttccttctccaccacttggcctccggcctgagaaaggggccagcaataaggaatgacagacagtaaggcaatcttacaatgtcagaaaatgtatttggctttttttttctttttaaaataagtgcatacaaatacagctagaagcatttctgatttgccaagtgctctaaaaaagcagcgcaagtcacagcctacatagaacggtaactgtcaccaggataataaagcacaaagatatgctaataacgttaacaaaagaaaaaaatgtctttataagtacataccttttgtcgtcaaaaaaaatatagaaacacaatgtattcaaaaaaaatcaaaattatacagccatgtttatgaagtctacatttcccttgtcttggatatatatatatatggagatatatatacaattcaagcagttttaattaagggtaatcattgggtttttctgaaaccggaaaagtcacgagtctctctcttttttcactttcacatctccagcaaggatggttgcaatttccccttgcataaaggcccaggggacattggagcccacaagagggcatttttccccactgggacaatagacctctccactagctccctgctgtttgatgctttgtctggagcaagggaagcagaacttgtgcgaagggacggacgggcactgcacaaaatgggtgtcctccagccgctcgtggcagagggtgcagcacagcggggcactggttgccagagaggagtccgggaggctggcagggtgcactggctccagtcctcctgtgttgcctgctccctggccccccacctctctgggrcccagccttctttggttcatagaggacggagagggcggactgttgctattcctcctggtagtggagtgaacctggttggcatcttttgaggcatgactgccccctgcattgtctgctactaagatcagggctgccatgggggactggccattctgggccgcttcaggcggtgtggtccggttggaatgaggtgaggcagtgggtggtggcggagacacaaaagaggatgtaggagtcatggggatcttgagcccytctgtggatgtggacagccacggctgggcctctccrttgatcttagggggcccgacttcaccttctggttctggagagggcttccttttccttgctgttcttgcaactggaaacacaaagaaataaaaggaaaaaggtaacataagtggcggtgcactgaaagagatcattctcttcctaacccgaaacaaaagtcgttacagaattcctcctctctaaaagcacagacagaaaatactcatatacgagtttcaggtgcacatgcaacttaaaaccttcaggcgtacgggattctgaggcagcagactgatttaaaatggasccactgaaaatgacacgcttgtaactgcctgtttgtacacatgcacaaaagtaccctcgtttgcactcaacatgtgactgctaatgtcccccaataggttaaaaggtgactggtgccctcatgrtcccatccaagaatgtgctgggaaaggaaaaccccgtgtcagagcgtatcagcccagtctgactcatctctgttatgctgcttcagcacatgaacacgttgccaccaagcactggttccgcctcaggcagatcaggaagtggggtgtttgttgtttctgggctggggtaaaatggtgaatccaaagaaccacccttcctctgctctccgtccccttttctcccctagaccccctcacttcacagccgcccctacctgctttagacccgttggccccgttggcctcgaaacccaacaacctgcctgcagtcarggccggctccttcttaaacttgctctcgaagggccccgagtggccgtgctggtgcagcgccagcagcgtgtcgcgcacggtcttgggcctgttgacccagtcctgctctccagacccgcggctcttgcccgcaccttccgcgctcagctcggcggccccggcmgcggtggacaggctgtcggccgggccccggtgcgcaggcggcggcggttgtttctccttggctgccrcctcacgctgctcgtgctccacggcagcgctgctcgacacggatgccggccgcttgtgggcgcccagatcggtgggctgcgcggagcccaggctggcggccgcggttccggacaccgcggctaaggaggcggcagcgcggccgccgaggccgagcgcggtgggcagcggcgtggccgagccgttcatgagcggcaccagggtgggcggcaccgcgtggccgcgccgcgggttcgggctctggcgattcagctcgggcggctcctctagcttggagaagccgttgggcaccaggatgccgttcacgggcggcggctgcggcgtcggcggctgggccaggctcgctgccgggcggctgctgccgaagtcagagccgaggcgcgggggcctctcggccgcggccgccaacgggtagcgctccaaggcctgcggcgcgcgcggggccgcctcggggccgccgtggccaagctgctgctgctgctgcaaaaggatgtccttggcggagagcggcggcggcttggcggcggccgaggccgcggcgccgggtggggagcgaccctccgggaagcagccgtgcgcccgcttgagctgccgcgccgtctcgatgacgaactcgacgcggtcggcgccctcgtagttgacgcagccgcggcagacgggttcggtgaagtcccagatcatggcccagggcatgcggggcaggtcacacaggtagcacgactgccgccgggacgcgccgccaccgccaccccgcggcatgtccgaggagcccgcgacgccgaggaggaggcggaggaggaggagggggcgccgccgccgccccccaccggcaccacgcgcgccctcctccccccccaaccccgcgtctcccccaccagcggcggcggcggccgcaaaggcggcggcggcggcggcaaagcccgcgaaggctcggcgcccgcgcagcgcccccggtgcacgaggggcggcgggcgcgaggtgaggggctgcagccgcggcagcagttccccccggccggcccgggcacgggcgggcggcgcggcgcggcggggcggcgggcgcggcggtgggggctcggccggagccgcggcgggcctccagaccggggcgaagacgggccgcgcgggcgcgggggagcgcagcaggtcgcggcggcggccggcacggagtgcggggcggggggcggggaggccgggggggcagggggcggggggcggccgccggggcaggctcagcccgagcggcggggcatgccgcgccggggtggcggcggccgggcggcgtggagctcgggcgcggcgcgggccccgggtcgctccgccgctctctcacagctcctggcgtcgccgctctccagcgccagcgtcagcggccagcccgcctcagctccgccgccgccaccgtcgctgctgctgctgccgccgcgaccgctccacttctacagacttgattcttcgacagtctcgcacggcgcctgcgcgggccccctcccctcgtgcgcgtgcccgccctcccgcgcgcgcgctccccctccccccgcgcgccgaaggagcgctgccgggagagccggctaygcggcgcccgcccgcccgcggggcagcgcagcagcgcagcgccggtgttcccttcggaacaccgcgcaaagtgatcgagtgcttttcctccactttccctcacttcgcgccccacccggctgtcccgaccaccctcaggatgttttcctctggtgtgcctctgggccaaatcgtgctaaaaatcattttttttcttttatgcaaggacactttgtcasttggtttccgtcagtctcctgagaatggggaatttaggtctagcgtggttcacagttctggttttttaggagttatacttgaaagctcaatgtcggacacatagcatgaaatccgtcactggtgctttgcatttgtcttggaaaggacatacrccccgcctgtcccttttactaactagggagactgtgaatattcccaagcccagcaccacgtgcacacgccgccagctggctcgcgcgttttccacggagccctctggaggggagggagcgcggttcggactagcctctcccgaacaccaagtgccgctcttagccccgtccagcccgccctgttcatcgggggcctcgccgcgccagtcgccccggctgccttatgtaggtatgcgcggcgggcgcgtgacgtgggcgcggggccgtgggcggccgccgccgcgagtgcgcacgctccgcgcagacgtgcctcggcgccgctggcactagggcctcgtggaacgaatgcacattccagggatccggggtctacggccagcgcggccgcgtcacagcgcaggctccacccccttcggcgagtctgggcgtcgaggcgccgcccccgggcccgaacttggactcgaggtggcgggaggcgagggcgcgagtgggggrggggggggtcctgctcgcctccgcgaggttcccgagggccgtgggggcgaccggctggctggctggcccgccgtcccgcagggcgggccgccgacggaggcggacttttgccctatatgccacccaggccgggatgagcccggcctgcaggtctgccaccgttggcagcctcagactcagcccagactgaattgaatgtttgagtttcgcacttttatcgggaggaggagctagtgtgtgttatggtaaatcactttgggctggtcgttagtctccctaatacacgtaggcttagtcgctcttcaattgggacttttacacttaagctctttaagggcggcctctggagctgcttttgttgggaacacaggcccacaactctcccttgagactggaatgagctggttaagtgtgggaagaacagggtactaattatattatctttcctacaactggattggtaggtggagagaaaaaaaaaatcatgctgacgtttctctctagtcgttgctattgaaaataccaggttgcttcaaaggattaaccacaaggaagaggaaaaacacccttagagaaacagtggagggagctgcttaaaacacatgaaaaaacctgttcgaaaatggcacagaaaacgtaatgtcagacctaaatgtttttacaggctaaccttgaatgtcttttggggatttccatagaaggtgcgcctgttttaaaggtctctgcatctgttcctggatcttgccctgcaattgcaatcctgcctcaccctctccaagctgggagaatggggcctgtccagatccttcccgggagtagctggtgccagcgggtttggtcactcccaggccctgctgttgcacaccgctttcaagacctgtccctttggtcaccctcctcagagaccctgtgacactcattccagtacatgscttcacccactgcgtcactgcccaaaggggatgaagtccagtccttgtgctgcagagaaatgaaccaactcatcgcccccaagagacggccccactaagcattgactgaaacatactaaaagaaaacacaactcaccattagagttgtggcctaattatactcatttctctgcaagctggtactgtaatggcctcaaggggagagcctgccactccatcctaaaatagaattagagatagaaattctgccacgatactaagatctttgcaaaacggagcttttcttctccaaaggaagagcatttccttcttattttacactgccagtttcatgtcgaaactgagttgttgtaacttccctaatgaaatgcccgatggaaaatggaagggctattttagttctgggctcgatccggaatcaagggggttaaggctggattcagggcagcaattccttatattgtatcagaagtctttcatgcagcctggcctttcatgtagctctgaagcagctttatcgatgtatgctaagtaaacatagctttgtttttgtcttccacccaccgctccctcccggcacagactggagttggatcccatccaaagcggctgctgcagcagttacagccgcctcctccacacacaggagcagggtttctagggtgaggcaatgcgtctgcaattcgcagagacaaggcaggaattgtaattgtagttcatcatgtgatgacttatgaaagaggaagttggtatgttttagtcacgtagactctgccctcttgcttgaggcaccaggtcctctcaaaagagaattatgatcatctttgccacccagagtcaaggttaccggsttggctgcagtgtgctcctgcacattcatatacggacaggcaggcagatgctgggccaagtgtcggcgacgcagcgggatgaggctggcttttcaccagaacactaaaatgttgcaatttgtcttaaggactaaaggaaatattctatggagaacactcctgctgagactagacaaaccaacagtcctttccagctctaatttctgagagttgtttttttttttaaataaaaatcacagtgtaggagtaaaaggaaagccattcagtatgacactatcagaaaagcaggaataaggaagtggcttggaaggcaaacctaagagagcagttgtaagcgatagctcaatgggtagaactaatgtgaccttccgacactgagattgaaacgggcttctactgcgtgaacgttaaacatctaaaatctgaatctggtttccagagcttactccagtcaagcagctattaacacacggaagccctgaactgacagtctatagagcagtgtaaagaaacggttcctacaagagtaccttattggaactttgcccccaggttatgcagctgcaagaggggtgcaaccccattcccccagcagcttgtgggtgctgtccaggagatagatggtattcctaggaactgctgagttcgtggctttcaccctctatccagaggtggaatcacagccttcattctttagagtgcagtttccttaaatagcatgatgttgcaaccatgctaaagcttcttaaactctgatcttggcgtatttgaagaagagaaaaaatgcagccacatttcatctggatttctgtggacatcattgcgggtttcttcagctttggcaaaagtgtcgtaaggtttgaagagcacacgtgatattcagggcttttccaattttttaaataagttatatatatttgaacacatttgtttatatgaatatatctacacatactatggagcaccatgacataaatgaaccttctgtaattgatatgagagtcttccttcttagtaacagcattttatgagacaatcttactgtttttcaaattgcaaatattcttttttagaaatactttccctctgtttgacctctctctatagcctacctcccctgtgcacagagcatacagatattaaagagacttttgcatgtggaggagataaactctctgtggagggtctaagaatcaagccagataaaatcacaggagctcttaatcatccacatattgtacacagaagctgttagtcggcagcctatatgtcaacgtatgtataggtccctatttagagcaaaatttgggatcttgatgaaggttaaatactcactgtgtcagaatttaaagagctaagtgagaaacagacaaaatagacaaaggagagattgaggtcacacacttgctcagtctgcaaggaaatttgtagaactggaagggattcaacagccatttgatgccagtaaacctcctattgactttttggaaaaagcaggatgaaatgcacttttctggaatatctggatgtgggtttaacttagaatatttaaaacactcactgaagccctttgaaagatatcagtaggaagatgttgacaaaataatgaattaacttcacagataatgtttgaaaatataaaaatggtaaattttcccttcttagcttttctattaaaaaatgtacatttcctacatacacattccatagcataagaactgaaaaagtcaaataatstaataattctaaaacgttaaagaacagtacgatggcatggtatttgctgtatctttcacatgaacattttaaaaagatatttcaaggataaattctattctcttgtcatccttttcagaaactaaaaacctgacttacctaaagtaacatgaaaagtgagtgtcagaggccagacgcggtggctcacgcctgtaatcccagcactttgggaggccacagtgggtggatcaggaggtcaggagttcgagaccagcctggccagcatggtgaaaccccatctctactaaaaatacaaaaattagccggacgtggtggcatgtgtctgtaatcccagctacttaggaggctgaggcaggagaattgcttgaacccgggaggcggaggttgcagtgagccaagattgtgtcactgcactccagcctcggcgacagagcaagactccatctcaaaaaaaaaaaaaaaagtgtcagaactgatatctaggtgtgagtcctgttgcctgaggatgtagtcgagaatattctatttgcattttgcattgttaaaaatcatgtaagcacagcatagagcccagcaaaggagtgttaacatctgagtgttaacaggaaaggtgttaagatttgctatctatacctatatttataggaaaaaggaaaattttaatatagttcatagaacaatcaatccaaagagaagtaaacattcaccacagacaaaaggagctgacagaggtagggcacagttgctataacaccatgtcgagtgtgggactctttaaatggcacaccatttttatgctagtctttatgaaccttggataaaaactgatgttggtgttaggataaaagattcaattgtgggagtcagttgggtgatgaaatggttttggcacttaccaggttggaatactgcacctccaactctttgtgatctattttcttaaaaagaggaaaaactcatgaaataatttaattccaattgtaggagtccaatcctgactactttgcactcagacaaataaatacaatgggctacagggtaccgaaaagaaaaaagtgtgaaacaacattgtatagaatatcacagttgyaagggtacaagttgttcataaagtatgccartgaactttcattgttattattattattatttgaaacagagtctttctctgtcgcccaggctggagtgcagtggtgcgatctcagctcactgcaacctccacctcccgggttcaagcgactctcctgcctcagcttcctgagtagctgggacaacaggcacatgccaccacacccggctaatttttatattttttagtagagactgggttttgccatgttgaccaggctggtctcaaactcctgaccttggatgatcctcccacctcggcttcccaaagtgctgggattacaggcgtgagccactgcacccggccatgttttgtatttcttatgaaatagaaattagccaatatgaattaggctttctcttgacaagatgaaaatatattttgcaaaacaatgccattcagcaggataatttggccttaccaatggagtttcactaatctattctggtgactgacttactttagtctaatgggctcagcaaaaaataaagtaagcttgttatttgaaacaattattgtatgtatatactgcagattccaatgatatctctcagaggtctacacatttaacaataaaattctttctccaacacctgttttttggcatgggaggagtagtggtcatttttgtaggtaaaggagacacagagagctccctacacaaggaaggaaagttgagcagactgactgaggactgtactttattagttggagtgaattccggtatgcattggcacatccatttctgtgcccacatggtaatgcctctttgtgaggcagagtgcaaaaccactgggaaaattaagaatcacacycagaactgaagttcatacaggggagaaggaaacagacatgcagtaggcagcctagatgtgagccctagcaagagactactgatggattccccaaagtgactgcctaaatgtagtgtgtttactacaaagcttgtcacagacagctaaaatgcaaatacaaatgaactttgatgtacttcgtggcaagactcccagcccttcragcaaattcctgagtgaggaagctggttctgaaacatgcctgggaactgcacacatgtgaacttcctgaggcctcttctctttagcacttaacaggtagctggattttaaacatttgtcaggctgcttttattctgtctaccyacctctcaattatctacctatctacctatccatctatctatctttgcattatcagaccaattcattattcttaacaatagttaagaacatcagtgtctgttcactttatgaactgagacaccaagataataaggaatctgtcttaaaacaaagaaaatgtgtggttaaacgacagttagaattcaggtttcccaaactgcagttctttctttagcccactggtgggctacctcctatttatattttcttcataggttcttttttgcatacatgtaaatatctatgcaggagatcactgagggaccgtagcttctcttcattcacctggcatgtgacctgaggcaggtcagctggacaccctaggccagtttttcttgagtggaggagacggtgctggccttgatgtcatttctgttctgacctctcgtggtgggtgggggtgatgggaatacacaggaatttgacaaacccaagcccaacattcttctgacccacatgggattacaaaacaatgcggaaaaactaccagtaaatgcctgcccattatttgggggcattgtgccatccaaataaagtcaggaggttaaatggctaccagagcatcacatcatcgagaacatcgtgtctgcttggtttgggctcaatcccagattaggagactctaaaccacggtctatacttagtttaaattagccagggcaaaacatctgtatcagcattaatataagcccaacttcaatgtctcagggcttatggaaaatatttgcatttttctttcctcaagagactgccttatttcatatatgtatgtgtgtgtatgtgtgtttatatataattttatatgtatatgtgtgtatgtatatatacacgtatatgtgtaaatatacgtatatatacacgtatacacatacatatacgtgtatacgtgtatatatacatatatacatatatgcatacatatatatatacgggcaaagacttaatatactatccacaggctattcagattgttcaagaggctctcagttgaagaagcaaacagacaaacaaaacggtttcatacacaggcaggcatttggctgagtaggtcggcaggatatggaaacttgctttgaggtgtttttggattctcacctagaattctactacttaatggctgtgtggcttctttgcaggctatatactgaattcataaaggatgttatgagagtaaattcaaagaattctgatgttttgaaatttgttgtgacttggttaactatggtgaaatgttacattcgtgttacattatggcttttgtttatacgggtctgattatgggataacttaataaagttgtaaaaaactctatgtttttcaaaaattctgtgtttttcttatgtgaagaatttgtttcaactattcttcaaacaccagaaaaggagtcaccgtatactttacttttcatataaagattactcaatatattttaaaatgggtgttccagaattagacttccagattccttgaattgagagtgtggaaaaggataggcagctcctgtaataggagacattcttttaaaagcctggaatgctgaaaccctcttagactgaaaacatgtcaggacatgcctttttgggatactgtcaaacggtttaggctcagaattccacattccgtacttttgaagttgttttctgttggcaaatgacctcttgattattttcatgtggtgagtattcaggccaacctttttggttccaagtgatttaaaaacayacacacacacacacacataaaaacaaaccactctgaagtgtccatattttagcataaagttaggaattatgcgagtgctgggtgtatcacggtcaattctgtgagcctcgtcacagtttatagccgaagtcagaggcttcaaaatcagacacacattgacctggaatgctttattctgcagtgctcattcttgattctcagaagtatcgctcctgtgaaaaacttatcaccattagggagctgtcatttccctggtaaaattaaacagcaatttcattcacctttgcttctttttggatgaaggctggcaatggtttaaggaacaaataaatgaatkaataaatgagtggagttccctcctcctgactcagaaaggtgctatttcccctcacgcaggagatacaacttccatgcaagccagttctccyactacatagagcccttctgtttttaggaagttctgattcatggattggagaattgaactaaattagtatactgtacagcatgggcctggttaaattaaacataaatgctctgccccctgccacccacctcactstgaccacggagagttcrtttaacaggcgccactgtctgtgagacccaaacaaaggtagctgacttcaaaccctgtctacatttgccttattatagaccatgtgttagtagatgttgtaatattttttatgaaccagtaggattctcagaatgcttcaaaacaggcatgatattgggtgatgattttattttaagtctcatctcgatttaattttgtgagaattttttaaaattgtctgttttattgagaaattgctcagagatcatatacaatgagaaactcggctagaagaagataaacaaaacaagtataacagagacaacgttcttttaaaacatttcattttgcagaccaataataaaacttgtaaatcttttaaaaatacttttcttatggtgtataaattctgatattttacttgaagctaataaagccaccatagagaagaaagttaattttttcttctttaagctttccataggtagtataatttaaataattctgtggtacagtttcaacacctcagattgagcacttttgtttacgaagtaagaacagtaatcctcatgtaaaaaggtggtattgctaccctagacagcagatggtgttattaaatacacaggcaaagtctaaggtcataaggaactaacaattaaccagaaatacgatctgtcacagtcgtttaatgggtaacctaacagatatataccgcttgtattcttctgagtggtgggaggtaaatagtcaagcttcagagcagttgcacaatcgtttagaaatattgtaattatattcttatttaagcatttagggaaaccaacaagcgagaaagaaagtgaaaatcagtgtgatttcctcataatactgtgtcctgttaatctgctttgaaaaatactttacaaattcagacagcacaatttcatagctatccctgaatctaactcgtctccccaaactaggaatgtcaaaattttgaattttttactgccagtctcagttgttctaagatctctttacattatcataggtataatttttgcccctgaagttttcgtcgtgtgaaggtaaaaaattggagcatacacaacagcaaatggaagcagggtggcaggagacagctgggaaactgtagtggggaggagaggcagtcagctggtggggtggaccgtaggaagagaatggtctcaccagtaaggaatgggtggcactattaaaatctggatgtgggctcaatttctattgtaaatcaaatataaatctatcactaaaataggagctggatacacagtgcccaagtcctcgtgagagtttcccaagaagggtttaccatggagaatgtgtcatcagttccttttcagttaggkcttttgaggatgaggaactgaatcctaaattcacccaaaggaaaaatggccaacagggcagcaactaagcctggatcacaaagaacaaactgcttggttagaatttggaagagtggctgggtgcagtagtaatataatcccagcactctgggaggctgaggcgggaggatyactggaggccaggagtttgagactggcctgggcaacatagcaagacccccatctctacaaaaaaaatacaaaaatcaaggccaggtagagtggcttacacctgcaatcccaggactttgggaggctggggtctctaccaaaaaattaaaaattagccaggtgtggtggtagtgcatacctgtagtcccagctactaagcaggctgaggcaggtggattgcttgagcccaggaggttgatgctacagtgatccatgaaccatgatcacgccactgcactccagcctggggaacaaagcgagacccagtctctaaaaaaaaaaaaaaaaaaaaaaaaaaagtttggaagagtgaaccttgtcccataggcaaataactacgaagcatacccaagagtcatgactctagccattgtgtcaaccaattgtaaaaacagcatctggaaaagcaaaaacatcctcagtgccccaggtgaatagaagatgaacaatgaaaagcaaggttcagaggtcactggctgatcaggctaaaaaagtgggtagattccaatcttcggacaaaaactattcttaaaagacaaaaagttattcagtttccttgctgttggatttggtgaggatgtctgagtcccagaaaatgcatactaataaggacttttttcttatacagtttcatgcatttatatatgtttatttaaatttctctaaatttaatttgaataaggcaggcaacagcatctcagggcacagactcataactggagaccttcatccacaagcttagctagctagattttccgtgtggccaggacgcctgctgaaacttccagcagtcctcagaaaaactgatgagatacccttgggctgaatgagtaagaactttctggagagtggaagactggtgaaagtccagctggaaaaacatatggcagcagaggcggaaagagtgctttatgaccgggagctttataaaaaaaatgtctgaaggctcaaggcagccgttacaacctaagatcctactaagcatgatggatgtttttacttctaggattgtctccaatttacctggaccacagccagcaccgtatcctcaggcaccccatgggacagtacatacagaagaacagcatcacaccacatcctatcaccaaggccaggattctgtgcctcygcccccctccccacctccttgaaacgggggaagtagggggaagagtcaattcttcttggagcacatgagatggtagcttgctgtgttgtcctgaaagaaaacaaagtttgtaaatcactgtagatagttttttttttttttgtaatagatatgtcgggagggaaaatgactatggtaaattccattctcaaccacacattaactcagagaattcttgagctacacagtgacagactgagctcaaggagaaagacaggcattctgagtttcagactacggagccatttggaggtgacatgtacagaacaatgcacagctttgagattttatattggtccttccctgcccaatgtcatttccaaactaatagaaaggaatattttattttttcatgttaactcttcattataatcatctcttattgcaatgaccatttgtatctgttactgagaacaggtataactagctttaagaacattctacatggaatgatatattccttagaaagaaatcaattaagaggtgattattcacaattacaaaaggaccctttataaagtctgtaatttaccacaggtttaaagaaaagtacagttgacctttgaacaacacaggtttgaatggcacaggtacatgcattgattttctcttgcttctgccacccctaagacaaagagaccaacccctgctcttcctcctcctcctcagcctacttcacttaaagacaaagagaatgaagacctttatgatgacccacttccacttaatcaatagcaaatatattttctcttcttttttttttttttgagacagtctggctctgttgcccaggatggcacaatctcagctcactgcaacttccacctcctgggttcaagcaattctcctgcctcagcctcccgagtagctgggattataggcgcccgccaacatgcccggctaatttttgtatttttagtagagactgggtttcaccatgttggccaggctggtctcgaactcctgacctcaagtgatctgcccgcctgagcctcccaaaatgctgggactacaggtctgagccactgtgcccagcccctcttctttacaattttcttaataacattttcttttctctagcttcctttttctgtaagaatacattatataataagacacatacaaaatctgcattcatggactgtttatgttatttgtaagacttctagtcaacaggtaggctattagtagttaagtttttggagagtcaaagttaaactcagatttttgaattcgcaggggttggcaccctgacttccatgttgttcaaggtcaaatgtacttaaatagtattagattttttaaatgtaatcaacatagacttgttaaagctccgcacaagttgctttggagaggcaagcatgtggacctcttttcatggatgcctcagcggtggcatctgtaatgtagccattgcagacaccactgtttttcttcaacagacaatactgtctccctttcggcttctctgatggatgtttcaccactattttacttaagctgtgttgacagtagaagcagcaattactgtagtcacaaaaatcagggcctacctttattacccgatcattatgacaattatccccaccccccgttttctctttgtccgtgcacacacatttccaaggcatgtattttcattaccagacagagaagggcctacaggtcaattgcacacactccgtactgataaagtaatgtcattaacttttgattttttaaaaaaagcaaatgacagtcctctattcctggattgtgtttttcgtcttaggtactcaagtaaaaaccaagatggtgtctctctctctctctctctctctctccctctctctctctctcatatatatatatgcacacacacacacacacacacacacacatatttaattttaataatgtcaggcagtatgtgttttgtttggaatgcactttgcacccatgagcaaaagccagcactgtgaatctaaaactacctgggcctaatgaggaaaggctttgaaacctgggcattttctaaatgttcagggagagaaaacaaagtcacctcttcttaacaaaaacttttctctttagggggctccagggctgttaagaacgatttgggccagggactggccagatttttgttcttttgaatggtgtccccacttcccctttctggggacctcagtggacttcttttgcatttcctggctctgtttcacacaatgcttagagcttcaaatcccacttctctgcagttactccaaggtttaagctgtgggaaagtcactcaggctatgtggcgggggccagctttgcttctgctgctgtactgctgtgtcaacacaccacttctctgtgcctctgtaaattgatataacaacggcaacaacaaaaccgactgccaagtcagtatgtgatttacaaatatgtccagagaccattcagtatcagtatcagccagcagataaagcacagggcttagagtcagagagcctggggtcttattccagctctaccacttttatcagttgtgtgatcctaggcaagtgacttaaaccttctgtgtctcaatttccctatctgtgaaaaatgggtctaaagttagtacttactgcagaggttgatggggggattaaatgatgtgcaaaatgcctggaacagtgcatggtccatggcaagccctggattcacattggcttttatgttacgttagttccagactttgctaaatcaggcacttctaaaaccagccagttctgctgctgctgctcatggccaggcttcaggatccttaggaacaatctctgctgtttagcagtcctccacgtccaccactccatggaagtagctgtcatcagagctgccaatgacttccctgtgaccatctccaagaagttcttagcgctctgatcctttctgagtcatctgccactttggatatcactccttggcatctttttctcactttgactcttaaagaaatatcctgtacctactgaacttctttccctatgtttttattttatgtgtttgctctctgcctccccacatccccaactccctactccacactggaagtgtcagtacttggcacatcg

SEQ ID NO: 10914 - DNA, 40000 bp, Homo sapiens
  misc_feature (1)...(40000): n = A,T,C or G, or insertion/deletion polymorphism (see Tables 1-2)
gggcaaataaactcccttgggcctcttttataaggacactaatcccatacataagggcagagccctcttgacctaattacctcctaaattccccacctcttcttaatactaccatagtggcaattgagtttcaacatatgagttgttgagggacacaaatattcaagccatagcagcatgctttttagaaaaaaacagagatgtgccgggggcattgtcgatactcaactctttcttcattttagccagggaagcagaatcatcagcaccatatggattcactttttccccctgactgatggttcttttgcttcccacacaggcacatttaggctggaaagaatctgtaatgtgggaggtctttattactaaaaattaagttcagtaaaatgcagatgtctttatggtgcccacaaataaactgtctttgtaataaatagccaactggagaaaatatatttacgcatctgtattagaacgaacggcagatttaaaactgaagatctgtttaagatcaccacaattgagggaaatacaagaaaacaagccaccagaatttttaagaatgaggttataaaacaaaagtgctggggaatccatatgttactaaaaaaataattacacaattttttaaataaaatatcaatgcatgacattaacagtcttattgtttgccctaataaaatcactttcttgcaaaactattatagaatattttcatgtccctaatctagacttttatgttactgtattaaatgtawgaaaataagcagttattatgatgaatatatactttattaagattaaaatactaagatattttatctaccttttaattttctctgacagaatgttaatatttttaaggtaaacgttttatttttaaaaaggtgtcagcaaggaaacatttttgtctatgattcctttaaaattactatttacttaagaacaatatataaattcagacctttttatcaaattactccctcatacctcatcaacagaattaactatagttaaatcaatcaacccaaatagagtgttaatacagttaaaaacactaaaataactgtattagttcattctcacactgctataaagaactacctgagactgggtaatctataaagaaaagaggtttaattgattcacagtctgcaggctgaacaggaagcgtggctgggaggcctcaggaaacttacaatcatggtggaaggcaaaggggaagcaagcatgtcttgccatggtggagcaggaggaagagaaagagaagggagaagtgccacacacctttaaaggatcagatctcgtgaaaactcactatcacgagaacagcaagggggaaatctgcccccatgatcccatcacctcccaccaggcctcttctccaattgtacatgagatttgagcagggatacgaatccaaaccatatctgtaacaatgttatgcttcagtgccttaagttcctctgttaatagtctttactgctttagaaacaaactgtagacaactataagcaatctaatatataaggtttacaaagatatttttaaaagggtagataaatgtgacagtcattcatccttatatccctcaactcctttcctccccttataattcctaagaaattataaccaactcaggactgttacattcttacctttttcttgctttctgttcttaccccctattttaggctagcacactgtcacataaactatggcatatttgaccatgctttgggaaatacctgcaatattgattgtagtggacctagattattcaaatattaactgcttttcaaaagatattaggatgctaaatttccaaaatattcttccaccttgagcctatatgttgcctcattttcatagctttaccatattgtagggagctgaatctttttactctatctattgcctgctctttgctgctggtggtaatgtcttatctacagttacaggaactgtattaggacttttctggttgcaagttataaaaaaaaatacacaatagaactcagcttaagaaagtttaattttattgctccatagtggaagaaaagatacagaaataattcacagaacagaatggagggttctaggaaccaataccttagtccttcagctctctatctctcatctctgttcagctttattctttttaactgaagacatgccttctctcagatggcaggaaaaatagcagccagcagcaccaacttgacatcttccaggcttggcaacccaacagtaaagagagttactctcttccaacttccttatgctgtattcatttcagggaagaattataattgtccttgcttgcatggtctcactctggattaagtactttgtccaagtgaatgggctgaatgatttaccaggccagggggaaatgtggcctgtgacaagaaggaaaatgggagaaaatatgcttgaggtcaggcgaagtggctcacgcctgtaatccctgcactttgggaggttgaggcaggtttcagaccagcctgggcaacatagtgaaaccccatctttacaaaaaataccaaaattagcccggcgtggtggtatgcacctggcgggaggatctgcttgagcctgaggctgcagtgagctgtgattgcaccactgcattccagccggggaggcagagtgagaccctgtctcagaaaaaaaaaacaaaacaaaacaaaactatatatatatatatatatatatatatatatatatatatatatatatatatatttgcttgacatatataagcatatatatgcttgacagccaaaaccatagtactgctgtccacagtaagaattagagtgctgtactgtggatactcgttttaaaacttagacaagccaggtgcggtagctcacgcctgtaatcccagcactttgggaggccgaggccggaggattgcctgaggtcatgagttcaagaccaggctggccaacatggtgaaaccctgtctctattaaaaatacaaaaaattagccaggcgtggtggcacatgtctgtaatcccagctacttgggaggctgaggcaggagaattgcttgaacctgggaggtggaggttgcaatgagccaaggtcatgccattgcatcccagcctggggaacggagcgagactctgtctccaaaaatatatataaataaataaataaaacttagacaaatcatctaagccttttaatatttttcatttctatgaaagaagtagtaaaatataatgatgcattaattaccacccctggggtgggtaggagggggaattcagatgattgggttaatcaagaggaagagaactgaagatgccttcaatggaagtattatatatatgtgaaagtaactactttctttcacgtaaatataattaacactaaacaatgctaacaaaaatagtcaacaccaaatcaccatagcaataaatttaatatttataagataaaggaaaacacacacacacaattgcctcatcctttggtgtatgttgtgcttccagatctggctaacaaggatatactttctttctgaagctataattaatatgtatgaaatccatgcaatagcatgaaaaatgtaaatgatgcaatgttaaggaaaaacagcagaatgtaaaatgtattttcttgtgaatacaagaatgcaaaaaagcatgtatataaaaaaactggatgggatttctcaaatgtgataacactgttatatcaaggcaacatgggatttttatttttattttttgctgccatctaaacttcctggaatatttttatgccacttttaccatttggggaaaaagggtgtttttgtcacactgggtagaacttctttaaaaatgactaatatagcaagtgctctaatctgtctgcatccaggtcttgcataatagacagtctattaattatactgctgacaggctatttcaaaccagctccatgtttgatgttccatggcagagattcactcttatggtaataatgagagaacatgtgcagacagaacaacaacaccggctaggcgcggtggctcacacctgtaatcccagcactttgggaggccaaggcgggggggtcacgaggtcaggagatcgagaccatcctggctaatacgatgaaaccccatctctactaaaaatacaaaaaattagccaggcgtggtggcgggcgcctgtagtcccagctactcaggaggatgaggcaggagaatggcgtgaaccccggaggcagagcttgcggtgagcagagatcgcgccactgcactccagcctgggcgacagagggagactccatctcaaaaaaaaaaaaaaaaaaaaaaaaagactgtatacaaatgggcaagacacatctggatatgtgatttctattgttgaatactaaataatgtgttaagcagggagaaattggcaaactttgtagaccagttatagacacttttgttaatttgacattggttttaaactgtatttgagttgttacattttaccttatagcccctaaacaaagctgaaaggatggcaatgatgcttaaggaaccctgaagcaagagcattggcaaataactggtaaggagtttaccctaagaaagcagaaatttgaaaggactcctgaatacttggaactactttgaggaagacgctgccatgatggagaaataggtccctctaatataaagctggcaataatgcaaaacagcatggtcatcaccattttcctttgccttctgttcaaatcagaatctatagtagagaatgagattcattcactcattcattcttcaggtaattattgaatctcattttggaatgttgggtcctcaacatctagagatacatggtgaacagaagtcagtgtctgctctccaggggtttaccatccaattaagaagatggtcaagcaaacaggccatttcaacacagtgtaatacatgctactgaaagagtgtacaaacacattcaaagttacaggcaatgttatctaagaaaggttttatgttgccatgttgcacagctaccacactcttcagggtaagtgatatgcccttgcaagtataccaaatgactttccaaaatttggatatctgaaaaataactaaccgggctaatagaaaatgcaccttcaataatttcagatatttgaaacatcatcaaatatctcagcattcacaagaataatgaccaaccttgttttggtacatgcttgagcctcacaattcctcagaggcacaacatgctttgttcatagcaatcccttccttcctacataaaatgaaaacatcacaccatttaactcttcaaaattattgaaagcaaccattttaagctgctggttagtatgaaatatttggtatcttgccaacttcctttttctttttcttaacagtatcccagaaataaagcacaggaactcaaaaggaataaaaacaactaatatcagatagtagttcctcctgccaatcacagcaatcatttccattttttctctggatttttttaattgactaaatattctcttccctgttgaagccagttactcacatgaatccacatgaacttatattctatttagtttttctgcattttactgcaagtaaaggacctaattccaagtattaaaaatcccatcttcctctgctttgtttaaagttgtttttaaaatgccagtagtgctgtcaggctacccctccagttcaggaaaaaaaggatattttttgtatggagcactccaagcacatcagctgcatctacactgcaatctaaggctgaagtattaaaaactcaagaaggcctttcactagcttaggaaaggatcagagaattcaatttctccacacaactccctcatccagttttctccagaggatttgtaactagatccctacacagctgagaaaagagaactagcttatatatctaggagtatagttgggcacatgcaaaaacgcaaatatggaaaacaattttagtgtcttaaaattaaatgaagtcagggtaaacaaagataatacttaataactttttaaaaataataataaatttactttggtctctaacaacaatttaaaggtcatataagtaacctgtatatttttcttatatctcttaacttttccttaatgcccattaacatgttgaactgtatgttaacagcaagacacaggattttagaaaaaaattggcatgccagaaagcatgttaagcttaccagctctgccagattatgttgtcataagaaaatactttatgggcccagcatgcttctactgtgctactctgctacatagaaaatactttaaagaaaatgtaaattggattaaaatatactgtaacaggccaaaaattaaattaaatatcattgctttctcagtaggtttttaaaatttcagttcttgagtattatttactcctaaaagctgaaaattatgtgctaatttatctaattgcctttaacttttattttgaataattttagacttatagaaaagtggcaaacattgtacagataattctcatatgcccttcactcagatttctctaatgttaatatctaatagagaaatagaattttttattttatgtaaatacaaagtggtatttgcaaatgtagtgtacttgtatttgtaaaatgcacatgtatttgttaagtataaaatataacatagtaaaattattgaaaccacgaaattataatacaattgaccaatctacgaagtttattctgatttcttccattttcccactaacttccttcttctggtccaggatctcacattgcatttagttgtcatgtccctagtttccaatcagtgacagttcctcagtttttcttttatctttgtcttccatracattgacacttttgataaatactagtcagttcttttgtgcaatgtctcttaatttgagtttgcctgatatttctcatgataaattgaggttatgtgtttttggcaagcataccattgaagcaacattgtgcttttgccagtacatcatgttacggggtacacatcaatatattttattactggtaatgttaaatgtgatcttttagttaaggtagtatctgccaggtttctccattataaagtaactttattttctttgtaattaataagcacattgtgggagatactttgagactatgaaaaaccctgtttgtaatcatacttttgtcgagcaactttagttatcggtagatggttcttgcctgcaacaatgattgctttggtgtttgcctaatggtgactttccataatatttttaacattttttctacatttattcatttaaattctacttgtaaagaagagttgtgccttctcccccttcatttatttatttgattatttatatcagtatgaatgtatggatgtttattttaggaatcctattggttataaccaaaaactaactttttttttttttggctcaaattttcccagattggtctattggcgatctttcaagttgatttctgtgtccttccaaaaatgcctgtattgtcttttgaacaattctttatttccttattttctggtgctagaagatgttctagactaattttctactttccctgccccagacacagaagcaatcattttccaaggagccttggtttcttttaatggagaatgatatttagaaaccaagatctgggctgggcatggtggctcacacctgtaatcccagcactttgggaggccaaggcaggcagatcacatgaggtcaggagttctagaccatcctggccaacatggcaaaaccccatgtctactaaaaatacaaaaaaattagccaggtgtggtggtgcgcacctgtaatcccagctacttgggaggctgaggcaagagactcacttgaacttgggaggcagaggttgcagtgagccaagattgtgtcactgtactccagcctgggccacagagtgagactccatctcacaaaaataaagaaagaaagaaagaaagaaaagaaaggaaaagaaaagaaaccaatatctgtttcttaggtatgcccaatgttcctgggtcgtcatttcttccaggtcttctcagcccagaaagacaggaaatatgtgtgtatattaacatactctcacacgtctgcatttatttctaaaaatatctgtgtgtgtatgtgtatataaaaccatgaatttatactgataccttccattttaatccaacacaaagttcattcttagccttcccctctttccttatttgtaaatttttctctgacagtgggaaacctggctctcattatccacaatatattttcttatttgttcaatcatagtaatgtgtacacataaagtactttaagaattgcaaacccatctccccaagaaacaaatttactaattagagtacaatatttctatccagatttttggtctttcatcttacagtttatagtcaaaatactattttccaaggatactcaagttagttctttccttccccacttacttcagtgtgattatgttattcatttaatgcacttagtttcatctaccattcttcatattccatttggggttcccccacatcctgggtgattttaattatttatttggggaggtggatatatgggctgttaccgtgtttatgatagtcagagctatacagaaagatgtacagtcccagcatggtggctcaggcctgtaatcccagtgctttgggaggcctgggcaggaggatcactcgagctcatgagttcaagaccagcctgaacaacatagtaacacccccacctctacaaaaaattttaaaaattagccaggcaggccaggcacggtggctcatgactgtaatcccaacacctggggaggccaaagcaggtggatcacctgaggtcaggagttgaagaccagcctggccaacatggtgaaacaccatctctactaagaatacaaaaattagctgggcatggtggcacgcacctgtagtcccagctactcaggaggctgaggcaggagaattgcttgaacccaggaggcgggggttgcagtaagccgcgattgcrccactgcacttcagcccggcaatggagcgagactccgtctcaaaaaaaaaaaaaaaaattagccaggtgtggtggtgcgtacctgtagtcccagctactccgaaggctgaagtgggaggatcgcttgagcctcggggtttgaggctgtagtgagccatcatcatgccactgcattccagcccgggcgacggagccagaccctgtctcaaaaacaaaacagagcaaaaacaaaagatctatacagagaagtggcactctcccctcattcttcctacacattctttccgccccatctttttctgctccctgtaggtaacctatctcattgtttctggtttatccctcttgcattcctttttcaaaagtgagcagataaatgtttattttcttaaaaccccctttttacatgaagtactttatctttttcagtgtttttcttctcttgcagtttttgtttttcagtgttatcctgactattcttgcatgtttgtttttccacatgaactttgtgtcaatttatacaactccataaaaaagcttcttggtattttcattgagattgcattaaatctataaattgatttaaggataactgacatgtttataatattgacttatcttacccaagaatagagattgtctttccatttgcacaagtctacttttctggctttcaggagtgttttaaattgttcacatctaggttttgcatatttcatattatgtttattcctgagtttttaatcttctttattgctattaaaatgggatttttctgtaattttatggactgtaactggttattggttatgtatatgaaggctattcatttttgacattttgccttatattttaaatgttaaatagttaactttggtgactaaatagaggttatcctttgtgattttaataaaaggacattaagagtgatatcatttcggccgggcgcggtggctcacgcctgtaatcccagcactttgggaggccgaggcgggcggatcacgaggtcaggagatcgagaccatcctggctaacacggtgaaaccccatctctactaaaaatacaaaaaattagccgggcgtggtagcgggcgcctgtagtcccagctacttgggaggctgaggcaggagaatggcgtgaaccccggaggcggagcttgcagtgagccgagattgcgccactgcactccagcctgggcgacagagcgagactccatcttaaaaaaaaaaaaaaaagagtgatatcatttcttaccaccatagtttctcttaatctagtatctatagtacataatgcaggcctgaaagtgctagattttgaggagcttttcccctcaatgtatatgtcagcaaaaaataatgccaaatgacagggttctattcaaatgaagcccttatttaatatttctaaaaatatattgtccacaaaaatcatagccaaagtgaccagtccttgggggaagtcaaaaaagcctgcattttgtggaaagtgagatataaatatgttgaatttgaggtgccagcaaaatatacgagtgaaaacgttctggggcattttgagatgcagcactagagcttggagagatagtagggattaattttttaagtccatatatgagtgatgattgaagacaatatatagaatgtgacccctaaggaagaaaagaaagaactgagctgaggcctggaccttggagaacacccagttttaggacaccatgaggaggtaggaggagcactagaataaggaacatcacagagaccaagaaagaagaaaggtccagaaagggaaaatgagcttctctggcaaagacaacagtagctgcaaaggaaatgaggcctgagtcaatgccattaggtgcaggtggttctagtgttttccaaagtgtggtccccagcattctagcttcttctggatgataatatgtattattccaaaaaaagttgcagtggtcaaaaagtttggaaaacactgtattaatcaaagtcaaacaggttacctcactacagggcttctcagggctgttagcatgctgctgtggattgcaaatttctatgaacaaggatagtatgcagatttctataaatttctttaaccaatttcacctgaagtactttgaccaagctcgtttttctcctaggcatttctcaagatgagatgtatcatggaatacactttggaaattttagagcacactgtaaactaatcttccttagctttctctctgccttcaaagtcaaacatagaagctcagaatcctattttattttatgggaaacagcactttctaactctggaagattgctggtactcctggcattttgcacagttccagctgaacagaatgctgaaaatcctctaaagcaggaactgtgagctggagactgagatggggacagcaagaggatgcgctgaggaggagggctctgtggagggcagaggggaagaacaaggagccatttgagtcaagggtcccagagaatttggaatctcaaatgcaatttggcagcatcagttcccaagagatctgacccaaaagggccagacgaccttgtggttctcagaagcaaaccctcaaccctaggagtagggaagctgtaggctatttccagaaagaagggagcagctcatctggactgaccctgcagttggacagcaatacagcaggccattaaggtggagagatgagggccaactgggattccatctctctaacagaaaacattctaaactttgggggaaatcctggaaagttcaaagtaaaattttctaaaatgaaaaattactcccgtaaagatactttatcagcaaaaaagtgctttttgttttataaacaccttaaaagaaattatagtgatagtggaagccagatagcagaattggatggacttatcataaatgtgttcagtgagattcaacattcattcaaatagaagtcatgtctgcaaaaagaagtatttttgcatgatgttttgaataaagttaaagggatgacagttgttttattacccaatactaatgtaagattcattttttaagacytaagggtattgcacagtctagagataagtggacatataaatatagttggttgtatcagttcctgcctcatgaaactccaactagcagtaggccctaaatttgctcaagatctgagcaagaaagcctggcagcatattggaaactccattcccatcagcatgtagggtctggaactagccatgttaacctaagtcttgtatccagggtacccatatttccaaccctgaactatgtcattcctgctttctatcttcctcatgcatgcctaatctgtattacaggacttctttcccaatttatcttgtaggatatacatcttccctacattcaagccttcttgaccagggtcttgacagtcacccaagtccttgtcagctgctatcttccacccctactctgacccctccacccctgctacctggtagctagagtcttgctttgaactaaacagaatttcacagccactattcttccattttacttaaattatcaccacttaawgaagatccatgccatgaggcttcactaagaaaatctgacattttaagtatcagtattaattgaatagagtggaagttcacgctagccccttggacactaggtttgaagtgttgacaattcccagacattcatcttagccctgctttgtgcccaactttgtcccttttcccaataacctgcccagaatgaggtctcaaaatatctttttttaaagttaatgacttactcttttctattgtttttaatttcttttttgaagtcttcaagtatataaagattttgtaggccaggtgtggtggcttacgcctgtaatcccagcactttgggaggcctaggcaggtggatcacctgaggtcaggagtttgagaccagcctggccaacatggcgaaaccccctctctactgaaaatacaaaaattagctgggcgtggtggcagtcgcctgtaatcccagctacttgggaggctgaggcaggagaatcacttaaacctgggaggcagaggttgcagtgagccgagatcgtgccattgcactccagcctgggcaacaagaacgagactccatctcaaaaaaaaaaaaagattttgtaatatctaactaaccaatacttatattaattgaagctcttgaaatataatcatgctatttgatatatctgctaactctcactcatagtagattatttccttgtgtcttttgtaagtttttacctgctctgcttgtgtatggaatttatgtgcaactagggtgtaagaggtaaccctccagaaagatattgcatttgcctccaccaagcaccctggaggtttaccagcctgaccttgattactttttttaggttaatttctcagtgtgggagagttcctgggttctacaagtggtgtaagttcaaatgacaaatgagggcttgtggttacgaattttaagaggatactattttggtccatgtggagcatacatgaaaatcaagctttcttgttaccttcctgtgttggtagacatttttctgttagctagctctttttttttttgaggtcagaaccttttgagaggtctagcagtatgtgggaatctaacctgtcactggcacaaggtcttgcatgggagagtaaacccaaggctctaggttaatgagaccaacaaatccttcaggcaaccataacatcatcttccccggcaccactttggttttcaattccttcttcatttttggtgcatggatatgtttgattttaccctaagtttccaaatgatttttcttagtcatttttgttttgttttgttttgttactgagagagagtctcgctctatcacccaggctggagttcagtggtgtgaactcagctcactgcaacctccgcctyctgggttcaaatgattctcctgcctcagcctcccgagtagttgggactacaggcacccgccaccacacccagctaatttttgkatttttagtagagatgaggttttgccacgttggccaggctggtctcgaactcctgacctcaggtgatccacctgccttggcctcccaaaatgctgggattacaggtgtgagccactgctccaggccttccaaattatttacaatgggagagtttttcaggttatttaatccacagtttttctataaatagaaatgccagtgtgtctttttaataatgaaaaggtcaactgtcagtataattatacattattcaatatgtcttttacataaacaaaagtaccttcaacagaaataatgcaagaccttactaaagaatatttcagagaacatctcactgtagtttatacatttactataaaacaaaagacctggatatattttctgctctgtgaagtattaataataaaatacaattcatttcctattgtctttttccattttctttgcatatttactaccactcttgtttggaccattgactcatgtcaggacttacgaaacagactcttaattgatttcctgtttccagtcttgcccaactccaaatcatgccacaggtaaccctgagattaatcttgctaaaatgctactcttgtggtaacatgttttctgcatatcagatacttctgtgcacaacttaaacatttactcattatccctttgctctccttgttaattcttgcatttgctcataattttcctgtcatctagttttcccttctaccttctctctgcctttccaactcccacctattcttaaaggctctgcataaatcctccatcttgaaaagatctctcacctaccccactggaagcaatcttgccctcttcagcacacctttagtgtctagtatctgacacatccatttaatatttatcataatgaatacagagaacccccaattttataaacaggatgtgttccaaaagcacgtttgtaaattggctgcttgaaatgctaaataccatttccctcagaagtcccattataaatgctgcttaaatttcagagctagctcacaaaagtctattcagcctttgatgaaacagaaccaaagtactgatcataccagttcaagaatctgtggatcaaactttatgctgtcaaggaaagaacaaaaggatatagtaaagtattccccccttttgataaggcaataatttctatgtttgagcaaatttctgcttaatctgacaaatgcttactaaacaattacttagtgccaattactgttctcggtcctgtagaaatacaatgaacaggacaaacacatccctcggcctcatggaaatcctttgtcactaccctttcaggtacacaatcttccccgatcccactgtggctttcttccagtgcccaaatcttctgacctggggactgggttgctggaagtagtaccattcaccaattggaattgtcagggaaagaatggtttggtggggttttgttgttttgtggggaatggaggtgtcaattgaagtggtttctgtttttcttatatttgcttgttgtggggtgcaggggagatgatgtgtcagggagaaaaaacatgtattctatttggaacttaaactttggaatggaaaacatcagagtgaggcaggtatcaggaggaaagtggctgtggaggaatgcagcacccaggggaaccctgcagagggcgggggaaagcaagcatccttattgtcatcatcatcagaagccacatccaatatacaaaagtggggtgtgacctgaaggaagcagattcctcctgcaggacccgggagataccccaaatactgtgctggtatccaccactgagagacccacagacagttcacatcacaggactctgtgcagacaacccccattaccagcccagagcctggcagacttgctaggtggctagatccggaagagagacaacaatcactacagcttggctctcgggaagccacatccataggaaaagggggagagtactacatcaagggaacaccccatgaggcaaaagaatctgaacaacagccttcagccctagaccttccctctgacagagactacccgaatgagaaggaaccagaaaaccaactctggtaatatgaaaaaatgaagttatttaacacccacaaaaaatcacactagctcaccagcaacggacccaaaccaagaagaaatccccgatttacctgaaaaagaattcaggaggttagttattaagctaataagggagacaacagagaaaggcgaagcacggtgcaaggaaatccaaaaaaatgacacaagaggtgaagggagaaatattcaaggaaatagataacataaataaaaaacaatcaaaacttcaggaaacaatagacacacttatagaaatgcaaaatgctggccgggagtggtggctcacgcctgtaatcttagcactttgggaggcgggcggatcccctgaggtcaggagtttgagaccagcctgrccaacatggtgaaaccctgtctctactaaaaaaaaatacaaaaattagccaggcaaggtggtgtgcacctgtaatcccagctacttggggagctgaggcaggagaattgcttgaacctgggaggtagaggttgcagtgagctgagattgtacaactgcactccagcctgggtgacagagtgagactgtcttaaaaaaaaaaaaaaaaagaaatgcaaaatgytttggaaaatctcagcaatagaatcgaacaagtagaagaaagacattcagagctcgaagacaaggtcttctaattaacccaatccaacaaagacaaagaaaaaagaataagaaaatacgaacaaagcctccaagaagtctgggattatgttaagtggcaaaacctaaggataatcagtgttcttgagaagaagagaaatctaaaagtttggaaaacatatttggaggaataataraggaaaatttccccagccttcatagagacctagacacccaaatacaagaagcacaargaacatctgagaaatttatcacgaaaagaccatcacctaagtacattgtcatcaggttacctaaagttaagatgaaggaaagaatcttaagagctgtgagacaaaagcaccaggtaccctatcaggttaacagcagtttctcagcagaaacctacaagctagaagggaatggggccctatctacagcctcctcaaacaaaacaattatcagccaagaattttgtatccagcaaaactaagcttcatgcacgaaggaaagatagtctttttcagacaaatgctgagagaattcgccactaccgagccaccactacaagaactgctaaaaggagttctaaatcttgaaacaaatcctggaaacacatcagaacagaatctctttaaagcataaatctcacaggacctataaaacaaaaatacaatttaaaaaactttggaatgtttggaggtcactaggtagaggatatgtagtgtgaacaaatgtaaaggaatcctgtcctagagttggtggggtgaagtaacctggaccagagctacaggcttggggtgatcagtgtaccaaggtaatctttctcatcatgggtatgaataagatcacttttgtaactgtgggttgcttgaaggtttacattttgaaaagtgctaaattcactatatagccttgtaccttattttggttttttccttgcagccattttataactgcaactagttttttcccttagggcaagaaactttccaatccagttttataccccataaagactckcacactatatggattcaataaatattcgtcgattgttccactgtgtcartgttacattctgagacacatcaataatttccctagggttaataaaagtaattgtaaacagttggatactctgatgtaccacaggttggctaaatatagcaataatagctaccacatttgctaaaataacagctaagctgctgtatacaatttgggattaaagactcattaaataataacacaattctttccagccaaactaccttactctttattctaagccaggcattgaatattccagctctcatgtttctggtgactccatttatcttgtctgttaagaccttatcaccacattgccacattctaccttaacctctctaaagtcccctctttgaaggtcttcccaaatgccctgggcctaggttgtcattcccacccagtatacaatactctgtttccttaattttatctatctaacccatcttcccaaccagatctagcaggaatcttttaaaccttttagtatcctcttgactagcacaatgtggtaaaataataggtattccataactcattattgtcgatgatgattgaaggataggcaccaaataagtcccaagatcatagactgttagtgttggaaggaaaccttgggacttcaatgatctgagcttaacacctgatagacattgtatgtttgacctcaaattgaccacataggctaatcaaaggttcccaatcaggagtcccaagacggctgctgaaacgagggcctccagtgatgaagctggtcagaaaaactagtctaatccaatgttattttgaaaatgaagaaacatagttgcaaagagctgcaattatttttcctaggtcacgtgactggttagtgatagagtctagaaacctagtttactgacctctaccttgaagatccttacacaacaccaaagtatttggagactgatacttcagccatattacctgtataaaagacatacatacttgacaacttttcctttctgctttcaataatgatattttgagttcaaaatccttttaataattaaactagacagcgactggataaacattgttctttgggttaaccaaaataactttgtacttaaaaatactttttatggttatcaccactgaggcttaactacaaataaagtgaagtaaaagaaagcttccataatcaaattgcttccacaattctatccttgytatgacctccaacaaggacaaagatgctgtgaantactaaatcctccaaaatagttctttaatgtaggtatgtcttctttgatgttgtaaaattatcatgcttcattttgttttgaacattctagaaagaattcaactgtcttaatatagaagatgctttttacatggagtatgctatgataccctctcaaaaagagagtttattaagtaattgagcatacttagctttcattgcatgctcacgaagttctggtaatgggaataatcactgccaaaataaaaagctatttatttcagatctattcatgcttttaagattttgggggtactatctcaattttttaaatgacatttartatatgaattagctttattgctctctgctttcccccatcttttaaactaacaaaaaaatatgaattttaatttttagacaatttattcagccttgctattgttatatctccagggactaaatttacattttgaaaaaataccatgatgtgcaaatgtgcataccctattcagccaacatatcatagatactgtatagtaacatctgggaatattaaactttgcctttactggcaacccaattggcatcttgaatttacagtgmagatgttttatactgatgtgttttggaaatctttgaagtattctcaagacagtattctgaggtttctgcagtggtccacttgagccttttgaagttccctatacaataggatacatacatatattttccaaaacatgttttagtgggaaaagaagaaaagttcaagttggcggtataataagcttccccgagttgtctgaaccgaattcctttttggcactattgttttggcagtcagcaagctttatgagaccagtctgataaaaccgttcctcttcccagactgctttgtagatgctaaatcattttaatgcctcatatttatgaagcactcatatttctaaagtacagatataaaattttaaatttacctctgagcatctgatatttcagctgtgcyttatccaagggtgataccccacaatggtggtcactgcctgtgtgtgaggaaatgctaatgagcccactgtgaaatgatgagtccttccacagtgttcgccctgagcactgtgctttcattcacagcctcagccacttctgacggtgcttgctcctgtttgcaccactagctcctccactggagcacagtgtggcttttgtttaaaaagacctgcctcggccatctgttgctggtggttgccagtggtccactacagtgctgcaggcttacaccatggatttcagaacatttctaaagcacagtttttatctcccctatttcagtgtggtgtcgttagcacatagaaagcacatagctctggagacaacacatgttcccagatgtaactcccagctccatcacttactagctgtaaatctttggaaaaaatctctttgactctcagttttccttctcctctggtggagtggcgataccttcctaattagaccgtggtgaggatgaaatacaacaatgggtgtagaacacttttcatatgtcagacctctgttacagtgtgcagttgccactctctgaactcccttggattagccaaatgttaaaatgcacactgcttcaattcttttttaatgtaaaatacacataacataaaatttgtcattttaatcattttyaagtgttcagtgtcattaaacacattcacattgttgtgttaccatcaccaccatccatctctttttcatcatcccaaactgaaacccggggcccattaaacactgattccccattcctcccttgtcccagcccctggtaactaccattctaatttctgtctttatgaatgtgactattcttaggtatgtcgtataagtggaatcatataatatttgtcctttctcttcaattcttataagttagctatgattcaggaattattgattaccttgccttggcactaaattattaacattgccatatatataatgtattcaagctgttagtatctgtgtgtgtatgtacttactatccttctaatgggatattagatggcaggatgatgatggtggtggtggtggtgtatcttccactgttatctccccagcatcctcctttgcatcctatggagcaataatttcactattagcaaaatcttctcatcctctgtctcttcacaagatctgcctcacctcttgcctatggagaacttaagaacattctacacccccagcaagctactgcagccctctggagtggaggctattcattttgcatctcccatattcagtgggcccagaggcaatattggcattgtcttaatatttctgtttttaaatgcattacttttttatctttatgcaaaaactcttcatcctttaggtatcttgtaaactgagattagctaataaaagttgctaaggcattggatgtggggtatgagaaaaaaagtgatgtgaatcatgatgcccaggttttaggctttagaaggatggagttactactgactaaaatagaactgaaaaggtggtttgaagtagaaggaatacatggagctatgtcaggacatgttaaatttgagatactcagatgctcatcagatagccaatgggagatggcaactaggcagcctgggggtcagcgaagaggtaaaggaatttgaaattcatcagcctctagatggtaaagtcgtkaagttaaatgagatcatgtagggaataagtgtagacaggaaagaggagagggccaagaatggacacgccaacatttccaggtcagccagaggaaactgaaaagaaaaggccagaaaagtgggaggaaatgcaagctagaacggtatcctggaagacaggaaaagaaagtttttgaaggaagaaggtcatcaattgtcgaatgttgctgacaggtcaagaaagatgaggactgaaaaatgtccattgggtttggaaatccggatatcactgatgaccttaaaaagagcagttttagtgcagtggtgggagtgaaaacctgccttaagtgggtccatgagagacttatggagagaaattggagacagctagtataaacaactaatttaaagagttttgcaggaaagggacagagaaaaaagtgtgcttcttggaggaggagggagggccatgagaggttttctcatatgggaggaatagcagcagcatgattgtatgctgatgggaatggggtcatagagaggaggaagagctgccccagcagcagccttgcattgaagggcatgacactagcattcaggcaaagggattggcctttgctaggagcatggcggtttttccataagtaatgtaagaaaaggtagtgcatgtgggcacagatactggtagataagtagaaatgccagggagagcttatgaaagttctcttgtaattccgccaagtgtcttggtgaagcaaaatcatcagctgatagtgatgaaggctaaggaagtgatggaagtttgagaagagagaaggtacaaaatattctagtcacttaaagcagtagaactccagatatattctgcagaccagtgttttttgttttttkttttttttttgcaaattatttgttatctttccatgaaaagatgagttcagaaattaagaatatgtatttagaagattccgtagcaactggacagagtaaaattagagacccatatttttatgtctttatttcatttttgttgtagcccatttttgctgtaatttaccaaagtattataccaagatggatttaaaattataagaagcttgtctctctcactatggataatttgagaaatgctggtttaaagatggacctaagcaaatataggataatttctgggaagcattaaaggcccagtagatgttagtaatcttaaatttgaaatagtcaacatagtcatttttgtcttgtcttattcaatggcacagatcaatttttattaggagagtgggatttaagcaaggttttagtttctccaggtgagtatggtaaagggagaaaggacaagggtgtcagagtgtagcaaggattcagttataacagtggtttccaacccttttggcatcagggaccggtttcttgaaagacaatttttccaggaacagggcctgagggtgggtgggggagacaatttttccagcagggagagctggggagggggaagggaagtagggaggatgggcgtggtggtttcgggatgaagctgttccacctcagatcatcaggcattagttagattctcagaaggagcaccataacctagattccttgcacatgcagttcacaatagggttccagctcctatgagaatctaacgctgctgcagatttgacaggaggcagagctcaggcagcagtgctggctcacctcctgctgtgtggcccagtaccagtctgaggcccaagggctggggacccctgagttataaagaacgatattatttgccaaaactcaacaaatgtaaacttaagatttgtgcattccttcataagtacattttacatcaaaagaagaaaactataaacaaatattgaacttgatatgcatgctgaaatatttagggcgaatatacggaatctgtgatttactttgaaatatatttatttatttttctcttttatttagaaactgatgtttattttccatcagcattatttccatgttgcttaagtgcctatgcaagaacagcttaagagtttaagaccattcagtggttgcttctacccattcagtggccggagcagtgggagctgcacaccagcctcccgtggcaggctaagcactccaggcttcagtagggaactgctgaataagcacagagggcacctgcatgtgccctcagaccagtctgcaccctcagactgagtagcggagagctcaggagctggcatagtccgttcatcctgaaattcctcgttggtcacagccttttcagcagcagcctggtctttttccatctcttcaggatctctgcagatgtagaaatcaggcatgacatcccacggatgtttgtgggaaatggtgccaggcatgtgcaggactttctgggccagcatccaccatgtcaaaccccctgagtgagctcccttgttgttgcatgggatgacaacttccacatagcacagaggagaatctgtgtgacacaaagcaatggtaggtaggttaacataagatgcctctgtgaggggctggtggtcagcctgggattagtaaccaccagaagccatggctcctggaaggctgcctggatctggttagtgaatattctaggagtgaagcagccagtaacaagagtggctccagtgacagcagccaatatcggcgtgcctttctggccagttttcctggaggatatgacactgacatcagcagggatttcaatgacaacaatggcatgagctgccagcagaaacttctcccaggtcttcttctgatttaggatgtagatgccatcacttttcatatagatgtactgttccatttggaagtcaaggttggtgccacctaagtgggttcctgctgaaaggaacttgaggacgtcctcctccttcattggcaggacatcaagggctctggacattgtgaacgttttcctttaagttatgaagggaatccagaacaacacagtatggatccctctgtgggtagcgcggaaaggcaaaatatatttataaaatgatgaattgsatcaggtgcagtggctcacacctgtaatmccagcacttccggagacctaggcaggcagactgcttgagctcaggagtttgagaccaacctgggcaacctggtgaaaccctgtctctacaaaaaaaaataattagcttggtgtggtggtgtgcacctgtagtcccagctattcgggaggctgaggtgagaggattgcttgagcctgagaggcggaggttgcagggagctgagatcgcacccagaactttactccagcctgggtaacagagttaaatgagtccatctcaaaaaaaaaaaaaaattgatggatggatagagaaatggctacatgaataaatatataataaagcttaatggctgaatttaagtgatggatatatgggtagtcactataaaatctttccattttgctgtttgaaaatttttataacaaatatcaggggaaaaaaatgtcttgaatttttttgtgaccattttatcttctcagccagactattagctccaaagagcaaaggcagttacatctggaaggttatctagttatatttcttatttcacagatgaggaaactaagtcctgaagatactaaatgactttatcaagatcaggtggcaaccgggtgcggtggctcacgcctgtaatcctagcactttgggaggccaagacaggtggatcgtttgagtccaggagttcgagaccagcctggacaacaaggcaaaaccccgtctgtacaaaaaatacaaaaattagccaggcatgatggcactcgcctgtagtcccagctacttgggaggctgaagtgggaagatcacttgacctagagggagcagaggttgtagtgagcaagatcatgccattgcactccagcctgggcaacagtgcaagaccctatctcaaacaaacaaacgaacaacagcagatggcaagttagggacatacttgattccatacttagtttcttctcattacactagggacaactgaagcccataactcaggcctagaggatccatggaagggctcctggaatgcccataaaaccccaaattctgaatgtaaaatttaagtatatgttcaaagatacattttcttttcttttcttttctttttaaggcagtacttttattttttcttacacaatgatgtgttgctggagcctaaagatgcattttctaaggagaaaagtcatagctttcaaaagatccttaagtggtctatgactcaaaaggagttcctgtctctaaaaagttactaggattaactttatttccatcaaattcctccttgaaaatagcgagcacagtgttaagacattcaagaaatatctttaaactgataatattttactgataatccatgttaagctaatatttttaactgattagtgataatggtattcaaaaaagctttttggagttccaagacagattgtaagaacgtgtaatgtgagccactcaagccctttagagtttttaactattttttatcttgtctcacacaaggctgtggtgacccacatgaagttggctaagttctgaaaacatatttatctttgtattttttacttccttgacctttggagatcactgtgttgctcagcaaaatccatccagagctttcccttcttaatttccaagcaaaatagtttattgtaacatccttcaggttcaggctataagttattctgccttgagtatgcacttagcaaggggttgcctccaagtgtagagttaggcctgtgagctctaacctcgtcctctgctctaccattagttagaggaaagccgacttcctgagcattagctttttttaacctatagactaaatttaacatctcctaaggtatcccacaaggttttgttagcatgagtaaattgatatttttaaaatagcttgtagaatatgatacagaacttaaaaatatggtgttacttttggtcaaggaaaaatgtatatgtcttatttgtatactttaagaaaccaaacactaaattatggaagaaataaataatttggcagaatttcttccaacattcagggaaaatattccatatctcgtagaagggtcactttcccgagtgacccttccatctacatgtgcctgagtttgccatccctctatttttatttctcaactcagtcaatgcctaacatttgttatatcacaaaagcatataaacatgaattttcaggtttcttctgaatctcccagagataaactgaatagatacatcagcacagctaaaacaagactgtctgtaaatctgcttgggctgtcaaaagaagaagagaagaagaattgtgcaggaagtaaaagagtcaatgagacaaattaaaggaaataaagaattctggtgtggattgaactgacaagctcaagaacaaaatgataaagacctttaatcacgtcagaaagtctataaagctatgtaagtacaagaactagcaaatgttaataataaaccttatcctattacataagagacaaaatgaactgccaaaactccagaaaggtcagatctatcatatattgtatctgtattgaatgctcgtattgaaaattaattggaagtctaatgaataacttgctttgctaagaaagaatgatctgttaatgcatcggatgatttaaaatttagaagactcctggaaccctatgattgccacaagatcatgcctgaattagcctgctgtgggatgacatacaaggaacaaatgagctgtcccagtggagkccacgctagattaggcaaacagctggtcaactgtgagagagccctagctgagatcagaaaagccatacagtcaagccccgccaaaatcagcaaaactgcccagccaacacagagttcagtccctccataaagaatatccttgatgaggtgggatgaggtgggagcaaagggaaaatgggaagaccagtgaagaggctactacaatatgctatgctaatagctcccaaactacgggatcaatgttaacatcactaaaagagagataacaggccaggagcagtggctcacgcctgtaatcctagcactttggaaagctgaggcaagtggatcactttaggtcaggagttcaaaaccagtctggccaacatggtgaaaccccgtctctactgaaaatacaaaaaaattagccgggcatggtgggaggcacctgtattcccagctacttgggaggctgagacaaaagaattgcctgaaaccaggaggtggaggttgcagtgagctgagatcaccctactgcactccagcctgggcaacagagtgagactccatctcaaaaaaaaaaaaaaaaagagagagagagagagaaaacaggcattatttgcctcctgatgtgatgcatagggaatacacaataccacttagggagtagtcttccctcaaatagaacctgctctgattaagtatccatatctaactacaaatttgcaagaaatataggggacagaaaacatattaaacaatgacgggggttgcaatcgcataatctggaatatggaaaaccctacaggacaaattagctggtttcttcaacaaataaagggtaaatataaggaggggggaatctagactaaaaaatattctatagacaaattggctttaaaatacatatttatgaaggaatcgggaatttggacaatgactggatatttaacaatatcagggaattattaggttttttataaaagatgtgataatggtattgtggttgctttttttgagtccttatagaaatacatactgaaatacttatgaatgaaaagatatatttggattttctcctaaataatgcacctgggagtggggaagtgagtggggtacagtatgaacaaaataagattagacgtgaattggtaattaatgaagctggttgatgggtacgtgggggttcattatatttttctctctacttttgtgtatctttgaatttttccatcaaaaatgttttaaaattttggaagaatatcatttatatacaacatatgacaggaaaaggttcatggataccgctcttcctcatcattgacaattaagctctgctattgcaaaaagcctttctccctttgcagacatgtcctctggagactctccagtgatattattagtgcaatgatccccctgggctagaaagtggctcaaaccaatataagaatgaaattcgattcagcaatcctacttgtgggaatttacccaagagattcaaaatcagtgtgtccaagagatgtctgcactcccatgttcacagcagcactattgatgtagccaagttataaaaccaacctcatcaacagatgaatagataaagaacacgtggtacatatacataatggagtactattcagacttagaaagaatttctgtcgtgtgcaacaacacagatgaaattggaagacatgctaagtgaaataagccagacacagtaagacaaataccgcatgttctcacttatatgtggaatttaaaacattcaaacttatagaagcagagagtagaatggtggttgccagaggctggggtgtggaagaaatggggagataatggtcaatgagtacaaatcctcaattaggaggattaaggggttttttttagctctatgggtacagcatggtgaatatagttaataataatgtattgtacattccaaaatcactaggagtgcatttcaagtgttctcgccacataaaatgataggtatttgaggtgataaatatgttaattagcttgatttaattattctacattatattcattaatcatgaaatcattttgtacccccaaaaaatatatacaattataacttagcaatttgcaataaaaattttttaattaaaaaaaatttttaaagattgaaatgaaagcattgtagcaacacatatgtataatgtgtgctatccactacagtatttattttaatgtacaaatacatactatgtattttatacatagtcactggattactttattatccttctaaaattagacttataaaattatccagattttttattattaaaataaaatgctcatgaccaaaaaacctaaacagtacagaagatgaggaaaaggcaaaaagtaaaagttcttcctctgaacacccagtcagtctcactctcagtggtgtggaatcacttaattaacacattcttgagtatcctttcagaaatgttcaatgcataattgtgtgtgtgctggaaaaagttgtttttaaggaatattgattaagtacaagggtgacctggcttttggttaattttattgtaaataattattagttaatatataatacatctttgttttgcagaaatacttttatattcacaaagaaggcatacagcttaatcacagcccttttgtcatatgattatccatatcattataacatagttatttatgtttgtattgatcatttgaaaatataactgaatttttcaccctaatataaaaaagatacattaaaatgaaaacacattaatgacttaccattgtttctttctttaaacccttcaaattgaaattgtttaatagattttcctttggggctattatgttgctgtcttacatcaacaaagtaatacaaaattttagggtatgaaaagaaaacaagattggtatcttgcttattcttatattatcagcctgaattaaaaattaaaataaaaatggtagatatatgcaataaattttcaaaatatattaaaattatgagggtatttcttttatattacctttctgtatgttttaacgttcatatttaaaaagttgtaagatttgcagcagtaaaacagaaacgattcattctttaaaaaatttaaccactaattttccacagaactacatgattaaagatggctttcaaatgaacattgactacaagtgttttttttttctattaattttttttttttttaccacatttcaagattcatctgaggcttgagttatccattaccaagttgttttttaatgcttccccattggcatgtgcttattttgtttgtgttcttccagtgattactgattcttcaaattactgaaaaagagaagaagaagaaaggcaactcttaccttggtgacatgcagagctggtttcaagggtgcatgatgtgcacagtcacagagtcccacggtcagaagtgtctcatggttggtttaatgctctgcggtcaccatcttgaaattcataataatgttatcttaaacttgttttgtaagtgaagcccaaagaaacattttgtgcacgaacaatatgcacaatatgtttgtatggtgttccttgccacctcatttgcatacagccttctgatgttccatgagcagagaattccagtggacccagcatgggagatcagcaagacggaagcaaatagataaacattttatgggagccactggcttccacagagtgttggtagaacaggcatgtatcaaaaagtggaataaaaaacagttgttaggttttttgcatcatttccagtgttctggtaagaacaaaatacatatgcatgcacaagctacaaaatacaaattatattatatmrgtggttctaaatacagttttgcatttaaaactggcattccataatataaagatgaatggtttttaaaaattatgccaataatttaaatttttaatttttcttcacttagaccagcattaaataamaaacaacaccatgacaagtcaagagaaagactgtggaagcaagaaaaaagctttacctttaagtatctttaatggcacttttccccagatttcaaaacaagggccctgtgttttcattttgcacggggcctcacaaatactgtaaccagtactggttacacattctttgtcttcccccagaatcctcctgcaggaagcatctgtcttctattctaaagtcattagttcacctttgcagctgagtttgggctggagaagggacatctttattttggcaaatggcagaagaactggcaaacagaaatagcaaaaggaatagacatgtttcctgaactctagtatggtaaaatgcttaagctcttacagattaggttttctttgcttcattgtggtttacagctatggatttttcacactgaagggcagttgtcaaataaatatttttccttcatcacttctttacactcaagacttctcagtatcagtaccatcttattatgaattcattttatcttagagctactagaaatgatttaagaccaacaaaaagctgtgttattaatttttattttgtgctttttgtcattgtctctatgaaccattttcagattgtttcaacaaatatttttggagagccagctttatgaggaccactgtgctagacactgaggacacccagtgaaaaagagtccccacctgccaggggtttaggtctaatcatcctccagagggaataaatgggccaaaatatgatggtgagggctggtttatgtggaaagttctttgggttttgttttttttcttcacacaaagtgaactctattctttgcggtacataaatcactccctaatagtgaggtaagtccattaagttaacttagagcaccactggttatattattgctgcaggaaatggcaagtcaggattgcaactgactcattttagaggaagaaatgcccctttgaaaaaaactattgtcctttggagctgaaatttctttctctgatttttaaagccaagtacagaaaggctgtttaggagaatgagactaaaataaaactccctaagtcccaaatctgtgattcagagtaactccactgacaatgatcaaaatcattcctcaagtcgtggcaggctgctgttatccttccagagtccatttatccataagtctctgaggccctttgttttcaacattcactcgctcttcttcattcctaacacctacattaagagtgatcaattgtgatgtgcttctgacaccaggttcttgagagtggtgcttttagctttattagaaaactcttcctgaaaatggtttaatgtatatcttaaattatgtatttaacgtggaaagacaaactttttgagacttgatttcattaaattctcatggatactttattcccaatagttcccagttacatcatatttatctattccccaacatttattctttccttcttccttgcaataatactgatttttagctgagcaacctggaataaaccccaccagaacaaatttagycacctggaataaagacatttcccagctaggtatcaccacatgactaagctttatataatatcccttcctgttagctgcaatgcacatgtaatcgctggaactttagcagccactttggactatgagatggaacatcaaagacaggaaaacaaaaagacagaagtttgaatccctgatgatttcaaagactgcctacttctagactttttttttttttttttgaggcagtcttgctctgtcacccaaactggagtgcagtggcacgatctcagcttactgcaacctctgtctccagggttcaagcaattctcctgcctcagcctcttgagtagctgggactacaagcatgcgccaccacacttggctaattttgtatttttagtagagacaacatggggtttcaccatgttggccaggctggtctcgaactcctgacctcaggtgatctgaccacatgggcctcccaaagtgctgggattataggcttagtcacggcgcccggctgacttatagacttttagatgaaagaaaagtgcaactccatcttgttaaagtcactatattactttttgtgtctctgttacttgcagctaaacctaattctaactgataatttattatagattcctggttcattctgcctagatgaatgcagtctttttttttttttctttgagacggagtcttgctctgtcgcccaggctggagtgcagtggggcgatcttggctcactgcaagctctgcctcccgagttcgcgccattctcctgcctcagcctcctgagtagctgggactacaggcgcccgccaccacgcccggctaattttttgtatttttagtagagacggagtttcaccatgttagccaggatggtctcgatctcctgacctcgtgatccgcccatcttggcctcccaaagagctgggattacaggcgtgagccactgcgccctgctggtgaatgcagtcttaatacttattcttttttctctaccttgaaatttattgctcctttggctagagaatccttaaggaatattatgtttttcacagttcagttaattcatctttgttataaaaatgacttaaacaatataagagcaacaaatattaaagtaatagctgtaaatagcagttattggttttctgtcaatgcatattctaattctgctaagactttgagtttggcttatctagagcactcagcactgagcccacctctggattggtttctggtcctacccatttcaccagcttccacaaatcaatgtttaattagcaaaataaataaattaattaaattgaattaaggaacagagcatctgagtaccacctcaaacctgtatcaagtctgatgggagggagcatcatgtctccttctaagtggaacatgggagagcatgtcctgagatgacattaaggaattgctagaatgggggagccaggagatgatgctgaagttataacctgaagactactggtgtccttccaatccaaatgacaaggtgagaactcgatggacaaatgagttatagagtcaccagcagagagagtctcagacagatgggggaacgccagactgggtctacaaaaacggtttaggacttagtccagcagcagagtaagcgctggtggggagggggcattrccgagtgccttccagacacaagtgagaaggatgttccaatggcctgaaaattaaaaagaagacctaagatcatgagcaaattrctacaaatgtgagaagaacatgctggctgaaacaaaaataaagyacctaaatagataactayataaaaataaaagttttgaagaaagttatggacaaaattaccatgctttaattggtgtaactttttaatttgaatttttgggtacctagatggatgagatgacattaataccaagtgatggtgaccaatataaggtctactgtccattttaaactactcagtttccctgcacagaactatttccatcatgaaaatcctgatgcataaataacattcactttaactcaaagtaaaaaagaccaggagtgttggaaattaaattagtaattgaagagaaccactcccaaacaatctcaaaatatacttgtttgaattactgggcactttagttcctaagagagcaatggtaaaatatatcagccagtggcaatagatatcaagaatttagcaagaaaactaaaacaatagtttgtgactgaactccartgagcctcagataaagtctttactttcccactctctttaatgaggtgggttggaaaacggtttctcaaccctgagagttgaagccagtttagccacagagctccctgttctttcctctttggtcttttccttatttgaaaagggttttcacaatggggtagggtggctcaccaagaacgggagcatctgagcccccaggaagaaggactggaatgcaggagctggcccagtctatcagacatctggagctatacagtctgatttgacagctgtttcagagtgtacagagagctaagcaggcattattcccaatctcatttccttctttactttgaggctaggtacctgtgatgcctttgacaccatggcagacagagtaacaaactctgacttactaacaggaaacataaaaagtatttactgaatattgtctatatgcttggtactcaaaggatgcaaaataatagatacgagtcctgccctatccttatgaggaagttggcaaaacaaggaacgaacacatataatgatctcttcatgtatccctgacctctcttagactgtaagctctatgagagtagggtctgtattcatcatattacaactgctcataataacccagttcctgcccactcaataaataccaaaaatgaataaacatgagccattgaagtaacaatacaaggaagcctctacatagttatgtaccaaagagagaagtagacaattaaagctaaaagcagttatagaaagcaagacagctaagtagacagtcagtgggtttaaaagtgagattaggccaagtgcagtagctcatgcctgtaatcccagcactgtgggaggccaaggtgggcgggtcacctgaggtcaggagttcgagaccagcctgggcaacatggtgtaacccccatctctactaaaaatactaaattagccggatgtggtggtgcatgcctgtagtcccacctcctcgggaggctgaggcaggagaatcacttgaacccaggaggttgaggttgcagtaagccaacatcgcaccacgcactctagcctgggtgaaagagtgagactccatctcaaaaacaaaacaaacaaacaaaagtgagattagcgttggtctttcccattacctgcagaatagaagaagttctctcagctggctggagcctgactttggggtcttgactctgccccatcaaatgtataaagcattctcaagagaggacataaagtggcaaatgccccagctccaatgtcaaggctatctttcccatatagaacaacagtggtatctttgtagggtttctcaggacaatctcttatctggagtctggggatctccaaacaaatgacacgtaaaaacactttctttggtcactagactgttcgttaaagaattcaaagcctgaacgccttagatactgctttggtttgggtgtggtttgtacccaccaaaactcgtgttgaaatttgatccccaatgtgccaatgttggtaggtagggcctagtgggaggtatttaggtcctgggagcaggtctctcatgaattgattaattccgtaccaaagggttgagtgagtcctcactcttatgggaatggattagtttctgagacagcgaactgttaaaaagagtatggctccctcagtttctctctcttgctacctctcttgctgtttgatctctttgcacatgcctgccttgattctgctttctgccatgaatggaagcagcatgagacagaagctgagcagatgctggtaccatgccccttgaacttcccaacctgcagacccctgagctaaagaaacctcttttcttcataaattattcagccccaggtgttttgttatagcaacacaaaggagactaagacaaatgcaaagcttgattataatactgtaatttaggtgtgaatgataggcttgaaaagtgaggatttggttgacatttagctacataatttttaagaatcagtagacgtctggacagctcagccccagattgcctagccactcttgataagggtccaagctatactcagaggaggaatgtaacagtcatctccccaggacagcccaggacaaaagttcactgcacagcccaggtctcttctcatgatatgctgaagctaatggaaatgtcccttcatgtttgactggaagtggaaggatctggtttacctttttgttttttgttttttgagacaggacagtggcacaatcatggcacactgcagccttgacctcctgtgctcaagcaatcctcccatttcagccccctgagtagctgggactacaggagcatgccactatgcccagctatttttcttttcttttgtagagacagggtctccttatgttggccaggctggtctcaagctcctgggctccagcaatcctcctgcctcggcctctcaaagtgctgggattacaggtgtaaaccaccacacccagcccagttttctttgactcatagctgttggaataacttatctccctttagcattagcatctgccaaacccagtctggagtaatgagaaaccagatccttctttggccaagatgccccctctttctttcccaaaagttctggtttgtgacaataaagtttgtgtatcactcaaagtcccagtggaaaacagatggcacactaaaaatggataatttaaggagaatttggtaagggcactgtttacgagggtgtgagcaggctatagagaatcaacaatggatagcactgcagtaccctaggactgttgccaccctgaaatatatgcaagggaatagagaaattgctggaacctgaagagagagaggctacgtgcagaggaccaccagatgggagccaaggcaccaagctgatgaaacctctcagagaggaaacagaagaataagtactctcctcccaccagtcttacttggtaatactcacaggaagttggagggcaagggaaccctttgatggagtctgtccagatgagactggtgcagagagcaagatggacagtggtgagagtggatctcaggggcaaatggaagctctccagcacagctatgctttatccattctccaagaatctgtgtctgtaaaaccccactcatttcaagtgaaaaagacctccttttagaattaatccttaatcagactaatacagtgaaccaaaagcaaatagaattagggaagcaagaccctacattctaatcccatttctgccagtaatttgctgtgtgaggctgagaaaagtaagttttctgcatttaggcttgtttatctactgcttactatctcttgagagtattgtgaggatagttgcagcacttgaatatktatcatcctcctttttttcttcaatcactttcctttatagcataactaccaggtgcttccttgattctctttctattcatttcttctctctctctctctctctctctcattttctcttctttcccaccgtgcttcatttcatattgaggtctgccttgtggtgtactgtgaatactgtgttgtggtttaattctatgtctgttgtagttattgtttagctctgcaaaaagctgatcctccaaatttgtgttgaatcatcccagtgataattttattacaacttgttcaaaacacaaacgctgctcacaaatattgttctaaatctccttgcattgcagtatatgccagagacagtaaaatgccaggagctgcattattcaaaaaacaacctattctataggattgtgattgtgatgatgatgacaatgattagttaatcagtgtttatatattacatatgtttacaaattactaataaataattagtgttgactatgtggcaggaaccttactaagtagtttgcacatgtaattttatgccattattaataggtactattaagtgtaattattatccccactttgtagaagaggaatatgaggcttagaaagttgggtaacttccccacagttgtaaaatattactcagattcaggactcaaatccaggtgtgtctaactctatagcccatgctcttagacactacaatttgcttgaattttaaaagttaacaggcatgtgatttaaaccctctgaccctataatcacactcaggagcatttttcctaacctaaaagaaaaacagtatcactgatgttagatgaagatagtcgcacaacaatgtaaatgtacttaataccatcgaactgtacacttaaaaatggttaaaatgacaaaatttatattaggcatattttaccacagtaaggaccgcaataatttgtaagaatcaacaggaacaaaaaagaaagcattatgtaaaacaaataaagtgactttgcaaggttgctttaaaattaatgatgaaattaaatatcataaatatctaatacctactttgtttccatgtataaaactgtatattcaagctggttaaaaactttgaaaatttatcttcttattggggagatggaatttttcttaagttcgatattgccatatatttgggcacgacaattttcaatataaaatgaatagctgtctaagctaatacttaaagaggagaaaaacaaagatagctttggatatgatctgacccaaattttgctatccattgaccacggaggattatctgaggagttattacagcaattaccaaggaagagaatggcatgggagaaattgaaatggagaggataaaaaggaaagtaccatataaacaaagattctgattgcaacattatatttaatttcaaatgaaatatgggaagtaactgaaatgcccaaagagaatgaggaaattagctattttatagtaccttcacttgagagagtattatgcagccattaaaaattataattatgaagatttttgtagcaacatggaaatacttatggc

SEQ ID NO: 10915 - DNA, 40000 bp, Homo sapiens
  misc_feature (1)...(40000): n = A,T,C or G, or insertion/deletion polymorphism (see Tables 1-2)
tttcaggatgagaagaacatattatggcacagaaaaagttcacttaatatattctgtttcacatttccatgtgattttattatattgttctctgatggcacatacatcaaccaataaagcatattaattatagtgctataacaactgaacacagacatttccagagaaatactgccattctccaagaaatagaaaaacaatgctttcagaaaaggaacaatttgttgaggggtgaaaacgaaaaatatgactttataattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactatatatttcccaagagtatcttaaacacctggaggatctttctagccatgtacaaatatttatatgccagggtatttgcatctctggcatataacataaaaaaggtgattcaccttttataaattcctttgaatttataaaatgatcatttcctttagaaatcaagagctggcccttttcccttagcaatttacttgtgaagagttaagactgtcagtataaatttatccctagaaggtcatgttataccctacacataatgtgtaagtcagctaaaaaaataattttgaatcagagatattcccttcaataacaatacaatatttttggagggatagcattgggagatatacctaatgctagatgatgagttagtgggtgcagcgcaccagcgtggcacatgtatacatatgtaactaacctgcacaatgcgcacatgtaccctaaaacttaaagtataataataaaagaaaaaaaaattaatttacttcaaactgcttaaatgagccccttgatgtaggaattatctgcagtttacccttttaaaagctcaaaatgagaacatagcttatgacaatgaaaataaacccctccttatactttcctctctaatatatctcctttgccacatacccaagaaattctttcatttgatttgtcatcagctcttggcaagtgtccagtggcggggcarcaagggggsaagtttctgtggctggaaaactctgctaattttctaacactgttgaaaacattaacatcctaatgtctctgagaaatcatgtcttaaataaatatggtcaaacttgtttacccatgtttccccaaattatttggggctgctactctaagatatttcaaaagctgtagggtacgcttgaggygtatataactatataatacattatgttgttagaaaaaaaaaagcttcaaaatataagtttaaaaaactcagaaagacatgaaaacaagtaaaatttcctttcctggaatgccaccatccacataaatccactcatatggtttggatatttgtccccgcccaaatctcatgtgcacctttaattcccaattttggagctggggcctggtgggaagtgtttggattttgggggtggatccccatgaatggcttgggccatctccttggtgataattgagctctctatctctgagttcacctgagatctggtcatttaaaagtgtgtggctctctctctcacttctgcttttgccatgtgatacatctgctcccctttcaccttccaccatgattggaaattcctgaggccctcatcaaaagccaagcagatgccagtgtcatgcttgtacagcctgcagaatactgagccaataaatcgtgttttctttataaattacccgtctcagttatttctctatagcaattcaagaatagtctaacacatccactttctattcaaatataaacttaatcattttcctcaaaccacatcctcacttttacatatacacactgtatatgtgtatatatatatatacacaaatactatatattacatcccctaactcccagacaacaggtatctgtttttcctgggaattttctacaatattgatatcttgctgataagttttgaaataacatatgttttgaagcgataattcaaaaagatgagattagtactggaggcaaaaatgagaaaagcagagtagtaaaataagtagtaagcacaatagattaagcatctaaatastcagatttaaactgatttttctcgagaacaagctatgtgattttaggtgcaatactttaatctctctgagtctctattcttacattttggatgaagarataatacctgctcaaatgactacatagcattggagtgatgttcaaataacactgtggtgccaaaacactttgagaggcatctattgcgtacattaatttagtaataaatgtttattaaacattttctatgtgccacttaggcactcttctaggtaacagtaatacaatgatgagtaaaactgtaaatgcttctgttcctctgtagcaaaccacatacttactttaggaaaaacatattttaggtcgattaggggatggatagagatgtgagtacctacagagttatgcaaaaacacatatatacacattctgctaattaaattcagattataaatgctctgaaaaaatgtcatttgaagagataaaacttgaaatgagactttaaagatgggaaaaatttagtaagatccagggaaatacattaaggagaggaaaaaaattaaaaaaaagaaggaggcaaaggatctgaggtgaaaataaatgtgttaaatgtgttatgtttaagaaacagaaagtgcagtatatctggatcctggtgatgctgaagatcatggcacaagatgacaatctagaggtaggtgggaccatatctgaagagccctgtgcatttcagctagcagttgacctttattttgatgcagtaggaagcctttgggtaatgaaatgaaatgatgtaacttgcagtctaagaagatagctgatgctgtgtgaatagtgaaatgcaagagtgactgtaataaaaaaaatggaggagggaatgaataagaaagaattgtaggtggtattttgttagtaatcctatcacaaccatttgtttaatatggtattggccatattttccccggaaatgctgtctgctgaggaactcagagtaacagttccatgggttcataactgatgatggaggtctattgccttatttaagctattttgtgtctattgattcacagaggtaggcaccacatggagactaaatggactaatattagtcattataataaaatgtatctgaaaaccctactttaaaatggtcctgtttggaaactgaaaatatcctgggctcctacataaacatcaatgtatactcctggataaagcaatgttccagctccctgctgacctgattgattggagcaacatttttgtcccctgtccttcatctccattcaattaatgcctcagaaaaacaggaaactatcccctagatgatatgtagagctacttarttttggctgtattcagctactaagtctagatatgggggtagacacccaagtttcaaggcgtttgaccagtccctgattcttcagtgttttgggattccaagaactcagatgatacaagcatgtcctaggaagaaaggtcgatattattgcaggagctatttatcttatttccactgataaattacctccatatgctgtaatatgagcagtttctatggacatagggctaatctttagaaaaaaatgtatattttgctgttggagcaatgggtttcttttggtcagtagaagtcttttttaaatttttataatttttaattgttgtgagaacatagtaggtgtatgcatttacggagtacctgagatgtttggatacaagcatgcagtgagtaatcagtataagtcttgatcaaaattgtacaaactgtgataactctcaggcaccctatttcacattcacagggtagcattttgttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatctgctcccataccttgcattaaaagccacagagaaaacgacagcaaattcaaaaggaaggattccagagtagaatttcaaaacataatactaaaggctattctctagtaaagtaaacacagcaaaaacaacaacaagagattggataaacctaaccatcttttaattttatttggaaatcgtcagtaatgtagattattttatctaatgctatcactttgtgactgaaattatcttgtcctattttttgaaattttgttttcttaatataaatacaaaatagatattttgacattagttgaacatgaacaaaatgtttctctctgatctcaatgttacaagggatattaaaaaatcaaaagatcacatgaatatcaggcattttatcatcccgggacagctcaaagttgaattttaaaagaattaaactgtgctgctttccctatcctcgagtcacctaaattttacaaagttgcacaaaaaatactttgatctttttagagcactcttagttttccattttttcttacttttacataaagaaatggaacccaagacccaagccaattccctaagaagccaacagcatcttgccaactgcagggaatttccaacccagctgccttgcattaggagttgggaattcttacatcttaaagctgagatctcttgcaacaattaggctaaaggttagtcttaaaggttttatattggcataaataattcaagattaggaaaaaatatgatggtaaggagaaagtctgctctgaggcataaatgatttgtaaaataatatgttactgttaaaatacattcagagacagctccagttactaacgctcttctaattgacgctgtcaaagaaactctataaatgaaaacaaaacaaaacccccaaaaccaaaaaaatccaaatctacaacatttacaggaaaaagaaaatgttaactaaatatctgttaaatgtgtagcagggataaaggtaggccattctctacctacaatcttacttctctatcatctgcctctccactcttctctcaggatttgtcgttttaggaatacacaatcatctctgtttcctttgctgtctttatctatgtggtttgaggacaaaacttttgatgggcatttatcatccaagttagtatacactgatattaagttgaagactgattcagatattataacaatatttccaggaactaccattaacagggagagagaggatgaaaaggtctttcttcggaaattcaaaatgtgactcaagacctcattccttcagctatagcatgtttgtgttctagttaaagaagtatctgccctaatttgttttccaagaagtgaaatgaatgtgtttatagaataatacatcttttgtaagttagatatgtggaaatgagcatatgtacagaagaagaaaaaacccttagcttggtggcatcacctcttagtgataaactgtacatcagtgtggctcacctgggattttggcttattgtaaataaagtgtagcctgtatatatggtggggcaaaagggaggagaaacatatcactggaagagtattaagtatccataaaagcctgattatcttccttcaaaattcagcttcaaatctctgtttatggattatttttgtcctatgcccaaagtgcaggggaagccaatatgaaagtgactgaaatttcacgcagatgggtgcagtacagcaggagcattatttaattttttaggaagctggagaacatccaggcttccttcatttattataatacgggcaaagaggagaaaacttgggaaaatgaatttcctgggaaaattttggtttcgtcctgatttaaaactaaaagagccatataaattgatcaagggacacttgagtctccccaggctcatgagattaattcctctcatttttcatttcctctgttttgctcttcttcacttcctcaattcctctccctcccctctgttctctctttattttctatcctcttttgctttccttttttttttaacttttttctttcacatcttcccattttttctgacttttatccttttttccttattttattcttctacactgaccatgctttaggtaagagttctttcaaatacattgctcagcttctagttgtaagaaagtagcagccccccacaccttgccaccaaataaagygattatggacaagaatgaatccagtaattactgataatttttagttktattttctggatactgattattttaactcaagtctatttaaaagtgtcttcattgacattgcacttaaattatgaacatagctatcttatttttctctttacaatcccaaatagaccatattaaatttttagaattccacgtattctaatcctttgtagctctcctacctttaaaaatcccttcctggagatacctctttattagtcatccttttatttgcagttctgcatggttgctcttatccctgaaaaggcagtcttttaaaatagttttacagtatttgcaaactgattcctatcatctagattaaccaagttatatattttgttttctaattattgaatccaaggtacatataaactaagaacagtgctataccttctgatgcagtgtgtgtttctaaaaaacaggtcatgatggatttgcaaatacaggagtttcttgtattagtctcaagtctcagcttatcacatttttctatttcctgaggacattcagaagcaaaaatccccgttttttgcataatgttgttacttttatataaaaaaagacttttgtcataataaagaagacagtgggcacctttatgttgcaagaggaaatcatcctagctgtgatcataaaattactaagggaaaacttttactcccttagaagctaatgataatctcacttatttcctttacatagtcttttcatctggaggcaaatggctcctataaaaaaaagtaaaaagggagggtctgttttgcaattgggatctactgggatgcatgtcatacttaaagtaccaaaaattcatggtagatgaataaaattaagtacttcaaatctgcaaaaataaaaaaaaagccacaataatgtcaacttaatagcagccagctatcatggtattatcacatttctctaagtctatggctggttatgtttttcaagatgtcttaaaactgtacttagtattttaaactatagttctctaatgacagataccttctcaaaatgtactttaaaatgttgatgactctgtagatataagtaataaacatgtgccattttattccttaaggattaaaaaaaattccaaaaaaagaatatttaaaaaaaagtttaatcagtatcaaagtttttttcataaatctcaaatccatcacatttaagtgtactaaattccaataggatgtttagaataaaaatagagaaaatatttgagctacttttttgtttgttttaatttctatcataccctcaaaaggcattgttaccaggaatcagaaatatcagaaaaaccatctttagtaaagataaaagcacatccactgttaattttctcaagtcctggaattattgtagcatattaggctcatttcactaaaaggaagatagcttgtctatacttggacaactactatttctgctctttaaatacatatctatttttgttattttctgggattaactggatgataaaagtagattctacaaaaatagcagtgtggcagtatgaattaatgtagttattcctgtaagcaaatctaccagtatcaccagtattgaaaattagcttttcaatatactctcagtctaatctttatatcttcaagttctatggctctccagggtctaggagtgcatatgagaattagttaaaataatttcacctaaaatttatttgatgaatgggttaaagtatacatttattaaagagttattctatgcaattaaaaggaaatgaacagtcacagtttgctacatgcactctgaacaataatataaccacatggctaatattttaacagtttgtgtgtaaaactatttaataaattgaagatgatgcacaaatctgtcaaataatactcatatttacatgccaaaatattaaatagaattttctaaactaggatgaagagaaattttttaaatatgttgtaaaattctgctgactttttagggaatgagatcatagggtagggaggagattaggtaaagtaatcagatacattacaaccagtattttcaaaagtcttgctatgtaaaatttatatcactagcctggctatttcttcttttcatacattcctcatctagctagttttgtaatttatcgcaaattttataaattaaaaaaaatttgaagccaattgagatgtttaaatgtacacaagcagtgttttaacatatcatatacaaaattaggctccccattttgtgaccactctattttgacttaaagaattttttctaaaaacttcaatataaacttggtgaagtctaaacctggggaaatttgtatagtatgtcctaaaatgaatgtttgaaattgattagaaaggacacctggtaagacctttgacatatatttgggttgtgtctttgccaaggcagtttcccttaaacctctgagactctaatgacatttggcagcttcaaaatagacccataatacacaaccatgtcattatactgtgcaaaatatttatttaaaagtaactgtaaatccatgcaaccatttagttgaaaaatcattgtttgaatttgtaagctttttattctttgcttatctgtgctgtctaaatgaagaagaagtggctgtcttaatattgccatttaatcactatttaaatattgctattaaatagctactacaaatgctttaggaaaggttcagtatcagctatagttgggaatcatggattctaaccttggttttctgtgtgactttgaaagaaaatttatttccttgcttcacttgttttactctgagatcaatattttgatttggcttcattagtctttgtttaaccaaataagatagtttgattatnnnnnnnnnnnnnnnnnnnnnnnnnnnnnnnnnnnnnnnnnnnnnnnnnnnnnnnnnnnnnnnatgaaatattccaaaataaatgtttgaaccaatagaatcaaagatatcctgttggaattaaatgcaaacataccagtaccaggtgagatagctgcagtcattgtgctggaagatagaatattatcccagtttttacctatatgataaaatcgttacacagaaagtactgtgcttatcatataaatgtagcatctgcttcgtgtcattattagaagtttgtgtctgccttttactacgtatggatatgaaactacagagtaacttgaattaacatagagtgatccattaaaaatagatttgtcattaaattacatgtcaccatttttattatttgaccatttagaggtaaattaaggctgtgatagtaaagatctcatattattctctawaacaaaaatacaataatgcaacctacctcccaatcctggtctcaggcgattgtcataaccatctaggagtctgtccaaaatcctggtgaagacagtggtattgtctttaagttcatcttgtaatgacggctgtccatagctgaaaaaaaacataaagagaagcaatagctaaattatacatttctactaaaacctctttccaaataaatcctttctcagtttttctactttggtttctactgaatcttaacttgaaaattattttttcacaaggtaaaaaggaatgttatttttaaactctgggcatttaattatatttttaattttcagtttttaaatgtgaaaggaaaattgtaagaaatgacttctgtctgtttactttttgaattcttatcatgtttattacgttgcaatgcacgtcttctctgagcaagcaagaatgctaatgcacataaaaaaaaatagagaaaacaaacctaggaaagttctttccaaattaaaaagagttaccaaaacaactgattttcttttttatttaacatgcagcaaaagcctaagtttttacctaccaacatcctttccttcattcacttcatataggtctgtgttttggtgggattttcttgatgttcttttaagagatttaggtaaaacatttcytaggacaattatatttttacatcagtgtgcaaatttccattcctcttaagattcatgacccaatgattaaaatttgtctgctcaaacatctaattaatttttattatttctagtctcagatgtaaaaagaacctttagaaagatcaagttcaataatcttaatttgtggttgactaagctgtagcacagttttagtgttttgtttaagaaggcacacctatttgtgagcaaaccttgacctagaacctagctttcttcaaattctagtctgaaactttattttcttcttctatattgggataattatttatatttaaacgttgctagttggagatgtagcctgtgtcccttaccattattagtctttgtgtttcgaccacatagtgacctcagttcaaaaattgtgtatttcctacatcaatcacattgctatctatgctccttgaatcatattttatgtgatgattagcatgacaactccaaaatcctttgagagaattgttttctatcttaggatggatcacatttactgatatatttcaatcatagttctgaccttgagtacaaaagcaaaatgaatatagggtgtaaactaagaaactgccacaaatatatcacttttgtattttctacttaatatactttgggcttcattcctgtgtgttgatgttactgataaatataagaaaaatagtaacatttgaaaccagaattcacttatttgacagcagcaagatatatgatcaaaaaatcatttcaaaaacaaacactgttttgcaggtaattaatttcgtatcggcaaaatgcaatggctattattctgataaagttttaatttgataaagttactaaaactaaaggctatccataatattggatatatgtaatgtgtctctttgaaacaatttttcattctcctaatttcaacattgatgccatgcagattgagggcttactctcttttggcaaaattaaacatcttgctgtttttttaaatcaaattttcaacaagctaagtgtcttccagtatgtctcattggcagaagacaacagtaaggcaaaaatagttttgtgaatgcaattatttataaaaactcattgtcacaaaatcaactgccattcctgcatctttcaaggatgctggaaggtcatcttgataaagatggaaaataaatgctagaacaccctaagttgtgaggaggccctgatcgggaactctgaggaagaaagcaatacaataagaagaaataaaagatgaaatggggtaacatgactaaataaacttaaattattaaaacaattcttaaaatatagagtgtttattacctttatctacaccctctaagtttttacagcttatataaaattcagaaaatgcttttcttcctgggtttgtcttacaaatgttttcaccaattgtttgcattggaatgcagatgcccaaagagaccactgccttttccccaagaccagttctgctttcccagctggaatggaaatctttattttacgtgattttttaatgacatttcatctttacttctaacttactatgtcaagttttaattgccagaaaaaaaccctacgaataagatgcttattcattttgtattaaacactcatcccaatgtagtgtttcctaaactgaatatatattttgaagagaaatgccagttacattacctgattttgattccatatgaaccactatataataaaacactgtgcactaactccatctacaggtcattgcaatagtaacacttcatataatttttcaaaagcagtaaagacatttaacttctctcattaaggatatctgataataatgcctgtctgtcagtgtttaccatacacaatagcaaaaaacaacaacagaaaacttctgaattaaaataaatcttcctaaattcatatgtctttccagactattccatctccctatcttaactcttaagagttcccttgccattacattttgaataaactcatgtttttattatatgtctgaccttcttatgggtcacaggaataggctacacaagaaatacaaaagcagataaagaaaaatctgtaatacttagtcatgtaaatagtttctattatattaatttcacatgcttgattggatcattagaacatattttgactatgattaagctttataaacaattagtaattgtttttttaatagggaaatttgattttaccaaagttcttaaatatttgtctcatatagtccacttttattagttatatagataacaatttcaaaacgtgatatgcatatgcatttagagagacgtgattttcaaataacagatattatttaaaactttccatttctataaacacaaaagttactctatgatctttacaataggctagaaattttcttgttgttaaatcaggttacacagtatgcaaccactaattggggtaactttttctatgaattaggaaaccgcacgttttgttcagttccaactgaacagtgagaagttcaatctaagacttaaatgttgaattaatacatgtcttaacaatggcttgttaattgtattctaactaacgtgcaaacataatgatttgtttcatactgctcctctttattcttagctggaaattattgcagttaagttttctgaattcccttagtcataaattcatttgaggacaattttcttcccccgataaaataaatgaaaagttacagaaattttcatgcagatttttaaaaaagtgwccccaccttcttccagtcagtgtgctcagaaggaggatccaggcccaaagacagtcagacagacctggacttttcctcatcgcgggctggagcagctgaaaagtagaataagtagagatcaatgtctctagcaagaaacatcaggttataaccaccagggctgactgaggcagtttagatgaatgctttgaagtcaggaaatgacctcactgggatatgacacctcattggaagcaatggaaacctggaccatccattctccactttcccttccatttctccattcagaaatatatcagtgtccttattctcctgtaaaagaatacaagctgaaacgctttcaggtgacagtattgctcaacataaaaactgtgagttgtttatctctaggttttatatttagaatatagtttggtttattctcttcttgttgtttatcatctaaatatttggacttttaagatttcagtttccacagtgaactgtgcattaaaatttttaagctggtgtctctaacaggaagaacatatttagggattggaggggataggttaacatgttgtgatggctgaattcctctttgaattctgcaggtaccttgatttcagaagcaactgtatttatttctatttaaaaacataggaaacacactgttgaatgccggagtcgtgcttttattctgttcctgtgactgctttgttaaacatgcttcctaatgtttctgtgaagctaaaggacacactttatagtcaagccatgtgctgatctctctcacatacaaaccacacacacacacacacacacacacaaatgcacacaaacatgcccacacatatctttcaagccctctcaaattctgccaggttgctgctagaaaatgtttcatctcaaacagatggaagctggagtgctttgctttgcatgaataaagggatctttttacctcttaggtaaagtgcaatcaatcaccatctgattgttgaatttagacttggtagtggaatgttggagaactggaagagtacagaaagcttagagaattaaaaatgtatatagtctatgtgtggagtcagttttcgaaattcaatgcactacctggataaggagcagctatggtaacattttaatgtgctgtaattaattccagtcataatataaggaatgttcaaagtatttaatctatatttctttgtagggtaagtgattaatagactgcaatcttttaaagcttctttttcattaaaccctctatagtttaatgtggtatgcctttaaatacatctacaaaatgctttctgcagtctcgggaaatcatttaaatcactaaaaaccattacaaacaggcttgtaagcaatgaaacataatatgtttagagcgaaatggtctagagataagaactctgagcctcgtcatagcttttccttaatttagtaatttagtgactggttttgaaacagattagttgactatgacaagaaatcttggataaatattatgttaaaatgctacatctaaattgcaaaattttaatttacccttttactaatcttcatcgtttgttacaagggaaaaacaacttttcttagccytattaatttttgttgatctttttaaaaagattgaatatctgaatgggtaaacaaaacacagcaaaaccatttgacaaggcaccatagatttttgccctcttctgacatttttaaaagagaaaaacaaacctatcatggcacttcagttgttaagaaagtttcttgcaaatacaaacataatagtttaaaagaaaggctaagctgcagtcttaccactttctaccttcaacctccccctcccccagacacacgctccaaacgttaccatcccatgccatccatatcaaagactaagttgagttttcgtgttcagaatgggagagacccctacacaagagggcatttcaccagcgtccactggaaagggaaaaacaggcaattttgcagccaggacaagagcgtgccttccctaggatgatggaacagtgagacaggttttccgtcccagcgtcttaactttagatgatggcccccgacgcccctccccaactcaccccagctcccccttgcaaataaataaataaataaaagaccaaaacaacatgccaccacccaccctgcggaatacattcaaatatgcctaagaaagaggagaagaaaagaagaaagacagcgggaaaaaaataataataatgctcttatattgctgcggtttcaccctgaaagaaaaacatttcgttgtttctacctgctgtgggatcaggctcctgtcctgctcgctcccttgctcgctcgctcgctctccttcttctctctctctctcttccccccgtctccccccgcccccccccccgactataacattcctgtctctccagctaggaaaagccacgttcaaagctctgtctgtgtatcgtggtccaaagtcgcacttacctaaggccccctctgracacaggatctcttaagaccggggaaaagtctgggagagagaatcgtggagagactggagccagcgcgagtctgcgagtccgagtccgggcgcgcyagagcagaggggcgycctcgctctgcctctcactcacttggtctgagccatcatggactctgcgtgctcctttgctgaagatttcacacccaaatttgcttcccaatatccaatctgcagctatacaacaaaagatttctctttaccaagacagtagtaatacgtcccagggcaaaccggatgtgaaataggcggtgacttcatgccagagagattttattttagaaaggaaggtggtaccagcctctggatctggagaccaatccgcccattttttatatgcagcacaatttaacttgcaccactctggccctaatccccttctctctagctgcaggctcaaatccttctacaatctgctgcaagcttctctttttggggggagcggcaatgggggagggaagggtagaaagggtgagagacatacggactgcacttagagtcttttcacacttgcaatttatgaacacccgattttaaggtgagcccattaaaaatacaactatttagtgcaactattctacctttgatcaaatattaaaccactgcctrcatatgaatgaacgcaagctctgaaactgggagatgcagggttacacgtgtggggagagcactcgtctcgcctctctccctcacacacacactcccacacatatgtctaagtccccgtgtcttgcagagtcacgaatggtgacggatggtaggaaagagttctggcaggtaggaaattggctactggatttagagagtctttcgcactttctcaggttgggagcgctttccaccccaccttcttctgtagcttagaggacagcaagaataccctccggaaccgggtttttacctttggaggcaactgtttgtctatgttatcatggagaaaacgcaggcgctgttacctctgaattgtgctgggttcctggacgaagaatatttaactaataaatcactccgatcatttctaggtttgagaatcatatctccatttccggaatcattcctttgcctcgagctccatcattctcggattaggaaaatgggagagggagaggaggaatttttagaagtcaggacgaaatccgcatctacttttccccccccttctccggcatcttctgttaccctccctggtagctctccacccacaaataattatacactaggaaaggggggtgtgtttcaacatcagtctaactaaatttccaaggaatcagggatgacttggtttcctcctcggattttgtgaatggctgtttgtagcagagaggggatgggtgctgtcttcctgggagcgcttactaagacctaaaacactgggagctgtcccttcagcacttccgtcctgttatggcaggaggtgctgaaaaggtgaggtgccccatrcaatgtttctggtggataaggtctgagctttggtaagctcactggtcattttctcctagtgagttcctagcagagaagacgtttcagatggggcggagcctgagcaagtgaagaaaaaaatctgagtagccagtccataaccactttggggtttctgattctacaagtgcttcttgaccttgtgcagcaatgcaatcagcttaatgattaaaacttaaataaggtgattgcaataataaggaatataaaactgaagaccacattaggggttgggcttggttaccttctgagttttgtggtcaagtgtcaactgggaagtgattttagagataaacttttggaagagagatttgaagattatgttaagatagccctgtttctgggcagtagttaattgcctgttatgttcagatataataaatgccaatgtattcttaaagatattcgctgaagaaacatcacagcttccctatgtgtcattacccaatttttatttacttatccattgattaattaatttattgagtggtttggagaataaaactgaatttaatgagatttataattaataatgaaatcctgagttaacgattagaaaacattattcttttacttcatctacaatgcaattccacagttttgtcttgttttaatgaaagtcaacagttataaaaatctgaatttttagtgttctcctggctaaactgttgcaggtccttttatgatcttctacaaattgaaaataaatttatatcctttatctaatgaaacacaactaaatcactctactgattttggttttgcaaacaaattcactgaagcttcatcatgtgaacaatagtctcagagcaatgccaattacattctgcttcagattaaaaaatgttatgtgactatgaaacaggatacaattgcacagcgttttcaaacatttaaagaaataaatattaaataatttgggggctatagtgtgtatatggaaatggaaatacctatactatgattctctctttaaaatgtaatactcacaaggtagattttactagatgattctctatgaatatcagcttgtaatatgtatatgcatgtatgtatacatacacacatacatgtaatttgctttaagacatctatatttttcataaattgtgagtgtttaaaaataatgatattttaatactccaaaacatcaattgatactctaattatgggtgtgtttattgtgttccatctgatatgtcattaatatatgcacatactaccataaaatataataaattaatgacaagaaaatactttatattgtgtttttatattcaatattttatataatttttgatattcttgtgttttgttttagccagaatgaaccacttcaaactatgtgtgcatataatgatgtcagtttttttaaatgataataactatggtgtttaatattcttagagtgtttacttggtgccaagtaatgtgaaaagtaattttcataataattcaatttgattctcaaaatgagtctctatgagagatggtcttaatatttctgttatacaaatcattcagtaaattgtagactagagagatcaaaagacttgcctaaggtcacacagctagtgaatatccacactaaaatgcaaatccaaatgctctgacttcaaagcctattctcttaaccacactcctacattactctctttccttactgtgagactgtgagctcatagtaaaatctttttcattcattttatatccatgcttgaccacctttatgtcagtcacataaagctcatctctgagtatttattattatttattcatggcaagagttttattttgatgatccagtacatccaactgcaacatagaatcaggcttactttagcgtttcagagatttaagctacttttcttttgtctcatgaggccggtggccaaggccctctgagcagttacaaagtcttggcagaaagaatttgaggtcaaatctagaaccagggatcctagggatgcctaatcactctatctccagtgctgcagtctggtacctttcgcttttactgtcaattttaaatggcaggaagccctkacctaattgatgaagtggtgctgattctattcaacagagaaacgtttttactttctttaactaaacgtgaaccaaatgagaaaaaaatagcaagagtgttctcatttattcagtgtgtctttttatagtttacaaaataatgtagggtgaaggaaaagaaataagtaaaaataataaaatatcaaataaactttcgttgaaactcagaaaaaattgatcctttaaagtgtatttgaatggctcagatatctacaatgaaattgtgttttagcattatgcattatatatatgaatatttatatggaatatttcattacactcatttaagtagtcccacttttctaatccctctgtatataatacagaccaccatgtttaattgactatactagcatatccagagggatgtctcttcttttataagtgatattgaaataatagctcagtaggagtaaaagaaaataaaagtggtttaagtaataggttacatttttgtaccttaatctagacatctttgtcatctgggttatttaggcaaattatatttcccaggctggaagtctcgtttggtatttcagcatacagagaaacatggtaaatatagcaaaaacaaaatttatgtatatttgagtcataagtgtttggcactctagtggaatttagagattgtttgccccaaccactttgacaggtcacaaagcttacgtaagttttcacatgatctttacagaagtagaacccaggttagcatggcacaataaatgattatgcacgaatatatacttgaagtcacagatgtttcaaaactgtaaggccgtgggcagattgctgaacttttctgaagttttcaaatgaagtaatgatattttataagctggtggtggcattacataggaaaacaagtgtgaatcagatagccctcttgtgtgacacctaatagacatctaatgaatgccaattttcctctctcttttttcttgccataaaattattcttttctctgcattttagtgcattatctacagcgtgtttaaataactaataatactgatagtactgtcaacattttgcatactgtcgaaataaaattttcacttagacaggtagtgggaaaagctagctcctgtgccatcttaatcctaggcccatgtttttatttttaagatgttgagtcggggaaattttcctacatgggccttgggcatagagtattttacatacacgttaaaccagtaacatttgaagagaatataatacaggatatagccaaccacagcaaatgttcgaaccacagctagtacagtcaaccacaggcttcccaaaagatacatttacattatttttccataagatgcaacaaatactcatcaggaataaaaatatgtatgtgagaatcagagtctatttaacagtaatgtaaatagggcactatccaattttcctcttttggcagttttcagtttatcagcaactcaaatgtaacccagattcacccattttctttcaaagacttttcttttcacagatgtctaacccatcaacccaagaaggtaaatgcagatttattcagagttaggaaaaatgataataagctgatgattagaaacaattatttattttaaaagttcaaataatatataaattatttttgaaatccttgaagaagaattttttgactctccaaataaaattggtaacacgatgactaatgtaagtcagaagggaggtaagaaaataaatataatttattaaaatgctgtcacaactctctagattaaatactttaaaatgctgtatcctatataacttgattgaggaaacatgcaattaaaaaaaatttatagctaaaatcaggcattcaggatgtttatgtgtctcctttggtaaaattaaagtgcataaatatatgcacacacatagtctatgtgtaaactccttttaaaccataagaatrtatgtttacttatgtttttcattgttaaagttaacagaatgaatacatatccaatcagtaacaacgactaagtgtctatcttgcagaaagaaacatagatctaagtgagagrgtcaacttacagagattatatatcaaaaataatgaaaaccattaggcatatttgtagcaagaaactgcattcagcttattcataacctgctggcatgttaggatatgtctagtttaaatatttgaagagtttaacgtggtatcattatcctgctggacagctgcatttacatatttgtttacaaaaaaatgacatcaacattaaagcagcatttaaaaaatcattcatcatgccctgaatggccataggatttgtggaaaggatatgaaatggaaggatttactagaataaagatcaagaattaggacactaataaaccatctgttcaatagctcccaattcttgatgtttataataattgtgttgtgtggaatgaaatgaaaacaaatttatggatatagatgcacttttattacggctgtacataaatatctccagacataactagtgcccttgtgttaaatgtagaaaatggatgtaattatatttttactataatttacaactacacaaaagcatctctcttaaccaaactcatttccaattttgcttagaataacattcaccaagatttctctgcagagaaaatttcatagcctctcccttctctctctctatgtctacatatagagagatatagatatgtaaatatagatatagatatctatttgtctatagctatataaacactctactagttatcaatatccatatctctatatcaatattgatatctatacttctaaattgatactgatatctttacctgtctcctatctctctctctcttttttgacctaaataaactttgacagagagagagagacagagagacagagagacagagagagagagagagtgtccgcttgggtagggagagatcgagagttttaaaaatgagtaatattcaagtttgagtaattatatatcaatgataagctcatacaaatctcagaaatgtggactgacccctatgaaaacttgggatttggcccagaaagcatgctctggatgaataaatagatgttcaaaaccagcctggccaacatggtgaaaacccgtctctactaaaaatacaaaaattagctaggtgtggtggcacatgctggtaatcccaggtactcaggagtctgaagaaggagaatcacttgaacctgggagctggaggttgcagtgagccgagattgcgtcacttcactccagcctgtgtgacagagcaagaaatattgtctcaaaaaaaaaaaaaaaaaaaaaaagaaaagaaaaaatagataaataaataaataagaattgagtgggtttttctgcttgtgattaaccacattcaatattggaatttcaacataaagttggccacctttaaattttatttaagggaaaagaaaaaataactcccaaataacagtcccttcctcataaaaaaaagttattatttagtagctataatatacctgacactctactagttttgttgttgttgtcgttgcttatatctcacataatattcgtaattgcattcttataaaggtgctgtttacagatagggaacctgagttcagtaagattagtagactttcctaaagacacatggcttataagtcagaatctggatttgaatgtagaaatagattttgtggcttccaaaagttcctgattataaggcagtgaaggtaaatccctccacatagcctgggagtataactgtaatgagagactgttgatactgtttctgatcacaaatatctgcagcaatgaaatgtagttattatgaattattaaaaattaaatattcaggccaggtacggtggctcacacctgtaatcccagcactttggctggcttaggtgggtggatcacttgaggtcaggagttcaagaccagcctggccaacatggcgaaaatccacctctactaaaaatataaaaattagccaagcatggtggtacatgcctgtaatctcagctactcagaaggccgagccaggagaattacttgaacctgggaggcggaggttgtagtgagccaagatcccgccattgcactccatcctgggccacaaaagggaaacttcatctcaaaaaaaaagaaaaaatatatatatttttttaggaaagctgcctaatgtagtattaaaaaaagaaatttggaagcaaaactgtcctttttttctaggtagattatttacggatgttaagttgggccacttctttgaactttagtatctttatttgtaatagagatttaatactttcattttacatggaatatttgtgaaataatactggtaaagtagttagcaaattaaaatattctcaacaattgatatgtatggttattgttaacacaagcattacagtgtaacagtctatgataacaagtaagtttttctagtataattcttagctttttgaataataaaattaagatttttgcctatggcaaccaattcatttgaggctttgcagttgaaccaccacactcaaactcagccaaaatttatcaaataccagactaaccatttgggtttttttcatcatatggttgaggcctgaagcaaggaagaattggcatttgcaaggaaagtgaattcattattttagagaaactcaactcagcaggcggtaggaccaaagacaaaatgcttaaggcccaagctattgttaaactcaaccttagcatcacaacagtaagaaaaatattctttctccatccaacttctgctaaagtatttttactaacaagacaataaggtttagagaaaggaagaaaggaagaaagagagaaagaaagtcagaaagaaaggaaagacagaaagaaaggaaagacaaaagaaaggaagaaagaaagaaagaaagaaagaaagaaagaaagaaagaaagagaaagaaagaaatgaaggaagggaggaagggaaggaaagaaggaaggaaggaaggaaagaaagaaagaaagaaagaaagaaagaaagaaagaaagaaagaaagagaaagaaagaaagaaagaaannnnnnnnnnnnnnnnnnnntgagaaggaaagaatcaaggaaagaaagaaagcaggcaggcacgaaggaaggaaagaaggaaggaccgaaggaaggaaagaaagaaagaaagaagaaagaaagaagggagggagggagggaggaagggaaggttttaaaattcaaatcaaataaaatggaatgcaaaacaaattgaatgaaaaacaatgaataagaaattaaaggaaactaacctatgcttgccatgttttacatgtttattaacaactggagtaggtattgctgaagcaaaaaaccatttacaaaacatcagaaaggaataccgaaaaagaagccatgtagtttggattcagcaaattctgaaatgaaaaccaacttttactagacaaagaaagaatcagggattgctatcatagaggctcatttttataccatatttttgttttatttattttttagaatattctagcaagcaaattcactctattatgaatcaagtgaatcatatcaatgttcttaaattcaaattaaacacaaaaatcaactatgattgtattgaaaacaaaacaaaacattttgttttgttttataatttctatataaaccaatttgggttaaaagtttgtactttttctaaactatcaaagtgaaataaagtcaaaacttggaaacagtgactgagaattaggaactggaatgatgttctgttcttatccttcattattagctctgtgaactacgctaaaatattatagttactctttgtatgaccttgggagactagatacctctaggaaacctagctatttcacagattgaacagtcctaagtcagtctgacagccatatgtttaaattatgatttcattgcctggagaaaattttgtcaggctcccaaacaagtcagcgaattcagtagaattgccctgtggctttggaggaacatggttggggaaggttagtcaaggttcagaaagcttttgtcaaagtcttaaagagggctcaaatacaagccctgttttcagatagaagggaatctgcttcccatatatatgctcatggaaggccccattaattccaaaaacaaacaaacaaacattacaagatggggctatttcttatgtttcctaaaatcaatgtgtaatttactctgaaaagtatataaaaacaaaagaaaattaaaaaaaaacaaaaaacaaaagatgaactaatatctcccttgataagagcttgtgaagtaccaggaaaatgtagagggaaaaagaagaacattttagtacaagatttttataaactttgcagtaactcctctacaacagcaatgcatgagtacaggtagagaatgtggttgtaaaatttgaaattgtagtcacaaattctgttctcattctttccttttgaaagataattttcactctaaggttgctcttctattaaagtatattaatgcagacataaaaaataaatatagttctcaaagttcagcatgtcagatgtcaaggaaaactaaaattttacataacagtttaataaacatgactcctagaaaatataagtagttatttctttatcacatttttatttgaagaagcttcagtaactgtcgtttgtactcatcattgtttttatctggtttccaaatctaaatccaaatttgagatttcctcatttagcggcacactatattaaaaggacatgcctgttcaggcaaactttctcctgcccatttgaggaattcatacctacacatgtgtacactaacttgcagtttccaaaacttattgtatacataatctttaaaaatacactgaataaaccaatcagwttatttttagaactagttaaatcaatccagaagttctctgaaggagttaatgtgagcaaaaccatcaaatcaaggcttagagattttaccagatataaaaatatacatgaagctatagtaaataaaactcaataattctggcacagaaagacttgcacagctataatcacaatgaagaatccaggaaaggacccatggataatcaagaaattgtatatggaaaggaagctttccaaagcagtgtaatttattatttaatacatggaaaaggattacagacattataataaaataaaacaaaaacacaagtaaacaaaaacattaaaattaaattcacacccccaaatagaaataaaaatgatttactggtgaaagaaggaacctacaaatatcctatgcattaatgaattcaattaaaaaaaatcagacaatgcacataaaaatgagaacacaggacaaaaccataggtcaacaaggaaatttcaccagtggccaataaacatgagagaagatattcagcagcaattgtgatcatagaaacacaaactaaaacagtcacagttatcagactaatgaaaactttttaaaaaagtgatgctattcagtatttatttgagttgttggttgtaaaaatggcaatctgttagtggctatcaaattatcagtatactgtatacaaattttaaatcagtatcctagttctagaaatccattctacagatatttgaatgcaagtgtggcagggtataagcatatggaagtttaatgtaggattaatgcaaatgcttttaaaatcagagccatattaaatgtctgagaataggaaaatagtttaataaattttggtatgttcccatcatgaaattaaatgagcatttaaaaaatgaggtatatatttatccattgatgcaaaaagacattttcacggttagctgattcaatgagcgaagatctaaatagtattattcgtattttacaaaatatatataatatacaagataaagtataggtctaaaatgaatatgcaatgatatgcatttcatatacgtaaaactattaacatgaattatctctttttattttatccgttacattaggtatgattttttgtgagtatatatatatatatatatatatcttttgtaaaaatttttcaggaaataataacaaaagaaaaagaaaataatgacatttagattcctagatatagaagacataaatcaatgccacccagagttcgcttaaaatcccaaagtctgaactctaggtttacaaagacaggtttgttataattatcaccgaagaagagttgggttctcaaaattgttgcgatttcattcacttctagaagttgagaagtaagtggaagcatagtgctagaagctcatactcactttcyttgtcttcctaattatatagccatccaagagtaacacttctcttcggtaataagatagttcagaatcttaaacatttttccaaataacatgcttagaggtctactgtaaattcaacaacaaatgattggaaattgaaactgtcagtcaactaaagagatatgtttgagtaagaaaaactgtctaatgcacattataaataccaaatcacttttgcaatgttacctacatgtakacttacatcttcctcctcctcctccttcctcctcctccccttcttcttcttcttcttcttcttcttcttcttcttcttcttcttcttcttcttcttcttcttyttccttcttctttgtcttcatctctgtctttgtcttcatcttctgctgcttctgctcctgttgttgttgttgtttcagggagaaatcgttttgtgtttctacataccctagggaacatatgtttgagcatgttagtagcatatttatggaaaccagagtactctgtttactttgctgtctctacactttggaactcttcactagttttgtaattctcatagcctcattgttaaatgaacccctcttatcccctgtgttgaaggatgtttacatttggctctatacttttgcacaacagttatgtaagtaatcagctccaaaattccatcaaggatgctctttctctcatgtgcaaatattttgtcccacatagcctcagcaaggagagtaacttttaaactggagaataaatttaaatgtctcaagttcctttgttttcacccctacataatgtaccacatccattcagtgtttctggagacataaatggttaacttcatggtcaagaaaaaagtwtctcttctttatatcattctaaaagaaatacaacamtttttccatatatgaatatacattttggacatccattgatatattctatgagttgagagcataggtttctgtctaatgaacaaaaaatcaggttaagtcatcaataatattttttcaagattttgttgaaatgcttctaagtttagaactttgatcattacattttactattgagtcccggtggataaagttagcatatcttgtttctcactcmscttaaatatatttgcctttcagaagagtaggtagtgaagattaacttgattgtyctgtagtatggtacagtaaagtgggcaatttttctacatctcttgagatcaaatgagggtagagggtggagataggtgctaaatttccaggcttgggtgggcagaaagatggcagagagattttcattcaacacaaacacaatgaaagaaacatctgggtggagttataacaggccagtttcaggcaaacgtggctcaactaagtactgagctgagacaagttacttaaccatctaatatctgatttttcacctgaagatcagatataatagccatctcaaatgttttcttatgaggtctaaattatataacttagctaaagtacttagcacagtttctggcacatgataaatattcaataaaactttttagaccttaactgataatgtatattcttattaaattataactaaaaacctctctgagactcagtttctaaatttatagattgaagttaatactttgtatttatcttaaggttagaaaccagtaattcaaggaaagcatcactgtaggtaccgttactggagatgcagttagaatgcacgattactcctaggctacatgaatctctgtgtatgtaaaaataatatgctaatgttgcagtttgtgaattatgtgtaactctctttctctatttcttctttcaatactaatgattaggtctattattgcagaaattaagcaagaacatttttccctatgtatcagtttataccttctttatggataaagtaaaaagtttttactgaacaatttcaaatacttgatagytcaagtactggtgcttagatatctagtgaaatacaacttcccttcttgagtcctgactctaactataaattgtgactgcattccaaactaagagaagcacatttctagctccagagtattgaagccatgctgattaggaacattttgattattacaaacaccaatagtaattattcacatgagaggatttttgtgactgcaatcatgctttaatttctcctgctgggtttcatatttgtaaatgcttcaaagattaaccagtcttccattctcattgggaagtattacttgattatctcctgtctgctttacttaggatatcagcctgaaaaacwctggcagcacttaaactacttatgagactgtaatcactaggatggggtggggctgggaatacgtttttggagacagagaatctgggttttcttatttagtaatacaagactcttagttccatgaagaccaggagtattcagagaaaacaaatggtttttaaaagtcatacataagatttaatcttgaagtgcaaaatagatttctggactgaagtgtaagaattagagggacttattgggagacaattcactgtgtgtatcttgcatttctgcacattctctgaacacagattttgattgcctttattccagattatcttttcaagtatttctctgtaataaacagccttggaagatagaggtagtgtctctctcctgaagaaacagcagatttgctcatagccatggaagatagagatagtgttcctctctgcaaggggcaggtacacttacttctcatagtgaaagaggtgggtttcctaaawtgaggatctatctactgtaattcacccaatttcatctgtagatgtcacttggccctcttcacgttgccctgtgggaattggggtaaagggcactgatgcaaacacgatgtcatgctgtttgctgtcccatgaataataaagcactttgtctcctacccagaagtcttgcatcttcttccagcagttatgaaactgcaggaagagaaagtgttagcttgcaagtagggtaaggcattagacattgcatagctcttgatacaatgcagtcagataaagtgataagaagataaaataactcaataagggaaaactaaaaaatagcctgagatttcctttcttcctgtttaataaagacacacttagcgttaactcatttattcatatagtaagcaccctctatgtgacagatattattctacttaccaggaatacagttctgactatgactgtcaatttccttcttctcttggtactgagcagaaacaggaacaaatatgtgaatgtgtgtgtgtgtgtgtttgtataaattccagatggttatatatactatgaagctaaataagaaggacagtgaaataaactaacacttctttaattataatagtcaggaaaagtctttatgaagtgataacatttggtataaggtcttcaatgtagaatttttgggaaaggacatgtcagatgacaaggaaaaggagagggagtgaaaaggagtgagagggaggggaaaagaagaaagaggggaagaggaaaggaaagagagcaaaagacaaaacagcaatagaagagaccctaggatttaatacatttgattttcttttccagaaagagaaagaaaagcagtatggctgggacataatggatgagaaaaaatggatatttaatgaatttagccctttgtgctggcacaaaatcatactggaaattatagaccacagtaaggtaatcaaatagggtagctgctttctctttaactttatgaattctttcactttcctcattatttttaaaagtcttaaagtttattgatgccatgagtattctgaaagtaaggaatacatttgcactggaaaatgcaggtgtatggatttctagaacagaatgagaaaaaaatacctttacttagaaacttctgaaatagaactaagtattattacaactaattacactgtttctattactactaaaacatagatacttctgatgctactaaaataaaatataaatataaggaaaaagagaaggaggaggcagaagacaagaagaaaaacaaacaaacaaaaaacccaacaaattattgagagamtcatcttccaagaactaagytcactgctttacatattttttctaaacttcaaaagtgctcaataaaatgctgcagtgctcctttcagagacagaaatgaatgctcacagaagtgaagtcctttgtttgggatttcccagctagccaatgcctgggccaggagttgaaccttggaactacccagctcctgagccaggatatttgtgcaatatgcagcccatattgtaatgaagcatctttatgccgcagatgttccttcacttatgaagcagacggctttgtcatcagttgatagagagttgcagtatttcaaagattgttaggttcagtcatgggacaaaatgattggtggtttttatctgcattgtttgaaaagtgtcgctctacacattggctgaaatacagcacataacatttcttttttctttttwtcttttaatggtgtcatcagacaacagatgtatcatgtctacacaatacgatgagtagaagtgcctaaatcaatcatgtagcatgaggatatagctgatccatgctgcattccaggtgcttctagactttggtcttttggaaggaaaaggatgagtttctggaaaatatctctaaagaaaaaaggattattattattatcccaaaggaaatgtttcataaatgcacataatcaaggggaacacataaaattatctgaaaaagtaggctttgatctaatagaatatcaaatatacagtgatctgaaatttacttcttgggtaattggaaaccaatttgttgttggtttgtcaaccaacatgttgacatgttgttacactgggaaaatatatytaaaagagattgactaaaccagtgttttcataactgtgttataaagaatgcatgtttctagagatagtagcattttatgaaaataagttctcatagtttgaaaaacctctggcaaaatttatttatttattataagaattgatattctttcttagtaacagaaccccatttagttagttggggaaggattataatcttatactatgtgcctgtatttctcagcctttacttcactggggaagccagtgaaatgtaggtctaattttggagtgtactatgagaaaagtcctgtaaagggttctaaatgaacttggaggagcatccattttgccacttccctgttttatttttctgcttggaaattgtgtgtaatgatggaactccaacagcccagttttgtgacattgggttgttttcaggataaaatccacaaattagcataacaaaacttataaatgaaacttcattttactttgtgatactactatatgagccctgatgtactgacatcttcattagatgtttggtaggaaagtaaaatggtaatggtttaagccattgtagccaggtctctgctatttaacagaaaatggacataattcctgatacatttgcatattccacatttttcttaaaggttttgcaggtacatttgatgattaaaaatcctgaaaagtgttgtcataaataatatctacataaataaaataactactaagaagttgccatcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaagaaagaagttgccatgtgctagagattgccctagatactgaggatgtgggaagatgaagagtgattgattctatgtcatggaaggcttttcagaagatgctaaattaagttttgaggggtgaatagaagtttcttagagggaaaaatggaaatataatacagattgaaagtgtaataaaggaaaagagatataaatatcatgtttcccaagaacttcagcatgcttgatacagctggaaaacaggagtgaatttgtctcaagggtggatatgttgtcctggaacagagttacatatgtagagaggtaaacaaaggccaaattgtgaaaggctttttgtagcaatctaaggaatacaggcactgtacactaggcaacatggaattattaagcagttgtaggcaaagataaacaggattgtatttgtgttcttgaatgacctcctggcatcaatatggaggatggataagggagcttatttgtgggattcaataaacaaatataagaaagcccaaactactacagcagtcacttctctgacttattaataaaaagccactggtgtttattcatgcaacaatgcccattccatgaacataaccaacatcaaaggaaattaagaacattcactgttaaaccaaaagaaagctcatatttgaggaaataatttccatgaattaaaaatttaaaaatatcctcccgttttccaattttatttaagaacaacccttttataagtgcacaaagttgcagacacctctttgatttaatcagatcttcccactaacagcagcttccacattgaagacagtttttgtttctctgccactttgcagaccttttagtacctcaggataagagcatagtctattcttgttttttttttgtttgttcgtttggttttttttttgtttttttttttttgtttttttttgttttttttgagatgaagtctcactctgtcacccaggctggagtgcagtggtgcgatcttggctcattgcaacatctgtctcccaggttcaagtgattctcctgcttcagcctcctgagtagctgggactacaggctcacgccaccacacctggctcatttttgtatttttagtagagacagggtttcaccatgttggccaggatggcctcgatctcatgacctcaagatccacccacctcagcctcccaaagtgctgggattacaggagtgagccaccgcacccagccaagagcatagtctattctacgtagtcaaggaagtttgcgttttcccagggctcccctttcctagcgtttagaagctggttagagacagcacacagtgacatttatcactatgcccacttgggcattgtgactgaagccaagatcactttcaacaaagtagtaccatttacactaaagtgccagtggttttgcatcagtgaaaatctgtatagccctgatttcaaaggaagtaatcactttttcggaaacagtaacagccttaggatcctttagcatgtctaattttttttaatagtccgtatccctcttcattagctcctggcccaacttcctaccacactaaattctgaggaggttgtgagcttttgaacaatcccccatcttcactgtggaacgtttactttgtgatcttttaggaagggctgtaaaatacttctgagtgtggttccaagctgaggaattagattttatcagggtcttcttgttgggatggttgtaggtaaactgtctttctcattgtaatagtggttgttgctatcatttatatcctagccacaattctcatcacctctattctgccaagtaaatttctgagagaaatcagtcagcgtagaaggaattagtattcaggtgcacccatgtggttttgaccaccatctatatatttttttaaagactattgtctctgaaattatttctctaggaatattgttttcttttaagcccataaaatgcatcatttcatgctaaatagtatatccaggaaccaccactcacaagaatttttggcagaaagtatcatcgttttcatctgaccatggcggacactgagtaaacagactggagggaaaaatagagtgacggttttgcttacctagtgagcttaataaatacgtatgttaattagaaaataacaaatggatattttagaaatatattactctaaaataggttgcttatagaaaatatattttttcttatttttatttgtacttcaacttgtttccaaagggaatttgtagtggctagtggtgcatattactactatcattattctattaaaagttttgcttgtctcttagagagcaaattcaatagaaaagaacactactgaatataaatctaattttactccaattaaattcaacttgttattttcaaaagagcaataggatcagtaagaagaaaagcagaaatagatagcttgttttttaggaaggtgggtcaggaagctcagtctttgttttgcacatatggagataaaaacactggaataaaaatcatggaactgaatcattaaaacattacaaaacaaaactttttgagagttaaaggcatcccctcatatctaggaaacatactgactactggtttataaaagtaatgcaaatcatacaagtcccacagattnnnnnnnnnnnnnnnnnnnnttttctcccttctgcaagtcaataggtgactatgtgaactaggacacatttactttctgattttttttttcgtagaaagcaaaattatgatttttaaaaaatttgtttagttattgtttattatttcaataggtttttggggaacaagtggtgtttagttacatgaataagttctttagtggtgatttctgagatttttgtgcactcatcactcaagcagtatacacgatacccaatgtgtaggcttttatctctggccatgattttgaaaagagttctaacaaaaaaacagcaaaagaaacatttgaaccagtgtccaagatcaaagactaaaaagtcctctgttagtaactaaatgtaacataatgcaaaccagaattttaaaaccagatagaaaaatttaggtagttacttctcttaaggaagagagacatgagaacacattcttcttttcaagtagtaaaaaaggcctttatcgtattctgctaaggcttttctggttaaaagattaacgaatcttctttaggtttctagaaatacttagtaacccagtttcataagatcccattatatcacagtagggtatgtgtttcagaactcttggatataaaagtttagcttagcaaaaaagaagagccaaactactggagggaaagtattgacttttaagaaaaagaagtttcatctttagtgattaaattaatcaaatggatatttttcactttccttccataaaacacatttttagagaccattcaaacataagttgctctcagaatcatactaattggctctctggtaattcaagagatgacttgttgatgaagaagatactgatacgctcacaagcgaatataagaaggagcagtcctactcatatttttaaagatataaataagaagaagcactttagaacagaagcttgagaaaggttccttaaagagatagtaatgctaatatatattgtcacttgtcttcagggtaaaaacgagggaaacatctagaaytgaatccctgtaaatggcgtaagaatcttaaactatcagaccctaggatgaagctgcatgacccacctagctccctagttatggtttgccccaaatataaggtttctgtaattgctcatattctattaatctgtgtggaaaagaaaggccattttctactgctgtgctgcaaaagaaattttttaaatttatagagcatagaagcagcaacatttctggaatccawgagcctgaaagtctcagctggttgcctcgtctgtctactttttttttttttttttttgccatagtacctcagtttatttggatattggccctyaaatggctcagaacggaaaatggaggctgacaatcatgatcagtctcataccctttggtaccyggggattaggaatgaatgtatggcccaatactgaagagagacatgcaggaaaatctatctatgtggctttacccacaggaaacatgyaatagtaggaacacccttctttttcacttacagtgggcatatgccaatatggtaccaagaaactgatgaacacatcttgcaaacgtaagtaacagctgccaatatcctaaggagaaaagaggacaaaagtactgagcatctgggtccatgataatattgctgatttgctatatgaactctaaaatcaagctgaagcttgtgtctaattttctgtaggtatcttgaatatctttaaatctctgtgcaggcaaaggcacttactgcttttgattctgatcatttttttcaaggatgtttgtatagcaaaagagtttgaaagatacagatagtgtctcattctggaaccaacggcggctttgcttactgttttcagtgtggtaaagataatgtttacctaaaaacaaaacaacaacaacaaaaaaaacaaaaaacaaaacaaaacaaaaaaactttaggcaagattaccgtccattgaagaagacttgttttctaagtttcgagtttctctcctgtaatgcagccaacttcatgtaagggcattgtctgaaccagtgtgcagttaaaatcaacacaaaagctgatctagcagagtaaaatcttagcgtcttcaccgttactggcactgggtttcctgttgtatgaggtaataaatttcctcagaccctctttgaatggcatgttctattatttatggataaaaatattttatctgaatatcatcacaatactatttatgttttgaagaaaagagaagataatctctagatacatgtttcatgttagagttagcagcattatgtagtgaaattgtaagagttggacacttctgagactttaggaaactatttgatacatttgtctcaatgttctcttgttgaatgggggcagtaaatctgccctaagtaaggactataccttgcatataatatatatggtcacttggtattctattttttaaaaaatcataaaattttatatgaatgctctcaaaaaagcaacttacaagtgcttatataactaatatttawatcacaacattttaactctaacaccaggtgttacaattgacagatttcttgaatactacaataaacactttttaaatttaattagtattctgaggctcgacctgcaaagagataaagtcttaagcacagctgcagaattatttctttagatgactcaaataatgtgacccaaaaataaaaaagaaagagctagaatttttccttcttctttttttctttatttttttagttggtattctaagaaggcacagatgggctatgtttaatgaatcttttgcgaagtaatcatcaatgaacaaaaaacttttaaaacatgtttaccagtttttgttaatctttaccatgtggaggagaacacatggaaagtagaatgtgaggtggtgacagagaggaaaattggagagctacatgaggtgtgggctggcaggattgatggtgaccagggatgcagggcatttagggaggattagagatccacacagataacctgaccagaagcttggtgaccaacagtgggagtgctgggaggagatcggcaaagacagaaaggaggccttcacagctacagtttggttacactgagcaagtaagtaactgcatttagaataaaatggaacctttcaaagcaaaagaagttattaatagac

SEQ ID NO: 10916 - DNA, 201 bp, Homo sapiens
atcctaaattggctattctgagttacacagtttgattttcttggaaggaggacctggtttcattagcacctagttgcaaatgaatctcctccttgaagttyttgttgctatttgagcttgtttttagctggagatttactcttggattttagttgttttcgccttcatctgttgaagaggtgggatgatattgcgtgtgtg

SEQ ID NO: 10917 - DNA, 201 bp, Homo sapiens
tacaattgagtataattagccaaatgcctcttgcatcctaaattggctattctgagttacacagtttgattttcttggaaggaggacctggtttcattagmacctagttgcaaatgaatctcctccttgaagttcttgttgctatttgagcttgtttttagctggagatttactcttggattttagttgttttcgccttca

SEQ ID NO: 10918 - DNA, 201 bp, Homo sapiens
gggagctcaaattctttttcagggcctcaggtcataataatgataaaacgaaacattgtatgttaagtgcttagcacagtcgtgaggcccaaggtcagttscccgataaatggtagctgctataaacatcatcatcattaccatccttgtgaaggtggagtgaacttattctttcaagacatttccactgacagataaatt

SEQ ID NO: 10919 - DNA, 201 bp, Homo sapiens
taagcgagttctcacgagatctgatggtttaaaagtgtgtgtcaattgcttcttttctacccatccccatccttccgctgtgtgagatgttcctcgcttcstcttcgtcttccaccatgattgtaagtttcctgaggtctccttccccagccatgccaagcggtgagtcaattaaacctctgttccttataaattacccag

SEQ ID NO: 10920 - DNA, 201 bp, Homo sapiens
gtttcatgctctcaatttttacttggcttgatccgtgctgtctccatccggtgttctgaggcatttcacacacgactggtcttcggcaactgggccaagcytgttctgttctttttcagttttcttaattgcaaggctttttgtttccccactggagaactcccataccaagaattctgaaatctaggtactcagacctta

SEQ ID NO: 10921 - DNA, 201 bp, Homo sapiens
gtggcaagacagtcactagcagaagtgttgcatctttattctgtcagttaagtgacttaggggaaacagagtgcagagtccacttcctggtcgcttcatcrgaagtcccagggctaactctgattggactcctcttcctcacttgcccataaatcaaccaatcacattgttcaggataggaatacactgactgaccaggct

SEQ ID NO: 10922 - DNA, 201 bp, Homo sapiens
tgcccaggctggtctcaaactcctgggctcaagcagtcctcccaccttggcctccaaaatttctgggattacaggcaggagccaccacacccagcctgtaytgactttattcagggaatgtctccccaccccaactcccagtgtggcaagacagtcactagcagaagtgttgcatctttattctgtcagttaagtgactta

SEQ ID NO: 10923 - DNA, 201 bp, Homo sapiens
gtgtgacccttatataacttccttactttgctctcatttcctcatttccctgtggctcagtaaatcttccaatatcttcttgtgggttcgtgctcttttgyaccctggaatggtaggacatgggcgctttgggatatttcctataactcagaacaggtagcctggaagaattttgcaatgaagctttgagctggcatcagc

SEQ ID NO: 10924 - DNA, 201 bp, Homo sapiens
tttaatatagtagaatggctcctgaatttttgaaaatttaagaggaaaatgtatccctgcaccatctaaaatgatcttgtacaccatcagtataccacacmctggaatacaccacgttaaggaggcccttagcggaaggcgttgtccactttcttctttgaatggtatgaaaggtcttacagtgtccttgttttcacaacc

SEQ ID NO: 10925 - DNA, 201 bp, Homo sapiens
ggcctcacaatcatggtggaaggtgaaaggcatgtcttacatggtggcaggcaagagagaatgagaaccaagtaaaagaggaaaactcttctaaaacaatmatatctcatgagacttattcactaccacaagaaccttatgggggaaactggccccatgattcatttatcccccactgggtccctcccacaacaggtggga

SEQ ID NO: 10926 - DNA, 201 bp, Homo sapiens
gtttggttttcagtgaacgatatgttttggagagctttccattttttgccttcattctctttgactgctggaaagaactccatgatatgcatgcatcagartatttttaagcattttcttctcactagactttttttgggggggtgggatgagggctatcagtcatatggctgtgttaaggatcgttggggagtcctctgt

SEQ ID NO: 10927 - DNA, 201 bp, Homo sapiens
ttttattatatgcatttgcatatgtttttgtttttctgagacagagtcttgctctgttgcccaggctggagtgcagtggtacgatcttggctcactgcaayctctgcctcccaggttcaagtgattctcctgcctcagccaccagagtagctgggtttacaggctactacaggggtgcgccatgacgcccagctgattttt

SEQ ID NO: 10928 - DNA, 201 bp, Homo sapiens
tccactatacagacagcttaagtcatgacgcaggcacagtgctggtaagcttcagagctgggatttgaactggctctaggagctatgcccttaaccattaygctatattgcttctcattaaaaaatgtatcctcattgtaaaaaaaaaaaaatgaaaatacagataagcattcctttggcttggcatctcaatgccaatct

SEQ ID NO: 10929 - DNA, 201 bp, Homo sapiens
  misc_feature (1)...(201): n = A,T,C or G, or insertion/deletion polymorphism (see Tables 1-2)
acctaggctgtagtgtggttttcccaacatcacctcctgataggtatccgacatcagtgctgccagtggaggctgtcctcaggtgtcttggggaccagggnaagaggccatgctgcccagtactttatctgggtgtgctgtggggagtggtggtgtattccacaggaatgcacagcacacaggtatgcaaagtggattctt

SEQ ID NO: 10930 - DNA, 201 bp, Homo sapiens
gcagatgggcaggaagcctgacagttttcctggaccctgggctagatcacccttttcatcgtccagggtccctcctaccacttaaaatggatttctgtgcrattatttattcttgccccttcttttgaagtcctttgagcctttgaacttgatatggtttggctgtgtccccacctaaatctcaccttgaattgtagcttc

SEQ ID NO: 10931 - DNA, 201 bp, Homo sapiens
ttctagctccatcgctgagttcttcctcccacctccatctttacttttggaaagcacagttgaaatctacctctcagggttcttattaggatcgaatgaartaaggtgtatgaaaaccctgaaaactgtaagaagaaatacaagtgtgaaacatgtcattgttagtcccgctttgcctttaagtcctttaagttttaagtg

SEQ ID NO: 10932 - DNA, 201 bp, Homo sapiens
aacaggcaattattcttatatataaatataccatgatgctagaaatgatactaaaggctcttggtgcacaagggtgcctggcacagttgctggtgaagacrtcccagggcggtggtagttaggctaagattggaaaaatgattagaagttggccaaccagggtggagtatgggggtagggaggtagtgtttaggtggagga

SEQ ID NO: 10933 - DNA, 201 bp, Homo sapiens
agatcctgtctcaaaaaataaataaataaataaataaaaataaatatagtttaaaagagaatggtatatcactgccaataatgaaaaccagtttcacttaygataagcagaagataacagcaaactaacaatcaaataaacaaacaaaatcttgccactagtaaaaaaaccaaaaataaagattacagtagtaatattaaa

SEQ ID NO: 10934 - DNA, 201 bp, Homo sapiens
agaagccacagttcgtctgaaggttaacatctaatgagtagcagtgccagcattcagttgaagacccaacatcttttctgacccatgatgttgtgctaacsctctgcttgtcctgagaagggaacagctctggcaagggttgtacctatctgttacaaggtcgtggggttaggagatgcgaagttgctctcacccatgaag

SEQ ID NO: 10935 - DNA, 201 bp, Homo sapiens
tttattgggagcttacctgagtgccaggtactgtgttaaatgctttgcctccattatctaatttaaacatcatgacaaacctatatgacggtgaccatcargattttcatccacctttgaggaaacaggcattgagagattaagcagcgtgtctgggatcaatcttacgccagagcccctgctttgagtcacaatgtaaaa

SEQ ID NO: 10936 - DNA, 201 bp, Homo sapiens
tcgccatgttggccaggctggtcttgaactcctggcctcaggtgatcctcccacctcggcctcccaaagtgctgggattacaggcgtgagttaccgtgacyggcttaagtgaggcatttctaactaacagattccatttattgggagcttacctgagtgccaggtactgtgttaaatgctttgcctccattatctaattta

SEQ ID NO: 10937 - DNA, 201 bp, Homo sapiens
gcaattctttgttttttaaatttttttattgtgtgtttttatttattttattgtttatttcttttttctttcttttttgtttttgttttgagacagagtckcgctctgtcacccagactggagtgcagcggtactatctcagctcagtgcaacctccatctccgaggtttgagtgattctcatgctgcagcctcccaagta

SEQ ID NO: 10938 - DNA, 201 bp, Homo sapiens
gttgctgatacggttattacaggacagcttgtggagaatgtcgtcctgtagcatccctcacacttctgtacgatgaagagcattgctttgttctgtttgasgcacgctttgatcttgttgacaacacaattcttataacaacttatggttttctttttgcttggattaccgcacaattcagagcttaatgcatgattcttc

SEQ ID NO: 10939 - DNA, 201 bp, Homo sapiens
  misc_feature (1)...(201): n = A,T,C or G, or insertion/deletion polymorphism (see Tables 1-2)
acaagttgagtcggtgcatatgcaaatttgttttgcttttctcaattaaagtagacagttctgttgtttagtttccacatttaaggaccaggtgataattncattgagctagaggaatattaattaatttagcttttactgctttgtgttttcatcatgccttaactagcactgaagggtactacaagaaatagttatttt

SEQ ID NO: 10940 - DNA, 201 bp, Homo sapiens
acattgcagaattagtaagtatagaagttaggcttacttccccacttggaaatgccacctaggcagttggaaatacggggttatggttcaggggagaattkaaaactaaagttagatattacatatgtgcatatattatagagtacatatcatattaattgatgatctgagaactgataaaatcacagcattatcatttct

SEQ ID NO: 10941 - DNA, 201 bp, Homo sapiens
  misc_feature (1)...(201): n = A,T,C or G, or insertion/deletion polymorphism (see Tables 1-2)
ctaaagttgtgtatgttataaactcttaaaaatttaagagttggtaatttttacctgtttaatgggtgtacaaatatcaactaattcagaaaatgtcatgnagattaattcaacaattagtatgaagcctttaggatagtgcttagcaaatagtaattactcaataagtgttagttcttgtcatgataactgctataatta

SEQ ID NO: 10942 - DNA, 201 bp, Homo sapiens
taccagcagggtactatgtcactctgaaatatttctggaaggctttaggactttgaatctgctacagttcagaggttatctctgaactggggctggaggagtgtgtgtgtgtgtgtgtgtgtgtgtgtgtgtgtgtgtgtgtgtgtgatgaagtagacagaatatacttcttacaattaacataaatctgaaaaatgaacc

SEQ ID NO: 10943 - DNA, 201 bp, Homo sapiens
  misc_feature (1)...(201): n = A,T,C or G, or insertion/deletion polymorphism (see Tables 1-2)
ttaacacatctttcacgactgttggttaccattttgggtgtctgtgtatgtggtgtgagtataattaagatctaatcgcttcacaaatttcaagtgtatantatgatattactaactgtagtcaccatcctcagaacttattcattcaccttataatggagagttggtaccctttggtcaacatatctacattatggccat

SEQ ID NO: 10944 - DNA, 201 bp, Homo sapiens
  misc_feature (1)...(201): n = A,T,C or G, or insertion/deletion polymorphism (see Tables 1-2)
gtgttagttcttgtcatgataactgctataattaaggacactttctgcttttgctgtcatgtactcacagtgtgtccttgggaaagccacttccccttttnaacttcagtttactcatctgaaaaataggagaagagtacagctaatgattgtgaacaaaccttccagtgctaacattctgtggtcttggggtttttcttt

SEQ ID NO: 10945 - DNA, 201 bp, Homo sapiens
accagcagggtactatgtcactctgaaatatttctggaaggctttaggactttgaatctgctacagttcagaggttatctctgaactggggctggaggagtgtgtgtgtgtgtgtgtgtgtgtgtgtgtgtgtgtgtgtgtgtgtgatgaagtagacagaatatacttcttacaattaacataaatctgaaaaatgaacct

SEQ ID NO: 10946 - DNA, 201 bp, Homo sapiens
  misc_feature (1)...(201): n = A,T,C or G, or insertion/deletion polymorphism (see Tables 1-2)
tttcaacttcagtttactcatctgaaaaataggagaagagtacagctaatgattgtgaacaaaccttccagtgctaacattctgtggtcttggggtttttntttacagcaattcaaccaatgaggggatgaatgtgaagaaatgctgcaaggggttctgcattgatattctgaagaagctttccagaactgtgaagtttac

SEQ ID NO: 10947 - DNA, 201 bp, Homo sapiens
  misc_feature (1)...(201): n = A,T,C or G, or insertion/deletion polymorphism (see Tables 1-2)
cctgcccaggcctgtcctctttgattcatgcttattctggatttcttctctctgtcaatggtattcctgttgtccaagccttccttgcttggaaggaacangaaggacggatgtatattgagctccctgatgtgcaggcagagtgttgcaggcagggatccgaggaccaccaccctcattgtagagaggaggaaagtgaag

SEQ ID NO: 10948 - DNA, 201 bp, Homo sapiens
attggtatcccaaataatggattgagaggtgttggccagaggggagaagaactggcaacatcaccacctaaatgaccccagggattctggccaaaagcagygagcaatctttctcgaagccccaacatctgctgttgctcagaaagcttcctggcagtttgagccaacttaatcagactgttctcttccacggcgctcgga

SEQ ID NO: 10949 - DNA, 201 bp, Homo sapiens
caataggctattcagctaagtaactacattgcagaattagtaagtatagaagttaggcttacttccccacttggaaatgccacctaggcagttggaaatayggggttatggttcaggggagaatttaaaactaaagttagatattacatatgtgcatatattatagagtacatatcatattaattgatgatctgagaactg

SEQ ID NO: 10950 - DNA, 201 bp, Homo sapiens
cccttatcagatatacaatttgcaaatattttttcctattccatgggttacctttttatattctagctattacattgatagtgtcttttgatgcacatttwaaaaaaaatttagggagtattgtctttttaccaataaatatttttctaaaaggcttgagttgtcctcagtgacatgtctgtaaaaacaaaagaacagtgt

SEQ ID NO: 10951 - DNA, 201 bp, Homo sapiens
  misc_feature (1)...(201): n = A,T,C or G, or insertion/deletion polymorphism (see Tables 1-2)
tctaagaagtgaaatggttgaattctttgatctctaaactagttcatgagattcttttatctgtgtcaaacacttaggaagactcagacaaaccacatatncaaacaactgtcagttttgcagaaaggatttagaatcatgccccaaaattgggtgcctccaagcctggccaatggaccaactgtacctgaatcacatgat

SEQ ID NO: 10952 - DNA, 201 bp, Homo sapiens
  misc_feature (1)...(201): n = A,T,C or G, or insertion/deletion polymorphism (see Tables 1-2)
ccaagtcactttctagtttccccatctaagaagtgaaatggttgaattctttgatctctaaactagttcatgagattcttttatctgtgtcaaacacttangaagactcagacaaaccacatatgcaaacaactgtcagttttgcagaaaggatttagaatcatgccccaaaattgggtgcctccaagcctggccaatgga

SEQ ID NO: 10953 - DNA, 201 bp, Homo sapiens
agaataaatttcttgaaagagtgggtcacagttgcaattttaacagatattgccaaatctccctccaaaggaaattcatacttaccccatcagtgcatgaragagcttatttctccaaagttttgccaatacaatgtgtaattaatctttcaaaattttgctaataggtaaaaagtatgctgagatataaatttgcacttt

SEQ ID NO: 10954 - DNA, 201 bp, Homo sapiens
agttattttttatagagtcataatctttcattatgcaaatataccatattttatttggtcaggcctctattgttggacatttaggttgtttccaatctttygctattgcaaacaaagctgtagtgaatatctttgtattgcgtcacattcagtgtagaataaatttcttgaaagagtgggtcacagttgcaattttaacag

SEQ ID NO: 10955 - DNA, 201 bp, Homo sapiens
ttcattggagttaatatttggggaaaccacatacatgtttaacaggctccttgattaattatttaaatttttttttttttttcagacagggtctcactctrtcacccaggttggagtacagtagtgtaatcatagcttattgcagcctggacttccctgggctcaggtaatcatcccacctcagcctcctgagtagctggg

SEQ ID NO: 10956 - DNA, 201 bp, Homo sapiens
atggttggagacagtggttgatgcctagctggctttctctccctccatttattaaccagagcacaaaatgggttgttttctttctttttcaatcttttttytaatataatagcaaaaaggagagaaatggaaaccattcgtggccataaattgtacaaattggtttctggaagccatataataattataacatccatctta

SEQ ID NO: 10957 - DNA, 201 bp, Homo sapiens
tttttgtttgtttccattgtggtcttttaatcaacatatactgttgttttggacagaccatgcgcacaaatgcagatgataatggttggagacagtggttratgcctagctggctttctctccctccatttattaaccagagcacaaaatgggttgttttctttctttttcaatcttttttttaatataatagcaaaaagg

SEQ ID NO: 10958 - DNA, 201 bp, Homo sapiens
  misc_feature (1)...(201): n = A,T,C or G, or insertion/deletion polymorphism (see Tables 1-2)
tacctggcctaaggtttatgcttaataaatatgtgtcatcactgcaatgttttgggatgttttctctgtatgtaaaatggtgcccatgtccacctccctgngctattgggggattaactgagacactgcatgacaaaactctttggaagtccagtgcaaatgagtggacttgtgacctctcacattatttctgtttgtagg

SEQ ID NO: 10959 - DNA, 201 bp, Homo sapiens
  misc_feature (1)...(201): n = A,T,C or G, or insertion/deletion polymorphism (see Tables 1-2)
gcagggaggttgcaaatagctccagaagaagttcagatgaggtcatacctgatatcttcgtggtgagttactgaggggatctgggatccagatttgactgnttgagaacaaagtcatggggccagctagacatgccacttggtggtcctcatggactttatttataatctcaggcaaagagctggtgcagttaggatattg

SEQ ID NO: 10960 - DNA, 201 bp, Homo sapiens
  misc_feature (1)...(201): n = A,T,C or G, or insertion/deletion polymorphism (see Tables 1-2)
agctgataataagcactaggcaaaaagtggattagggaaaggcaaaaggaagcccttgggtggtggtgcgatggggttttgatttgaaatagagccatctncacgggagggtccacttgagaacaggcaggtggaataggagagaacttgatcgtttctgtgattgagaaagagaggggactggaagtgcagttgttcctg

SEQ ID NO: 10961 - DNA, 201 bp, Homo sapiens
atagctccagaagaagttcagatgaggtcatacctgatatcttcgtggtgagttactgaggggatctgggatccagatttgactgattgagaacaaagtcwtggggccagctagacatgccacttggtggtcctcatggactttatttataatctcaggcaaagagctggtgcagttaggatattgttgctcatgggctgg

SEQ ID NO: 10962 - DNA, 201 bp, Homo sapiens
tgtgtgtaagatagacatctcttcttcttgtaacatcttaaagtatatacatttagcatggtgccaggcatggagaaggcattttacaaataactatcagrtcattattataattttatttttcttattattgtggtcatcatcatcattattataactttatacttgttacactgcaagctctgagtaagctaggaaagc

SEQ ID NO: 10963 - DNA, 201 bp, Homo sapiens
gaaaaagatggagttagtgataataatcccatatcctgacctgctaatgatcaactggaagctggaagtgactgtcatctctgcgcagtacaccttagtcmccacctgggttggtttatttatccatgttacctccagggctttttaaagtattttatcccaggttgtcttgtactcatttttattatttttatcataatc

SEQ ID NO: 10964 - DNA, 201 bp, Homo sapiens
acgcctggctaacttttgtatttttagtagagaccaggtttcatcatgttggtcaggatagtttcaaactcctgaccacaagtaatctgcccgttttggcytcccaaaacgctgggattacaggcatgagccaccgcgccgctccaatttcagacattaaccactaaacgcccgtagtggtttaattttgtttaagttagt

SEQ ID NO: 10965 - DNA, 201 bp, Homo sapiens
gtggctgtggatgttgcttctgaaacaaggcaggatgaacgttccttggagcactggcagggggggacattcactatattctaacgttaatacttgggttktcttgatagctgagatgctaaactttgctgtgagagcttggaaaagtctgttctctctgagcctcagtttcctcatctgtaatatgggcaactcctttat

SEQ ID NO: 10966 - DNA, 201 bp, Homo sapiens
  misc_feature (1)...(201): n = A,T,C or G, or insertion/deletion polymorphism (see Tables 1-2)
cctttgtagagctatgtttttccaaatgcacttccttgttcctaagttggagggcattgttaacattcatgggctaatattaatgagagccactggatacngggattgggatggtgctcaggactctcgatgaattctcattttatactcatgacaaacctatggcatggctgctatgattatgcccattttactgatcaa

SEQ ID NO: 10967 - DNA, 201 bp, Homo sapiens
ccacagtgagatataatctcagctcagaaaagatattatcaaaaatacaaaaagtaaatactggcaaggatgtggagaaagagaactagtatacattgctsgtgggaatttagaacagccattatgaaaaacggtatggagtttcctcatactaaaagtagaacttctgtatgatccagcaaccccattactgggtaaata

SEQ ID NO: 10968 - DNA, 201 bp, Homo sapiens
taaacctgggaggcagaggttgcagtgagccgagatcgcaccactgcactccagcctgggcaacggcaagactccgtctcaaaaaaaaaaaaaaaaaaaaraactctgagacttcatatgagactcaaatatgagtttaaatctcatatctcagctatgactgcttttcaactacttattgtatccttgaattagctcagt

SEQ ID NO: 10969 - DNA, 201 bp, Homo sapiens
taggtcttggggacttgaccgttcctgttggaagttcagtgcatgatatgtaaaaggacttagggtgagcatgggaaggagcacaggctttgtagctgccmaagttcaaacaccagctctgcaaaactggcccacggggctcagtctccttaactgtgaagtgatgatagcacatccaacccacaggtctttaaaggaaga

SEQ ID NO: 10970 - DNA, 201 bp, Homo sapiens
acctgggaggcagaggttgcagtgagccgagatcgcaccactgcactccagcctgggcaacggcaagactccgtctcaaaaaaaaaaaaaaaaaaaagaastctgagacttcatatgagactcaaatatgagtttaaatctcatatctcagctatgactgcttttcaactacttattgtatccttgaattagctcagttct

SEQ ID NO: 10971 - DNA, 201 bp, Homo sapiens
gcaaccttcttatatctctttaaatctttgtattagtcctgttcatttttgcttatatgatagatgtaaaacggaatctaaccatggtcttcaatttgcawttatcttattaagaagttgaacatattttcacatttattggccatttgggttttcttttctttggtttgtttttcttgaacagtcatgtcagaagattca

SEQ ID NO: 10972 - DNA, 201 bp, Homo sapiens
  misc_feature (1)...(201): n = A,T,C or G, or insertion/deletion polymorphism (see Tables 1-2)
gtgaatggagcagatccatgttcttcagttgacagaaagggagagttagagatgaacctaatgccctgcttaaatcagagggcgaagtgatatgaagtttnaatttaggaaggactttttttttctctctctaatggcctggagatatcctacaggctatgctgggtactttgcatagactaccttcaagatgcagagaaa

SEQ ID NO: 10973 - DNA, 201 bp, Homo sapiens
tgcaaggattctcgaaccttgggaaactagttaaaattcagattctgggcttaaggtgctgcatatttaaaagatcccaagattattttgataagctaccrgaaagtattgtaaagcagcaattggcaagtgttttatttaaaagcccagatagtcaatattttaggcttggcaaaccaagaggccacacattctgctgct

SEQ ID NO: 10974 - DNA, 201 bp, Homo sapiens
cagattctgggcttaaggtgctgcatatttaaaagatcccaagattattttgataagctaccagaaagtattgtaaagcagcaattggcaagtgttttatktaaaagcccagatagtcaatattttaggcttggcaaaccaagaggccacacattctgctgctatagcacaaaggcagccacagacaatacaggaaagggc

SEQ ID NO: 10975 - DNA, 201 bp, Homo sapiens
aggaatctgttctagctgttggtatggagatgctgaaacaccctgcagtctttgttctgccagcgtgtgagtatgcaactgatagtatttagtgaagaagycttactttattagaaacttttgcctaaatggaaactctaggtttgtacatcatttggagtagttccctgagacctgagtattcccaggatttacacctaa

SEQ ID NO: 10976 - DNA, 201 bp, Homo sapiens
ctgaggcaggagaatcatttgaacctgggaggcggaggttgcagtgagccaagattgtgccaatgcactacagcctgggctacagagtgagactccgtctyaaaaaaaataacaaaaataaaaacaaaaaacaaaaaacctttctaggaagtgataagagataccccaaataaaccagatagaatagtgattatcctttgt

SEQ ID NO: 10977 - DNA, 201 bp, Homo sapiens
attgttgatgactttacagtttagccatgggtttgggatttttgtttgtttccattgtggtcttttaatcaacatatactgttgttttggacagaccatgmgcacaaatgcagatgataatggttggagacagtggttgatgcctagctggctttctctccctccatttattaaccagagcacaaaatgggttgttttctt

SEQ ID NO: 10978 - DNA, 201 bp, Homo sapiens
aagccacactcttttcttttttgtcgtctttggctcaacattgtgtttgcaagattgttgcatgtaatttcagtgctttcattctcattgctggaatgcascacacatggatgtctctgtcctaatcttgatggacatttgggtaatgtcctattttggggccattatgaataatgcttcttttgttaatgagtgagcgca

SEQ ID NO: 10979 - DNA, 201 bp, Homo sapiens
  misc_feature (1)...(201): n = A,T,C or G, or insertion/deletion polymorphism (see Tables 1-2)
aatgaggggattttgattatccagaaaattagctcatatggggcatttcagttgtcacagattcctgcatggaaacatgactgtaggtgcattctccttgnggcttaataaataacctccttttcggctgttcggcaagcccattgtgaaggccttgctgctggctttgtgtctggtagggggagacagaggcccctctaa

SEQ ID NO: 10980 - DNA, 201 bp, Homo sapiens
ttcctttctcgttctctctccagtttcagagacctcatgactattccccaccttttcgatttgggacagtgcctaatggaagcacggagagaaacattcgsaataactatccctacatgcatcagtacatgaccaaatttaatcagaaaggagtagaggacgccttggtcagcctgaaaacggggtaaggatggcagtttc

SEQ ID NO: 10981 - DNA, 201 bp, Homo sapiens
catcctgccctaatgcatgcatttacctcctaacaccagacaaaatgatcactaatttattatttgttctctcctccccctcctcccttctctttcttttyctactctctctcttcctttctcgttctctctccagtttcagagacctcatgactattccccaccttttcgatttgggacagtgcctaatggaagcacgga

SEQ ID NO: 10982 - DNA, 201 bp, Homo sapiens
  misc_feature (1)...(201): n = A,T,C or G, or insertion/deletion polymorphism (see Tables 1-2)
aaagggtaaatgggtggagggatgaatggttggttgcttggatatatgtatgggtgaatcaattatattattaatttcttcagagtagaaattctggtacntgtatttatcttctctgttattagtatgacactgcatttaggaaatgctcattaagtatttgttgcctggttttctctgcattcagaaatgctgttaact

SEQ ID NO: 10983 - DNA, 201 bp, Homo sapiens
tcagttgacagaaagggagagttagagatgaacctaatgccctgcttaaatcagagggcgaagtgatatgaagtttgaatttaggaaggactttttttttctctctctaatggcctggagatatcctacaggctatgctgggtactttgcatagactaccttcaagatgcagagaaaggaaatgcatctaatgctgttagt

SEQ ID NO: 10984 - DNA, 201 bp, Homo sapiens
cactttgggaggccgaggtggcagatcatgaggtcaggagattgagaccatcctggctaacacagtgaaaccccgtctctactaaaaatacaaaaaaattrgctgggcatggtggcacgcgattgtagtcccagctactagagaggctaaggcaggtgaatcgcttgaatccaggaggtgggggttgcaatgagccgagat

SEQ ID NO: 10985 - DNA, 201 bp, Homo sapiens
gaggtgggggttgcaatgagccgagatcgtaccactgcactccagcctgggcaacagagtgagactccgtcacccccacccacccccccacccccccgccaaaaaaaaaaaaaaaaaaacagaaccaagagaaggaaagattattaggaaaccccacaatgaagaaacagcttgaaatcagccttgttaaaaacaaatact

SEQ ID NO: 10986 - DNA, 201 bp, Homo sapiens
aggtgggggttgcaatgagccgagatcgtaccactgcactccagcctgggcaacagagtgagactccgtcacccccacccacccccccacccccccgccaaaaaaaaaaaaaaaaaaacagaaccaagagaaggaaagattattaggaaaccccacaatgaagaaacagcttgaaatcagccttgttaaaaacaaatactg

SEQ ID NO: 10987 - DNA, 201 bp, Homo sapiens
  misc_feature (1)...(201): n = A,T,C or G, or insertion/deletion polymorphism (see Tables 1-2)
tgttggtatggagatgctgaaacaccctgcagtctttgttctgccagcgtgtgagtatgcaactgatagtatttagtgaagaagccttactttattagaancttttgcctaaatggaaactctaggtttgtacatcatttggagtagttccctgagacctgagtattcccaggatttacacctaacttggtttatatttgc

SEQ ID NO: 10988 - DNA, 201 bp, Homo sapiens
cttataaaaatccttttcttctttctgtttctttatgttgtggtttctgagcccattttagagtatctctgtgttggagttattatttttctgtcttgacttttttttttttttttttttttttttttttgagacggagttttgctcttgttgcccaggctagagtgcaatggtgcgatctccactcaccacaacctccac

SEQ ID NO: 10989 - DNA, 201 bp, Homo sapiens
  misc_feature (1)...(201): n = A,T,C or G, or insertion/deletion polymorphism (see Tables 1-2)
agaataatggcttccctaagatgtccatgctgtgaatatgttgcttatagtgtaaaggggactttgcagttgtgagattcagggtttagtaccttgagatncggatgatcctggattagcaaggtgggaccaacttaatcctgtgaatcctcaaaagtgaagagcttttccaggatgtggacagagaaagatgtgaagatg

SEQ ID NO: 10990 - DNA, 201 bp, Homo sapiens
ttataaaaatccttttcttctttctgtttctttatgttgtggtttctgagcccattttagagtatctctgtgttggagttattatttttctgtcttgacttttttttttttttttttttttttttttttgagacggagttttgctcttgttgcccaggctagagtgcaatggtgcgatctccactcaccacaacctccacc

SEQ ID NO: 10991 - DNA, 201 bp, Homo sapiens
attcagggtttagtaccttgagatgcggatgatcctggattagcaaggtgggaccaacttaatcctgtgaatcctcaaaagtgaagagcttttccaggatrtggacagagaaagatgtgaagatggaagagtcagagagatgcagtggtgctggcttgaagatgaaggaaggagtcataagccgaggaatgtgggcagcct

SEQ ID NO: 10992 - DNA, 201 bp, Homo sapiens
aaaacagaaagacactggggattcagaatgcacaacaatgtttgcaattgcaatgcagagacggtgatgtggcaggcagtcagtcagccagtcagtcagcrtgctccctttccgggatctgccagtggagtgcactgtgccccatggatgggcttcggagggggtagtggtgacatcagctccccagcagcttctcacctc

SEQ ID NO: 10993 - DNA, 201 bp, Homo sapiens
tataaaaatccttttcttctttctgtttctttatgttgtggtttctgagcccattttagagtatctctgtgttggagttattatttttctgtcttgacttttttttttttttttttttttttttttttgagacggagttttgctcttgttgcccaggctagagtgcaatggtgcgatctccactcaccacaacctccacct

SEQ ID NO: 10994 - DNA, 201 bp, Homo sapiens
agtggattctcccctacggcctccggaaaggaaagcaatcctgctgacaccttgattttagtccagcgagacccatttcacatttcagaaccacagaagtrtaagacaataagtgaggattatttaagcccccgccaagttgatggtaatttgtcatagcagcaatagaaaatgaacgcaccatggctgatcccattaaat

SEQ ID NO: 10995 - DNA, 201 bp, Homo sapiens
gaggctttctgttactccctaatcataattagtgccctgtcccctgcacccttgttattttctttgtagagctgtatttttttccttcatagaattcaacraaattgataaatatatatttacttgtatgatttatttattgtctatatatccatttgggaagaggccttggatattttgctcctcatctagtggaggccc

SEQ ID NO: 10996 - DNA, 201 bp, Homo sapiens
ataaaaatccttttcttctttctgtttctttatgttgtggtttctgagcccattttagagtatctctgtgttggagttattatttttctgtcttgacttttttttttttttttttttttttttttttgagacggagttttgctcttgttgcccaggctagagtgcaatggtgcgatctccactcaccacaacctccacctc

SEQ ID NO: 10997 - DNA, 201 bp, Homo sapiens
gactgtgagttctttcattcctgcaccacaagcacttcctctcctccaccaggacatggcactatgtctggcacatagctctaaaatgcaagccccatgargcagggagtttgtccatcattgctatactccagtgcctagaatagtacctggcacagagtagctatatagtaaatatctgttgaatggatgaattattga

SEQ ID NO: 10998 - DNA, 201 bp, Homo sapiens
taaaaatccttttcttctttctgtttctttatgttgtggtttctgagcccattttagagtatctctgtgttggagttattatttttctgtcttgacttttttttttttttttttttttttttttttgagacggagttttgctcttgttgcccaggctagagtgcaatggtgcgatctccactcaccacaacctccacctcc

SEQ ID NO: 10999 - DNA, 201 bp, Homo sapiens
attgctatactccagtgcctagaatagtacctggcacagagtagctatatagtaaatatctgttgaatggatgaattattgaatagcagattctcaataartatacagaggctgaaggttaataaacctgtagtaattatctaaaagccttttgtttatgtttcagtggtactttatggaggcatagcttacatatagtat

SEQ ID NO: 11000 - DNA, 201 bp, Homo sapiens
aagagggaatttgctagagaaaaaatgtgagagagttcacagctgggggatccagttagaggtagggtgctctttttttgctcattcatttattcatccamttaaaatatcgtgagctagggagtgtgctggtgtagcatgtatccgaatgtcctttctttttgaacgctggctaatatttcattgtatgtatttacattt

SEQ ID NO: 11001 - DNA, 201 bp, Homo sapiens
ttagggaggccgaggcaggaggatcacttaagcctaggagttcaagaccagcctggggaacacagggagaccctgtccctccaaaaaaaagaaaaaatagycagatgtggtggcataggcctatagtcccagctacttggaaggctgaggcaggaggatgcctgagcccaggaggtcgaggctgctgtgagttgtaattac

SEQ ID NO: 11002 - DNA, 201 bp, Homo sapiens
agttcttggtacatggttgaggcttaataaagagccattaagtaaacgagtacgtgaataagtactgtacttttctaatagtcttttgggtgctaaagtcrtacatatattgaatgcttgctatataccaagcactatagtgctgagtattttacatccattaaattgcacgtaaatgacaacaacaataacaaactcgct

SEQ ID NO: 11003 - DNA, 201 bp, Homo sapiens
attaagtaaacgagtacgtgaataagtactgtacttttctaatagtcttttgggtgctaaagtcatacatatattgaatgcttgctatataccaagcactrtagtgctgagtattttacatccattaaattgcacgtaaatgacaacaacaataacaaactcgcttgaatggtaaatgttattagctcaagtgtataactc

SEQ ID NO: 11004 - DNA, 201 bp, Homo sapiens
agtcttttgggtgctaaagtcatacatatattgaatgcttgctatataccaagcactatagtgctgagtattttacatccattaaattgcacgtaaatgamaacaacaataacaaactcgcttgaatggtaaatgttattagctcaagtgtataactcaggaaattgagactaagaaaattacagctgggtgcggtggctc

SEQ ID NO: 11005 - DNA, 201 bp, Homo sapiens
gagacttgaacactgtttgtgtctccctttcatatgcttgcacttagcatttaaaaaaatttctggggagttattttctctacttagcatgtgcctaatcktaaatatctctttcctaatgtctcatctttttatcagtcaacatcagggctaattccattaaacatatatacatagtacatgctctcatgtgtgtgggta

SEQ ID NO: 11006 - DNA, 201 bp, Homo sapiens
tatattttttgtaactcataaagatttgaacccagataagtctaacctcatagccctcatcacattcttcactatgatatcatggtatcatgatttagttrtccagtctgcataatggtaggaatttaggagttaattttcttttatttaaaaaaattttgtgggtacatagtaggtatatatatttatggggtacatgag

SEQ ID NO: 11007 - DNA, 201 bp, Homo sapiens
tcatgggtatattctgtgatgctgaggatatgaatggtcccatcatccaagtagtgagcatagttcacaacaggtagtttttcagccttgctctcctcacycttatcatcatccccagtgtctattcccatttttatatccatgtatacccagtgtttagctctcacttataagtgagaacatgaagtatttgtttttctg

SEQ ID NO: 11008 - DNA, 201 bp, Homo sapiens
ctgcttctttaacattaaatagtaagcattttctctgcatcattaatttgtcttcaaaaacatgattttcaatgacccgaatggtctgttgaataaatacrcaatatttgctcttttccttttccccaatttcttcactttgtccttggaaaccagattctcccccacacaacacccccatcagtcgcttctgcaccatgc

SEQ ID NO: 11009 - DNA, 201 bp, Homo sapiens
tccaatctattctctacacagccttcaattgacatgatctattacctctttgatgtcaccctcgcttctatgtcttcccatagttttttttgtttgtttgtttttctgagacagggtttcacacttgttgcccaggctggagtgcaatggcacgatctcggctcaccgtgacttctgcttcccgggttcaagcaattctcc

SEQ ID NO: 11010 - DNA, 201 bp, Homo sapiens
tgccacctctttcaattttcttctttactcattcctctcttctttcctcctctcttttcctctccatctcctctcatctctcgattcctctctccatcatmctctcttccctcttcctcccttccctcttcttttctctcctctctgactcttccatgacttatctccatttcaactatgctttttttaaaaaattcattt

SEQ ID NO: 11011 - DNA, 201 bp, Homo sapiens
gtaaatgacaacaacaataacaaactcgcttgaatggtaaatgttattagctcaagtgtataactcaggaaattgagactaagaaaattacagctgggtgyggtggctcatgcctgtaatcccagcactttgggagactgaggcaggaggatcactttagtccaggagtttgagactagcctggacgacattggcaaaacc

SEQ ID NO: 11012 - DNA, 201 bp, Homo sapiens
tttctacaactgagatgtaggtattgacgatctgaatagctcatatttgctgaaaaactgaaaatatacctaaaaactttcccattttaaaaagacaaaaragaaactcctggcctagatggcttcgtctatctataacaaacatttaaaagaaataacagcactctatacaaagtttttcaatatgttactaatcataat

SEQ ID NO: 11013 - DNA, 201 bp, Homo sapiens
ctcgaactcctgacctcaggtgatatacccacctcagcctcccaaagtgttaggattacaggcgtgagccgccatgcctggccaatgtttttaattagtasacgaataaaaccacaagaaaaccattggcaagccctctagttctttgggctccttgctttagcacagtggaaagcctgtgtactaagtcagaacggcgac

SEQ ID NO: 11014 - DNA, 201 bp, Homo sapiens
ggggatctagtgcttcagaaataactccgtgtgcttctgtctctaagaaagagaaagccagtggagcaggtaaataccagtcgtgttacccttaaagctgcccccccagcactacacgctggtacagcaggtcagcagaggggaaagactgctgaggagggagctgttattctgggactcggaggcgatttcttttcatct

SEQ ID NO: 11015 - DNA, 201 bp, Homo sapiens
gaatcaggtggaacctacaagcctattatgagctcctatggggagacatgcagggcatgaggaatagaaataggaggaggagacagaacatcataatttcsctctaggtttagggatggaagctggttggtgggtcaggggtgggaaaatgagtgaggctttttatctcttaggagattggagatgttttcaagagggctg

SEQ ID NO: 11016 - DNA, 201 bp, Homo sapiens
tgtgacagatgagtgcaaatccagcctatttctctggtccaaatgaatacttgtccttgtaacactgaaaaccaaatatttgaataggaatgagtattctrgggtattctggggtagcatggctcagaggctcctagcagttgttcagtgacttaaaagggagatggttgtaaaaatttggggcataagctgaacatttgt

SEQ ID NO: 11017 - DNA, 201 bp, Homo sapiens
cacagtgaggaaaatatagtagatctctagcaaattaacacattcaactgaaataagtgatgccatctcccaaagcatgtgtgtgtgcaactgtgtgtgcgtgtgtgtgtgtgtgtgtgtgtgtcttgcactggttcttttgttgttgctgttgttgttgttgttgttgcagttgtaacatcaacccaactccaaaaagaa

SEQ ID NO: 11018 - DNA, 201 bp, Homo sapiens
aacctaatacacagcaagcattctttccccagctctctgtaattcctgatagttcactttggcaaagtgcttccatcccatggggtctgtcctagtaccartttgcagactatttgcttcagaatctacttaaaaatacggatttctgggtcacacctcagacatactgtgccagataaaatccgtgggaacagagcccca

SEQ ID NO: 11019 - DNA, 201 bp, Homo sapiens
acagtgaggaaaatatagtagatctctagcaaattaacacattcaactgaaataagtgatgccatctcccaaagcatgtgtgtgtgcaactgtgtgtgcgtgtgtgtgtgtgtgtgtgtgtgtcttgcactggttcttttgttgttgctgttgttgttgttgttgttgcagttgtaacatcaacccaactccaaaaagaac

SEQ ID NO: 11020 - DNA, 201 bp, Homo sapiens
  misc_feature (1)...(201): n = A,T,C or G, or insertion/deletion polymorphism (see Tables 1-2)
ccccaccagagtctagtgcaatgtataattattctccttcaaatgtatatctcagatccttcctcatctccagtgctaccaccatcatcaccatctggagntgtagatgaagcagcctccactggtctccctgcttctacctctactcctcccctacttcatcctttcctttgcagccagggtaaattggatcaggtcact

SEQ ID NO: 11021 - DNA, 201 bp, Homo sapiens
ctagtaccaatttgcagactatttgcttcagaatctacttaaaaatacggatttctgggtcacacctcagacatactgtgccagataaaatccgtgggaayagagccccaggagaccattgctaaagatatggaagtggggttgaacctgtgtgtgtgtgtgcatgtgtctgtgtggtcattgatgggcatgaggagtagt

SEQ ID NO: 11022 - DNA, 201 bp, Homo sapiens
ctgtaatttgtgaatgaggcttggtggttgacaggtgaggaagtggtggattgactcagagctgggtggaaggtggtgccaggtgggtgtgacaggaggayaagatgggagcaggaaaattgtgggcgtggcaggaaatctgttgctgtgataaagagatctgggctgtaatagggaaaaaatggaaagtcacgaatgagc

SEQ ID NO: 11023 - DNA, 201 bp, Homo sapiens
tatgcatttctctgtccccctacctatactcacttccacccttgctcactcattcattcaaaaaacatttacagagtggctactgtatgtcaggtacaagrctaggtgctggagctacaattgtgaggaagaaagcagggtccctaacctgttctccacttttgtaagtgacatcaccattcacttggcaatcctctttca

SEQ ID NO: 11024 - DNA, 201 bp, Homo sapiens
acctgggaagcggaggttgcggtgagccaagatcatgccactgcactccaccttgggcaacagagcgagactccatctctacaaaaaaagaaaaaaaaaaraaaaagaaaaaaagttacttgaaggaacatcagtttaccgctctgaaaaattgtaataatatctctttcacatctatgtgactctgctgtgatggtcaag

SEQ ID NO: 11025 - DNA, 201 bp, Homo sapiens
cagttgaatgtacctcctaaacatctcttgaacctctcttttgtgtatctgtattgcagcaatcctagttcagatctttctctcttttctggagttgcttyagtgagatttctctgggcctgcttttctgccttcattcattccctcctccaagcccttcctcatactcaagctcaagtggtccttcccgaagataaaaac

SEQ ID NO: 11026 - DNA, 201 bp, Homo sapiens
ttagttcagggtgcattcttctgctgtggatgcattgcttccagaggaagaagctggtgatggaggaagcactgtgctggggaagggttgatcttcagatsgtatctgaatatatgggagaatgaccaggtaaaggaaagggagctcacaggttaagcaccgataaggagggaggtgcacgttgtcagtggtgaagagcaa

SEQ ID NO: 11027 - DNA, 201 bp, Homo sapiens
ttctacctctgagccccctcatttcacaccccctgttcatccagctctcacttataccctgccctctctaacccatcactgtgctactaactcagccactscctttctcactggatgttcgtttatttcttcaatctcttatacccacaactcatgtcacatccacccatccgtccatctgttcatctgtccatccatcca

SEQ ID NO: 11028 - DNA, 201 bp, Homo sapiens
cgcacatatgccagatttaaattaaacaacgtccctagaactccgaagagcctaatatttcaagacacagtgggatagtttgtgtttttcttttaattgaytttcatgtacaagtctgggtgtatacatttatggaaaagtcccaatttccttagaagcctcagttttcagctctcaggatccccagtcccctgtgcgatt

SEQ ID NO: 11029 - DNA, 201 bp, Homo sapiens
cgcttgggttcttgatgtctcagtggggtctgcacttcctccccttaccagcctttcttgggcatgtcacaagagcatccagattttgtgcattcataagmcaggtgttgcaaacttagatgactaaggaaggcagaaaggaaacgggagtgggtgcagcaggcgggacatgagaaaaatagcacagatgacgtgaaacgg

SEQ ID NO: 11030 - DNA, 201 bp, Homo sapiens
tttggttcacaaaaaaagaaaaaatatcttggttaattgctgcatttttctggaaattttatctccaagtgttgcatctctacctcctccatcatcaaatrcttgccatgttttagtcacttggatgaccttcagacatgcctccatattggatggaaaaaaaattagaaaataatcctctgttctccaaactgtaaggag

SEQ ID NO: 11031 - DNA, 201 bp, Homo sapiens
gtctcccatgactttgtgactgtgcgaaagcatgggaggctgttggaagaaaaggaattgaatcaagataccctcttctcatccctttacctacacaaccrattgatcagcacccatttttgtgggtgaggaactggaaagggatggatttcctatttttttaaaaaaaaactcattaacatgtatgcttttttttctggt

SEQ ID NO: 11032 - DNA, 201 bp, Homo sapiens
actgcactccagcctgggcgactgtagtgagaccccatctcaacaaaacaaaacaaaatacctccaaagggaggggggacgtcaacagcacattgtatttycaaagggatggcattggtgtttttgtgagaagaggaagcagccgtgcaggtctgaggtacatggtgggcagagaaatctggatgagtttgagatagtgtt

SEQ ID NO: 11033 - DNA, 201 bp, Homo sapiens
ggaggttaagaaagggttagaggaagtgagttcatggatcaaaatggaaagaaattgtttcttttcacacaaaaaagtcttgtatctctttagtgagctaragagaactctttttccaattcaatcagagagaaaaaaatatcaattggcttgtcttatgaaaatgggtcgtgaatattgaatctggcctcaacccagttt

SEQ ID NO: 11034 - DNA, 201 bp, Homo sapiens
aaatatcaattggcttgtcttatgaaaatgggtcgtgaatattgaatctggcctcaacccagtttctctagatttttatcttgcttgcatttgtaaaacayttccataaaaatgtcaagtattttgctaaatttagcaaaacctctctttccccacacttttcctgctgcatttttaaaagtaaaataaattgtaaccaga

SEQ ID NO: 11035 - DNA, 201 bp, Homo sapiens
taccaggtgtggtagtcatactgattatgcatgtgtagtactttctagtggtgccgttcttagaccacattttcagttcttgagaacagtgtcattgttgkcatttttctcccaaagagctggcataatactcaaaagaaacggggtcttattaagtggttgttcattgactgataggaagagaactgtgggaatatatat

SEQ ID NO: 11036 - DNA, 201 bp, Homo sapiens
tagggctctcaaattgttgattactgtctgagatggggataattggtttgggtgaaattggattgacggtggtgggttacttaggcttagttttcaaaaayagcaagtcttatccatcccatcccaagggaaccctcctcttcccccagtgccttagaataatcacgtttttaactgggcaaagctgtcgttaagcttatt

SEQ ID NO: 11037 - DNA, 201 bp, Homo sapiens
tatcacaataaataaaaggctttttcagctgtcagcccaggatcacagtctacctctcttagccactttctaactcttattggcaagtttgctgagggaamaaaaacttcttaatatcattcaggtaaatactccccaaaagagctgtttactctgccagactgcaaatggcatttcatttattttacaattggatgttat

SEQ ID NO: 11038 - DNA, 201 bp, Homo sapiens
tggggactgacaggcatgacatacctgtgatatacctgaaggaaacacacggtggtgagaatgttagacatcagacactgtcttatgtcattgcctagtcytccctgggatggacagaggtcacctggcaccaggacccctgggtcagaaccatcactctgagagatgcttgcagcatgatattgggcatgccatgtgact

SEQ ID NO: 11039 - DNA, 201 bp, Homo sapiens
cacaataaataaaaggctttttcagctgtcagcccaggatcacagtctacctctcttagccactttctaactcttattggcaagtttgctgagggaaaaaraacttcttaatatcattcaggtaaatactccccaaaagagctgtttactctgccagactgcaaatggcatttcatttattttacaattggatgttatgct

SEQ ID NO: 11040 - DNA, 201 bp, Homo sapiens
ctcctttgccatggtgctgcaaagttgtgtcatttagaagacgtggaaaaaagccacaggggagctgtttgtatttgcattagtgctgtgtttgtgggttktagtgttttgggttttgttgctgtcattgtggttgattctttcttgattacaacagccaccataatcacagctctcattaatggagctctcggtatgtgc

SEQ ID NO: 11041 - DNA, 201 bp, Homo sapiens
caataaataaaaggctttttcagctgtcagcccaggatcacagtctacctctcttagccactttctaactcttattggcaagtttgctgagggaaaaaaarcttcttaatatcattcaggtaaatactccccaaaagagctgtttactctgccagactgcaaatggcatttcatttattttacaattggatgttatgctga

SEQ ID NO: 11042 - DNA, 201 bp, Homo sapiens
gctgccatcaccatggggccatgtagatctcagggaagtcatttaacctctcatcctgtgtctttaggagaaatgccatccatgagtgttatgccacttgygttatctcttgagtagttaggatcaaagagataatgggtgtggatgggctttgtaacctttatgaatgggtaaatggaatgtaagttgctattatgctct

SEQ ID NO: 11043 - DNA, 201 bp, Homo sapiens
cttcagtaagtcctcatccccatcccttacatatgtcacttgcccataggataaagataaaaccccataacaggcaacctactaactcccttggtctttctttttttttttttttttttttttttgagagactcttgctctgtcacccaggctggagtgcagtggtgcaatctcagctcactgcaacctccgcctcctggg

SEQ ID NO: 11044 - DNA, 201 bp, Homo sapiens
ttgtaacctttatgaatgggtaaatggaatgtaagttgctattatgctctaggaaacaccaggctttggtacccatggagtcaggtgtcaccctggggacycagcaagctctggaacattctggaacaggattgaatgctctagacctgattgaatgagtcctcagttatgatggtactgaaacacagagtctagagcaga

SEQ ID NO: 11045 - DNA, 201 bp, Homo sapiens
aatgttgaattaatgataatagttccacgtatggagacctttctgtgtgccaggaactgtgcattaagagatgtttgttgttattatcttataagtaagcstcataacagcatatgaaatggaagtgttgtttttatttggtgattgagtgaactgaggttcaaaaagattatgtggcttgttcaaggtcacatggctaaa

SEQ ID NO: 11046 - DNA, 201 bp, Homo sapiens
tgtaacctttatgaatgggtaaatggaatgtaagttgctattatgctctaggaaacaccaggctttggtacccatggagtcaggtgtcaccctggggaccsagcaagctctggaacattctggaacaggattgaatgctctagacctgattgaatgagtcctcagttatgatggtactgaaacacagagtctagagcagac

SEQ ID NO: 11047 - DNA, 201 bp, Homo sapiens
aaggtctcccctgctttggggcatttgcatatgcttttctttccacctggaatgctcttcccctcattccctcccttggctggctatttctcatcattatscatcatctcctgagaaagggcttgcttccgctcctgtcaatcccctcctgcctatctttgctgtcaatgtggatttcagcttccttttttatttcctttt

SEQ ID NO: 11048 - DNA, 201 bp, Homo sapiens
tacgcattgtctatggctgtttttgtgctacaaaggcagagttgagtagttgtgatagagaccgtatggcctgtagtgctgaaaatatttactaattggcygtttaccataaaaaaaaaaaaaaaaagattagtgacctctggcttaaacaataaaagtgacatgttattttgaaacaattccaacaattggaagaattta

SEQ ID NO: 11049 - DNA, 201 bp, Homo sapiens
aggatgtggagacaagcacccaaactgtcaaagtcaggcgtggacagatgagtctcccacttctaccttttcatcccattctcacagcagacccatgtgayggaagggtcattattcctatcttataggtaaagaaactcaggcccagaaagattaagcactttttcaaagccacggggctggctaggttagccacagtcc

SEQ ID NO: 11050 - DNA, 201 bp, Homo sapiens
tttctttctttcttcctctctctctctctctctctttctttctttctctctttctctcgacagagtcacattctgtcacctaggctggagtgcagtggtgygatcttggctcactgcaacctctacctcccagattgaagctattcttatgcctcctgtgtagctgggattacaggtgcatgccaccatgcccagctcatt

SEQ ID NO: 11051 - DNA, 201 bp, Homo sapiens
actctttcacagatggcctgtgccgagctggctctgggccaattaactgctgtccctccaattatctttctcctgaggaagttcacagtgcagccatgccytcctctctacatgtagagaaccagataagatgcgtgtgcttacagctttgctctgtgcacagaccttttcatgggtaccctggtcatgtctagctcagag

SEQ ID NO: 11052 - DNA, 201 bp, Homo sapiens
ctgtgacacccaagcagttcaaggaggcatttaagggacactgtgatccaggaaacgtccctgggaacttcagaaatggcaaagtagatggaaaattaacygaaaattgagaaacactaaatgggttatggtggcatttgtgaaacagtaagagaattaaagtctaagggggaaatagtgaataataaatatgtctagaga

SEQ ID NO: 11053 - DNA, 201 bp, Homo sapiens
aaatatatcgttagaaaactgtctttgctgatgctgttttatttccgtggcttgattttccggtcatgagctggggtgggggtcagatagagtttgttctrttagaaccatatagactcaaaggaggaaggggcaggacgaactagaggaaaatgagaagaatagatgataagcaagcaataattacagacatccttccag

SEQ ID NO: 11054 - DNA, 201 bp, Homo sapiens
gttcaaggaggcatttaagggacactgtgatccaggaaacgtccctgggaacttcagaaatggcaaagtagatggaaaattaaccgaaaattgagaaacamtaaatgggttatggtggcatttgtgaaacagtaagagaattaaagtctaagggggaaatagtgaataataaatatgtctagagaacatctcaaataatta

SEQ ID NO: 11055 - DNA, 201 bp, Homo sapiens
ttccatctcaaaaaaataataataataaaagggaaatacagtcaacaaaccatgttggtttattaccagcagggtactatgtcactctgaaatatttctgraaggctttaggactttgaatctgctacagttcagaggttatctctgaactggggctggaggagtgtgtgtgtgtgtgtgtgtgtgtgtgtgtgtgtgtgt

SEQ ID NO: 11056 - DNA, 201 bp, Homo sapiens
caaagtagatggaaaattaaccgaaaattgagaaacactaaatgggttatggtggcatttgtgaaacagtaagagaattaaagtctaagggggaaatagtraataataaatatgtctagagaacatctcaaataattagattttggaagttaaaggagacttatgactataagacgaaagagataaaatagaaatctggag

SEQ ID NO: 11057 - DNA, 201 bp, Homo sapiens
tcagttcaaaaaacttaaatcctgagaatgagaaatatgaagacatagcataatcaaatttctcaaaatcagttttaaagatatatcagctaaaaagatayaccacagttgaaagctgtcagagtgaaaaaagatgtcagccgacttctcgtcggaaacaatacaggttagaaaagaatgcagaaagatattttgtactga

SEQ ID NO: 11058 - DNA, 201 bp, Homo sapiens
agggtctgagcacggtggctcacgcctgtaatcctagcactttgggaggctgagccaggtgggttgcttgagcccaggagtttgagatcatcagcctgggcaagatggtgaaacctcgtctctactaaaaatacaaaaaattagcacagcatggtggcatgtgcctgtcgtcccaactacttcggaggctgaggtgggagg

SEQ ID NO: 11059 - DNA, 201 bp, Homo sapiens
tttaaaatgacttaaaagataagtgtgtccatttttcccttcatcaaatagttaagttgtattagttcgttctcacactgctaatgaagacatacccaagwctgggtaatttataaaggaaaaaggtttaattgactcacagttcagtgtggctgggaggcctccggaaatttacaatcatggcagaaggggaagccaaca

SEQ ID NO: 11060 - DNA, 201 bp, Homo sapiens
  misc_feature (1)...(201): n = A,T,C or G, or insertion/deletion polymorphism (see Tables 1-2)
aacagcatgggggtaaccattctcatgattaaattacctcccaccaggtccctcccacaacacgtgaggatgatgggaactacaattcaagatgagatttntgtggggacacagccaaaccatatcacaagtaaaagcaatgctctaggaagttctactgtatttgtgctctgcacgtgtgttctgctgggctgtgtgtgc

SEQ ID NO: 11061 - DNA, 201 bp, Homo sapiens
accaccctcattgtagagaggaggaaagtgaagcccagggaatcacagaagcttatttttggtgacactgctggtaggcaggtaacagagctgggccctgractcaggtctcctgactccacaacctctgtttttttgatcagaagaatttcttaagttttgtttccttccatggcaccttcacaacattttggccacttt

SEQ ID NO: 11062 - DNA, 201 bp, Homo sapiens
acactgctggtaggcaggtaacagagctgggccctgaactcaggtctcctgactccacaacctctgtttttttgatcagaagaatttcttaagttttgttyccttccatggcaccttcacaacattttggccactttgactaattttttattgtgatataatacacataacatagaatctgccattctaaacattttaaag

SEQ ID NO: 11063 - DNA, 201 bp, Homo sapiens
tgttatgtgaccttttgcatctggcatctttcacttagcataatgttttcaaggtccatccatgtcgtagcatgaatcagtactttattccttttcatggytgaataatattccattgtatggatatactatatttaatttatctattcaaccattgatgggcatttgtgctgtttccatctgttagctattgtgaatggt

SEQ ID NO: 11064 - DNA, 201 bp, Homo sapiens
gtgagtgaattctcatgagatctgatagttttatagatggtagtctttcctgcatgctcacactctttcctgtctccccgtgaagaaggtatttgcttccycttcatcttctgccatgattgtaagttttctgaggcctccccagccatgcagaactgtgagtcaattaaacctcttcctctataaattacccgtctctgg

SEQ ID NO: 11065 - DNA, 201 bp, Homo sapiens
ttcatagagtgcctactgtatgccatgtactttctgtccaagatcgaatttaactttcttaagagccctgtgaaaaaaagaatactacttgtatcttatakaggatgtaccagaggctcaaagaggtagaatgacttgtcagagtaagcttttttaaagatacaaataagactgtccttcctgcttaggaccttccattct

SEQ ID NO: 11066 - DNA, 201 bp, Homo sapiens
acctgaccagagttcgcagaggaaagaatagcacagaagtaggcagggtggttatagccaactctctagatcatttttgctataaaagggaacagagagamatggagaattatctacagagggacacgaggtcacataagggttttcatttctgtttttaaggtagaagctacgcttgtattttggggtgatcctcctcat

SEQ ID NO: 11067 - DNA, 201 bp, Homo sapiens
tgattttgctatggttggaccctgtatacacttcttcttcttcttctttttttttttttttgagacagggcctcactgtgttacccaggctggagagcagyggtgcaatctcagctcactgcaagctctgccctaccaggctcaagagatcctcccacctcaggctcctgagtagctggggccacaggtgtgtaccaccat

SEQ ID NO: 11068 - DNA, 201 bp, Homo sapiens
ctgcaagctctgccctaccaggctcaagagatcctcccacctcaggctcctgagtagctggggccacaggtgtgtaccaccatgcctgcatgcctggctattttttttttttttttttttttttgtatttttagtagagacggtgtttcaccatgttgcccaagcctggtctcgaactcctgagctcaaatgatctgctta

SEQ ID NO: 11069 - DNA, 201 bp, Homo sapiens
ggccacaggtgtgtaccaccatgcctgcatgcctggctattttttttttttttttttttttttgtatttttagtagagacggtgtttcaccatgttgcccwagcctggtctcgaactcctgagctcaaatgatctgcttacctcggcctcccaaagtgctgggattacagtacacttctacaattaattctttcacattat

SEQ ID NO: 11070 - DNA, 201 bp, Homo sapiens
gcttccgctcctgtcaatcccctcctgcctatctttgctgtcaatgtggatttcagcttccttttttatttcctttttcaaagtctaccattggtaactgkgggaatgtatcacagttcactgagtggcgaagagcttggagtctgcggtagactgctgaggtgagaattctggctccaacacttaccagctgctgggata

SEQ ID NO: 11071 - DNA, 201 bp, Homo sapiens
tgatcggtgaagtaagttatcttttcatcccctaggctcttactcagacaaagggcctgcagtcctcaggaatgttagcaggaaaagtaaagtactgttgttctctctctcttttttttttttttttttttgccttgcatccaggtggtctatcaacgggcagtcatggcagttggctcgctcaccatcaatgaggaacgt

SEQ ID NO: 11072 - DNA, 201 bp, Homo sapiens
ctggcttaacaataaagcttactttttgctaacctgatggtccgatggtgggtattcctggggtcagcaggcagcttctcttcatgtggggatttaagaastcagtctccactatcttgtggctctgccatcttctaataacttaggattttctgcaagcagccagaaaatccaggaaacaggaaggagagaagaaagggt

SEQ ID NO: 11073 - DNA, 201 bp, Homo sapiens
tagtctgaaaagtatatgctgatttaaaattaatcgaatcatattttaaatgtgactacccattaagccaaatagtttgtaaagaaggaaattcttgtgatttttttaaccgttttgtaaatttatgtttttacataaaaggtgttttttttttttaaatcaaggaagagctatgttttctatcatctgcttttctctagc

SEQ ID NO: 11074 - DNA, 201 bp, Homo sapiens
ccaaatcacacacaactctaacttgcattgggaactgacaacccattgctttttctttatcagttggtgctttcgttatgctgtagcattgtcatgtttasaagtataacatccaactgcctcattttgcatggaagaaaaggctcagaaaggtgaagaatgtgtccaaaatcatccagtgaatatatggcacagccagca

SEQ ID NO: 11075 - DNA, 201 bp, Homo sapiens
  misc_feature (1)...(201): n = A,T,C or G, or insertion/deletion polymorphism (see Tables 1-2)
gcctgcaaagctcaaaatatttactctctagctctttacagaaaagtttgctgacctctggcttaacaataaagcttactttttgctaacctgatggtccnatggtgggtattcctggggtcagcaggcagcttctcttcatgtggggatttaagaactcagtctccactatcttgtggctctgccatcttctaataactt

SEQ ID NO: 11076 - DNA, 201 bp, Homo sapiens
atgctgatttaaaattaatcgaatcatattttaaatgtgactacccattaagccaaatagtttgtaaagaaggaaattcttgtgatttttttaaccgtttygtaaatttatgtttttacataaaaggtgttttttttttttaaatcaaggaagagctatgttttctatcatctgcttttctctagcacttggactgtattg

SEQ ID NO: 11077 - DNA, 201 bp, Homo sapiens
caagacatttagatccctttccagtgaccaccctggattctatgctttttttaaaaaattctgctgctgtgaaatgctgttgcgcaatttcccaaagttaygcctttaaacacagtaattttgtaaatggtatttcagccccagagaagcaatgcatcaagcgtggtaagtcgccatccactgcttggtgtttaatgaaac

SEQ ID NO: 11078 - DNA, 201 bp, Homo sapiens
agatttccaacagggtggaatctgagacagtttctgtgagtgaccacactgtgatacagtagttccttatatttgcataatcagggcttgtgctgttgtgaatttacacattttctgatgaatatttatcaaatgggtactacgtgccaggaggcactatactgctgccagagataatgtggtaaatcaaatagagatttt

SEQ ID NO: 11079 - DNA, 201 bp, Homo sapiens
tactcgccacacatgaaggtactgttagtgtccttattttactaatgaagtgttagcagtgaggtgacttccctctttttattaatggggcaactgaggcacagacagatcctgcaatttgctcaaggtcacaaacttacgttgggattcagttttttttttttttggagatcaacacttccttggacttattgggaaatg

SEQ ID NO: 11080 - DNA, 201 bp, Homo sapiens
gaatgtgggcttttgaattagaaatagaataggatttttcagttagcatcgtggatacaggggctgaaaagatgccacaatgagctgaagttaggaaggawcaggggacagctgtgggaggaggacagtgtggggatgactggaggggagtggaaataggggaccatggggcaggggagtggggagagaatatgaaggctt

SEQ ID NO: 11081 - DNA, 201 bp, Homo sapiens
gttatataacctccttgctactgcacagttattaaacatctgttccttcaccaagcacagaccatgtcactgttaactcccaaaattgtgaaggtaaaccwtgacctgtttggctggtggaatcccggctgttgtgtccggttccatcacaagaatctgtccagttcaggagtggccagggccccctgggaggcagtggca

SEQ ID NO: 11082 - DNA, 201 bp, Homo sapiens
  misc_feature (1)...(201): n = A,T,C or G, or insertion/deletion polymorphism (see Tables 1-2)
gctataataacaaataattcctgcaaaattttaatgccttagcacaagatttgacaagctgtggttctccagcccaatttgggcccttgtttgtttttgtnaataaagttttattggaacacagccacacccatttgtttacagatcatctaaggaagcttttatgctatgataacagagttgagccattgtgagagagac

SEQ ID NO: 11083 - DNA, 201 bp, Homo sapiens
actcgccacacatgaaggtactgttagtgtccttattttactaatgaagtgttagcagtgaggtgacttccctctttttattaatggggcaactgaggcacagacagatcctgcaatttgctcaaggtcacaaacttacgttgggattcagttttttttttttttggagatcaacacttccttggacttattgggaaatgg

SEQ ID NO: 11084 - DNA, 201 bp, Homo sapiens
gtgtatcttcttccttcctctctcccttctggaccttacctttcctcatctgtaaaatgggattgggctaaggtccactccttgacagactccgctgcttsttggaagtcaggagtcactccagcctcattgatgatgatctgccttttgcatgcttgggggacctacacctctgtacaggcgagagccctccaagcatcc

SEQ ID NO: 11085 - DNA, 201 bp, Homo sapiens
ggtctaggtagtatgacagacttgactatgaatttaccacatatttaccaagtataagttattaacaactgtgaacccaggagttttcctaaagagggtgygtgtgtaagatagacatctcttcttcttgtaacatcttaaagtatatacatttagcatggtgccaggcatggagaaggcattttacaaataactatcagg

SEQ ID NO: 11086 - DNA, 201 bp, Homo sapiens
ctcgccacacatgaaggtactgttagtgtccttattttactaatgaagtgttagcagtgaggtgacttccctctttttattaatggggcaactgaggcacagacagatcctgcaatttgctcaaggtcacaaacttacgttgggattcagttttttttttttttggagatcaacacttccttggacttattgggaaatgga

SEQ ID NO: 11087 - DNA, 201 bp, Homo sapiens
tcgccacacatgaaggtactgttagtgtccttattttactaatgaagtgttagcagtgaggtgacttccctctttttattaatggggcaactgaggcacagacagatcctgcaatttgctcaaggtcacaaacttacgttgggattcagttttttttttttttggagatcaacacttccttggacttattgggaaatggat

SEQ ID NO: 11088 - DNA, 201 bp, Homo sapiens
tctgtgtggttcccattttagttagggaagtaggacatggagaagttactgcactggaaatcaagtagaagagctcaagtagatctatagcacaaatgagkgggcaaaaaaagtcttatcccaggagagttatgaattagtattgaagggaagttatttggccttcattgatgacacctggcatgaccatttatgtgtttt

SEQ ID NO: 11089 - DNA, 201 bp, Homo sapiens
ttagcagtgaggtgacttccctctttttattaatggggcaactgaggcacagacagatcctgcaatttgctcaaggtcacaaacttacgttgggattcagttttttttttttttggagatcaacacttccttggacttattgggaaatggatgatcattgttaaaaacacgttttccaaaaaaaatattttttcttgaggt

SEQ ID NO: 11090 - DNA, 201 bp, Homo sapiens
gctgagtaacctgccatttcagacgagaagcccgtgccacgttatgtcatcagggtccattaagagattactctgattccagaggaacatccgttccgaakacagaggaacttgctttcatcttccaagggatgccaattgttgattccttgctcctcttcaaagggaaatgtgataaaaatccttctggaggaattttcc

SEQ ID NO: 11091 - DNA, 201 bp, Homo sapiens
actctttgcaaatatttatctgggagatcaccatatgctcaacaaacacttctcgcagtgaaatcaggcacctcagaggccaagctgtcctgtgggccttygctgtacatctgattgggactctgaactcagaagtgggaaaaacagctgagtctcaaagtaaatcagcaagagatacgaggtgagagaatccagaggaac

SEQ ID NO: 11092 - DNA, 201 bp, Homo sapiens
cttgctgagtaacctgccatttcagacgagaagcccgtgccacgttatgtcatcagggtccattaagagattactctgattccagaggaacatccgttccraatacagaggaacttgctttcatcttccaagggatgccaattgttgattccttgctcctcttcaaagggaaatgtgataaaaatccttctggaggaattt

SEQ ID NO: 11093 - DNA, 201 bp, Homo sapiens
tacacaggatttgagcttattgatggcagtcaaagccctacgactgggcaaggtcttgcaggggagaatgatgactcaggagggcctgggtttaaaccatraggaactttaacattaattggtaaataatcctccaagggaaaggagaatgttggagagaaagagttacgctgtaaattccaggtgctcttcccacatgga

SEQ ID NO: 11094 - DNA, 201 bp, Homo sapiens
  misc_feature (1)...(201): n = A,T,C or G, or insertion/deletion polymorphism (see Tables 1-2)
gttagaatcttagtctcctcttggcttactttctcacaaccagaggggtcagtttaagctgtgcttggcataaccagagtgagggacccgcattgtaaganaggcaagatcccacatgctcctgaaatcaacgtcaggatttcttcacaggtttcgttgtgggagtcggaaatgtgggcactactttttaatgtcttagaa

SEQ ID NO: 11095 - DNA, 201 bp, Homo sapiens
tcctggcatgaatcttagggatggaggagtcacggtccagcgtgatggtgctagctgtgttctgcgtgggcatgggaggccagccacatttctacatgggyctcaaagttgggtaaatgaactggcagatctgctggtgtctggtgtaccattgtccaaatccccacagtcagcttcctgaggatctgcttcatttggtta

SEQ ID NO: 11096 - DNA, 201 bp, Homo sapiens
gtatttatttccaaaacaagaacttgatgattattaagattggcagatattagaatgagcaataacagggagttttgatagctcacctccagagatcttcrtacctgagttagcacaactggaagtgtgtacaacataggtctctcttatcctatatgcttacagcattactggtcaaacattcttacttaaagctgcagg

SEQ ID NO: 11097 - DNA, 201 bp, Homo sapiens
gtaagttatcttttcatcccctaggctcttactcagacaaagggcctgcagtcctcaggaatgttagcaggaaaagtaaagtactgttgttctctctctcytttttttttttttttttttgccttgcatccaggtggtctatcaacgggcagtcatggcagttggctcgctcaccatcaatgaggaacgttctgaagtggt

SEQ ID NO: 11098 - DNA, 201 bp, Homo sapiens
ggctcacacctgtaatcccagcattttggtaggccaaggcaagtgaatcatttgaggtcaggagtttgagaccagcttggccaacatggtgaaaccccatstctactaacaatacaaaaactagccagacgtggcggtgggtgcctgtaatcccagctacttgggaggctgagggaggggaatctcttgaactagggagga

SEQ ID NO: 11099 - DNA, 201 bp, Homo sapiens
gccacaggtgtgtaccaccatgcctgcatgcctggctattttttttttttttttttttttttgtatttttagtagagacggtgtttcaccatgttgcccargcctggtctcgaactcctgagctcaaatgatctgcttacctcggcctcccaaagtgctgggattacagtacacttctacaattaattctttcacattatc

SEQ ID NO: 11100 - DNA, 201 bp, Homo sapiens
cacaggtgtgtaccaccatgcctgcatgcctggctattttttttttttttttttttttttgtatttttagtagagacggtgtttcaccatgttgcccaagsctggtctcgaactcctgagctcaaatgatctgcttacctcggcctcccaaagtgctgggattacagtacacttctacaattaattctttcacattatcat

SEQ ID NO: 11101 - DNA, 201 bp, Homo sapiens
  misc_feature (1)...(201): n = A,T,C or G, or insertion/deletion polymorphism (see Tables 1-2)
aaaaatataaaaattagtcgggcgtggtagcacacgcctgtaatcccagctactcaggaggctgaggcaggagaattgcttgaacccgggaggtggaggtngcagtgagccgagatcgcaccactgcactccagtctgggcgacagagcgagactccatctcaaaaaaaaaatgttgaataaatggatgagtggatatgca

SEQ ID NO: 11102 - DNA, 201 bp, Homo sapiens
  misc_feature (1)...(201): n = A,T,C or G, or insertion/deletion polymorphism (see Tables 1-2)
cctcttctctagatatagtccttagtagttggagctttgcagatgcctccacaatctacagttgtagcctcaacctcttgccctgggttcctgacctgttnccctaggtgcttggtgggcttctctccttgacatggccatgggtgcctcacactgaacctgcccaggcctgtcctctttgattcatgcttattctggatt

SEQ ID NO: 11103 - DNA, 201 bp, Homo sapiens
ataaggtttttgaaatttcctaccagcataaacattggcaatttggacagaagggaacagagaagataaaatgaaggaaggccattacactccctaaattytttttttattattattatactcgaagttctagggtacatgtgcacaatgtgcaggtttgttacataggtatacatgtcccctgttggtttgctgcaccca

SEQ ID NO: 11104 - DNA, 201 bp, Homo sapiens
ttttttttttttttgagacggtgtcttgttctgctcattctgttgcccaggctggagtgcagtggcacaatctcagctcgctgcaacctctgcctcccggkttcaagcgattctcctgcctcaggttcctgagtagctaggattacaggcatgcaccaccacgcccggctaatttttgtatttttagaagagatgggattt

SEQ ID NO: 11105 - DNA, 201 bp, Homo sapiens
accagtcctctccggtggggagacaaaggcagtgtggtttgactgcaaccccaaaacttcccaggctccatctgttcccaagagagcatttagcttgtgtsttcccagcaagaatgagtctgcttcaggaaagagatttaattgccccatttatcagctctggttcacaagatcacactgacaaagatcacggcctctttt

SEQ ID NO: 11106 - DNA, 201 bp, Homo sapiens
ttttttgagacggtgtcttgttctgctcattctgttgcccaggctggagtgcagtggcacaatctcagctcgctgcaacctctgcctcccgggttcaagcrattctcctgcctcaggttcctgagtagctaggattacaggcatgcaccaccacgcccggctaatttttgtatttttagaagagatgggatttcactatgt

SEQ ID NO: 11107 - DNA, 201 bp, Homo sapiens
gcctcaggttcctgagtagctaggattacaggcatgcaccaccacgcccggctaatttttgtatttttagaagagatgggatttcactatgttggccaggstggccttgaattcctgacttcaagtgatctgcctgcctgagtctcccaaagtgctgggattacaggcgcgagccaccaagcccagactatttcacatctc

SEQ ID NO: 11108 - DNA, 201 bp, Homo sapiens
gagcttagaggagaataatggtggtaaaatgcttagtgcagtgcctgacacatcataagcgctcataagtaaaataataacagtagtagtaataataacartaataacatgctaataataatggcgaattactcttcctgttttgccactctaggcagagggatattagtgaagagaatacaagatccatggtgggtcagg

SEQ ID NO: 11109 - DNA, 201 bp, Homo sapiens
gggcagatggcagattcattctatactcaatctcccatgtgggggatgctttgcattgttactttaaactcagaaactagagctgaaggagtacaagtctttttttttttttttttttttttttttgagacggagtttcgctcttgttgctcatgctggagtgcaatggtgcagtctctccccgctgcaacctccacctcc

SEQ ID NO: 11110 - DNA, 201 bp, Homo sapiens
ggcagatggcagattcattctatactcaatctcccatgtgggggatgctttgcattgttactttaaactcagaaactagagctgaaggagtacaagtctttttttttttttttttttttttttttgagacggagtttcgctcttgttgctcatgctggagtgcaatggtgcagtctctccccgctgcaacctccacctccc

SEQ ID NO: 11111 - DNA, 201 bp, Homo sapiens
gcagatggcagattcattctatactcaatctcccatgtgggggatgctttgcattgttactttaaactcagaaactagagctgaaggagtacaagtctttttttttttttttttttttttttttgagacggagtttcgctcttgttgctcatgctggagtgcaatggtgcagtctctccccgctgcaacctccacctccca

SEQ ID NO: 11112 - DNA, 201 bp, Homo sapiens
gaattacccaaggagagttccccttgacagactgaattaatttgtagatgttattttaaggttggaagaaaatatttgctctggtggggtgtgcagtggcrttatgacatttgtcaagtgaatggcaaatgatggagccggatggaacccgtattacttgcttaagaaattgtcttgaaaatttccaatgtgtcatttaac

SEQ ID NO: 11113 - DNA, 201 bp, Homo sapiens
cctatagggaacgtctttgaggaaggctgatcagttgcaaaaagaattcctgttagacaacatgattgtgtgaaacctttttgtttctcacttctggcaartggtgggatcttctaagaataccaggtaaccggaaatgagctgagaaatcttcctttctggtctgttagttgggtgataaagacatgcagagaaaattgg

SEQ ID NO: 11114 - DNA, 201 bp, Homo sapiens
cagatggcagattcattctatactcaatctcccatgtgggggatgctttgcattgttactttaaactcagaaactagagctgaaggagtacaagtctttttttttttttttttttttttttttgagacggagtttcgctcttgttgctcatgctggagtgcaatggtgcagtctctccccgctgcaacctccacctcccag

SEQ ID NO: 11115 - DNA, 201 bp, Homo sapiens
gataacatcaaattggttcagactgcaggttctggagccagacacaaatgggttcaaatcctacctctgctaattactagttgttgggcagagtcagctcktgactggtagaccaggcctgttttactaccactaaatgctctcagtaagattgctaatgtcctgagtcatttttctgatggagaactcagtaaatgagtc

SEQ ID NO: 11116 - DNA, 201 bp, Homo sapiens
agaaattaatgccaagaattccatgattaacataataatagaggatccagcagggctgagactaaggttgggcaagtacagtcggatcttgtctttatttcaaattttgatttgttttgcatcattttttttgcattggtttttatttgtaaaaatatcatattaaaatattacttatcttgactgatgagtcatttatca

SEQ ID NO: 11117 - DNA, 201 bp, Homo sapiens
gagcgctttttacctgcttattgggcaattgtatttattcttttgagaggtggatatgcaagtcttttggccattttacatttgggttgtttgggttttctttttttttttttttttggttgttgttaggttttaagagttctctgtatattctggatatcaatcccttatcagatatacaatttgcaaatattttttcct

SEQ ID NO: 11118 - DNA, 201 bp, Homo sapiens
ataaacatcacaaagcaagaaccaactctaaggtgcccataagaaacccactttaaatataaaagcataaataggttgaaagttgaaatatggaaaaataygtacacactaatactaattttaaaaaactggactggctgtattaataagacactaagtagatttcagatcatgaagatttttggcattaaatattgccat

SEQ ID NO: 11119 - DNA, 201 bp, Homo sapiens
aaactttttttaaagtagaaaaaaatgtctgtggggggcaggagttaaataaagtgagatcataattctttaaactcagagacggaaaaaaaaaaaaaggyaaaaaaaacagactaaaaagaaatatatcaaaatgttatcggagatgctgctaggtgattgggatgatggactttacatctttttacatttaacaaattt

SEQ ID NO: 11120 - DNA, 201 bp, Homo sapiens
agagggaggaagcggcaggatcacaagagggtcgctgcgtgggaaagatccacctccctcggggaaccgggaccgcgggagcccgcgtccttccctccccmtctcctactgctggctcgtcacaaactcagccagcgcccccccaccctcgttacctcctctttctctccctacctccctcgctcagcagctcccggtcgc

SEQ ID NO: 11121 - DNA, 201 bp, Homo sapiens
tctgtttgtgatttttttttgctgaagtcggcatatggaaaggatcttctcttaaactacaatccctgacttgaaaactacaatccctgacttgaaaaagsttaattgtttccattggtccctaacagtgactcttttgccaaaacaaaaataaactcactctaaaatgtaagttgtgatttccaaaaatcactgacacct

SEQ ID NO: 11122 - DNA, 201 bp, Homo sapiens
agattttcatccacctttgaggaaacaggcattgagagattaagcagcgtgtctgggatcaatcttacgccagagcccctgctttgagtcacaatgtaaawaaaataaaaaatatgactgttctcataatattccacaattaaggccgtttctaatggcccaccattatgcaaaacctagtaccaatttcgtcatattttt

SEQ ID NO: 11123 - DNA, 201 bp, Homo sapiens
ctcaaactcctaaccttcagtaatccacccacttcggcctcccaaagtgctgggattacaggagtgagccaccgtgcccggtctgcatttgtatatattaatatatgtccacacagaataaaattttattctgtggaatgctatcaaactctatgcagtatgtcacagtttggttttcagtgaacgatatgttttggagag

SEQ ID NO: 11124 - DNA, 201 bp, Homo sapiens
ttgacatttaggttgattccaaatcttggctattgtgagtagtgctgcaacaaatatgggagtgcagatgtctccttgatattttcctcttaattcactgwctaataaacatcacttcctaatgataaaggcaggtaaaaaccaaaataataaattaaaatttcattctattctaaatgcgggaccatataaaatgaacat

SEQ ID NO: 11125 - DNA, 201 bp, Homo sapiens
tcaaactcctaaccttcagtaatccacccacttcggcctcccaaagtgctgggattacaggagtgagccaccgtgcccggtctgcatttgtatatattaatatatgtccacacagaataaaattttattctgtggaatgctatcaaactctatgcagtatgtcacagtttggttttcagtgaacgatatgttttggagagc

SEQ ID NO: 11126 - DNA, 201 bp, Homo sapiens
ttacttaataaagtatattcagcttgttttgcacatcttactgtagtaatatgtttgtattctaaagagccagccagactcctctctggtttttcagttgycaaattattctttttagtcagttgtattctcctgcatttggaacatctgcttatggcagaaaatactctagatactattctgttgtttatccacttctcc

SEQ ID NO: 11127 - DNA, 201 bp, Homo sapiens
gcagggctgtgcacctgccgcagttcatgcgtgtgcaccacctgaggacatgtgaggactccggctggccgtgggcaccgctacagcagtctgaggaagtrcgcagaaaagcgcgcgtgcctatgagcgtgtgcggcccactgcccacgtgcacctaggacttggcaacagcgcccgcagtagaaaggctagggaggggct

SEQ ID NO: 11128 - DNA, 201 bp, Homo sapiens
atgatatttgaagatttggcagaggaggtgtaggaggcttgtcttctgtgccagctccatcctgctgctcatgtgagtgatgatagtggggttggggtggmtctggtctgcactgattggaagtatgaggggtagtgggatggtgcccttgtgcgagtccaggctgggaggcccagagagcaggtaagagagatgtgagct

SEQ ID NO: 11129 - DNA, 201 bp, Homo sapiens
cctctcttctatcctctccccttctctgcttctctctgcctctgtcttacaaaatcactcaggatttattatcagctaaaaaaataaatattaaccatcchtcttttttgcccaattcacagtgaatattattggtaaaaaaataagccacacaaaataaactgacaagagctgaaagcacacagggtgaaatttggtatt

SEQ ID NO: 11130 - DNA, 201 bp, Homo sapiens
tgaggcaggaggatcacttgagcctaggaatttgaggctgcagtgagctctgattgtgccactgcattccagcctgggcgacagagcgagatcctatctcaaaaaaaaaaaatatatatatataaagaaatccatcaactcacacaaaaatgttgttgatgggactttgcattattcttataattaagaaaagcaaaatga

SEQ ID NO: 11131 - DNA, 201 bp, Homo sapiens
tgcctctgtcttacaaaatcactcaggatttattatcagctaaaaaaataaatattaaccatccatcttttttgcccaattcacagtgaatattattggtaaaaaaataagccacacaaaataaactgacaagagctgaaagcacacagggtgaaatttggtattgactaaaaatccatagatgactcaaatcttcttagc

SEQ ID NO: 11132 - DNA, 201 bp, Homo sapiens
ggatcacttgagcctaggaatttgaggctgcagtgagctctgattgtgccactgcattccagcctgggcgacagagcgagatcctatctcaaaaaaaaaawatatatatatataaagaaatccatcaactcacacaaaaatgttgttgatgggactttgcattattcttataattaagaaaagcaaaatgaaaattcagta

SEQ ID NO: 11133 - DNA, 201 bp, Homo sapiens
ctacaataaattcttcgtctctccgttgttatccatttatcctatggacaattactaggcacccaccaggtgtgggatgctatgccagataggaggcacagggctccctgccctcacaaagctcatgatttaatgctaccctttgcattgtccactgagatgggtctgtggttggcaagaggctgcagccccttagcaata

SEQ ID NO: 11134 - DNA, 201 bp, Homo sapiens
atcacttgagcctaggaatttgaggctgcagtgagctctgattgtgccactgcattccagcctgggcgacagagcgagatcctatctcaaaaaaaaaaaatatatatatataaagaaatccatcaactcacacaaaaatgttgttgatgggactttgcattattcttataattaagaaaagcaaaatgaaaattcagtaag

SEQ ID NO: 11135 - DNA, 201 bp, Homo sapiens
tatgccagataggaggcacagggctccctgccctcacaaagctcatgatttaatgctaccctttgcattgtccactgagatgggtctgtggttggcaagaggctgcagccccttagcaatactagatgcagtgaatctgtggggcaatagtccttcttttctttcccatgcatgtgtggaaatccagtgtgtatgaagtgg

SEQ ID NO: 11136 - DNA, 201 bp, Homo sapiens
ttttcatgtttctttgctgcttcctttcatcttgccaagttacatttagcaggatattcatctaattccttttttaaaattttaatgctccccattttttkggggggtgggggacaaaaagagccttttaggaaataagcatcaggaactaactaatcaaagtgaaactttctgggagacatctgacagccgcatgcctct

SEQ ID NO: 11137 - DNA, 201 bp, Homo sapiens
tcccccactccactgcaccattgcaggctgaattagggggcctcttctctgcgcctcttacattaccctgggtttcccgtgctcaggccatgcctaccacttttttttttttttttttttttgagatggagtttcactcttgtcacccaggctggagtgcaatggcatgatcttggctcactgcaaccttcacctcctggg

SEQ ID NO: 11138 - DNA, 201 bp, Homo sapiens
taattccttttttaaaattttaatgctccccatttttttggggggtgggggacaaaaagagccttttaggaaataagcatcaggaactaactaatcaaagygaaactttctgggagacatctgacagccgcatgcctctaatgaccttcaaaaagatcacgtgctccaggcaattacaggatttgggagaaaatagctcat

SEQ ID NO: 11139 - DNA, 201 bp, Homo sapiens
gcttattttctggggtatgcataggatttctaaggaaatgataacattccacattttgaactgcatggtgatttcaaggatatatacatatgtaaaaattyatcaagcattttattacacatacgttatacctcaataaaaataagtgtatcaaaaaagaatttaaaagtgctatgtgtattcacatggaaatatattcac

SEQ ID NO: 11140 - DNA, 201 bp, Homo sapiens
ttttaatgctccccatttttttggggggtgggggacaaaaagagccttttaggaaataagcatcaggaactaactaatcaaagtgaaactttctgggagasatctgacagccgcatgcctctaatgaccttcaaaaagatcacgtgctccaggcaattacaggatttgggagaaaatagctcattctgaatagccgaacct

SEQ ID NO: 11141 - DNA, 201 bp, Homo sapiens
atgcctaccacttttttttttttttttttttttgagatggagtttcactcttgtcacccaggctggagtgcaatggcatgatcttggctcactgcaacctycacctcctgggttcaagcaattctcctgtctcagcctcctgagtagctgagattacaggcacttgccatcacacccaaccaatttttgtatttttagtag

SEQ ID NO: 11142 - DNA, 201 bp, Homo sapiens
tcaggggactttgttggtcaagctcttgaatatgggtgcagctggaaaaataacctatttgtcaataggttaccagtttcacagctggtagtgcccagaakggcgctgaataaacttcagtgggatccctgctgcttggtgcttgaagttcatctgacgtgaagcctttgtgaaaagagtattcaggaacccagtagcaat

SEQ ID NO: 11143 - DNA, 201 bp, Homo sapiens
caggggactttgttggtcaagctcttgaatatgggtgcagctggaaaaataacctatttgtcaataggttaccagtttcacagctggtagtgcccagaagkgcgctgaataaacttcagtgggatccctgctgcttggtgcttgaagttcatctgacgtgaagcctttgtgaaaagagtattcaggaacccagtagcaatc

SEQ ID NO: 11144 - DNA, 201 bp, Homo sapiens
ttatgctctttaatgcaatatatgcaatatgcatatgaggcacatatatgcacatatttaatatgtgcaatatgaggcatataaccaacagaattatataytccctggcttttacaactgtagtggatcataaattgctacttagtccagtaatatggaaactgaagccacagaggggatatgacctcacctaaagatgca

SEQ ID NO: 11145 - DNA, 201 bp, Homo sapiens
ggggactttgttggtcaagctcttgaatatgggtgcagctggaaaaataacctatttgtcaataggttaccagtttcacagctggtagtgcccagaagggygctgaataaacttcagtgggatccctgctgcttggtgcttgaagttcatctgacgtgaagcctttgtgaaaagagtattcaggaacccagtagcaatctt

SEQ ID NO: 11146 - DNA, 201 bp, Homo sapiens
tacttcatcaggttccctctgttccttttgtactgcaacttttgccagcaataattttaaagactcatctagattgttaacagattggagaggaccacaarccctgctctcatgttaataaggaaacttcctgcaatggactctagagttttaatagcaccattcagcataatgatgctcacagatcttggagtgggggag

SEQ ID NO: 11147 - DNA, 201 bp, Homo sapiens
gaggtaaaattctagggcctccccagaaaactgtttcatgaatgaggaagctaagaaaaagggccactggctttaaagcccagtaggttaaataggagaayggagaaagttataaaatgattaattggtcaagttgggatgggaaccttaggttataatatcaagatttaaccttggcactatggacattttgagcaggag

SEQ ID NO: 11148 - DNA, 201 bp, Homo sapiens
tagattcaccactttgattcccccacacacccttttttaagagacgagaggctgcagtgaggagccacctgtagtcccagctacttgtggggactgaggckagataattgcttgagcccataggtcaaggccacagcgagccatgttcatgccgctgcactccctggagtggctcactgcaggcctctacctcctgggctt

SEQ ID NO: 11149 - DNA, 201 bp, Homo sapiens
actgcacgctgaatctggctcatagatgcattttgtttcaccagtacagcatttttaaatgcttgaattttaatgtctttagacagcatgcattttcaaawtcactacagctgtccccactctgttatcccatatctagggtgattcatacatttatgttaatgatatggtttctgtgagtatttgagatcatggtgctca

SEQ ID NO: 11150 - DNA, 201 bp, Homo sapiens
  misc_feature (1)...(201): n = A,T,C or G, or insertion/deletion polymorphism (see Tables 1-2)
ggaccatatgtttgcacgaggcttagggatttagagtgtggacatatatagtttctcattttatctctgccaaggattaataactcagtgatagcctgggnaacctggcagctccaacggtatttgtttaaagaatctctattttcagatgaggaaataaaggatctgggagttgcagtaatttgtgcattgttcaaagct

SEQ ID NO: 11151 - DNA, 201 bp, Homo sapiens
gattcagtggtgctggaaggaaactcgggtatatgcacactgaaaagctcattagggtgattttgatgctaagttattgaattactagcactctacacaaytggaggacagaaaatacctatgtgaggttgtagtatttatggaagaaggaaaaggtgatatctagatcttgaaagataaaatactgacaaaataaacatt

SEQ ID NO: 11152 - DNA, 201 bp, Homo sapiens
ggttgtatggatgtgttcaaattgtagaaaattgagtggtataatttgtccactgtttttatgtattaaaaatttaaaaatgtgtgtttgtaagacctctytctgtgtcacacacacacacacacacacacacgcacacacacacacacccctatggatctctttccttcagtgttcaggagagacacactccccagacat

SEQ ID NO: 11153 - DNA, 201 bp, Homo sapiens
  misc_feature (1)...(201): n = A,T,C or G, or insertion/deletion polymorphism (see Tables 1-2)
ttaactgagacaatcagaagcttcctttgcctttgtaggacttgctgagagctttatcctggcaaacggaagctaaatgtggccagcatgaaagtgatcgnaggagaagactatctcattgacctttgcactaaatgactccaccaactggaccatatgtttgcacgaggcttagggatttagagtgtggacatatatagt

SEQ ID NO: 11154 - DNA, 201 bp, Homo sapiens
  misc_feature (1)...(201): n = A,T,C or G, or insertion/deletion polymorphism (see Tables 1-2)
tttcataggtatttgtgcatctattatgtaagcagccctgggctgggtacgagggccataaaggcaaacagaacacagtcccaccctcaatgagtccactngggcagacagatgagtgtgcaggtctcacactagctagtgaggtagggaaaggagaggctacctgcccagttttatgggattagaggctgcttcccagaa

SEQ ID NO: 11155 - DNA, 201 bp, Homo sapiens
  misc_feature (1)...(201): n = A,T,C or G, or insertion/deletion polymorphism (see Tables 1-2)
tcacccctggaaattgaaataaaatatgttgaaatgctcagttgatacactatgagagtaacagaaagcacatcagggcttaccagggctcacaagggcantcctcaacaggagaatgcaaattccccaggagtctctctggatcgttgctgagttacctccattatttccttttcttggcagacagcaggaaaataagtt

SEQ ID NO: 11156 - DNA, 201 bp, Homo sapiens
  misc_feature (1)...(201): n = A,T,C or G, or insertion/deletion polymorphism (see Tables 1-2)
agttttgccatgttgcccgggctggtctcaaactcctggcctcaagtgatcctcctgccttgccttcaaagtgctgagattgcagatgtgagccaccgctnctggctaacttgttcatttcataggtatttgtgcatctattatgtaagcagccctgggctgggtacgagggccataaaggcaaacagaacacagtcccac

SEQ ID NO: 11157 - DNA, 201 bp, Homo sapiens
gaggaggatggatgtgatgatgatggaggatgatgatgacagaggaagggggagggaggtgggtggtggtggagtagttgttttccagtgtgaccaattcwgcttatgtgcacgtgagaatgctatccatctgaatcctcaggcttaccaggcttatttgatgtttttacttttcctctcacccctggaaattgaaataaa

SEQ ID NO: 11158 - DNA, 201 bp, Homo sapiens
cccattttagagttgagacattcatccctgcattccacagtgatcatttcagcctcgttaaataactttaacatttggaaacaatatccaggactactgayagggatctaatcataattagcacctgtaatcccagcactttgggaagccgaggtgggtggatcacttgaggccaggagttcaagaccagcctgaccaacc

SEQ ID NO: 11159 - DNA, 201 bp, Homo sapiens
ttttgtactgcaacttttgccagcaataattttaaagactcatctagattgttaacagattggagaggaccacaaaccctgctctcatgttaataaggaamcttcctgcaatggactctagagttttaatagcaccattcagcataatgatgctcacagatcttggagtgggggagccttggaagtcaatggagaactcac

SEQ ID NO: 11160 - DNA, 201 bp, Homo sapiens
gccaccacacctgtccagttatttcttatttaaatgattataacaaccttctaatgccctcctgcttttctattcactcatcctcctgtagatgctaaatwtttttttctgaaatataaatgtcatgttcctattaataacccattacttgttgataaagtccatattgcttaactcactgcataagtctctttgttcatg

SEQ ID NO: 11161 - DNA, 201 bp, Homo sapiens
  misc_feature (1)...(201): n = A,T,C or G, or insertion/deletion polymorphism (see Tables 1-2)
actggctttaaagcccagtaggttaaataggagaacggagaaagttataaaatgattaattggtcaagttgggatgggaaccttaggttataatatcaagntttaaccttggcactatggacattttgagcaggagaattctttgctgtgggaggggctgttctgtgcattgtaagatatatagcaacatccctggactct

SEQ ID NO: 11162 - DNA, 201 bp, Homo sapiens
tgtgatgttctgccaaagttggaaactaagccatgttatatagcatggaataaaacccctctgacaagactttattgtctgtaggatgtgactcttcaggycccttagatagggctttgggcaagagaagaaaatggtcggagtttggtccttatattaatttcatttgcccctcacaatgactaaatggcatggagttat

SEQ ID NO: 11163 - DNA, 201 bp, Homo sapiens
  misc_feature (1)...(201): n = A,T,C or G, or insertion/deletion polymorphism (see Tables 1-2)
agaaatggacttgacttggtggaaataataaccacaaaagaaaactcaaaatggcagaagttataaattagtaaaatttgttgtggtccaaatcctgatcnatgaagcaaatatttataaaatttaaacacaaaagaattgaccccagtaaaaatgtttccaaaaaagttggaaacaatttaactacgctatgcaagacat

SEQ ID NO: 11164 - DNA, 201 bp, Homo sapiens
catttcctggtggtaaaaatctcccccagttgaatgtaaatttgttcagccattgtggaaagcagtgtgatgattcctaaaagaacttaaaacagaattaycaatcaacccagcagtctcattatggagtatatccccaaaggaatataaataattatataaagatatatgcatacatatgtattctgcagccctattcac

SEQ ID NO: 11165 - DNA, 201 bp, Homo sapiens
tgtagatgctaaatttttttttctgaaatataaatgtcatgttcctattaataacccattacttgttgataaagtccatattgcttaactcactgcataastctctttgttcatggccttctaggcttgtctctctccactctgacctatgtttaaatgacttaaaacggttgtcacttcttgagacaccctcatttcttg

SEQ ID NO: 11166 - DNA, 201 bp, Homo sapiens
tttgtcaaaaatcaattgacagtgtcagagcttatttctaaacgttcagttttgttccagtgatttgtctctttcccttaataccacactctcttgatttytgtagctttgtaatatgtttgaaatgagggtaatgtaagtccttcaccattgtttttctatttcaaaattattttgcctgggtctattttttttttggct

SEQ ID NO: 11167 - DNA, 201 bp, Homo sapiens
aaaatctcccccagttgaatgtaaatttgttcagccattgtggaaagcagtgtgatgattcctaaaagaacttaaaacagaattatcaatcaacccagcartctcattatggagtatatccccaaaggaatataaataattatataaagatatatgcatacatatgtattctgcagccctattcacaatagcaaatacatg

SEQ ID NO: 11168 - DNA, 201 bp, Homo sapiens
ttatctagtgttctaaattgaatctccatgtacataattttataatattttataacttttaagtgaaaattcttaaagcaggcatttgctccctttacattatatatatatatatttaattatactttaagttttagggtacacgtgcacaacgtgcaggtttattacatatgtgtacatgtgccatgttggtgtgctgta

SEQ ID NO: 11169 - DNA, 201 bp, Homo sapiens
ggagtgcaaaagttttaaattttaatggagatgaatttgcctattttttcatttatgtctagtaaaagaataatgaatggttttgtgtctaagagctttcygcttaacccaaggacatgatggttttctctaatttttttttcaaggagccttatagttttagttgttatatttaggtctaagatctattttgagttaatt

SEQ ID NO: 11170 - DNA, 201 bp, Homo sapiens
tatctagtgttctaaattgaatctccatgtacataattttataatattttataacttttaagtgaaaattcttaaagcaggcatttgctccctttacattatatatatatatatttaattatactttaagttttagggtacacgtgcacaacgtgcaggtttattacatatgtgtacatgtgccatgttggtgtgctgtac

SEQ ID NO: 11171 - DNA, 201 bp, Homo sapiens
aaaatctgaatttgattgaatgcatttatgtgtttcgagcatttgttatgttctgagcattgcacacatactttacttatataataacactttattcccarcagccctctaagggcaaatattgttggctccatttttctttcttgtttttttttttgagatggagttttgctcttgttgcccaggctggagtgcagcagt

SEQ ID NO: 11172 - DNA, 201 bp, Homo sapiens
cttggactgtaagaagactccttttctagaacagaaaagatgaaaagtatgtgcatgtaattatggtgtttatgccactctaaaaaaattattcctaaatrttgtttgggtagaattatttagagaatgaggctagaaccattccaatcccaaagactcctcatttgactaaactcttctattctttgttgaaaggactag

SEQ ID NO: 11173 - DNA, 201 bp, Homo sapiens
ggctgtttttgtgctacaaaggcagagttgagtagttgtgatagagaccgtatggcctgtagtgctgaaaatatttactaattggccgtttaccataaaaaaaaaaaaaaaaagattagtgacctctggcttaaacaataaaagtgacatgttattttgaaacaattccaacaattggaagaatttaactaaacatgactg

SEQ ID NO: 11174 - DNA, 201 bp, Homo sapiens
gaattgggccagttgtgcaatcatgcaatctactgcaaaaggttttttgtttttttttttcactttgttgcccgggtattccctaaaacacccagagactstagctcttaaatataaggctgattaaagctgatcgatgccacctgactataatactgtcacttgagtgaaggtgccaatgctacgcagcaaatgtaggag

SEQ ID NO: 11175 - DNA, 201 bp, Homo sapiens
tgctcttccactcatccctggccactgtctcaccccatctggtgccttagacttgggaaaagggagaggaggtcagaggagcacctccatacctggggagsgggaggatgtcatcaaaggaagagctgagagctctcctaagtcataacccagccctgcacaccaccctattaccctctatggaaagaaaaacagggtctt

SEQ ID NO: 11176 - DNA, 201 bp, Homo sapiens
gaactgagcctgtaactctcacctttcctcagtccagcactttttaaaaattacagcctcctgagccctcaccattttgtttgcaagtgtcttgttgattmactccattacagatttaggacattataaccagggacccagtcattttccttattggtatctcctctgtacacgtggcttagtgctgagcagagagtaact

SEQ ID NO: 11177 - DNA, 201 bp, Homo sapiens
ggtcagacagaatgagcacagagagaagagctatgattccaggaaggtctcaggaagaaaggcagagggcatgagagagcagtcttcaaacatacgaaggrctgtcctgtggaggagaaacaagagccactagttactgtcccgcagggaagagtaggacctgtgggcaaaagctataagggagagagaaattagctgtgc

SEQ ID NO: 11178 - DNA, 201 bp, Homo sapiens
tccaagggtctgggttcctcttttaaaaaatgctttctgggccaggcacagtggctcatgcctataatcccagcactttgggaggttgaggcgggcagatmactggaggtaaggagtttgagaccagcctggccaacgtggtgaaaccctgtctctactaaaaatacaaaaatcagccaggcattgtggtgggtgcctgta

SEQ ID NO: 11179 - DNA, 201 bp, Homo sapiens
  misc_feature (1)...(201): n = A,T,C or G, or insertion/deletion polymorphism (see Tables 1-2)
catgttgaaaaagcagagttccttctatttgggagtgaaggagggtcctgaaggtatcttctaggaagtagcatttgaatctagcctttgaagtgagttanctttattctgtttctgactccagtaaacaagccagcaaatcaaacccttagagatggcaagactaccttaacagagcaggtgcagatctcttctgacccg

SEQ ID NO: 11180 - DNA, 201 bp, Homo sapiens
  misc_feature (1)...(201): n = A,T,C or G, or insertion/deletion polymorphism (see Tables 1-2)
attttggaagtggagctaaacccaaggctgactccaggactacaactatttctacttggagcccttgagcttatttttccagtacataggtctcagctgancaatctgaaaatggagagtagggacatagggccttggaggttcctacttattttaatcagttccatagcctgaccctggtccagtgagcatcagatttgg

SEQ ID NO: 11181 - DNA, 201 bp, Homo sapiens
ggagccccatgttgggcagaagttgccaggccccatgtccccctcatgccctgtcactggctgaggactgctctggcagaatgtgacctcagctcaaaagyggaagtgaatcctgagggctctgaagccagaggatgtcagtaacctgcacccccagtggctgaatgacacattcttttttgaaggcagatcggatccaag

SEQ ID NO: 11182 - DNA, 201 bp, Homo sapiens
  misc_feature (1)...(201): n = A,T,C or G, or insertion/deletion polymorphism (see Tables 1-2)
ccatgaaaggagccccatgttgggcagaagttgccaggccccatgtccccctcatgccctgtcactggctgaggactgctctggcagaatgtgacctcagntcaaaagtggaagtgaatcctgagggctctgaagccagaggatgtcagtaacctgcacccccagtggctgaatgacacattcttttttgaaggcagatcg

SEQ ID NO: 11183 - DNA, 201 bp, Homo sapiens
  misc_feature (1)...(201): n = A,T,C or G, or insertion/deletion polymorphism (see Tables 1-2)
tcagaccaccatgcagaccagacagtctctgccaacctaacagaaagctttggagaagaggttgcccatgaaaggagccccatgttgggcagaagttgccnggccccatgtccccctcatgccctgtcactggctgaggactgctctggcagaatgtgacctcagctcaaaagtggaagtgaatcctgagggctctgaagc

SEQ ID NO: 11184 - DNA, 201 bp, Homo sapiens
acttaatatgtgagagataattttatgatttaaaaaaacacctggtgttagaggaatcagaccagaaaaatgaacattttatttttattctgttttctttkttaagaactgtgagtcctggtttgaaatccccacccctattcatctctccatcattgagaatttttgatgagtgattagtctatgtgctaggtgctgtag

SEQ ID NO: 11185 - DNA, 201 bp, Homo sapiens
ccatccatgccagttatcacttgggtttcgttttctatgttattcctatgcaagcctcatgtcttctgccagagtgtaagtcgtttgagggcagatttttwaaaaaactgtttatctgtatatgtgtatttgacatgacaaatgcttctctcctccgcagacatataaaaataatgccttttcattgtagagcacttagga

SEQ ID NO: 11186 - DNA, 201 bp, Homo sapiens
  misc_feature (1)...(201): n = A,T,C or G, or insertion/deletion polymorphism (see Tables 1-2)
acattttggaagtggagctaaacccaaggctgactccaggactacaactatttctacttggagcccttgagcttatttttccagtacataggtctcagctnatcaatctgaaaatggagagtagggacatagggccttggaggttcctacttattttaatcagttccatagcctgaccctggtccagtgagcatcagattt

SEQ ID NO: 11187 - DNA, 201 bp, Homo sapiens
ccatggtgactggctcattgattagcatgaatcatagttaagaacgatgagatgggagattttattggagggcttctgagaaccttctaaagatacaagarcatgcatggaagcacttgtggaatgttggcaggttcccatgttgtgttcacgatggggcaccagccataagatagtttcagcagagggtatgtagggcag

SEQ ID NO: 11188 - DNA, 201 bp, Homo sapiens
ttagaattttgcctactgtggctggtaatccaaaccaaatattcttcctgtggattaagactatcactttgggaacatcttagaattctgcctgctgtggstggtaatccaaatcaaatattcttcctgatctttgtgttaagactatcacttttggaacagccattttccaaagctctctcataattccatcgtaggcag

SEQ ID NO: 11189 - DNA, 201 bp, Homo sapiens
aaactgattgcctcgtattcgcttcccatgcatcaagagctagtttgagttctactgtccataattgtcagttgctacacactcactcagcagcaatatgscagatttttctgctagttaatgcttaaaagtttattccattttacaaagtactgatgaatttcgacaagaataaaaggccttatggtttccagtaggaaa

SEQ ID NO: 11190 - DNA, 201 bp, Homo sapiens
agccagatatttttttctctgtttcctttttttttttttttttttttggagctgctccaccccctggtatggtgcagcttctcctggggctcctctgtaaytttacagcagcttctgagctagtgaagaaggcgggatttgctcacttgcagttaagtctggccagacagctgttagttgttgccacaaacatcttatgtg

SEQ ID NO: 11191 - DNA, 201 bp, Homo sapiens
gggatggctggctcaaatggtatttctagttctagatccctgaggaatcgccacactgacttccacaatggttgaactagtttacagtcccaccaacagtrtaagtgttcctatttctccacatcctctgcagcacctgttgtttcctgactttttaatgattgccattctaactggtgtgagatggtatctcattgtggt

SEQ ID NO: 11192 - DNA, 201 bp, Homo sapiens
agcggtagcagagatctgaataattgattcttcagccgcaccagacgcccgggagcgggcggagagcgtggttccaacaccacggacagcagcgcgcgccrccgcaggcgcccccgtcgccagccagccacctatcctggccttatttgccgccgtgcgctctcggaacgggtggccgcgctccgcgtcgccgccgaggga

SEQ ID NO: 11193 - DNA, 201 bp, Homo sapiens
tgtctccggtcatgtgacttagctgcctggactcttctgttctatgcaggaacagagctagttttcatttactgcaggaaagaccagattggcaggttgattttttttttttctttctcatttgagcaaggcactgggaacactgagggtgataaagggaaggcttagttttgcaatctgtgcttatatcactgagctccc

SEQ ID NO: 11194 - DNA, 201 bp, Homo sapiens
tcttagctcctaatcctcacttcatccttacctaccttctacctctctgtgtgtcaactctattgtgtttctatgattacatttttaaaaatatttatttsttttgaataggcaatacccacatgggattacaaaaattaaatcagcatctgtatgtgtctagcaagtattttttcttctaagcttccttcctggaggaat

SEQ ID NO: 11195 - DNA, 201 bp, Homo sapiens
ttatattctaattccttgaccttgtgagtatgttaccttacatgacaaaaggggctttgccaatgtgattaagttaagcatcttgatatggggagattttyctgtattatccaagtggacccaacaatataatcacaagtgtcctcatcagggaaagacagggagattctactaccagggaagatgacagtttgatgacca

SEQ ID NO: 11196 - DNA, 201 bp, Homo sapiens
atgtgatggtggtctgctgcgctcatcaacctgtcacctacattaggtgtttctcctaatgctatccctcccctagcccccaacccctgacaggcccagtrtgtgatgttcccctttctgtgtccatgtgttctaattgttcaactcccacttatgagtgagaacatgcagtgtttggttttctgttcttgtgttagtttg

SEQ ID NO: 11197 - DNA, 201 bp, Homo sapiens
caagagagaaaggggatcagtgccacactcttttaaacaaccaaatctcatgtgaactaagagcgagagctcactcattaccagggttatggtgctaggcygttcatgagggatctgcccccatgatctaatggcctcccgccaggccctacctccaacactggaggtgacatttcaacatgagtttggagggaacaaaca

SEQ ID NO: 11198 - DNA, 201 bp, Homo sapiens
acctctgcctctagggttcaaatgattcttgggcctcagcctcccgaggagtagctgggactacagacgtgcaccaccatacctggctaattttttggggttttttttttgtatttttggtagagatgaggttttgccatgtttgccaggttggtcttgaactcctgacctcaagtgatccatccaccttggcctcccaaa

SEQ ID NO: 11199 - DNA, 201 bp, Homo sapiens
cagttttacctgattgttttgtgggaaaatgtccattttttcctcttatggtaagtgactaaaactatttctaaaaattattaaatgtgggtaggttctgraagaaaatgcaaagtttttaggtaaagcacaaaagggcagaaaaaatgtcatgcttcctctgactctgcagttagaggaacagaggtggggagtttgaga

SEQ ID NO: 11200 - DNA, 201 bp, Homo sapiens
aaaatagaggtaactctaatcataagcagagataactctcctatactcaccatccagcttcagcatttatcaactcatggacaatcttaattcattttatygccacccacagtagattattttggagcaaattcccaacatcctatcatttcatctctatacttttcaatatgcgtctctaaagataagagctcctggggg

SEQ ID NO: 11201 - DNA, 201 bp, Homo sapiens
ggcttctggtgaggcctcaggaggcttccaatcatggtggaaggtgaaaggggggtagcatatcgcatggtgaaagacagagcaagagagaaaggggatcrgtgccacactcttttaaacaaccaaatctcatgtgaactaagagcgagagctcactcattaccagggttatggtgctaggctgttcatgagggatctgcc

SEQ ID NO: 11202 - DNA, 201 bp, Homo sapiens
  misc_feature (1)...(201): n = A,T,C or G, or insertion/deletion polymorphism (see Tables 1-2)
gagcagggcagcctcctccccggggccagggacaggggaatggcctaaggagccaggacccaagggtagcccaggaccggggaagggggcagagacctccncttggcctaggtcaggagctcagaagtgccacatggctgagggggcagcggcccgggaagagccagaggcagagccaggaaagcaccatttcctgggggg

SEQ ID NO: 11203 - DNA, 201 bp, Homo sapiens
  misc_feature (1)...(201): n = A,T,C or G, or insertion/deletion polymorphism (see Tables 1-2)
tccccaagtgtgttgtttctttcagtgatggtgattcagaggctgtgatacatcggcttagctgttttgggtttcagctttctcatgactagatgtatgtntttggacaagtttacattttcccatatttactttctttgtccttaaaaaaaaagttgctgttgctgctgatagtatctattcctcatagttgcgagtggg

SEQ ID NO: 11204 - DNA, 201 bp, Homo sapiens
tgaggttttgccatgtttgccaggttggtcttgaactcctgacctcaagtgatccatccaccttggcctcccaaagcgctgggattacaggcgtgagccaccgccaccggccttattttatcttattttttagatatgagagtttatcattattatggcaggaacgggtagtgttggaagcaagactgagaaggagataat

SEQ ID NO: 11205 - DNA, 201 bp, Homo sapiens
tccccacttcatgctgccatatcgtggttcctaaagccaggtctggggtacttgctggggtggaatttagaagctagaaacgaacttgctcaagtctacawcccatccacagttcacatgcccttggtccacgcccacttgtgctgtgtgctcctgttctcttggtttggggagaccatatcccgcttgtattgatgactt

SEQ ID NO: 11206 - DNA, 201 bp, Homo sapiens
agcacaccagcatggcacatgtatacatatgtaactaacctgcacattgtgcacatgtaccctaaaacttaaagtataataataataaaattaaaaaaaawtttattttttttgtgggtacatagtaggtgtatatatttatggggtacatgagatgttttaatacaggcatgcaatgtgaaataatcacatcatggaaaa

SEQ ID NO: 11207 - DNA, 201 bp, Homo sapiens
  misc_feature (1)...(201): n = A,T,C or G, or insertion/deletion polymorphism (see Tables 1-2)
gataggtattgcttcagctgcctaaacccatatctccctgtacccccaaaacactcaagagccatagccataaaacttcaagaagatgaaatattttgggngttagtaatacccttgatggttagagttatatgtggctgagattcttcttgtatctattctggtctcatttaagatggctgaaatgattgatcactgccc

SEQ ID NO: 11208 - DNA, 201 bp, Homo sapiens
ttaatatctgaaagtctgtagtaatgcaccagactttatttctgatagtctcttttcttcttgatcagtctacctaggtttatcaattttgtttttttttktttttttaaagagaatcagctttgggtttcattagttttctctgttatttcttaattagcttctcagcctaaatgttttctcagaaaggatgtttcctga

SEQ ID NO: 11209 - DNA, 201 bp, Homo sapiens
tgcctactctcgttttcacagtcccttcacaaatattgtatcttcggttatgctcatgtgtgagttctgtattttaagaaggacattgataaactgagctygttaaaaggaacatgactaagggaggtacaggctgctggaagtggttcctgaataacatcaacaaaaggataaatgtttgcatttctgagagtggagaga

SEQ ID NO: 11210 - DNA, 201 bp, Homo sapiens
ttaattattatactttaagttctgggatacatgtgcagaacgtgcaggtttgttacataggtatacatgtgccatggtggtttgctgcacccatcaacccrtcatctaggttttaagccccgcatgcattaggcatttgtcctaatgctatccctccccttgcccactaccccctgacaggccctggtgtgtgatcttccc

SEQ ID NO: 11211 - DNA, 201 bp, Homo sapiens
  misc_feature (1)...(201): n = A,T,C or G, or insertion/deletion polymorphism (see Tables 1-2)
ctgtaagtactcctcatgcaactacctgcagtggatttaaagtcagctcagggcagtttcaacaccagagttggaggaaagaggttgtgtgtacattgtcntctggggactgctgctgtttatgccttgtggtttcctttgggggagacagatccaccctgctttcctcatccatcttcctacatggatatatcttgttat

SEQ ID NO: 11212 - DNA, 201 bp, Homo sapiens
tttgcctctgcctactctcgttttcacagtcccttcacaaatattgtatcttcggttatgctcatgtgtgagttctgtattttaagaaggacattgataamctgagcttgttaaaaggaacatgactaagggaggtacaggctgctggaagtggttcctgaataacatcaacaaaaggataaatgtttgcatttctgagag

SEQ ID NO: 11213 - DNA, 201 bp, Homo sapiens
aaggagacaggtgaaaaaaaaaaatgccaatgtaagaacatagttgagactgttgagtcagtatctagaggcagcattcattttccatcaaccgtgtgtgkgtgtgtgtgtgtgtgtgtgtgtgtgtgtgcgcgcgcgcgcgcgcgtgtagagagagagattcagggggtgcgtgtgcaggtttgttacatagacatatta

SEQ ID NO: 11214 - DNA, 201 bp, Homo sapiens
tgagcgaggtggttcacacctgtaatcctagcactttgggaggccaaggcgggtggatcacctgaggtcaggagttcaagaccagcctggccaacatgctkaaaccccatctctacaaaaatacaaaaatcagctggatgtggtggcaggcccctgtaatcccagctactcaggaggctgaggcagggagaattgcatgaa

SEQ ID NO: 11215 - DNA, 201 bp, Homo sapiens
cttggctatttcagatggggaagtacgcatgcctcattttatccaagtttctcacagttctataagtcttttttcacacacagttccatacacaaaaggtrgctttgcaaaaaacttcttttaacatagctggcaggctatactgtacatatatctatacacatgtatgcatgtatgtgcatatacatatacctttgcata

SEQ ID NO: 11216 - DNA, 201 bp, Homo sapiens
agggcatggcaccaccatcctcccagatgcccaggctcaacttcttgctgccaccatttccctcacacccctcaccctgtgactacaccttctacatagtrttcatatccatccacttttctcttttctctgctggccagaatcctctaatcttttaccttgaaaggttcaataacagatgaatgaacagatgacagaatg

SEQ ID NO: 11217 - DNA, 201 bp, Homo sapiens
cagttccatacacaaaaggtggctttgcaaaaaacttcttttaacatagctggcaggctatactgtacatatatctatacacatgtatgcatgtatgtgcwtatacatatacctttgcatatatatgtttatgcatacattttattttgctttatttagaattattatttttggagatagagtcttgccttgtcaccgagg

SEQ ID NO: 11218 - DNA, 201 bp, Homo sapiens
  misc_feature (1)...(201): n = A,T,C or G, or insertion/deletion polymorphism (see Tables 1-2)
attccttcttcaaactggtcctcctccagggcatggcaccaccatcctcccagatgcccaggctcaacttcttgctgccaccatttccctcacacccctcnccctgtgactacaccttctacatagtgttcatatccatccacttttctcttttctctgctggccagaatcctctaatcttttaccttgaaaggttcaata

SEQ ID NO: 11219 - DNA, 201 bp, Homo sapiens
gctccttgttctttcacttagagaagtctttgtcggttctgttagccagggttctctagagggacagaactaataggatagatgtatatataaaggggagtttattttattttattttattttttattttttttgagacggagttttgctcttgttgcctaggctggagtgcagtggaacaatctcagctcactgcaacct

SEQ ID NO: 11220 - DNA, 201 bp, Homo sapiens
ttctagtagtatttattggactcctatgatattccttcttcaaactggtcctcctccagggcatggcaccaccatcctcccagatgcccaggctcaacttsttgctgccaccatttccctcacacccctcaccctgtgactacaccttctacatagtgttcatatccatccacttttctcttttctctgctggccagaatc

SEQ ID NO: 11221 - DNA, 201 bp, Homo sapiens
ctccttgttctttcacttagagaagtctttgtcggttctgttagccagggttctctagagggacagaactaataggatagatgtatatataaaggggagtttattttattttattttattttttattttttttgagacggagttttgctcttgttgcctaggctggagtgcagtggaacaatctcagctcactgcaacctc

SEQ ID NO: 11222 - DNA, 201 bp, Homo sapiens
aggcatttgtttggcaggattcctgcccactaagagcttaccatgagtgtcatggtgggaatgagctgggtatttttagagcttggcagcctagcactgcsgcttgctcttccccgaggtctgtggattagcctaggggtagcatatgcctacgctttgcttgcctggtcctggtacatggtcctgtgtactgttaagaaa

SEQ ID NO: 11223 - DNA, 201 bp, Homo sapiens
tccttgttctttcacttagagaagtctttgtcggttctgttagccagggttctctagagggacagaactaataggatagatgtatatataaaggggagtttattttattttattttattttttattttttttgagacggagttttgctcttgttgcctaggctggagtgcagtggaacaatctcagctcactgcaacctcc

SEQ ID NO: 11224 - DNA, 201 bp, Homo sapiens
ggatcatccagctaggtaggcatttgtttggcaggattcctgcccactaagagcttaccatgagtgtcatggtgggaatgagctgggtatttttagagctyggcagcctagcactgccgcttgctcttccccgaggtctgtggattagcctaggggtagcatatgcctacgctttgcttgcctggtcctggtacatggtcc

SEQ ID NO: 11225 - DNA, 201 bp, Homo sapiens
  misc_feature (1)...(201): n = A,T,C or G, or insertion/deletion polymorphism (see Tables 1-2)
tgcatacatctgtgataccatcaccaaaatcaaggagtactgaatatatctttaacctccagggtatgtgattaatgtatatttctcctcggggatcatcngcttcgtaggggcaggaactgtattagttttcactcaccgttttgtccctattgattactacagtagttgacaaagtacaactaacattttaccgagcac

SEQ ID NO: 11226 - DNA, 201 bp, Homo sapiens
ccttgttctttcacttagagaagtctttgtcggttctgttagccagggttctctagagggacagaactaataggatagatgtatatataaaggggagtttattttattttattttattttttattttttttgagacggagttttgctcttgttgcctaggctggagtgcagtggaacaatctcagctcactgcaacctccg

SEQ ID NO: 11227 - DNA, 201 bp, Homo sapiens
tctcaaccctctccgtgaaactttcccagcccccttttgattccctttcatgggtaatagtgagaggcagcacacacagggaaccaggacagtaaacaacyttcttacccttttccaagatttcttcccaggagagacacagtaaaatagagcaggtgaggcaatgcggacgtgtgactgcatgatccattacctgaaata

SEQ ID NO: 11228 - DNA, 201 bp, Homo sapiens
cttggaaaccagattctcccccacacaacacccccatcagtcgcttctgcaccatgctggtccagggatgtacatgtgacccattaggccagtgtctcttyttaaaatttcttgtagcctagttctcttcttcttcttctttttttttttttttttttcactttttagcatctctggatgttaatggaatatgaagcaagt

SEQ ID NO: 11229 - DNA, 201 bp, Homo sapiens
  misc_feature (1)...(201): n = A,T,C or G, or insertion/deletion polymorphism (see Tables 1-2)
gttttgtgaccatcgctctgaaatttctccttcattttcctttggattgaaaaatagcagttaatgtgagtaataaaaaatgttatactcatgtttgttantttgtggaattgcacaagcttacaaatataaacagcagttgtctgagagaaagcaggagagaaatcaacttttaagggtacattggcccagaatataagt

SEQ ID NO: 11230 - DNA, 201 bp, Homo sapiens
aacccagataagtctaacctcatagccctcatcacattcttcactatgatatcatggtatcatgatttagttatccagtctgcataatggtaggaatttasgagttaattttcttttatttaaaaaaattttgtgggtacatagtaggtatatatatttatggggtacatgagatgttttgacacaggcgtgcagtgtgaa

SEQ ID NO: 11231 - DNA, 201 bp, Homo sapiens
gaggcggccgagatgctcgtgcgcgcagcgcgccccactgcatcctcgaccttctcgggctacaggtacgtcccagagggagatcagggctccttgggccrgggaggagggagactcgaccggagggagagcgggagagggatcaggctagagagggagagggaaagcgggagggagcccagcggcgaagtgcaggagggg

SEQ ID NO: 11232 - DNA, 201 bp, Homo sapiens
aaccgtataaaacaatgtgagagggcctgtctctcttcttccaccctcaccatcctgtatgctttagtgttatatgcattgcatctgtacattaatacccyaagaggcaatgtaaggatttgtgctttaaatagtcacatgcatatgtatttttttaattaaaagaagagtcttttatgcttatccagatatttatgcttc

SEQ ID NO: 11233 - DNA, 201 bp, Homo sapiens
ggctagataattatttgtgaatagggagctttcctgtgcattgtaggatgtttagcagcaaccctggtctttacccactgggtgccagtcataccctgccycctagctgtgacagctaaatgcatctccaggcatagcgaaatatcccctggtggagcacagtcattgcatgttgagaaccactggtctagggtatctgga

SEQ ID NO: 11234 - DNA, 201 bp, Homo sapiens
cctttagtttcgcttctctttctttttctgagtataaaaccgtataaaacaatgtgagagggcctgtctctcttcttccaccctcaccatcctgtatgctwtagtgttatatgcattgcatctgtacattaataccccaagaggcaatgtaaggatttgtgctttaaatagtcacatgcatatgtatttttttaattaaaa

SEQ ID NO: 11235 - DNA, 201 bp, Homo sapiens
tctggatggctgtggattgaggtatcactgagtaagtttgggtggtggatgacaaggtcagttttagagtctgctgagcttaactggcttatggggcaccrtgaacatccagttctttaaatatcaaagcccagtggaatgatctggatttggaaggcattggcatatatttaaaaccatgaaggatggataaaatgtcca

SEQ ID NO: 11236 - DNA, 201 bp, Homo sapiens
gtagaaagttttgtgcagctattaggttggggcaaaagtaatcgtgggttttgccatttaaaaaaaacagcgaaaactgcaattagtttcacacaagcctratagttgcagaaagaaatttggagtgtgagaatgcttagtctgacttctacatttgaggatcgagggggctccatgataaggaatgcaggggcctctagg

SEQ ID NO: 11237 - DNA, 201 bp, Homo sapiens
agttttagagtctgctgagcttaactggcttatggggcaccatgaacatccagttctttaaatatcaaagcccagtggaatgatctggatttggaaggcaytggcatatatttaaaaccatgaaggatggataaaatgtccaagtaaatgatgtacccagtgaggaacaatggatgcaacacagagccttggggaacacta

SEQ ID NO: 11238 - DNA, 201 bp, Homo sapiens
ctgttttgtgcaacaggatggccattgactccctgtgtctactgagcatttgaagtgtggctagtgtgacctgaaatgtgctatatgtgttaaattcactstgaatttcagacttgctgtgaaaaaaaagaatgtgaaatatctcattaataataatttttatattgattgcacattaaaatgataatatagtgagttgaa

SEQ ID NO: 11239 - DNA, 201 bp, Homo sapiens
  misc_feature (1)...(201): n = A,T,C or G, or insertion/deletion polymorphism (see Tables 1-2)
ttttgtgcaacaggatggccattgactccctgtgtctactgagcatttgaagtgtggctagtgtgacctgaaatgtgctatatgtgttaaattcactctgnatttcagacttgctgtgaaaaaaaagaatgtgaaatatctcattaataataatttttatattgattgcacattaaaatgataatatagtgagttgaataa

SEQ ID NO: 11240 - DNA, 201 bp, Homo sapiens
  misc_feature (1)...(201): n = A,T,C or G, or insertion/deletion polymorphism (see Tables 1-2)
caacaggatggccattgactccctgtgtctactgagcatttgaagtgtggctagtgtgacctgaaatgtgctatatgtgttaaattcactctgaatttcanacttgctgtgaaaaaaaagaatgtgaaatatctcattaataataatttttatattgattgcacattaaaatgataatatagtgagttgaataagatacat

SEQ ID NO: 11241 - DNA, 201 bp, Homo sapiens
acatttaagttaaattttaggtttctgagaagtgtcattgttccttgtggcccatcattatggttcagctgttgagatttagaatgatcactcctatccckattttgcatggttttgcctgatgttcactgatttaatccacgctttattcctcagataatgagcagtgtagaactgtgattaagggcctcaactctggag

SEQ ID NO: 11242 - DNA, 201 bp, Homo sapiens
caaagctcatgatttaatgctaccctttgcattgtccactgagatgggtctgtggttggcaagaggctgcagccccttagcaatactagatgcagtgaatytgtggggcaatagtccttcttttctttcccatgcatgtgtggaaatccagtgtgtatgaagtggagatctgaccccatcttgtttgagctgtgtgctgat

SEQ ID NO: 11243 - DNA, 201 bp, Homo sapiens
  misc_feature (1)...(201): n = A,T,C or G, or insertion/deletion polymorphism (see Tables 1-2)
taatttcaactttttctttttactttaatatatgtggtttgagggcagggcgcagtggctcacacctgtaattaccagcactttggaaggctgaggcgggnggatcacctgaggttgggagtttgagaccagcctgaccaacatggagaaaccccatctctactaaaattacaaaattagctgggtgtggtggtgcccacc

SEQ ID NO: 11244 - DNA, 201 bp, Homo sapiens
cacacctagagagttgggcacatcaggaaacttttgtcaatagtttagtttctggcagagtctcatggagaatcaagttactcggtgtgtgtgtgtgtgcrcgcatgcatgcatgagtgtgtgtccacatgtgagtgtgtctgtgagagaaggagaacatactggtatgtgtgtgtttgtagctgaaggagtgtcatatcg

SEQ ID NO: 11245 - DNA, 201 bp, Homo sapiens
  misc_feature (1)...(201): n = A,T,C or G, or insertion/deletion polymorphism (see Tables 1-2)
aaccccatctctactaaaattacaaaattagctgggtgtggtggtgcccacctataatcccagctacttgggagactgaagcaggagactctcttgaaccngggagtcaggggttgcagtgagccgagatcacgccaccgcactcccgcctgggtaacaagagcaaaactctgtcaaaaaaataaatacgaccaggtatgg

SEQ ID NO: 11246 - DNA, 201 bp, Homo sapiens
atttcactgtctttgcctcctaatgcattaataattcatactgttttaaaatttttttaatttctatttcaatagtttttggggtacaggtgcttttggtyacagggataagttgtttagtggtcatttctgagattttggtgcacccatcacctaagactactaactattgtagtcttttatccctcaccccctcccaaa

SEQ ID NO: 11247 - DNA, 201 bp, Homo sapiens
agaagcacacctagagagttgggcacatcaggaaacttttgtcaatagtttagtttctggcagagtctcatggagaatcaagttactcggtgtgtgtgtgygtgcgcgcatgcatgcatgagtgtgtgtccacatgtgagtgtgtctgtgagagaaggagaacatactggtatgtgtgtgtttgtagctgaaggagtgtca

SEQ ID NO: 11248 - DNA, 201 bp, Homo sapiens
ctatttcaatagtttttggggtacaggtgcttttggttacagggataagttgtttagtggtcatttctgagattttggtgcacccatcacctaagactacyaactattgtagtcttttatccctcaccccctcccaaactttccctacccctaagtccccaaagtccattatgtaattttttttttgagatggagtctcgc

SEQ ID NO: 11249 - DNA, 201 bp, Homo sapiens
caatgtaagaacatagttgagactgttgagtcagtatctagaggcagcattcattttccatcaaccgtgtgtgtgtgtgtgtgtgtgtgtgtgtgtgtgtgtgcgcgcgcgcgcgcgcgtgtagagagagagattcagggggtgcgtgtgcaggtttgttacatagacatattatgtaatgctgaagtttgagcctctaat

SEQ ID NO: 11250 - DNA, 201 bp, Homo sapiens
ttttctgtgtctgcagaaagacacagtgcaaactgttaaatttggaggtttttggcagcttcattaaagggcaaggattttcctctttgggggtgggcttyatgttttaatggtcgtggtcagcattgctgggtgaggatccttaggctttttgtcaggggttcagggccttctggcttccccaggcttctccaggcttct

SEQ ID NO: 11251 - DNA, 201 bp, Homo sapiens
aatgtaagaacatagttgagactgttgagtcagtatctagaggcagcattcattttccatcaaccgtgtgtgtgtgtgtgtgtgtgtgtgtgtgtgtgtgtgcgcgcgcgcgcgcgcgtgtagagagagagattcagggggtgcgtgtgcaggtttgttacatagacatattatgtaatgctgaagtttgagcctctaatg

SEQ ID NO: 11252 - DNA, 201 bp, Homo sapiens
  misc_feature (1)...(201): n = A,T,C or G, or insertion/deletion polymorphism (see Tables 1-2)
ccttaagcgctggaattacaagcatgaaccaccatgcccagccttatttagaatttcatagggaattcttatgttattaaaactaagggttataagggctnccaaatcgctgtcatatggctggtctcaaatgcatttaaacaccccctcccccattgattttttttttttacatggttttcttatgtttgaaaatttgta

SEQ ID NO: 11253 - DNA, 201 bp, Homo sapiens
tgtaagaacatagttgagactgttgagtcagtatctagaggcagcattcattttccatcaaccgtgtgtgtgtgtgtgtgtgtgtgtgtgtgtgtgtgtgygcgcgcgcgcgcgcgtgtagagagagagattcagggggtgcgtgtgcaggtttgttacatagacatattatgtaatgctgaagtttgagcctctaatgtt

SEQ ID NO: 11254 - DNA, 201 bp, Homo sapiens
tatactgtacatatatctatacacatgtatgcatgtatgtgcatatacatatacctttgcatatatatgtttatgcatacattttattttgctttatttaraattattatttttggagatagagtcttgccttgtcaccgaggctggcgtgcagtggcacgatcttagctgtctgcaacccccacctcctgggttcaagcc

SEQ ID NO: 11255 - DNA, 201 bp, Homo sapiens
  misc_feature (1)...(201): n = A,T,C or G, or insertion/deletion polymorphism (see Tables 1-2)
agcctccttaagcgctggaattacaagcatgaaccaccatgcccagccttatttagaatttcatagggaattcttatgttattaaaactaagggttataanggcttccaaatcgctgtcatatggctggtctcaaatgcatttaaacaccccctcccccattgattttttttttttacatggttttcttatgtttgaaaat

SEQ ID NO: 11256 - DNA, 201 bp, Homo sapiens
agactgttgagtcagtatctagaggcagcattcattttccatcaaccgtgtgtgtgtgtgtgtgtgtgtgtgtgtgtgtgtgtgcgcgcgcgcgcgcgcgygtagagagagagattcagggggtgcgtgtgcaggtttgttacatagacatattatgtaatgctgaagtttgagcctctaatgttcctgttgcccaagtag

SEQ ID NO: 11257 - DNA, 201 bp, Homo sapiens
caatcttcctcctacactctgcgctcacaagggacatggaaacctgtcctgtttctcctcataccctgccgtcgactgcggcccctgcacacagtggggtytacgatgttgatgggagccaagggattgttgtactgattttttaaggctggatatttatttttcggtatgctttgcactttttgcctagggaatcaggac

SEQ ID NO: 11258 - DNA, 201 bp, Homo sapiens
ttgtcaatttttttttgttgcatttgcttttgaggacttagtcataaattatttgcctaggctaatgtccagaacagtatttcctaggtttcttctaggattttttatagtttgaggtcttacatttaagtctttaatccatcttgggttaatttttgtatatagtaaaagataggggtccagatttagccttttgcatat

SEQ ID NO: 11259 - DNA, 201 bp, Homo sapiens
gtggattgctgctttgaccaagagtgttggaccgatgaaagtatatccagtcctcagtctgaaatttgacgtctgtggctgggtttgaaaggatgagcttraatgtgggcttttgaattagaaatagaataggatttttcagttagcatcgtggatacaggggctgaaaagatgccacaatgagctgaagttaggaaggaa

SEQ ID NO: 11260 - DNA, 201 bp, Homo sapiens
tcaagggacttagaatcatccccagagaaggatgctgtgaacaacctcacgtgtgatggtgtggccactttggttgtactagagtggtgggatttgggagktttttcttatttttatttatttattgtaaatttttttaaattaaaacaattttaaatagagacagggtctcaatatattgcccaggttggtctcgaattc

SEQ ID NO: 11261 - DNA, 201 bp, Homo sapiens
  misc_feature (1)...(201): n = A,T,C or G, or insertion/deletion polymorphism (see Tables 1-2)
cggcgctcggaggttttcatcctttgggacaagagatagctctgagttacttaacttacctggttcttgtatacgcttcatgttgtggcttttagtttctnttctctccaaggtgagccagttggatcttccaggaaacagatgctgagatggagttaggggcacaagaagtttattgagagggcataagtacctgggaaa

SEQ ID NO: 11262 - DNA, 201 bp, Homo sapiens
gtagctcaatgtagctgtctgtggttgatgtcactcggagtcaggggtaggagtgtgtgtgatacagtgtagcagagatgccaatctttgtggttgccccrcccttcttgctgtggattgctgctttgaccaagagtgttggaccgatgaaagtatatccagtcctcagtctgaaatttgacgtctgtggctgggtttgaa

SEQ ID NO: 11263 - DNA, 201 bp, Homo sapiens
ctcttgccttctcctctgattatttgttttctacctcaggtctatgtgtaattattttatgtgttatgtgctttttttgcttctatgttacttgcagataytgcagaatagtaataagtctgcctaacatggtaatgtgcttggtgaatttccaagaacatatatggtggtttccaagtatgctagcacagcagtatctat

SEQ ID NO: 11264 - DNA, 201 bp, Homo sapiens
cttgttctttcacttagagaagtctttgtcggttctgttagccagggttctctagagggacagaactaataggatagatgtatatataaaggggagtttattttattttattttattttttattttttttgagacggagttttgctcttgttgcctaggctggagtgcagtggaacaatctcagctcactgcaacctccgc

SEQ ID NO: 11265 - DNA, 201 bp, Homo sapiens
acagaaaatacctatgtgaggttgtagtatttatggaagaaggaaaaggtgatatctagatcttgaaagataaaatactgacaaaataaacattttcttctttttttttttttttttttgagacagcgtcttgcactgttgcctgggttggagtgcaatggcgtgatctcagctcattgcaacctccgtctcctgagttta

SEQ ID NO: 11266 - DNA, 201 bp, Homo sapiens
ccccagtatttccaggggtgtgagccaagacatggggcaaaatgattaggggacctcctgggtcttggaagtggtttaatccttcctgtagctcaatgtarctgtctgtggttgatgtcactcggagtcaggggtaggagtgtgtgtgatacagtgtagcagagatgccaatctttgtggttgccccgcccttcttgctgt

SEQ ID NO: 11267 - DNA, 201 bp, Homo sapiens
cacaaactgaaataacccaaatcaatactagttttatttatttatttttccttttctaaaatttccataggtttttttttggggggggaggggggacagtwggtatttggttacatgagtagttcagtgatgatttctgagattttggtgcacccatcacccgagcagtatacatttaatccaatttgtagtcttttattc

SEQ ID NO: 11268 - DNA, 201 bp, Homo sapiens
tttttagtagagacggggtttcactatgttgaccagactggtctcgaactcctgacctcatgatccgcccaccttggcccctcaaggtgctgggattacargtgtgagccaccgcactcggcccattttatttctttaaaagagccttttggttattgtacattgttaaaacagaaatacactataaaataaaatcgacaa

SEQ ID NO: 11269 - DNA, 201 bp, Homo sapiens
aaagccccaacatcttcctcataacagcttctaagcttgaggaccaagagttatcctctaaaaaggtgtccccaaacaaggtaggtgactttcccccagtrtttccaggggtgtgagccaagacatggggcaaaatgattaggggacctcctgggtcttggaagtggtttaatccttcctgtagctcaatgtagctgtctg

SEQ ID NO: 11270 - DNA, 201 bp, Homo sapiens
gtctgaagtaattaggttaagaaaagttagtttaacacatacatccctgaatagcagaaactgaatccaccacagatgtacttcttactcgtctgaagtcraatgtggatgtttgtattcagagggcggccctctgacaagtgacgattcaggggctcagctcctttcatcttttggttctgccaccttcaacatatggct

SEQ ID NO: 11271 - DNA, 201 bp, Homo sapiens
tccacactttcactgttgtgtctggactttgccccttggaagacatttgggaaaggtgatgtggggctggaagtctatgctgaccggccaagagagtaaaktgtgtgtgtgtgtgtgtgtgtgtgtgtgtgtgtgtgtgtgtgtgtgtgttttaccacaatttaaaaaaaattgaaaaagaagaacactattagttacctg

SEQ ID NO: 11272 - DNA, 201 bp, Homo sapiens
  misc_feature (1)...(201): n = A,T,C or G, or insertion/deletion polymorphism (see Tables 1-2)
ctgctcatgtgagtgatgatagtggggttggggtggctctggtctgcactgattggaagtatgaggggtagtgggatggtgcccttgtgcgagtccaggcngggaggcccagagagcaggtaagagagatgtgagctcactttgccctaatgtggagaagcagtgcatgaataatcacccagtgggggagagaaactattg

SEQ ID NO: 11273 - DNA, 201 bp, Homo sapiens
aagcacacctagagagttgggcacatcaggaaacttttgtcaatagtttagtttctggcagagtctcatggagaatcaagttactcggtgtgtgtgtgtgygcgcgcatgcatgcatgagtgtgtgtccacatgtgagtgtgtctgtgagagaaggagaacatactggtatgtgtgtgtttgtagctgaaggagtgtcata

SEQ ID NO: 11274 - DNA, 201 bp, Homo sapiens
  misc_feature (1)...(201): n = A,T,C or G, or insertion/deletion polymorphism (see Tables 1-2)
aggaagttgttgtgggtgcggcagttggcgccgaggaagagctgctgcacggtgagccagtcctggggcacgtagccggtgccgccactgatcagatggtncgccatgctgccgcaaggccccgcgaagcgacaaacacccgcgcggccgcctgccgctgctgccgctgctgctgacgctgtgggcctgggaactgtaagc

SEQ ID NO: 11275 - DNA, 201 bp, Homo sapiens
taatgctaccctttgcattgtccactgagatgggtctgtggttggcaagaggctgcagccccttagcaatactagatgcagtgaatctgtggggcaatagyccttcttttctttcccatgcatgtgtggaaatccagtgtgtatgaagtggagatctgaccccatcttgtttgagctgtgtgctgattgttggatggggtg

SEQ ID NO: 11276 - DNA, 201 bp, Homo sapiens
aatcagagtgaagagacaacctgcagaatgagagaaaatatttgcaaactactcaactgacaagggattaatatgcagaatatacaaggaactcaacagcaaaaaaaaaatccgattaaaaatgggcaaatgagttaaataaacatctcttaaagatatgcaaatggacaagtttatgaaaaaaatacttgacatcactaa

SEQ ID NO: 11277 - DNA, 201 bp, Homo sapiens
tgaagccctgttcaaacttcttgaccttatgcacctcgttggcctggaactctggggtgcagttgtggtgaatgaaaccaatacctcccatcagagccatygcgatggccatgtcggcctctgtctcagtgtccataggggaagagatcagtggtgtcttcagcatgatcttccgggtcagggctgaagttaggtctacct

SEQ ID NO: 11278 - DNA, 201 bp, Homo sapiens
acattgaatcaaccactgaattaacagatgaagaaaatgtggtatgtatacacaatggaatactattcagccattaaaataacaacatcttggctgggcgyggtggctcacacctgtaatcccagcactttgggaggccaaggcgggtggatcacaaggtcaggagatagagactatcctggctaacgcagtgaaactccg

SEQ ID NO: 11279 - DNA, 201 bp, Homo sapiens
gcttgatccttggcgtcatcacctcactgaggagggtggtgtggtccttctcagcaagaaagttgatgtctcgggaggagatgatgcccaccaacttgctscccatggtgcccatctcagtgatgaggatgcaagagaagccatgccggatcttggcctccagcacatcacccacagtgtgtgaggggctcagcaccacgg

SEQ ID NO: 11280 - DNA, 201 bp, Homo sapiens
attcttcttcaggttggtgtgggagacgatggccactagctcatggcgatcattgaccataggcagcttcccttgctaggctgaaggatctcatttgcctstttcaatgtcatgcctgctggagccaccatcagcttgatccttggcgtcatcacctcactgaggagggtggtgtggtccttctcagcaagaaagttgatg

SEQ ID NO: 11281 - DNA, 201 bp, Homo sapiens
gacgttgatgcctacccaggtgagcaggtccaggcagtatttgtcatcctcatgggtgcccacagctgccctgcacagcagctgcttgtgggaatccttgraggccagaatgtagtctcgattcttcttcaggttggtgtgggagacgatggccactagctcatggcgatcattgaccataggcagcttcccttgctaggc

SEQ ID NO: 11282 - DNA, 201 bp, Homo sapiens
  misc_feature (1)...(201): n = A,T,C or G, or insertion/deletion polymorphism (see Tables 1-2)
tcctgccccttcaaacatttgtcctctttgctaaggacaccctttccattgattctatatctgggtagctcaaagtgggtctgcccttttccacttcattnctgcagacctgtatactaattcgtaagagtgttaacagcttgctttggcattgtttgcttgcctattcatcttcgcttagactagaatccccaagagggg

SEQ ID NO: 11283 - DNA, 201 bp, Homo sapiens
agtacattggccagaggtgcagtgatctaaaggctggactgaggctggaggactggctggcatggatggcttgtttccgaggctgctggcagggggcctcrtttattgattttgagaacctctccgtggggctgcttgaagtccctcatgtcatggcagccaacttcctcagagtgagtgatccaaaagagagaaggcaac

SEQ ID NO: 11284 - DNA, 201 bp, Homo sapiens
gtacttaatagaatttataatggaatttgcaaagtgacaggccacaggatgaatgagttttattcagcccacatggtgctttgacttagtctccaacattkacaaatcaggagatgttacatgaaattctggatatttgacttctcttaaagatttaaaagctccagtgatactgtctgttgaaatggcagtattcagatg

SEQ ID NO: 11285 - DNA, 201 bp, Homo sapiens
gttatcagttaaaatgaacacacacacacacatttttttaactttttttatttttatttttatttttactttaagttctagggtatatgtgcacaacgtgyaggtttgttacatatgtatacatgtgccatgttggtgtgctgcacccattaactcgtcatttacattaggtatatctcctagtgctatccatcccccctc

SEQ ID NO: 11286 - DNA, 201 bp, Homo sapiens
  misc_feature (1)...(201): n = A,T,C or G, or insertion/deletion polymorphism (see Tables 1-2)
cgggagcaacttagttgggggattcttgcctagggtctcttgtgaggctgtggtcagtacattggccagaggtgcagtgatctaaaggctggactgaggcnggaggactggctggcatggatggcttgtttccgaggctgctggcagggggcctcatttattgattttgagaacctctccgtggggctgcttgaagtccct

SEQ ID NO: 11287 - DNA, 201 bp, Homo sapiens
  misc_feature (1)...(201): n = A,T,C or G, or insertion/deletion polymorphism (see Tables 1-2)
gtaaaaagctatcccttaagaacttatggtttcaaaggtagtttattcatacactcagaggtttgtgtaaatgtgtgtgtcactgtgtatatgtggttgcnttagaaataaattcaacacaaatgtgatcatgtcatttcactggatgaaaacttcccctttttgtcttaggtttaaaaagtgaaaagtacttaatagaat

SEQ ID NO: 11288 - DNA, 201 bp, Homo sapiens
gagttggggtatgtttagctgcaagtaattatgagaaccttgactcaaagtagattatacgatgtataaacttattatttcacatgaccagaaactctgamgtagatcaaagttggggactgatggattcagtggcccagtggtatcaacaagaatccaccttcttcccttccgtctgttctaccatccttagtgttgagt

SEQ ID NO: 11289 - DNA, 201 bp, Homo sapiens
tttcgccacgttagccaggctggtctcaaactcctgacctcaagtgatccacccgccttggcctcccaaagtgcggggattacaggcgtgagtcactgtgyccggcccattgtatcattcttatacctttgcatcgtcatagcttagctcccacttataagtgagaacataacgatatttggttttccattcccgagttac

SEQ ID NO: 11290 - DNA, 201 bp, Homo sapiens
gcataattcatattctttattaccacagagtcgcaggaagaattcaccccaaatttcaaaatgtgggacctgctgaacacagaatctaccactgaagtgtsgaacatgagtcacttaatagtgctgaactaatagtgagaatttcatcgtgagaacttaacagtgactcatgtttcactactgctgaaggctgaagtgtgg

SEQ ID NO: 11291 - DNA, 201 bp, Homo sapiens
aactaatagtgagaatttcatcgtgagaacttaacagtgactcatgtttcactactgctgaaggctgaagtgtggaaaatgagtcactattaaacaaggawgggcactgggtaacctttgtgctgtggttctcaaagtgtggtttctggaccagcatcatcactatcacttgagatagggccaaaatatgcacattctcag

SEQ ID NO: 11292 - DNA, 201 bp, Homo sapiens
ggcttaaggtgctgcatatttaaaagatcccaagattattttgataagctaccagaaagtattgtaaagcagcaattggcaagtgttttatttaaaagccyagatagtcaatattttaggcttggcaaaccaagaggccacacattctgctgctatagcacaaaggcagccacagacaatacaggaaagggcttggctgtg

SEQ ID NO: 11293 - DNA, 201 bp, Homo sapiens
gtttcactactgctgaaggctgaagtgtggaaaatgagtcactattaaacaaggaagggcactgggtaacctttgtgctgtggttctcaaagtgtggtttstggaccagcatcatcactatcacttgagatagggccaaaatatgcacattctcaggcccatatgcatcctactgaatcagaaagtgaggggcagggattg

SEQ ID NO: 11294 - DNA, 201 bp, Homo sapiens
  misc_feature (1)...(201): n = A,T,C or G, or insertion/deletion polymorphism (see Tables 1-2)
gttagtcttactactccctgtggtcaacagcagtccattctttgtatgctaatctgttacatttgtattagaagatggatatctcagcatgacacaaccanattagttttgctgttggaagccaccatggggtactagttggggcacagctgttgcatagccatgggatatccaaataaggggattggggaaggcactgtc

SEQ ID NO: 11295 - DNA, 201 bp, Homo sapiens
cacaatcagtgataaactttgaagatgctgcagcctccattgagtttctttttgtatatatatacttttatttatttatttatttttttggagacagagtstcactctgtggcccaggctagagtgcagtagcgcaatctcagctcactgcaacctctgcctcccgggttcaagcaattctcctgtctcagcctcctgagt

SEQ ID NO: 11296 - DNA, 201 bp, Homo sapiens
gagccaagatcgtgccattgcactccagcctgggtaataagagcgaaactccatctctaaatacatacatacgtacatgtatacatacatacatacatachtacatacatacatacatacatacaagtcaatagaggcaaagaaatgatagatgcaggggagagaagaaggaaggaagcaatacaaagcctagagagattg

SEQ ID NO: 11297 - DNA, 201 bp, Homo sapiens
acctcaggtgatctacacccccttcggcctcccaaagtgctgggattacaggcgtgagcattgtgccaggtctgagtttctactttaattggctgccttaygcaaaccatgaagaagcccctgcatgaataaggcaggaaactttttagtcccagactaggtgagacatatgccgtatccccaaaataaatgttggggcat

SEQ ID NO: 11298 - DNA, 201 bp, Homo sapiens
taaatatttgcccatcagtgatagagtggatcaagaaaatgtggtacacatactccacagaatactatgcagccataagaaaaggatgagatcatgtcctktgcagggacatggatggagctggaggccattatccttaggaaactaacacaggaacagataaccaaatatcatatattattacttaaaagtgggagctaa

SEQ ID NO: 11299 - DNA, 201 bp, Homo sapiens
atgctggagatacagcagtcaacaaacctgtcttctttgtgtgaggagaggccaacagaaacataacaaatatttaatgtgtcagctgataataagcactrggcaaaaagtggattagggaaaggcaaaaggaagcccttgggtggtggtgcgatggggttttgatttgaaatagagccatctccacgggagggtccactt

SEQ ID NO: 11300 - DNA, 201 bp, Homo sapiens
gtggtacacatactccacagaatactatgcagccataagaaaaggatgagatcatgtcctgtgcagggacatggatggagctggaggccattatccttagsaaactaacacaggaacagataaccaaatatcatatattattacttaaaagtgggagctaaatgatgagaacacatggacacatagagtggaaaaacacac

SEQ ID NO: 11301 - DNA, 201 bp, Homo sapiens
tgtaatgcaccatggtgatttgatacaccgagttcccttgggaggagtccaagactatgacgttgatgcctacccaggtgagcaggtccaggcagtatttktcatcctcatgggtgcccacagctgccctgcacagcagctgcttgtgggaatccttggaggccagaatgtagtctcgattcttcttcaggttggtgtggg

SEQ ID NO: 11302 - DNA, 201 bp, Homo sapiens
acgctttgcttgcctggtcctggtacatggtcctgtgtactgttaagaaaacagattgtcccaggtagatatgtagccagatatttttttctctgtttcctttttttttttttttttttttggagctgctccaccccctggtatggtgcagcttctcctggggctcctctgtaattttacagcagcttctgagctagtgaa

SEQ ID NO: 11303 - DNA, 201 bp, Homo sapiens
  misc_feature (1)...(201): n = A,T,C or G, or insertion/deletion polymorphism (see Tables 1-2)
aaaagtgggagctaaatgatgagaacacatggacacatagagtggaaaaacacacaatggggccttgcagagggtggagggtgggaggaggaagagagtcnggaaagtaactaataggcactaggcttaatacctgggtgatgaaataacctgtacaacaaacccccatggcacaagtttacctgtgtaacaaatctgcat

SEQ ID NO: 11304 - DNA, 201 bp, Homo sapiens
cacagcagtgccctggggctgaccgcaggccatcacttcctgggtgatgcagatagagctgcagcccataactacatgcagtccatccacaccagtgtcartcaggttcttagcctgggctgctgtcaccacattcctcccaatcacctggaggtggaggtacttctgtttgatgtaatgcaccatggtgatttgatacac

SEQ ID NO: 11305 - DNA, 201 bp, Homo sapiens
cgctttgcttgcctggtcctggtacatggtcctgtgtactgttaagaaaacagattgtcccaggtagatatgtagccagatatttttttctctgtttcctttttttttttttttttttttggagctgctccaccccctggtatggtgcagcttctcctggggctcctctgtaattttacagcagcttctgagctagtgaag

SEQ ID NO: 11306 - DNA, 201 bp, Homo sapiens
ctctctaatggcctggagatatcctacaggctatgctgggtactttgcatagactaccttcaagatgcagagaaaggaaatgcatctaatgctgttagtamcaataataaataatagcaatagattccctgtacatgctggacagtgcaccaagcattttattttatttttcacaataataccatgaggaagctacttttt

SEQ ID NO: 11307 - DNA, 201 bp, Homo sapiens
ttaactcgtcatttagcattaggtatatctcctaatgctatccctccccgccccccaccccacaacagtccccgatgtgtgatgttccctttcctgtgtcygtgtgttctcattgttcagttcccacctatgagtgagaacatgtggtgtttggttttttgtccttgcgatagtttgctgagagtgatggtttccagcttc

SEQ ID NO: 11308 - DNA, 201 bp, Homo sapiens
ggacacaccaaagtgctgagcgtacttggccaccttgtacacagcagtgccctggggctgaccgcaggccatcacttcctgggtgatgcagatagagctgyagcccataactacatgcagtccatccacaccagtgtcaatcaggttcttagcctgggctgctgtcaccacattcctcccaatcacctggaggtggaggta

SEQ ID NO: 11309 - DNA, 201 bp, Homo sapiens
gctttgcttgcctggtcctggtacatggtcctgtgtactgttaagaaaacagattgtcccaggtagatatgtagccagatatttttttctctgtttcctttttttttttttttttttttggagctgctccaccccctggtatggtgcagcttctcctggggctcctctgtaattttacagcagcttctgagctagtgaaga

SEQ ID NO: 11310 - DNA, 201 bp, Homo sapiens
catgctggacagtgcaccaagcattttattttatttttcacaataataccatgaggaagctactttttattactcttgttatacagaggagcaaactgagscttaggaaggtgacgtgacttgccccaactcatccaattagtgagaacctaagttgggatttgaatttggctctcaatctccaagcagtcatgtgtccaa

SEQ ID NO: 11311 - DNA, 201 bp, Homo sapiens
agatgagtaggttgcgaaaattttctcccattctgtaggttgcctgttcactctgatggtggtttcttttgctgtgcagaagctctttagtttaattagaycccatttgtgaattttggcttttgttgccattgcttttggtgttttagatatgaagtccttgaccatgcctatgtcctgaatggtattgcctaggttttc

SEQ ID NO: 11312 - DNA, 201 bp, Homo sapiens
gatatgggagaagtgttcagatactccatgggctgttacaaggtagaaggttaagtcttaattttgttattgttctggggacagacataagagtgaaattattattattattattattattattattattattattattattgttattatttgagacagagttttgctcttgtcgcccaggctggagttcaatggcacgat

SEQ ID NO: 11313 - DNA, 201 bp, Homo sapiens
aagtatcgtttctggctgctgctgctcttctccatggcatctagcgagcccatgccccagtacttcttgagctgcaccctgtctgagaagaagtactcgcygctgggcctccgtggtggtggccagcagggagcccatcatcactgtggaggctccaagggccagggccttgaccacgtgccccacggtctggatgccaca

SEQ ID NO: 11314 - DNA, 201 bp, Homo sapiens
ctttgcttgcctggtcctggtacatggtcctgtgtactgttaagaaaacagattgtcccaggtagatatgtagccagatatttttttctctgtttcctttttttttttttttttttttggagctgctccaccccctggtatggtgcagcttctcctggggctcctctgtaattttacagcagcttctgagctagtgaagaa

SEQ ID NO: 11315 - DNA, 201 bp, Homo sapiens
taccaaatgtaaaatgcagagagcccattacaagtagctccttgaatgagttggggtatgtttagctgcaagtaattatgagaaccttgactcaaagtagmttatacgatgtataaacttattatttcacatgaccagaaactctgacgtagatcaaagttggggactgatggattcagtggcccagtggtatcaacaaga

SEQ ID NO: 11316 - DNA, 201 bp, Homo sapiens
agccttaggaaggtgacgtgacttgccccaactcatccaattagtgagaacctaagttgggatttgaatttggctctcaatctccaagcagtcatgtgtcmaagtggttgccactgggtgggggattctggaagtcctttctgtgtcctcatgctctagatatttttttatttttttctgtagtgagcatacagagattct

SEQ ID NO: 11317 - DNA, 201 bp, Homo sapiens
agccattaagtaaacgagtacgtgaataagtactgtacttttctaatagtcttttgggtgctaaagtcatacatatattgaatgcttgctatataccaagractatagtgctgagtattttacatccattaaattgcacgtaaatgacaacaacaataacaaactcgcttgaatggtaaatgttattagctcaagtgtata

SEQ ID NO: 11318 - DNA, 201 bp, Homo sapiens
atatgggagaagtgttcagatactccatgggctgttacaaggtagaaggttaagtcttaattttgttattgttctggggacagacataagagtgaaattattattattattattattattattattattattattattattgttattatttgagacagagttttgctcttgtcgcccaggctggagttcaatggcacgatc

SEQ ID NO: 11319 - DNA, 201 bp, Homo sapiens
ccactgctatcctcagtacagctgcttctggtaagcgtgcaggccatggacgccaccctcgatctgggctgacatggtccacttctcaaatttgagctctyctgagtacatcatggagccatgctggttactcgctatgaggtagggcacaaacttctgaatggaccctttgtcctggatggaggccgagacaccctgcac

SEQ ID NO: 11320 - DNA, 201 bp, Homo sapiens
caagcctcagtttcctcatctgtaaagtaggggtgataatatctaaattgtaggatactagagagattagaaagaatctgtaaaaagtgtctaagatactrccaaatgtaaaatgcagagagcccattacaagtagctccttgaatgagttggggtatgtttagctgcaagtaattatgagaaccttgactcaaagtagat

SEQ ID NO: 11321 - DNA, 201 bp, Homo sapiens
  misc_feature (1)...(201): n = A,T,C or G, or insertion/deletion polymorphism (see Tables 1-2)
tccaggaccctggctacgaagctcgctgtgcctgacttcctcaagccacttgcctcccattttttctttagaggaaacttccactgcctcggatacataangtcattgcaatcctgtctaaagtctggcctccagggtttgcagtaagatttctctgaagcaaggctgcatctctacccatgagattttgcatcccctagc

SEQ ID NO: 11322 - DNA, 201 bp, Homo sapiens
aaaaatgttcacttcgttttcctttagcatgtagggagttattttaggatatcctgtgttttctggcacaagtttctctgtctaggacagaaggattgacwtagaggacattggggaatggggaaaaaagaaagcaggaggaggagccccctgaccccagtttgaatcccagtattcagagaaattcttctctatacctct

SEQ ID NO: 11323 - DNA, 201 bp, Homo sapiens
tatgggagaagtgttcagatactccatgggctgttacaaggtagaaggttaagtcttaattttgttattgttctggggacagacataagagtgaaattattattattattattattattattattattattattattattgttattatttgagacagagttttgctcttgtcgcccaggctggagttcaatggcacgatct

SEQ ID NO: 11324 - DNA, 201 bp, Homo sapiens
atccccagaagtaaccttcccatgaatttccctgctgctggcttcttttcctttcctgtcttatttttctacttcctcaccacacttcctgtgatcacctyccaactaaaccatgtccccccagtttcttgctttagcatctgctctaaagtaaaacttaactgaagtaattcccctttgcttcattttgcttaagcttcc

SEQ ID NO: 11325 - DNA, 201 bp, Homo sapiens
  misc_feature (1)...(201): n = A,T,C or G, or insertion/deletion polymorphism (see Tables 1-2)
caaacatcttatgtgtttgcaatcttgcctgtcctcctgggtaggcagaatgcacaatctctcctcaggggaagtgagaagatctagaaggcccaaggaanaattatttttggcatcattgctcctccatactcattatccacatctgttgagcattcctgtggcccagaagctgatggcagtgtcactgtggcaccctag

SEQ ID NO: 11326 - DNA, 201 bp, Homo sapiens
  misc_feature (1)...(201): n = A,T,C or G, or insertion/deletion polymorphism (see Tables 1-2)
atcagcctggtgggttggaacgaatgtcaactttgagttcaaaggcctgtactgaatcctagcggtgcctctcactagctatgtgacctaggaaaagttanttaacggcatcaagcctcagtttcctcatctgtaaagtaggggtgataatatctaaattgtaggatactagagagattagaaagaatctgtaaaaagtgt

SEQ ID NO: 11327 - DNA, 201 bp, Homo sapiens
tttctgccagaactgacagtaatattgaatgatgagagaaatgcagtaatattgaaggacgagagaaatgagagttgtataacatttaatgattttttttwtaaaaaatcacccaagaacgtgaagatgatttgaaacgcctctgaaaatgatcccttcctgtccataggcagcccagcttgcacatagcccgtgcttgct

SEQ ID NO: 11328 - DNA, 201 bp, Homo sapiens
tgcatctgttatcaatttgtttcagaatctagctggagagactcataatgcaagtgcagtatgattgtattcacgggaccatgggaatgcagaggagggayagcttcatccacaggtctgagggtagggatctggggtcaaattggagagctggtctggaagaggcttgtgtcctgggtgcctgcccctacaggttgtcat

SEQ ID NO: 11329 - DNA, 201 bp, Homo sapiens
gaagtggcaggggataaataaatgccccccagaactgtctttaatgatgagggatagaagttggcataccctggcttctttgctgctcagggagacagtamtgaggtgtgtcctacactgttattggagggcccttgtggggttaaatccctgttatccccagaagtaaccttcccatgaatttccctgctgctggcttct

SEQ ID NO: 11330 - DNA, 201 bp, Homo sapiens
aggtgtttgtcgggagatgctactaatatcagcatgtagggaccagggatgctgtaaaatatcttacaatgtacaggacagcccacccagcaaagaaacaygatctggtcagtagtgcagaggttgagaaaccctggcatagggcaaaagagatttaatcctgagcctcctgtaggcaagtaagcacttgaacaaaatgag

SEQ ID NO: 11331 - DNA, 201 bp, Homo sapiens
atgcagaggagggacagcttcatccacaggtctgagggtagggatctggggtcaaattggagagctggtctggaagaggcttgtgtcctgggtgcctgccmctacaggttgtcatcccccacagctgaagatgagctgtagagggaaggctggctcatggaggagcagaattgagttcacaatctaagccttcctctcctc

SEQ ID NO: 11332 - DNA, 201 bp, Homo sapiens
gatggacagttcccaacacagtgatggcttctcacctcaagcacaggcatctctctgcctaagaatgttctctggccatacgattgtgtttggctcctgcrtatggcagacctgaagtggcaggggataaataaatgccccccagaactgtctttaatgatgagggatagaagttggcataccctggcttctttgctgctc

SEQ ID NO: 11333 - DNA, 201 bp, Homo sapiens
agctcctggaggaggatggaattaatttcaaggggatttgggaagtaattgtcttgttgttagttataaatttttgagagatgatggaaccttatcaagayagcttgctgttgaaatcttatagtttcccgtttagacctctgttattattatctgattatttgattattattatcaagggttttatatgtctaacagtgt

SEQ ID NO: 11334 - DNA, 201 bp, Homo sapiens
  misc_feature (1)...(201): n = A,T,C or G, or insertion/deletion polymorphism (see Tables 1-2)
tttaaaaactactttgagttactactcattcattcactcaacaaatatttattaagtgcctactatgggtcagccattgatcttggctctggggatactcntgtgaaaaggcaatgccctgcacccatggagtttttcttcccaatgttttattactactcacttacgactgccctttccatcagactctgagacccatgc

SEQ ID NO: 11335 - DNA, 201 bp, Homo sapiens
aatctctgttaagccctctccccagctgtagcccctgagctttttgtagagattcctcctggtgcagagatggagcatatggttcagtgctggaacaatgyggtcattatatgctcctggtccctgtgaacagttcggggatggttatctggtccaggaagacccagtgaggtgaaatgagactttacctcaaacttgagt

SEQ ID NO: 11336 - DNA, 201 bp, Homo sapiens
atcatctatgtcttgggattagggaaaatttccatgtcaaactaaagagtaaaaattcaccaaggttttgatatgctctgatatgatcactactacttgarcctccccctcatcggttttatttcccacccatcatagctcctggaggaggatggaattaatttcaaggggatttgggaagtaattgtcttgttgttagtt

SEQ ID NO: 11337 - DNA, 201 bp, Homo sapiens
tcactgagtcctcttttccctaacttctagaggaagtgcatttaatcatgctgtgatcaagtcagccctgggtacccatgttggcttttaattttaaaaaagagaatgacaggaaaagaaaatgggccagttaggttttgaagatttttctattttattattattaaaggaagcccatgtgggagaatgtctggtgctagt

SEQ ID NO: 11338 - DNA, 201 bp, Homo sapiens
tggaatgaacctgtgtattttttatcttaacactcatttccattcttctggtaattgtatgtaatcaatctctgttaagccctctccccagctgtagcccstgagctttttgtagagattcctcctggtgcagagatggagcatatggttcagtgctggaacaatgtggtcattatatgctcctggtccctgtgaacagtt

SEQ ID NO: 11339 - DNA, 201 bp, Homo sapiens
tggtcgtggtcagcattgctgggtgaggatccttaggctttttgtcaggggttcagggccttctggcttccccaggcttctccaggcttctccggcttccrtctctagagaagactcgggatgaactctgaattcttctagaccccagctaccagttcggctccagacccagagtggcactgctttaatctcggcaaagaa

SEQ ID NO: 11340 - DNA, 201 bp, Homo sapiens
gcatctttaggaacctcagttccagtttcattgtgcatttggccatcatccggcctgtctctgcctcttgttcattgtggtcccacgtgacttctttctgrctggtttgtctccggtcatgtgacttagctgcctggactcttctgttctatgcaggaacagagctagttttcatttactgcaggaaagaccagattggca

SEQ ID NO: 11341 - DNA, 201 bp, Homo sapiens
  misc_feature (1)...(201): n = A,T,C or G, or insertion/deletion polymorphism (see Tables 1-2)
gcagtggatttaaagtcagctcagggcagtttcaacaccagagttggaggaaagaggttgtgtgtacattgtcctctggggactgctgctgtttatgcctngtggtttcctttgggggagacagatccaccctgctttcctcatccatcttcctacatggatatatcttgttatctagtgctgaaatggcatggacacagg

SEQ ID NO: 11342 - DNA, 201 bp, Homo sapiens
tcatttggtgcaatatccagcctggagctgtctctagcctggagtatgcttagtgaaaccctgagaaagaacttaaatgttgggtataattcctgctgttwagggagtgacaaaaatgtacatgtatagacaccactatttcatatttcaattattatttatttaacattttaaacctgatggcagaaaaatatgcctcag

SEQ ID NO: 11343 - DNA, 201 bp, Homo sapiens
  misc_feature (1)...(201): n = A,T,C or G, or insertion/deletion polymorphism (see Tables 1-2)
gcgaaataatttaaaatgacttaaaagataagtgtgtccatttttcccttcatcaaatagttaagttgtattagttcgttctcacactgctaatgaagacntacccaagactgggtaatttataaaggaaaaaggtttaattgactcacagttcagtgtggctgggaggcctccggaaatttacaatcatggcagaagggg

SEQ ID NO: 11344 - DNA, 201 bp, Homo sapiens
attcagaaatgctgttaactggaatgactgctaccagctgtccagggatatgaacttctagtgggtgagggagtgtatgtgtgaattcatttggtgcaatrtccagcctggagctgtctctagcctggagtatgcttagtgaaaccctgagaaagaacttaaatgttgggtataattcctgctgtttagggagtgacaaaa

SEQ ID NO: 11345 - DNA, 201 bp, Homo sapiens
atttttgaaaatggtgtcttgcatgccagctttagattgagcaggactatgtaataaactggctggtgagagattaatcactatgatcagttagagaaggyggagagtcaactctttctttgttgtcggaatcagaaccaaaattattttgggccctcctgtttcaggtctccagtgaatcttatttacagcagtgaactg

SEQ ID NO: 11346 - DNA, 201 bp, Homo sapiens
ctttcaggaatcttctaaactgctgggattcccagggggaggacgggacctttagggatcttgcaaaccccagcagaatatcagttttcttcacagaagcrtgtctaacttccttcagccctggtctgcaaattccagacatgaaactgtgctatttgctagcttggcctggcaggtatttattcaaaggctgcaggactc

SEQ ID NO: 11347 - DNA, 201 bp, Homo sapiens
cactgcatttaggaaatgctcattaagtatttgttgcctggttttctctgcattcagaaatgctgttaactggaatgactgctaccagctgtccagggatrtgaacttctagtgggtgagggagtgtatgtgtgaattcatttggtgcaatatccagcctggagctgtctctagcctggagtatgcttagtgaaaccctga

SEQ ID NO: 11348 - DNA, 201 bp, Homo sapiens
tggagacttcaaggcttaaataacttcctaaaatcactcaattagcaaatgataaacccaggactcaaactccggtcagtcctccctccctcccccctccstcccttgctccaagagtattgctctgttgcccaggctggagtgcagtgacacagtcatggctcactgcagccttggattcctgggctcaagcgatcctcc

SEQ ID NO: 11349 - DNA, 201 bp, Homo sapiens
cccttgcttgtctcaggtgagctgctcctttccctttcaggaatcttctaaactgctgggattcccagggggaggacgggacctttagggatcttgcaaaycccagcagaatatcagttttcttcacagaagcgtgtctaacttccttcagccctggtctgcaaattccagacatgaaactgtgctatttgctagcttggc

SEQ ID NO: 11350 - DNA, 201 bp, Homo sapiens
tgactttacagtttagccatgggtttgggatttttgtttgtttccattgtggtcttttaatcaacatatactgttgttttggacagaccatgcgcacaaaygcagatgataatggttggagacagtggttgatgcctagctggctttctctccctccatttattaaccagagcacaaaatgggttgttttctttctttttc

SEQ ID NO: 11351 - DNA, 201 bp, Homo sapiens
tccatggttctatttcctttttaaaaatttctatttaattttaagttctgggatacatgtacagaacataggtttgttacctaggtagacatttgccatartggattgctgcacctctcaacctatcacctaggtattaagccccatatgcattagctatttatcctgatgctctcccttccccaccaccaacagactctg

SEQ ID NO: 11352 - DNA, 201 bp, Homo sapiens
aggtaggaggttttctgagtgtggggaggagtagcttgctagtaggagctttatgaaaaaactaattgtataacattgatgaaagagaaagaaaagatggsagaaaagcaatgagaactcaaatcattcaagttacagttagcattcctctctgtctgttggcattgtggagtgtaacacagactccatagctgaagatgt

SEQ ID NO: 11353 - DNA, 201 bp, Homo sapiens
gctcctgggggaaaagacttggtattttctattaaaagtgaacctgaaaagatgtagggaataaaatcactgctaccatcttgcttccacttggagccaasaattggagccaacaactagagccaactgtgtggcagcagaacagcaagaaggaggaacacgaaatccagatgacagattttgggtcctgaattcacctgt

SEQ ID NO: 11354 - DNA, 201 bp, Homo sapiens
taaaaatacaaaaaaaaaaaattagccgggcgttgtggcgggtgcctgtagtcccagctactccagaggatgaggcaggagaatggcgtttgcaatgagcygagattgcgccactgcactccagcctgggtgacagagtgagaatccatctcaaaaaaaaaaaaaaaaaaaaaaaaaaagaaaaaaaaaaagtaagtacta

SEQ ID NO: 11355 - DNA, 201 bp, Homo sapiens
ttctagcctctccccttccccccagtcttgcctctcaaatgactatctacacaactctttgtcttctccagaaaggcttcctttatttcccagggtgaatyagcctctcatctctccattattccatagcattctgtaatactttaacatttactacattgttctgaaatcataaaatctatttgtctgtctcaccaacca

SEQ ID NO: 11356 - DNA, 201 bp, Homo sapiens
acaaagtgggggcaggaaaattgtgggtatgacaagaaatctgttaatgttatggataaagaggtctaagttggaatcgggaagaaatgaaggcatgaacraatagactaattgagagaagatagagaccagggatgacgctggagaggagacataagaatacctgaatgagagctgtggattttctgaattcagagtcat

SEQ ID NO: 11357 - DNA, 201 bp, Homo sapiens
tccaggagccagaaaactgtttctggttctttcacatatttgctgtaatttgtgaatgaggcttggtggttgacaggtgaggaagtggtggattgactcaragctgggtggaaggtggtgccaggtgggtgtgacaggaggacaagatgggagcaggaaaattgtgggcgtggcaggaaatctgttgctgtgataaagaga

SEQ ID NO: 11358 - DNA, 201 bp, Homo sapiens
tgtgagtacatgcacacatgggtgtgcacgtgtgcatatgggatatgaggaggagagtgggacacttttatatatgtactggttaaaatttagtggcaaarctgcctgaacgtgtgctgtggttaatgattgcttgagctctgccttccactctcagctttggagtgggtggtacgctgtatacagagcacctagcgtgcg

SEQ ID NO: 11359 - DNA, 201 bp, Homo sapiens
tgcttggagctgagattgagctaagagaggtatttactcaccaaagtctactccccaaggaaaagccgaccgaattgaagtgtgtgtgtatgtgtgtgtgygcacatgtgagtacatgcacacatgggtgtgcacgtgtgcatatgggatatgaggaggagagtgggacacttttatatatgtactggttaaaatttagtg

SEQ ID NO: 11360 - DNA, 201 bp, Homo sapiens
ttctgccagaactgacagtaatattgaatgatgagagaaatgcagtaatattgaaggacgagagaaatgagagttgtataacatttaatgatttttttttwaaaaaatcacccaagaacgtgaagatgatttgaaacgcctctgaaaatgatcccttcctgtccataggcagcccagcttgcacatagcccgtgcttgctt

SEQ ID NO: 11361 - DNA, 201 bp, Homo sapiens
  misc_feature (1)...(201): n = A,T,C or G, or insertion/deletion polymorphism (see Tables 1-2)
ttattggagggcttctgagaaccttctaaagatacaagagcatgcatggaagcacttgtggaatgttggcaggttcccatgttgtgttcacgatggggcancagccataagatagtttcagcagagggtatgtagggcagagagttggaaggagcaaaatcttgatgacatcattggtctactgacttgaaaactcctgaa

SEQ ID NO: 11362 - DNA, 201 bp, Homo sapiens
aacaaaaatctctgcccttgaggagctcacagtcttgttgagatgtgatttaaaatggttaatcaattcaagaatattagatttctgcaaaagctactgtmgggaaaacaataattatccaaagtctttaaatctattacccactttaattaatttaattaggtaaaattcatggaactgcaatgttggaaggggcccaga

SEQ ID NO: 11363 - DNA, 201 bp, Homo sapiens
cctttgagtataaccaagactaggaccaaagtaatgggagtacaaaactgaagaagctgaagatatgcagtattgcacccatttctggagaaatagaaaartaaataaatgaagacagcagcggaagagaagaaaaaggagaaagaggaaaatgatatttacaaggtgctgtccaaaaccaaagaagcatgatggataggg

SEQ ID NO: 11364 - DNA, 201 bp, Homo sapiens
aaacattctttcttgtaatttgctggacagtatctagttgaattttctttcattcctttttgcaaatataaaacccctggcttccaccttgtcagtgggtrgatgggtaatgggagaaactcctccactgtctgcatcctgtctgtgccttttgtctaaccagccttcttacagcctgacccaagcagccagtggaatgga

SEQ ID NO: 11365 - DNA, 201 bp, Homo sapiens
cactgagtcctcttttccctaacttctagaggaagtgcatttaatcatgctgtgatcaagtcagccctgggtacccatgttggcttttaattttaaaaaagagaatgacaggaaaagaaaatgggccagttaggttttgaagatttttctattttattattattaaaggaagcccatgtgggagaatgtctggtgctagtt

SEQ ID NO: 11366 - DNA, 201 bp, Homo sapiens
  misc_feature (1)...(201): n = A,T,C or G, or insertion/deletion polymorphism (see Tables 1-2)
ctgtggattaagactatcactttgggaacatcttagaattctgcctgctgtgggtggtaatccaaatcaaatattcttcctgatctttgtgttaagactancacttttggaacagccattttccaaagctctctcataattccatcgtaggcagagatggagtgtggccatacaatgttttggaggctccaaatctaggta

SEQ ID NO: 11367 - DNA, 201 bp, Homo sapiens
ctgcatgacaaaactctttggaagtccagtgcaaatgagtggacttgtgacctctcacattatttctgtttgtaggttcaactggcaagccaatcatgctyatttatagcgacacgcactgaaaacttttttctcacaagaggttattgaaccaagatgagaggaaataccaaggctctttttggtgttttaattccttca

SEQ ID NO: 11368 - DNA, 201 bp, Homo sapiens
tggaatggaatggaagcaagttggagacacacacacacaacactgcctcaattatccttgcctgttcccttttaaatggaatggaagcaagttggagacayacacacacaacactgcctcaattatccttgcctgttcccttttagattctgcatctctctgacggttgactcctgaaactctattactctgtcttttaat

SEQ ID NO: 11369 - DNA, 201 bp, Homo sapiens
aggtatacactcaaggaagattttacttgttaacctgaaaattgcaaaacaggtgcttgtagagctgtacccacagcagtacattgatgtcgcaagtatcsgggcgggaaaaactacaattgctgcgtggggtggggtgggggtgaccatagttccctttattagccagagatataagtgacaggagtctaaatgagaacc

SEQ ID NO: 11370 - DNA, 201 bp, Homo sapiens
tccatctttccctaggtttcaggaatgctcaagaattacgggatcttgactgggcacggtggctcacacctgtaatcccagcattttggtaggccaaggcragtgaatcatttgaggtcaggagtttgagaccagcttggccaacatggtgaaaccccatctctactaacaatacaaaaactagccagacgtggcggtggg

SEQ ID NO: 11371 - DNA, 201 bp, Homo sapiens
tggaagtccagtgcaaatgagtggacttgtgacctctcacattatttctgtttgtaggttcaactggcaagccaatcatgctcatttatagcgacacgcastgaaaacttttttctcacaagaggttattgaaccaagatgagaggaaataccaaggctctttttggtgttttaattccttcacatctatttctttcatca

SEQ ID NO: 11372 - DNA, 201 bp, Homo sapiens
  misc_feature (1)...(201): n = A,T,C or G, or insertion/deletion polymorphism (see Tables 1-2)
acactttattcagcagtggggagagtttagcagaattctctttctgcacagtttaagatggagctgggaaaagaacccaagtttttagatacagcagtctntctgctacttgaatcttttcttctccgccataccaggactggaagacatagattgtgcccaatttctatatcctaattacctaccagaggattgggcatg

SEQ ID NO: 11373 - DNA, 201 bp, Homo sapiens
tgaatgtacccacatatatacagacacaaccactaaagaaaatagattatgtaatatttattcaatgtattttacttgtctgttgtttatagagccctgcytcagttggatgagttatttcagatttggaagtgtctcgttctctagcttgggaatgcagctgaacactgggggcagctgtggccctctttttgtttgttg

SEQ ID NO: 11374 - DNA, 201 bp, Homo sapiens
  misc_feature (1)...(201): n = A,T,C or G, or insertion/deletion polymorphism (see Tables 1-2)
agatttctgccatattgtggctcttccagtcccctaaatctcactgtcttttctttccaatcagcagaaaaataagtgaggagaaaacacgcccctttctnaagagtcctggcctgaatgtgactttgtttatgctgatcttccattagaaaggacaattggactactgatgatttccgatcaagtagaataaatcaatat

SEQ ID NO: 11375 - DNA, 201 bp, Homo sapiens
atctggatatctgcagtgaactaaggagtctcagagaagtcatcctattattgtgtttaaatcttttctttttctctttcaaaaccaggatttatcaatgstggaatatttcagacatgctgataagtacagagaataaaataacaaacaaccatgtactgacaattcagatttaacaaatgttaatatttttgtcacatt

SEQ ID NO: 11376 - DNA, 201 bp, Homo sapiens
gctggaaggggaagaggatggattggtaaaggagttgttgtataaagagaagggtgaatgattatttgaatggatgagtggaaagatgtagggttgaatgsatcaagggtggaaaggtggatgagtgaaagggtaaatgggtggagggatgaatggttggttgcttggatatatgtatgggtgaatcaattatattattaa

SEQ ID NO: 11377 - DNA, 201 bp, Homo sapiens
ggtataatggtattagtatgttttatgctttttataaacagtactatatttttccaactactgttttttttttcttttttctttctttctttcttttttcytttttttttttttttttttttttttttttttttttttgagatagagtctcgctctgttgcctgggctggagtgcaatggcgtgatctcagctcactgcaa

SEQ ID NO: 11378 - DNA, 201 bp, Homo sapiens
acttttttgttgcctttgccactactaaccttctaagagttcggaaaagaggcacttagagtttataatgacatatataatatcacaccacctctctctgycccagactgacttcactgtgggtttgggagtctttttcagaagcaacaagggagaaaattttgcttttgatggcaccccatcaatcaaagtgagacacac

SEQ ID NO: 11379 - DNA, 201 bp, Homo sapiens
ttcctctgaagatcagcttatagttttatttggcttcttttttttcgcttggtttacttttggtttctgctttatccacgtaggatattttcctttttttrgctttgtttctttattctgttcggttttttaaaattaaattttaacttcttattgtcactccatattcaaatatatccatttatggatgtattagattgg

SEQ ID NO: 11380 - DNA, 201 bp, Homo sapiens
agattcccctcacagggccatccaggagggattccaggagggcagagtctgacacaacatagatgttcaataaatatgtgttgaatagagccgtcattgascagtccattcattcactacctaggtctcatggctgccttagagctgggaaggtacaggctgcttaggggacccagctgtggtcttccctctcccacccac

SEQ ID NO: 11381 - DNA, 201 bp, Homo sapiens
  misc_feature (1)...(201): n = A,T,C or G, or insertion/deletion polymorphism (see Tables 1-2)
tctggtctgcttacccactccttgccccctgcatccaccccccttgtatatttttcccttaatgaaaagaaaatagagatcattttaatacagaggtaaanttctagggcctccccagaaaactgtttcatgaatgaggaagctaagaaaaagggccactggctttaaagcccagtaggttaaataggagaacggagaaag

SEQ ID NO: 11382 - DNA, 201 bp, Homo sapiens
tgacatttactggagctggcattctttaattcctactctctgagccactttccaacatgttctattcatcactgtgacttttttgttgcctttgccactaytaaccttctaagagttcggaaaagaggcacttagagtttataatgacatatataatatcacaccacctctctctgccccagactgacttcactgtgggtt

SEQ ID NO: 11383 - DNA, 201 bp, Homo sapiens
ttgactttgtacagaggacaagaggaagagtgtggagttaagctgactgcacttacatctacatcatcctaccacctaactacatggggggcctgggacaygctctcgagtcttagcttcatcatctgaataatgggtctcttactttcctattgctgccataacaaattaccatgaacttcttagcttaaagtggcacat

SEQ ID NO: 11384 - DNA, 201 bp, Homo sapiens
cctgtggctctttatgttggagctggtacaggtaggacccctgctaaacctggcaggggagtagcaatgataataatgatgatcataattatagtaaaatmatgctttttattgagctcttaacatgggccaagcactatgcttggtgctttatatgtacttacttttatcttgtccttacagcatcataggtggcaccat

SEQ ID NO: 11385 - DNA, 201 bp, Homo sapiens
gactctacccactaaatgcaggtagcagtccatagttgtgacaacaaatgtctccagccatagacaaacatttcctggtggtaaaaatctcccccagttgmatgtaaatttgttcagccattgtggaaagcagtgtgatgattcctaaaagaacttaaaacagaattatcaatcaacccagcagtctcattatggagtata

SEQ ID NO: 11386 - DNA, 201 bp, Homo sapiens
atttttgggtgggaggcttatggttgctgtcataagcatctactagaagccaaataccaggttatgtactagaaatggctaggcggggctcatgcacagtkatttgctatgattctaacccatttttaaattataatttcaacttttattttagatccagtggatacatgtgctgggttgtttcatgggtatattctgtga

SEQ ID NO: 11387 - DNA, 201 bp, Homo sapiens
catgaataaagtggcagcttcctcaggggagcctgggaagagggtatttgctccattatcagcccggcttttggcggtgcaagaaatgaaggctactgtaygtctagaagtttccaatattttcaccacctagtgttcttttttattattttgactcctatggacactgtttttaggaggattttatctactgataaaagt

SEQ ID NO: 11388 - DNA, 201 bp, Homo sapiens
ggtggatcacgaggtcaggacttcaagaccagcctggccaacattgtgaaaccccgtatttactaaaaatacaaaaattagctgggcatggtggcgagackgaggcgggagaattgcttgaaccgggacctgggaggcagaggttgcagtgagccgagattgcgccaccgtattcctgcctgggctacagagtgaggcact

SEQ ID NO: 11389 - DNA, 201 bp, Homo sapiens
gccttttaggaaataagcatcaggaactaactaatcaaagtgaaactttctgggagacatctgacagccgcatgcctctaatgaccttcaaaaagatcacrtgctccaggcaattacaggatttgggagaaaatagctcattctgaatagccgaacctgctgcaatgttcatcactttgcagccgtgcccctacctccccg

SEQ ID NO: 11390 - DNA, 201 bp, Homo sapiens
tccattatttgaaatctttcatattaagtaaaattagccacggccagtgctatattaaagtatcaaaacttttagcatttgctcaccctcctttcctgggragaacaggtttctctacacgattgcctgtatgctttgctatgagtcatagtttagagaaaacccccacgttcctgtgcaatgaaagaagcagcataatga

SEQ ID NO: 11391 - DNA, 201 bp, Homo sapiens
ataaagcagaacagaacaatcctattgttctcaccatactgctgagacataaaatcccagaattctagaagggctctaattaggaaaggcttccaggagamggtgactgtggggtcatgaataaagtggcagcttcctcaggggagcctgggaagagggtatttgctccattatcagcccggcttttggcggtgcaagaaa

SEQ ID NO: 11392 - DNA, 201 bp, Homo sapiens
cgggacctgggaggcagaggttgcagtgagccgagattgcgccaccgtattcctgcctgggctacagagtgaggcactctctgtctctgtctctgtctctstctctctctctctctctctctctctctctatatatatatatatatacacacacacacacacacgtatgtgtatatatatatgtgtgtgtgtatatatata

SEQ ID NO: 11393 - DNA, 201 bp, Homo sapiens
tttctttgctgcttcctttcatcttgccaagttacatttagcaggatattcatctaattccttttttaaaattttaatgctccccatttttttggggggtkggggacaaaaagagccttttaggaaataagcatcaggaactaactaatcaaagtgaaactttctgggagacatctgacagccgcatgcctctaatgacct

SEQ ID NO: 11394 - DNA, 201 bp, Homo sapiens
  misc_feature (1)...(201): n = A,T,C or G, or insertion/deletion polymorphism (see Tables 1-2)
atccctgctgcttggtgcttgaagttcatctgacgtgaagcctttgtgaaaagagtattcaggaacccagtagcaatcttttcctttattttaattagacnatgcttctctcttgtttgcagggttttttgagattttatgcaaacttttaatgtttttgcctgtcagtgtttccattatttgaaatctttcatattaagt

SEQ ID NO: 11395 - DNA, 201 bp, Homo sapiens
  misc_feature (1)...(201): n = A,T,C or G, or insertion/deletion polymorphism (see Tables 1-2)
catgtgaagcaaagatttgcacctggggttgttagtagcagggtctattgaactatgacatctcttgatatgttttagtcaccatattaatttctcttgcnatttcaaatagcattagaggaaaatgtgaggttaaaaatgtttatcaaggagacctggatcataaaagcttgagaaacatcaatgtagaggcatgaacag

SEQ ID NO: 11396 - DNA, 201 bp, Homo sapiens
aaagaggctgcttcagcctgcaggatgttgttgacatagtattacatctaagtacgcagggagccccgagccagggttgctggagtgtccctattgcaagkgaagttttggcaaacacaatctagggattgaaaaggtaactccttcattagatctgcctggaatttacacatctgcaaatgtgagaggacaaaaaggact

SEQ ID NO: 11397 - DNA, 201 bp, Homo sapiens
ctcccaatgtttgtccaatgtcatgacagagggtcaacctcccatgaaattgagagggttatagtcttggcttgagatggggttggagtaaataatgtatycaatcctcttccagcttagcattcacttggtggccaatgagctcttccataattattaacactactgagcacacgctacaagtcaagaactatgctagat

SEQ ID NO: 11398 - DNA, 201 bp, Homo sapiens
agctcagccaccaggtacctaccaaccagctaaacagatctcatcattcaaagtgtggtccatgcaccagcagctttgacatcctctgggagcctgaatgyagaatctcaggtcccatccagactgaccgagctagaatctgcctcttaacaagatccctcggcgattcacgtgcatgttaaagtttgagaagaactgccc

SEQ ID NO: 11399 - DNA, 201 bp, Homo sapiens
tcattcatttattcatccacttaaaatatcgtgagctagggagtgtgctggtgtagcatgtatccgaatgtcctttctttttgaacgctggctaatatttmattgtatgtatttacattttgtttacctgttcttctgtcaatggacatttgggttgttcccacctttggctattgtgaataatgctgctatgatgggctg

SEQ ID NO: 11400 - DNA, 201 bp, Homo sapiens
cagtactcaaaagttatcttttctgctcctctaccgcctcccacccaagaactggtaaattgggccagctttctagaactgcaacaattgtttgcagttgwtacatggtgtattagttgcctattgctgaaataaattaccgcaaacttactggcttaaaataatacaaatttattatcctacagttctgcaggtcagaaa

SEQ ID NO: 11401 - DNA, 201 bp, Homo sapiens
gagtttgaaagctcagccaccaggtacctaccaaccagctaaacagatctcatcattcaaagtgtggtccatgcaccagcagctttgacatcctctgggarcctgaatgtagaatctcaggtcccatccagactgaccgagctagaatctgcctcttaacaagatccctcggcgattcacgtgcatgttaaagtttgagaa

SEQ ID NO: 11402 - DNA, 201 bp, Homo sapiens
agaggtagggtgctctttttttgctcattcatttattcatccacttaaaatatcgtgagctagggagtgtgctggtgtagcatgtatccgaatgtcctttstttttgaacgctggctaatatttcattgtatgtatttacattttgtttacctgttcttctgtcaatggacatttgggttgttcccacctttggctattgt

SEQ ID NO: 11403 - DNA, 201 bp, Homo sapiens
gttgagaaggggaaggtatccagccatatgaaaatgaccaaaaactggagttttcatttgttctgataataaagcagaatattgacaagtcagactccccyacacattcactcacaactcaccacctacccatttattagctgggctaggctatacaggcttgcactctgctctcacagagcttatcaatctagacgggga

SEQ ID NO: 11404 - DNA, 201 bp, Homo sapiens
actctaaagactgcactggaggttccccccataccgcactcagctttaatgaggttaactgacaaagaaaaattgtatatattaaaggtgtacaacacaatttttttttttttttttttaaagaaaacagtgtttcactctgttgcccaggctggagtgcagtggcatgatcatagttcactgcagcctcaacctcctggg

SEQ ID NO: 11405 - DNA, 201 bp, Homo sapiens
  misc_feature (1)...(201): n = A,T,C or G, or insertion/deletion polymorphism (see Tables 1-2)
cacagatgtgtctgatcagaagcccaaaatacaaaatcaatgccaagagatgaagtgactagtctacgtagacaaagagagaacagcatcatggtcagganaagtgggctggcgacttcctcccctgtttcactgagcatggcaccggttaggagctgagctgtttggggttagagagcgagtttgatcaacatttacgct

SEQ ID NO: 11406 - DNA, 201 bp, Homo sapiens
cttttctaagcctctcccctgggagtatgtgacatgatgagctgtcactccttggttttattaggccacatggcagaaaggacttctcagttgactttgarttactcaacaaggagattattggggcgagcctcacccaatcacatgacccctttaaaagtagaaagttttgtgcagctattaggttggggcaaaagtaat

SEQ ID NO: 11407 - DNA, 201 bp, Homo sapiens
atatatatcgatttatatatattatatgcacatacgcatatcatgagatgctttatttgacaatttttaagtttttctgtcttattctaagttagactacrgtgcataaaatatatatattaaataagcttatatcttatttaatgatgaaataatgaaaatagatccacataggcacattcaaatgatttttgatcaatg

SEQ ID NO: 11408 - DNA, 201 bp, Homo sapiens
aattcaatatccagttatgataaagatggtaaattcctcaatctgataaagggtatctatgaaaaacctataatatatatatcgatttatatatattataygcacatacgcatatcatgagatgctttatttgacaatttttaagtttttctgtcttattctaagttagactacggtgcataaaatatatatattaaataa

SEQ ID NO: 11409 - DNA, 201 bp, Homo sapiens
ttatgtaatgctgaagtttgagcctctaatgttcctgttgcccaagtagtgtagtgaatgcactacctgataggtagtttttcaacccttgaccccctccytccctcctcccttttgggatccccaatgtctattgttcccatctttatgtccatgagcacccaattttagttcctacttattagtgagaacatgtgttac

SEQ ID NO: 11410 - DNA, 201 bp, Homo sapiens
ttaacagagtaaagggggaaatatggtcatttcaatagatgcggaaaaagcatttgacaaaattcaatatccagttatgataaagatggtaaattcctcartctgataaagggtatctatgaaaaacctataatatatatatcgatttatatatattatatgcacatacgcatatcatgagatgctttatttgacaatttt

SEQ ID NO: 11411 - DNA, 201 bp, Homo sapiens
  misc_feature (1)...(201): n = A,T,C or G, or insertion/deletion polymorphism (see Tables 1-2)
cagatatattgccattgtgctagaaagatctactggacagctcaacctagggctggctttcattctttctgttgtgctagggaagctccctgatatggttnggcattgtccccacccatatctcatcttgaattaccacatgttgtgggaaggacctggtgggaggtaattgaatcataggggcgggtttttcccatgctt

SEQ ID NO: 11412 - DNA, 201 bp, Homo sapiens
cttttaggaggagaaaaaaaaactttctttctctgtaatagtaggagtagtgtagaaatagccgcagtggttaacacatgcatgttcttcacatgtggtasgagaaggactcaccaaatgtgtccatgccctaatgcttggaaccagtggatgtgttgcctaatttggcaaaagagattttacaactgtgattaagttaag

SEQ ID NO: 11413 - DNA, 201 bp, Homo sapiens
tgttcaactcccacttatgagtgagaacatgcagtgtttggttttctgttcttgtgttagtttgctgagaatgatggtttctagcttcatccatgtccctrcaaaagacatgaactcatccttttttatggctgcatagtattccatagtgtatatgtgccacattttctttatccagtctcattgatggacagcttgatt

SEQ ID NO: 11414 - DNA, 201 bp, Homo sapiens
agagagttggagaggaaggcaagggggagagaaaaggagggagggagaaggagagagagagagaagagtgagactgattctgaaattagttgagaaagatrcatagagatatatacagtaatacaaaaacataaagggagtaagattttgcaaggcaatttgccaatttttataaaaatttaaagagcatactttgtgatc

SEQ ID NO: 11415 - DNA, 201 bp, Homo sapiens
aatgctatgcctggtggtttccatttgtattcaaacccttccctgcccatggtcttctcttctatttgcttcttgtctgttttgatagaaatcaataattwccctcatcttgctcctgcatttagaaaagtgaaccaactgtccagtttccctgcttcattgacacacagaggttaacatctcggggacgtcaatcctcag

SEQ ID NO: 11416 - DNA, 201 bp, Homo sapiens
  misc_feature (1)...(201): n = A,T,C or G, or insertion/deletion polymorphism (see Tables 1-2)
ccacattctctggaacaatgacagtttactttattgccttagagagaaggagctacaaggcctgagtacagagaagatgggggaagtaacccaggtcaccncttgaaatagctgaaagaaactatccaggaactgacaaatgggctttgcattctgacaggtgcagggccctcttcagcagttcgcattggaaattggaaa

SEQ ID NO: 11417 - DNA, 201 bp, Homo sapiens
  misc_feature (1)...(201): n = A,T,C or G, or insertion/deletion polymorphism (see Tables 1-2)
taacccaggtcacctcttgaaatagctgaaagaaactatccaggaactgacaaatgggctttgcattctgacaggtgcagggccctcttcagcagttcgcnttggaaattggaaaaatgagcctattgttgaagatctagatcattcattccatttttaagtgagaaaggaggtatttcacactattacctttacttccga

SEQ ID NO: 11418 - DNA, 201 bp, Homo sapiens
tggaaattggaaaaatgagcctattgttgaagatctagatcattcattccatttttaagtgagaaaggaggtatttcacactattacctttacttccgagmgtttgtgccaaagatgtaagatgataacatggagggtgatattccatgtgatggatttcttcttcccttgcctcactacagaatgttcaaaaataaactt

SEQ ID NO: 11419 - DNA, 201 bp, Homo sapiens
ctgcaaaatggttgctgtgagaattagagatgattcaggtaaaccactgagcatgatgctagacacgtccaagtattagctgtacagtctttggatttatstcctgggtagagagaacctcctgccccaagtctggaaagatgttggcttttgtagagtaaactctcgaaatgtattaaattgactccatgcttgggaatt

SEQ ID NO: 11420 - DNA, 201 bp, Homo sapiens
agacatgatggtgcaacagaagaccagaggattacaatgatgtgtccgaaatctgagccaggagcaaaaacaaagaatgcatccttttccccacatgagcygcctgtcctgactcatgatggacctgggatctcttgcctctgttgacttggagactggggtctttacgaatgggggttggagttaggggcagatttaggt

SEQ ID NO: 11421 - DNA, 201 bp, Homo sapiens
  misc_feature (1)...(201): n = A,T,C or G, or insertion/deletion polymorphism (see Tables 1-2)
gtctgcaaaatggttgctgtgagaattagagatgattcaggtaaaccactgagcatgatgctagacacgtccaagtattagctgtacagtctttggatttntctcctgggtagagagaacctcctgccccaagtctggaaagatgttggcttttgtagagtaaactctcgaaatgtattaaattgactccatgcttgggaa

SEQ ID NO: 11422 - DNA, 201 bp, Homo sapiens
tcataattatagtaaaataatgctttttattgagctcttaacatgggccaagcactatgcttggtgctttatatgtacttacttttatcttgtccttacarcatcataggtggcaccatgattatttatcctcattttgcagctgagaatcagaacaattaaccttgtatcgtatagctagtatgactctcttgaatccag

SEQ ID NO: 11423 - DNA, 201 bp, Homo sapiens
atcttgacatctccttttcttcactcttgattcctgcccctgacatcaactgtagtgatgcaggctcctacttctcttgagatctggtattcttctattgygtctaagtggtaggttggtgttgtggaagccatatgggctttggaggcagaaaaaccagggtttgcatcttgggcttattttttacaagctgcagatttc

SEQ ID NO: 11424 - DNA, 201 bp, Homo sapiens
  misc_feature (1)...(201): n = A,T,C or G, or insertion/deletion polymorphism (see Tables 1-2)
gtcatccacccatctcagcctcccaaagtgctgggattacaggcgtgagccactgcacctggcccatcttttcatttctttggtatactgtttttttcctnccagctttattgaggtttaactgacaaataaagtggtttgtattcaaggtgtacaatgtgatgttttgatgagtgtgtagactgtgaaatgattaccacc

SEQ ID NO: 11425 - DNA, 201 bp, Homo sapiens
agacatcttgacatctccttttcttcactcttgattcctgcccctgacatcaactgtagtgatgcaggctcctacttctcttgagatctggtattcttctrttgcgtctaagtggtaggttggtgttgtggaagccatatgggctttggaggcagaaaaaccagggtttgcatcttgggcttattttttacaagctgcaga

SEQ ID NO: 11426 - DNA, 201 bp, Homo sapiens
aaataaataaaattaaaacataaagctaaatattaccaacaaaagaataaattaacgggaaaatacatctattggaaattacccaaatgcagcacagagasaaaaaagaatgcaaatattaaaacaaggtaaataacctagaggagagaatgaaaagttccacagtattttaaagttttcaggaaaaaaaaaaaaaaagat

SEQ ID NO: 11427 - DNA, 201 bp, Homo sapiens
aaatatttaaccactacagcattatcacagctgaatcagaatagacactcactttgtagaattctggagcacctgttatgtgaggtgttaatcctttagtrgctggttatggggaggtagggggttcccaagggaggggctgagtggcagggggcacttggggttcctggaagatgtggctattcacaagcaaaacggaag

SEQ ID NO: 11428 - DNA, 201 bp, Homo sapiens
gggacctgggaggcagaggttgcagtgagccgagattgcgccaccgtattcctgcctgggctacagagtgaggcactctctgtctctgtctctgtctctgyctctctctctctctctctctctctctctatatatatatatatatacacacacacacacacacgtatgtgtatatatatatgtgtgtgtgtatatatatac

SEQ ID NO: 11429 - DNA, 201 bp, Homo sapiens
  misc_feature (1)...(201): n = A,T,C or G, or insertion/deletion polymorphism (see Tables 1-2)
tttcctcccagctttattgaggtttaactgacaaataaagtggtttgtattcaaggtgtacaatgtgatgttttgatgagtgtgtagactgtgaaatgatnaccaccatcgaattaattaacacatctttcacgactgttggttaccattttgggtgtctgtgtatgtggtgtgagtataattaagatctaatcgcttcac

SEQ ID NO: 11430 - DNA, 201 bp, Homo sapiens
ctgggaggcagaggttgcagtgagccgagattgcgccaccgtattcctgcctgggctacagagtgaggcactctctgtctctgtctctgtctctgtctctstctctctctctctctctctctctatatatatatatatatacacacacacacacacacgtatgtgtatatatatatgtgtgtgtgtatatatatacatata

SEQ ID NO: 11431 - DNA, 201 bp, Homo sapiens
atcttttcattaaaatgggtccacaaatttctgcttagaaatacaattttagcttccctctttgaaatccttacagattaaacatttcctccttgctatcmttgtgacaatatcttccatttattgtgcctctgctgtatgccagacggtgatagatgctttccatgcataatctaattctaatttttacaacttaataat

SEQ ID NO: 11432 - DNA, 201 bp, Homo sapiens
  misc_feature (1)...(201): n = A,T,C or G, or insertion/deletion polymorphism (see Tables 1-2)
agttgcatgctcaggattttatagtatatatggtttttcttattgtgctttgccctctgtggactttcttagaggattcaagattttctttaattctgganaaaatctcagccgctatctgttggattctttctttccatcattctttctattctctccttctgaatatacatgcatatgtatagtcatgcgttgcttcat

SEQ ID NO: 11433 - DNA, 201 bp, Homo sapiens
ctgcaaatgtggaagctgaggcacacagtaagaaagggtaaacagtggaggctggatgcaaacccaggtagtctgattacagagtttgaaagctcagccaycaggtacctaccaaccagctaaacagatctcatcattcaaagtgtggtccatgcaccagcagctttgacatcctctgggagcctgaatgtagaatctcag

SEQ ID NO: 11434 - DNA, 201 bp, Homo sapiens
gccgagattgcgccaccgtattcctgcctgggctacagagtgaggcactctctgtctctgtctctgtctctgtctctctctctctctctctctctctctcwatatatatatatatatacacacacacacacacacgtatgtgtatatatatatgtgtgtgtgtatatatatacatatatatgtgtgtatatatacacacat

SEQ ID NO: 11435 - DNA, 201 bp, Homo sapiens
  misc_feature (1)...(201): n = A,T,C or G, or insertion/deletion polymorphism (see Tables 1-2)
tttagcttccctctttgaaatccttacagattaaacatttcctccttgctatccttgtgacaatatcttccatttattgtgcctctgctgtatgccagacngtgatagatgctttccatgcataatctaattctaatttttacaacttaataatagtgataattataaaacaatgataaacagtagctttcatgtatcaaa

SEQ ID NO: 11436 - DNA, 201 bp, Homo sapiens
aggcactctctgtctctgtctctgtctctgtctctctctctctctctctctctctctctatatatatatatatatacacacacacacacacacgtatgtgtatatatatatgtgtgtgtgtatatatatacatatatatgtgtgtatatatacacacatatttatacgtgtatatatatgtgtgtatatatatatgtgtgt

SEQ ID NO: 11437 - DNA, 201 bp, Homo sapiens
ggcactctctgtctctgtctctgtctctgtctctctctctctctctctctctctctctatatatatatatatatacacacacacacacacacgtatgtgtatatatatatgtgtgtgtgtatatatatacatatatatgtgtgtatatatacacacatatttatacgtgtatatatatgtgtgtatatatatatgtgtgtg

SEQ ID NO: 11438 - DNA, 201 bp, Homo sapiens
atgaagtgttagcagtgaggtgacttccctctttttattaatggggcaactgaggcacagacagatcctgcaatttgctcaaggtcacaaacttacgttgrgattcagttttttttttttttggagatcaacacttccttggacttattgggaaatggatgatcattgttaaaaacacgttttccaaaaaaaatatttttt

SEQ ID NO: 11439 - DNA, 201 bp, Homo sapiens
ccctgggtgtccctccgggcatgcaacacacagatggcaatgttccgagtgttgcaatacacatttgtgtttctggttactttaatatcagccccatgtcmtgatgttcgtgtcattggcatggatgctaacaggctgtctagaaaatgtgcaatatattttttattttgcctaaatagcacatctaattgttcagcatga

SEQ ID NO: 11440 - DNA, 201 bp, Homo sapiens; identical to SEQ ID NO: 1343
  misc_feature (1)...(201): n = A,T,C or G, or insertion/deletion polymorphism (see Tables 1-2)

SEQ ID NO: 11441 - DNA, 201 bp, Homo sapiens
  misc_feature (1)...(201): n = A,T,C or G, or insertion/deletion polymorphism (see Tables 1-2)
tctactccaatccctgcccaccccactcctctcagctgctgtttttctcctggactctttctcaccctgtcttcacgcagtcctccctgggtgtccctccnggcatgcaacacacagatggcaatgttccgagtgttgcaatacacatttgtgtttctggttactttaatatcagccccatgtcctgatgttcgtgtcatt

SEQ ID NO: 11442 - DNA, 201 bp, Homo sapiens
aaggtggagctgtaactctggggcattcttgcttatgacaatgaggatttccaaggtgtctgcaactcagagattctgggacctagagaatcagagcaacstcgggttgggagatgagttttctttcctgctcatcttcatggtgaaagcggagctggggtgcacggtgtgtggggggtgactggcagtgcaggcatgccc

SEQ ID NO: 11443 - DNA, 201 bp, Homo sapiens
taaagcctgcagaactgtgagccaattaaacgtcttttctttataaattacccagtctgaggtatttctttatagcaatgcaagaacagactagtacaggrtctctgcctttcttatctgttgttgaatatccagcacccagctccaggctcagagtagacactcaatacatgttggttaaagaactgagtgaattagtaa

SEQ ID NO: 11444 - DNA, 201 bp, Homo sapiens
  misc_feature (1)...(201): n = A,T,C or G, or insertion/deletion polymorphism (see Tables 1-2)
tgggacctagagaatcagagcaacgtcgggttgggagatgagttttctttcctgctcatcttcatggtgaaagcggagctggggtgcacggtgtgtggggngtgactggcagtgcaggcatgcccagctgtgagtgccgtggcaccaggacaatcacctccctggatagagtttccctcgtgcagcatcagcaataggtgg

SEQ ID NO: 11445 - DNA, 201 bp, Homo sapiens
acagctcacaggtgattcatcttgaacatacagccaataaacacccaaagactttcccatcttgtaccaaggcaggtggatttttttttttttcaagactkaatctctgttgccaggctggagtgcagtggcacgatctctgctcactgcaatctctacctcccaggttcaagcgtttctcccaaggcaagtggattttga

SEQ ID NO: 11446 - DNA, 201 bp, Homo sapiens
tgtttgtattgagcatatttttatgtgcttagtggctgtttgtatgccatcttgtaagaaatgtctattgagaccctttgccttttttaaaaacggagtcrcctttctattgttgagttgtgagtgttctctatgtaccctggatactagacttttatgagatatataatttgcaaatattttctgtgtgtcgtgttttca

SEQ ID NO: 11447 - DNA, 201 bp, Homo sapiens
ggtggtgctggcccttttcttgcttccagtgcctgaattcatccatcaattccacaaatatttattgattgtgagctaggtgccaggctctgtgctagttsctagggatacagtggtgaaggacatagttcatgctataaaaaggctggggagacagataaacaggcaattattcttatatataaatataccatgatgcta

SEQ ID NO: 11448 - DNA, 201 bp, Homo sapiens
  misc_feature (1)...(201): n = A,T,C or G, or insertion/deletion polymorphism (see Tables 1-2)
caggacattgtgggacttgattgctgcagtgtgaaatttatggttttgtaagacagatttaaaaccctttcatggcatcttgtagcctttggaataaaatncaacatcctcaccatggcctatgaagagaccctgcatgatttgggcactaggtgcttttttggggctttgtttgctgtcattttcctccttgttctttcc

SEQ ID NO: 11449 - DNA, 201 bp, Homo sapiens
ttgctggatcatataggagttctatgtgtagctttttgaagaactgtcgtactgttttccatagcagctgtaccattttacattctcacaatcagtgtacrgggtttcttatttctccacatcctggtcaacatttgttatttccattcttctgaatttagccatcctggtgagtgtgaagtgctatctgattgtgatttt

SEQ ID NO: 11450 - DNA, 201 bp, Homo sapiens
tgtctccctttgtccccagccctagaaaccatggatctactttttgtctctatggatttgcctattctggaaatttcatgtaaatggaattgtataatacrtggccttttgcgtctggtttccttcacttagcataatgtcttcaatgcccatccatgttgtagaaggtatcagtacttcattcctttttatgggtgtata

SEQ ID NO: 11451 - DNA, 201 bp, Homo sapiens
  misc_feature (1)...(201): n = A,T,C or G, or insertion/deletion polymorphism (see Tables 1-2)
aatgtggctgagatggatgatagacttgagatgcctgttacacatcctattagtattttttccctttgctgctataacaaattacacacagtggcttaaancacatcaatttataatcctactggtcacccacatctcactgggctaaaatcaaggtgcagtgctgtgttctttctggaggctgcaggggagaatccattt

SEQ ID NO: 11452 - DNA, 201 bp, Homo sapiens
  misc_feature (1)...(201): n = A,T,C or G, or insertion/deletion polymorphism (see Tables 1-2)
tctgcccaccttggcctcccaaagtgctgggattacaggcatgagccaccacacctgtccagttatttcttatttaaatgattataacaaccttctaatgncctcctgcttttctattcactcatcctcctgtagatgctaaatttttttttctgaaatataaatgtcatgttcctattaataacccattacttgttgata

SEQ ID NO: 11453 - DNA, 201 bp, Homo sapiens
tcatggctggtgaaaaacagaaagacactggggattcagaatgcacaacaatgtttgcaattgcaatgcagagacggtgatgtggcaggcagtcagtcagycagtcagtcagcgtgctccctttccgggatctgccagtggagtgcactgtgccccatggatgggcttcggagggggtagtggtgacatcagctccccagc

SEQ ID NO: 11454 - DNA, 201 bp, Homo sapiens
aatggagctatgagcataaggctgtattgttattgttgtcactgtcatgatcatggctggtgaaaaacagaaagacactggggattcagaatgcacaacartgtttgcaattgcaatgcagagacggtgatgtggcaggcagtcagtcagccagtcagtcagcgtgctccctttccgggatctgccagtggagtgcactgt

SEQ ID NO: 11455 - DNA, 201 bp, Homo sapiens
ccccagcagcttctcacctctcttggcctgaagggggctgtgccctttgtttcactgcagctgctgcagacagagaaaggaggagattcccagcctcgagkttgcctcgcagggcagtagcaaccgagggcagagcacagaggagcagctgcattctccatggggacatgactacgtggcctggcttctccttcccccagg

SEQ ID NO: 11456 - DNA, 201 bp, Homo sapiens
caatgtccctgcccttatcaaacttatattccaggggatggggacaaaatataaacacggtaaatatataatgttagattgcattaagtgccacaggcaargcagggtaaagagactgaaagtgacaggagatgccctttaagatagggtttcaggaaagctggatcagctaggatggatgaggccctgctgcacaaacag

SEQ ID NO: 11457 - DNA, 201 bp, Homo sapiens
actacccagtcagttctctcctattattctctagcttgcactttatttctttcacagcctttatcatactgtgacattaccattttttttggttgttattrtccatatgcccctctcctccattccctactagaaattaagctcccaaaggcacaggccttgtgtatcttatttgtgctaagatggtgcctgacacctagt

SEQ ID NO: 11458 - DNA, 201 bp, Homo sapiens
attattctctagcttgcactttatttctttcacagcctttatcatactgtgacattaccattttttttggttgttattgtccatatgcccctctcctccaktccctactagaaattaagctcccaaaggcacaggccttgtgtatcttatttgtgctaagatggtgcctgacacctagtgagtcctcagtgagtgtggtat

SEQ ID NO: 11459 - DNA, 201 bp, Homo sapiens
agtagagtgtttagaaaaatgtttataaaatacctataaaaatgaaaattagcttttctccttgtgtatacctgatgggtttatcatatttgaaatgactycatcactgtccagattccctgctaaactccacctgggcaggagcatatccccttcatagagtccccccagcacctagatactgcctggcaagtgatggat

SEQ ID NO: 11460 - DNA, 201 bp, Homo sapiens
ggagcaccataatctcctgcttatatctcagaccaaatcctgctctcttttcccttggtcctttatctttctggaacattcctcacactcacctttgcacmtgttgttccgtttgcttgggaatttcttcccctggacctttctgtggttgtcttgttctcaccattcaagtttcgtctcaaacattgctgactgtgacag

SEQ ID NO: 11461 - DNA, 201 bp, Homo sapiens
attttagttcctacttattagtgagaacatgtgttacttggatttctgttcccttgttaacccacttaggataatggccttcagctgcatccatactgctsgaaaggacatgatttcactcttttttatggctgtgtagcattccatagtgtatatatatcacattttctttatccattccattgttgatgggcatgtggg

SEQ ID NO: 11462 - DNA, 201 bp, Homo sapiens
ttttgttgactttgtcaaagatcagttggttgtaggtgtgcagctttattttagggggtctgtattctgtttcattggtctatgtgtcttttaccagtacyatgctgtttgggttactgtagcattgtagtatagtttgaagttaggtaatgtgatggctttggctttattctttttgcttaggattgccttgcccattca

SEQ ID NO: 11463 - DNA, 201 bp, Homo sapiens
  misc_feature (1)...(201): n = A,T,C or G, or insertion/deletion polymorphism (see Tables 1-2)
caaaattaatgttttataaaaggaagaaatataaaaagtctttaggccatctgtattggcctaatgcctaaaatcatttagcgaggtctgggccatgttanggttagggttagattctgttttttcataattagtaatctggttgcagggaccagacatgctctgcaataacaaacagccataccagtaagtatcaaatta

SEQ ID NO: 11464 - DNA, 201 bp, Homo sapiens
  misc_feature (1)...(201): n = A,T,C or G, or insertion/deletion polymorphism (see Tables 1-2)
ggttagattctgttttttcataattagtaatctggttgcagggaccagacatgctctgcaataacaaacagccataccagtaagtatcaaattatgtgctnagtgaaaagtggagtccctaatacaatgtctcttactggagtctatggacctcctgcatcaatgatgccaagtatgctggttcagaatatagattcctgg

SEQ ID NO: 11465 - DNA, 201 bp, Homo sapiens
  misc_feature (1)...(201): n = A,T,C or G, or insertion/deletion polymorphism (see Tables 1-2)
gagctgagagccacacccccttagcacgcagctgctggactcccctttcacgttttggtgaactcttctccaggggcttctgtcacatcaactgcagtggnattgctgcctccagtttgtgtcttctggtgctagcacagaaaccccaccttcttctcttctgtttctggaaaacaccagcctcctcttaccttactgaga

SEQ ID NO: 11466 - DNA, 201 bp, Homo sapiens
  misc_feature (1)...(201): n = A,T,C or G, or insertion/deletion polymorphism (see Tables 1-2)
aactcttctccaggggcttctgtcacatcaactgcagtgggattgctgcctccagtttgtgtcttctggtgctagcacagaaaccccaccttcttctcttntgtttctggaaaacaccagcctcctcttaccttactgagatcagaattcttataacacccaccactgtttcatcttagggtcctttttcacatacagtct

SEQ ID NO: 11467 - DNA, 201 bp, Homo sapiens
cttagggtcctttttcacatacagtcttatggttttctatttgaaatggcccacgtgcatctgctttgcctcctaaacgaagctaaatgtcttctgatcaygtctccttttaataactcatctctttaaaaaagtcatatcatttgattcttctaaatgtaaaagtaactactctcatcgtagaaaattggaaagccacgt

SEQ ID NO: 11468 - DNA, 201 bp, Homo sapiens
  misc_feature (1)...(201): n = A,T,C or G, or insertion/deletion polymorphism (see Tables 1-2)
ctttaaaaaagtcatatcatttgattcttctaaatgtaaaagtaactactctcatcgtagaaaattggaaagccacgtatcagggccaggacaaggaagangagattaagaatccctccttggatgcaaaatttaaaagggtgccaaacaattaagttatcaaggtaaataccatttcagtgcaatattttagagaataga

SEQ ID NO: 11469 - DNA, 201 bp, Homo sapiens
agcaacaacggatgaaaataagcatgggacgttgccaacaagggaagctcactgagccttggcgtgcagagtcttttttggggtctgctgttgagttcttrtatgggtgaccttggcttccaggtcctctggaggttgagctcatgctatgtgattctaagcccccactctaaatcacactgttagactctctggtgtgac

SEQ ID NO: 11470 - DNA, 201 bp, Homo sapiens
acatgcactcagtctactgtaacctgtgcagaaatgatttcccctcctgccttctttcatgatccccagcccccaggtagtcttctctgactgccgccccmccaagactcatcaagtgccctatcatgctgccattgtagcacttaacaacgtgtaatgattatctattaatcgtgtaatgattatcttaatgtgtaatga

SEQ ID NO: 11471 - DNA, 201 bp, Homo sapiens
tcatgaaaggtccaaccgtgagctgccagtggtgatcttcctacggaatcatggacagtgccaccttctcagcaacaacggatgaaaataagcatgggackttgccaacaagggaagctcactgagccttggcgtgcagagtcttttttggggtctgctgttgagttcttatatgggtgaccttggcttccaggtcctctg

SEQ ID NO: 11472 - DNA, 201 bp, Homo sapiens
aggccatttcacttggggcttgatcacctgctcattgtcggctctggactcaaactcatttgccccagtagcagcatgctcttcagaggacagaaagaggsccataggctctgatcccttagttggtaaacaatcatttctctagatctgtgttcatccatcatggcccattaagcagcagtggcctggggccattttcca

SEQ ID NO: 11473 - DNA, 201 bp, Homo sapiens
gaatcatgaaaggtccaaccgtgagctgccagtggtgatcttcctacggaatcatggacagtgccaccttctcagcaacaacggatgaaaataagcatggracgttgccaacaagggaagctcactgagccttggcgtgcagagtcttttttggggtctgctgttgagttcttatatgggtgaccttggcttccaggtcct

SEQ ID NO: 11474 - DNA, 201 bp, Homo sapiens
tgttatagctgaaggatacagactaaaatcagccaaaagagggacacataggcagaatcatgaaaggtccaaccgtgagctgccagtggtgatcttcctayggaatcatggacagtgccaccttctcagcaacaacggatgaaaataagcatgggacgttgccaacaagggaagctcactgagccttggcgtgcagagtct

SEQ ID NO: 11475 - DNA, 201 bp, Homo sapiens
aaccaaacaacgctcaggtatccaaagtgtctttcctgactgtcccccactccactgcaccattgcaggctgaattagggggcctcttctctgcgcctctyacattaccctgggtttcccgtgctcaggccatgcctaccacttttttttttttttttttttttgagatggagtttcactcttgtcacccaggctggagtg

SEQ ID NO: 11476 - DNA, 201 bp, Homo sapiens
cttttcttgccttttgttgaattaaaattctttaacttctcagctatctcatggatctttgcatctgttttgcatctgtttcttagcagcctagcttggckcatggtgctttatagagacatttagcatgtaaagatatttataaaggagggattctcttctatttttgcccagtcatctgttggagagagggggagcagc

SEQ ID NO: 11477 - DNA, 201 bp, Homo sapiens
aaggaaaccaggcaagtggaattaaccaggcaccttaatccagggcatcagctcccactccatcctagctggctgtcccttagaataagtgtgggaaggcrtagcagtgagtgcagttgcctcatgctaacctcaggacgaagcatgtaagagcctcggaaattgccccatggtagatatttatattaacgacatttgacc

SEQ ID NO: 11478 - DNA, 201 bp, Homo sapiens
cccaggctggtctcaaactcctgggctcaagagatccacttgccttggtctcccaaaatgctgagattaaaggcatgagccatcgcaccctgcccaatctkgttttcttaatactccctcctccctaataccttaccaaccccctgattattttaatgcaaatctcagaacttatatcattttaatttaaagtttcagtaa

SEQ ID NO: 11479 - DNA, 201 bp, Homo sapiens
  misc_feature (1)...(201): n = A,T,C or G, or insertion/deletion polymorphism (see Tables 1-2)
tttaatcagttccatagcctgaccctggtccagtgagcatcagatttggagactgtgccatttatgaaacaggcaggtattggagagactccaaaaagctngtctcatgtgtgcttccctgcaaaaacagccagttccagctagaaactttatcttcatgaaaggaaacctctaggcagagagaagttctatttgttttta

SEQ ID NO: 11480 - DNA, 201 bp, Homo sapiens
acccaagaactggtaaattgggccagctttctagaactgcaacaattgtttgcagttgatacatggtgtattagttgcctattgctgaaataaattaccgyaaacttactggcttaaaataatacaaatttattatcctacagttctgcaggtcagaaagctgaaatgggtctcatggagctaaaatcaaggtgttagtag

SEQ ID NO: 11481 - DNA, 201 bp, Homo sapiens
catctaaaatgatcttgtacaccatcagtataccacacactggaatacaccacgttaaggaggcccttagcggaaggcgttgtccactttcttctttgaawggtatgaaaggtcttacagtgtccttgttttcacaacccagacagagttagtcagtgcctggagcaaacaccagcgacatgcataccaaccatgaaatct

SEQ ID NO: 11482 - DNA, 201 bp, Homo sapiens
gctggtcgagtgagtaagaacgatgacaaaacccatatcttgaatcacatgcatctttattaaaatcttcctccagctttccattttacctagaattaaartcaattgcttgctgtggcctagaaggagcaccataatctcctgcttatatctcagaccaaatcctgctctcttttcccttggtcctttatctttctggaa

SEQ ID NO: 11483 - DNA, 201 bp, Homo sapiens
gctgtgggtggtaatccaaatcaaatattcttcctgatctttgtgttaagactatcacttttggaacagccattttccaaagctctctcataattccatcktaggcagagatggagtgtggccatacaatgttttggaggctccaaatctaggtaaagtggaaccactggagacagagtgccatcttgtttctggagtcag

SEQ ID NO: 11484 - DNA, 201 bp, Homo sapiens
ctgaggcatgaggatcactttaacctgggaggcggaggttgcagggagccaagattgcgccactgtgctccagcctgggggatagagtgagactcccttcaaaaaaaaaaaattatttatctcatctctctgggttctgcacatatttgaatttgctgcacctgatacagaccaaatcagtgtttcctaaacctctctgat

SEQ ID NO: 11485 - DNA, 201 bp, Homo sapiens
aaacctacaagtcacctttgatttctctctccctcttacctgctatgtagaaaccatcagcaagggcttctagctctgcccttaacacagatccatgaaamatgcttctaccttcactgcaactccttatgaaatctgcattcagtgacagcagcatcttctaaactggtatcttcttccagctttgacatcctatgatca

SEQ ID NO: 11486 - DNA, 201 bp, Homo sapiens
taagagaagggacttgagttaccgtttagtttgaatcccgtctctactagcttgctgtgtgatcttggacaagtcacttaacccatctgtgctctagtttrcttatttgttaaaagggataaaatagaactgacctcatagagttgttatgagcattaaattagttaatatattttatatgtttgaaacagggcatgtcac

SEQ ID NO: 11487 - DNA, 201 bp, Homo sapiens
tagaaataaaaataaaatcctaaaccaccccaactaattaaatggaaccccttcttggccagggggatcccagagaaaccttgaaaactgagttcctagcyataaccagacaggagctcagacttaccacattatatcctctcccttgctaaccatcatttggctttctttcctaagggttaaacagaaacaggccatctc

SEQ ID NO: 11488 - DNA, 201 bp, Homo sapiens
tcagactgacggagggctcctttctaggtcattgctaatctcatggaagagggaaaagagaaggatgtagatgaagagatggatcttaaagattctcctgsaagtggcactgtcactcccacttacattccgctggctcccagcccaacattggcgaggattccaattgtccagtagggaggagtcctgtagagaggaggg

SEQ ID NO: 11489 - DNA, 201 bp, Homo sapiens
tgaagtttggcacccacagaggtctatgcttaggtaacggggtgcagatggcttgtcgtttgcagagacagtggctaataaccatctcccttccaccttckctttctgcaaaagcccagggcctggcagagtcacattgcttgcaaaggaagcctaatcataaaaaggtgccttttggtggcttaaagataaggtaatcag

SEQ ID NO: 11490 - DNA, 201 bp, Homo sapiens
tctcaaaaaaaaaaaaaaaaaaaaaattagctgggcatggtggtgcatgcctatagtcccagctacttggaaagctgaggtgggaggatcacttgagcccmgatggaggctgcaatgagctgagatcatgctactgcactccagcctgggtcgcagagtaagaccctgttccccaaccctgcccaaaaataaataaaaaag

SEQ ID NO: 11491 - DNA, 201 bp, Homo sapiens
attcgagacgggaatgaaggaatgggctacctgagcttggagggtggagatgtggctgggaaacactttgaaagcccttcaaaggctgttcaagtataatygggacagtcatatgacagggctgggcctccttgaggtgggtgtttggatggtaagagggtcccaggcattgtcatctggctgcaatacaaggatctgcaa

SEQ ID NO: 11492 - DNA, 201 bp, Homo sapiens
atctcctccttgaagttcttgttgctatttgagcttgtttttagctggagatttactcttggattttagttgttttcgccttcatctgttgaagaggtggsatgatattgcgtgtgtgtgtgtttgtgtgtgctggaagttatgcttccaatatttacaatattggctttccaaagcagaagatgatgggctttctgggag

SEQ ID NO: 11493 - DNA, 201 bp, Homo sapiens
ggtggctcacacctgtaatcctagcactttgggaggccgaggtgggcagattgcttgagcccaggagttcgagaccagcctgggcaacgtggtgaaacccwgtctcaaaaaaaaaaaaaaaaaaaaaattagctgggcatggtggtgcatgcctatagtcccagctacttggaaagctgaggtgggaggatcacttgagcc

SEQ ID NO: 11494 - DNA, 201 bp, Homo sapiens
  misc_feature (1)...(201): n = A,T,C or G, or insertion/deletion polymorphism (see Tables 1-2)
ctcaggtacaactcagaattgtatgagcaacagtggattctgcagtacaagatctcagagtctaacagggaggcgaagatattcactggggcagaacattngagacgggaatgaaggaatgggctacctgagcttggagggtggagatgtggctgggaaacactttgaaagcccttcaaaggctgttcaagtataataggg

SEQ ID NO: 11495 - DNA, 201 bp, Homo sapiens
tgggatagtctaggaaatgctggcttcgcacaacacagccgagtgggtgggagccaaaaatagccagtcctttgagtagaaactcctctagggaggaaacwtttctttgaaattggacacacaaattagctaatgatatccagacactaaagaactgcatgttccccagacagcccgcggccccaggatcagacgctgatc

SEQ ID NO: 11496 - DNA, 201 bp, Homo sapiens
  misc_feature (1)...(201): n = A,T,C or G, or insertion/deletion polymorphism (see Tables 1-2)
gttcatggagctagctttcttaatgcctcaatcatacttttaatcagaaaaaatttagagcattaatcttcagtgcttgttcttgccatttccagccactngacactttttcataaacaaagtgacagtttgattgaatgtggtttttaattaagctgccttcacttggaacaactttctgggggcatatgtaaggagcag

SEQ ID NO: 11497 - DNA, 201 bp, Homo sapiens
aaaaaaaaaaaaaaaagaccctgctgcttccctgatctggcaaattaaaaatataaaacctttcgttaaaccccagagccacgagtttcctataagcatgrtagttttatgattcagctgcaccattagtaatctccagtcttcttagcccctcccatctctctgccacctctttcaattttcttctttactcattcctct

SEQ ID NO: 11498 - DNA, 201 bp, Homo sapiens
  misc_feature (1)...(201): n = A,T,C or G, or insertion/deletion polymorphism (see Tables 1-2)
atgtgtgcttccctgcaaaaacagccagttccagctagaaactttatcttcatgaaaggaaacctctaggcagagagaagttctatttgtttttacaactntccccagttgtatttgaagatggcaaaatgttgggcttaaggcctgccctgggttcatggagctagctttcttaatgcctcaatcatacttttaatcaga

SEQ ID NO: 11499 - DNA, 201 bp, Homo sapiens
aggctgctgtgagttgtaattacaccactgcactccagcctggatgacaaaacaagaccccatctcaaaaaaaaaaaaaaaaaaaaaaagaccctgctgcktccctgatctggcaaattaaaaatataaaacctttcgttaaaccccagagccacgagtttcctataagcatgatagttttatgattcagctgcaccatta

SEQ ID NO: 11500 - DNA, 201 bp, Homo sapiens
  misc_feature (1)...(201): n = A,T,C or G, or insertion/deletion polymorphism (see Tables 1-2)
aatagctagaaaagcagactttttaatgttctaaatacaagaaatgacaagtttgaggtgatggataagctaattaccttgccttgatcattacacattgnatacatgtattgaagtatcacaccgtaccccataaatattaatatacaatgtcaatttaaaaagtatcagtatgaacttatgatgtatttttacttaaaa

SEQ ID NO: 11501 - DNA, 201 bp, Homo sapiens
tccacttagagtttggtttttaaattattttccactgagggagaccactgggaaagtgggtgattcaaggtgtagggtggaaatgaacaagataaaccttyctagagtgtcttgtcactgcaatgagcaaagcagttaccaaagactacaggtcaaagggactcagaagccaatctgaaatcaactggccaaagatggaac

SEQ ID NO: 11502 - DNA, 201 bp, Homo sapiens
tgacttttagagatgtatactgaaatatttacagatgaatgatatgatatctggagttcacttcaaaataatgcattggaaggagaacattggtaagaatrtggacaaaacaagatcagtcacgaattgaaaatagttaaaattgagtggaggatacatgggggtttgttatactattttttctgttttctatgtttgaca

SEQ ID NO: 11503 - DNA, 201 bp, Homo sapiens
atcatcacaataaaccagcaaggctgggaattatcacctttctcgaaatgagcaaactgagggtaagcaaggtgaaaagacttgcccaagttcacacagayaggaagaggctgagccaggtccctgtaactgcatttgcctgagtcacatagcttctccgtggatactttgaaaagtgagtggcccttgctttctagacca

SEQ ID NO: 11504 - DNA, 201 bp, Homo sapiens
gccaactttaaagaggaggcttgggttccactcttaatgctaataaaagactcacagaacagaggaaggaacgttcaacaaaggatcagaacaccgggatstggcagcaacttgtttggttacaggagaccagttagtgtcctgtcctcctttggacatgtgagagagttaggttacataagtgtttcccagaatatgggg

SEQ ID NO: 11505 - DNA, 201 bp, Homo sapiens
gttgtctatttttccttttagttccattctgtatttttgggggttctgttattaagttcatacacatttatggttattatatctttctgatgaattgaccyttttctcattatgaaatgcccctccgggaatactgtcttgaagtctgttttatctgatgctaataaagatggtccattcttctaacattttctggttgtg

SEQ ID NO: 11506 - DNA, 201 bp, Homo sapiens
atcgattgaacaaggtttacattattttctttacctgcttctccatgctagatgttgcatttgtgattcttgagttaaagggctggtctggataaccattyttcctgtggttatcctataattagaaatgaaatttagcatatgagggttaaatgcattaatacaaccctttgaggggctggagatcaggtataaaaggtg

SEQ ID NO: 11507 - DNA, 201 bp, Homo sapiens
catttatttgcagtctgtggatggcaggctggtctttgctcctagagacttctttctcatgctttccatgtagctcctccagcaatggtgaatgaagatcytctgacactttgagtctctctgacttcttctctgctacttctctgactccagctggagaaagttctctgtttttcaggggacttgtgagtaggatccatg

SEQ ID NO: 11508 - DNA, 201 bp, Homo sapiens
attcttcctgtggttatcctataattagaaatgaaatttagcatatgagggttaaatgcattaatacaaccctttgaggggctggagatcaggtataaaakgtgtgagaaggaactttaagttctttaaaagtgatgcttttattgtttgcaggatgtcacataatcagttcaattcaacattgaatctgtgctctgttct

SEQ ID NO: 11509 - DNA, 201 bp, Homo sapiens
agaaaacatttcagattgtaaatgagtaagaatgatgttattatagaaatgaccttgaatgtgctgtagcttacaaaaaaagccaaaatcatttccaagtwtcactgattggactgggatcctaactaattagtgcatcacacctcacagctgctcatgatccattagttttgaggacctcttatctatgctatggtctcc

SEQ ID NO: 11510 - DNA, 201 bp, Homo sapiens
attaagtacttacatgtgtggtacagacactaggtgctcaggggtttggacaggcatcatggtgaaccagccctgaacgatgcttggtgaacgtcatcccrccacaaagcagattcccactttctgattctgcagtagggcagcaggtagatgaaaccaacactgggtaacttagattaaaaaaaaataattaattagcat

SEQ ID NO: 11511 - DNA, 201 bp, Homo sapiens
gagcatctgagaaaacacgctagatgcagccaaacctctttaaaccctggcaccaaggaacaagagtgggtcccccctctgcctttcttttccactcactstctatcatctagttgatcaacagacatcagtggggacattggggggtgggaggggatgtctgctccctgccgggcgggcactgtgctagcgtcaggggca

SEQ ID NO: 11512 - DNA, 201 bp, Homo sapiens
gtaacttagattaaaaaaaaataattaattagcatgtttcaagggtgctctgcaaaaagcgtgcatctgcaatgaataaggagagcctctctagggatccrtgaaggaggatctgacaggcagttacttcagcacacagcagtcagtgaatcggccctgaccttgtgtttttcctcctgtgttggaaatgtttggagaatg

SEQ ID NO: 11513 - DNA, 201 bp, Homo sapiens
ccccctctgcctttcttttccactcactgtctatcatctagttgatcaacagacatcagtggggacattggggggtgggaggggatgtctgctccctgccrggcgggcactgtgctagcgtcaggggcacaaaatagaagcagacctggtttcagtctgatgtgggaaagagctaaagtaaacacgcagtgaatttgctgc

SEQ ID NO: 11514 - DNA, 201 bp, Homo sapiens
caggtaaactgatatcccaagggtttgtagtacagattatttcagcacccaggtattaagcctagtacccattagttatttttcctgtctgtggaataagrttctcttgaaaactctggaggactaagaaaaataaggctgtggaaactcacctaggtgaggattcttcttgtattagtgtacaaagtaaaagctagatat

SEQ ID NO: 11515 - DNA, 201 bp, Homo sapiens
atcatctagttgatcaacagacatcagtggggacattggggggtgggaggggatgtctgctccctgccgggcgggcactgtgctagcgtcaggggcacaaratagaagcagacctggtttcagtctgatgtgggaaagagctaaagtaaacacgcagtgaatttgctgctgtttgggggatgagggggccagggggcttcc

SEQ ID NO: 11516 - DNA, 201 bp, Homo sapiens
taccgtttagtttgaatcccgtctctactagcttgctgtgtgatcttggacaagtcacttaacccatctgtgctctagtttacttatttgttaaaagggayaaaatagaactgacctcatagagttgttatgagcattaaattagttaatatattttatatgtttgaaacagggcatgtcacatagtaaggagtctataag

SEQ ID NO: 11517 - DNA, 201 bp, Homo sapiens
aaagtaaacacgcagtgaatttgctgctgtttgggggatgagggggccagggggcttcctggaggaggtgacactgccctgatttttgaaggactagttgsaattatctaggccaggggacatttggcaatatctagggtgggtttttgttttttttgttttgttttgttttttgttttttttttgagaaggagtctcatt

SEQ ID NO: 11518 - DNA, 201 bp, Homo sapiens
cttatatcactgagctccctgcaagcaagacccttgaggaacatgtggggtgggtgcccaggtgagctcaggcacagactctattgcaacccccatcctgyccaggtctccctgtttgttaccactgcctttcctggtctgagtctaggggttgtgccgtccttgggaattgagccgaatcacaaataaaagggcacttat

SEQ ID NO: 11519 - DNA, 201 bp, Homo sapiens
ggattacaggcgtgagccaccgcgcctggccggcaatatctaggtttttctgttgtccaaactggggataaggtggagttgctactggcatctagtaggtrgaggacagggatgcttgtaaataacctacagtgtgtgcaggacagccccctccaatgcagagttatccagccccaaatgttcgcagtgctggggttaaga

SEQ ID NO: 11520 - DNA, 201 bp, Homo sapiens
  misc_feature (1)...(201): n = A,T,C or G, or insertion/deletion polymorphism (see Tables 1-2)
gttttgaataggcaatacccacatgggattacaaaaattaaatcagcatctgtatgtgtctagcaagtattttttcttctaagcttccttcctggaggaantgctgtttcttgtacatcattttgtctgagtatgtatttggctaagcctttcaaaatcaccttctttatggatcaaagtggtcacttaccagcaaattga

SEQ ID NO: 11521 - DNA, 201 bp, Homo sapiens
tctaggtttttctgttgtccaaactggggataaggtggagttgctactggcatctagtaggtggaggacagggatgcttgtaaataacctacagtgtgtgsaggacagccccctccaatgcagagttatccagccccaaatgttcgcagtgctggggttaagaaacacaggtctagacaagaggaggaaaagtgctgtggt

SEQ ID NO: 11522 - DNA, 201 bp, Homo sapiens
caaaatcaccttctttatggatcaaagtggtcacttaccagcaaattgacatgattcacccaaattccagcataaatacgggactttatcagcacttgacrtataacgtattttcatctgtattagtgtattgcctgtctctctccatcagagtgtaagctaaatggagccagggcttgttttgtttactgctaaatctcc

SEQ ID NO: 11523 - DNA, 201 bp, Homo sapiens
ggtggaggacagggatgcttgtaaataacctacagtgtgtgcaggacagccccctccaatgcagagttatccagccccaaatgttcgcagtgctggggttragaaacacaggtctagacaagaggaggaaaagtgctgtggtttgaatgttagcgtccccctagaattcatatgttgaaatcttgatctccaaagtgatag

SEQ ID NO: 11524 - DNA, 201 bp, Homo sapiens
gttcgcagtgctggggttaagaaacacaggtctagacaagaggaggaaaagtgctgtggtttgaatgttagcgtccccctagaattcatatgttgaaatcytgatctccaaagtgataggctgaggtggggtggagcctttgggaggtgattaagtcatgaatgggattagggcaagccaggcaaggcaaaaatctctaga

SEQ ID NO: 11525 - DNA, 201 bp, Homo sapiens
gggtgtggtggcatgcgcctgtctcagatactcaggaggctgaggtgggaggatcacctgagtccaggaggtagaggctgcagtgaactctgatcactccrctgcacaccagcctgggtgacagtgcaagaccctgtctctaaaaaataaaaaccaataataaaagaaataggagtagagaagctgtcagatggagatgaa

SEQ ID NO: 11526 - DNA, 201 bp, Homo sapiens
ctcctgaaactctattactctgtcttttaatgttgtcagcattaggaaaagagtgaccttgacaccttgctccttctactgaacttacagctttcctcacratggtgcagaactaagtggttagtagagatacttgtggctggaaacatctcccctgaaaacagatataggaagaacaggtgcaagttcccatgggcgcaa

SEQ ID NO: 11527 - DNA, 201 bp, Homo sapiens
tccaggtcctctggaggttgagctcatgctatgtgattctaagcccccactctaaatcacactgttagactctctggtgtgacccaaggcccccacaagcaaaaaaacactcctatccaggcatgacattcccagggcttagtaagacaccaagggtaaagaccagacttctttttgggcgaggtttaattctttactatg

SEQ ID NO: 11528 - DNA, 201 bp, Homo sapiens
ttgagtctctctgacttcttctctgctacttctctgactccagctggagaaagttctctgtttttcaggggacttgtgagtaggatccatggaataaaccwggataatctctccgtttttaggtccataatcacttttttcatgtaacataacacattcagaggttccagggttaaaggtgtggacatctttgggggattc

SEQ ID NO: 11529 - DNA, 201 bp, Homo sapiens
gtgacaattacgttccactgtgacaaattctatacaaaaaaaaaaaaaaaatccaggatgttatggtagaggaaaccatggcgtcatatttacattcctgkgccttcagggaagacttcctgaaggtggatacctctgagctatacaccaaagatagctattgccaagttttcagcacaaataccatgcagctggtatatc

SEQ ID NO: 11530 - DNA, 201 bp, Homo sapiens
caggataatctctccgtttttaggtccataatcacttttttcatgtaacataacacattcagaggttccagggttaaaggtgtggacatctttgggggatycattttgcccattatatctgcctttttatggatttttagagtatttacacactttgttttaacttatttattggcttttaatctatacctctcatctcaa

SEQ ID NO: 11531 - DNA, 201 bp, Homo sapiens
ccccagcacttataaagacattattccactgtcttctggactctgtagtttctaatcttaagtctgtgaaaaatttgaatcattgttctctatatataatktgctatttttctcttgctaattttgagattttctttcttttgattttcatcagtttgactgtgatgtgcctagcatggttttctccacatttgtcctatt

SEQ ID NO: 11532 - DNA, 201 bp, Homo sapiens
agccagaggatgagaaattatggtttaggagtcatgcagttgaaggctgcaagactctaaacctccccaaattgctcctggggataacatcactattgtamaacctaagatcggtacttgagatattttgcagacccttcatctgatggatcagttagcaccacccagattgataaactggctcatctggccttgtggccc

SEQ ID NO: 11533 - DNA, 201 bp, Homo sapiens
gtcttagcaggtaactaacctggttatacttacatttccatatctgtctctcaggtggaggcttagttctcagtcctgttgggtttaaatgcaaactactytgagccttgtctactcaccctttgttcaaggactggccagaggcttgggcagagtttacatatacatgccaagaattcccttctctaagtctcctctttc

SEQ ID NO: 11534 - DNA, 201 bp, Homo sapiens
atattcttgctacaagatacaggagctagaaacaagaatcattttattgtcagtcacagttctgtgggttgactgggctctactaggtggtttttctgctscatgtaataacagctgaggctacagttccctgagagcacagttgggctgaaatgtatgagatggctcatgacatggctaagtggatggagctggctattg

SEQ ID NO: 11535 - DNA, 201 bp, Homo sapiens
agttgggctgaaatgtatgagatggctcatgacatggctaagtggatggagctggctattggcttgggggcgtagctcactgcctaatgtaacctttttawgtggcttggatttcacaaagcatggtggttgagttttgagttgacatacccaagggcaattgttatatcagggaagaagtggaagcttctgttttactga

SEQ ID NO: 11536 - DNA, 201 bp, Homo sapiens
  misc_feature (1)...(201): n = A,T,C or G, or insertion/deletion polymorphism (see Tables 1-2)
attggcttgggggcgtagctcactgcctaatgtaacctttttaagtggcttggatttcacaaagcatggtggttgagttttgagttgacatacccaagggnaattgttatatcagggaagaagtggaagcttctgttttactgaaaattaggcttttctattggtcacatagtcactgtgctggtcagattcaagaggaga

SEQ ID NO: 11537 - DNA, 201 bp, Homo sapiens
aacaaaaccaggaactgtgctaagttatatatattatatatgtatataatatataatatatatacatattaatagagaataagtttgctatactctctctmtatatatatattatattctctatttttatatataaattttgtcctcactgcaacaatattaggtaggctatgtaatcattattatcttcactcaagaagt

SEQ ID NO: 11538 - DNA, 201 bp, Homo sapiens
  misc_feature (1)...(201): n = A,T,C or G, or insertion/deletion polymorphism (see Tables 1-2)
cctctccccttccccccagtcttgcctctcaaatgactatctacacaactctttgtcttctccagaaaggcttcctttatttcccagggtgaatgagcctntcatctctccattattccatagcattctgtaatactttaacatttactacattgttctgaaatcataaaatctatttgtctgtctcaccaaccagtctgc

SEQ ID NO: 11539 - DNA, 201 bp, Homo sapiens
agttaaattattcacctggaggcctagcaggttgtatcctgaaggctgaagtcaagtgcttactcaaacattgaatttgagctgcttttttctgtatcagsgatcccaatgcttggtgcagaacaagaactcgagatttctttgacgtcaaggttggctctacctagagtgtgattcttgaactgtagtgtgtataagatt

SEQ ID NO: 11540 - DNA, 201 bp, Homo sapiens
gttctgcccttttattcccatgtcttgttccaagcttgggtgggtattgggggcaggggtaagggaaagcaaggtcagaaaaacataataatgaccaaaawaaaaaaaaaaaaaaagacaaaactccaaaaaacaaaaccaggaactgtgctaagttatatatattatatatgtatataatatataatatatatacatatt

SEQ ID NO: 11541 - DNA, 201 bp, Homo sapiens
tagactttatcttagggaaggggaaacattaaagtgttttaagcaggttttaagtaacttagtccaatatactttttagaatgatcactctggataatgcrtgtcgggtgcggtggagggtggcagggctgcacacggcggggagaggcttcaaatgcgggctgttagtgcatgcaagcggagaagtgatcaccatgtttc

SEQ ID NO: 11542 - DNA, 201 bp, Homo sapiens
tactttttagaatgatcactctggataatgcgtgtcgggtgcggtggagggtggcagggctgcacacggcggggagaggcttcaaatgcgggctgttagtrcatgcaagcggagaagtgatcaccatgtttccacaaaagaacttagaattggtttagttaatgcagtgcaatggaatgcagttatacaacagggtcgttt

SEQ ID NO: 11543 - DNA, 201 bp, Homo sapiens
gaggagagatggtatgaagatgcatacaatcttaaaaaaaataatactggccaggcacggtggctcacgcctgtagtcccagcattttgggaggccgaggygggcggatcacgaggtcaggagatggagaccatcctggctaacacagtgaaacgccatctctactaaaaatacaaaaaaaaaaaattagccgggcgttgt

SEQ ID NO: 11544 - DNA, 201 bp, Homo sapiens
catacaatcttaaaaaaaataatactggccaggcacggtggctcacgcctgtagtcccagcattttgggaggccgaggtgggcggatcacgaggtcaggasatggagaccatcctggctaacacagtgaaacgccatctctactaaaaatacaaaaaaaaaaaattagccgggcgttgtggcgggtgcctgtagtcccagc

SEQ ID NO: 11545 - DNA, 201 bp, Homo sapiens
gttcagtacgctagtcaaagagggccacgaggcaggaaatgattaatttgaaaatgattggaacaggctgtaattggtaatgagaaatgtgcatttgctcttttttttttttttttttttttgaaattgaagtctgctttaccatgttgatttcctctaaaaagaggtattgtttgggcaaagggcagaaggaaatctttt

SEQ ID NO: 11546 - DNA, 201 bp, Homo sapiens
cacttgagcctaggaatttgaggctgcagtgagctctgattgtgccactgcattccagcctgggcgacagagcgagatcctatctcaaaaaaaaaaaatawatatatataaagaaatccatcaactcacacaaaaatgttgttgatgggactttgcattattcttataattaagaaaagcaaaatgaaaattcagtaagca

SEQ ID NO: 11547 - DNA, 201 bp, Homo sapiens
aggcaggcggatcacttgaggtcaggagttcgagaccagcctggccaacatggtgaaaccccgtctctgctaaaaatacaaaaattagccaggcatggtgrcaagcacctgtagtcctagctactgggaaggctgaggtatgagaattgcttgaacccaggaggcagagtttgcagtgagccaagatcataccactgcact

SEQ ID NO: 11548 - DNA, 201 bp, Homo sapiens
cttgagcctaggaatttgaggctgcagtgagctctgattgtgccactgcattccagcctgggcgacagagcgagatcctatctcaaaaaaaaaaaatatawatatataaagaaatccatcaactcacacaaaaatgttgttgatgggactttgcattattcttataattaagaaaagcaaaatgaaaattcagtaagcaaa

SEQ ID NO: 11549 - DNA, 201 bp, Homo sapiens
  misc_feature (1)...(201): n = A,T,C or G, or insertion/deletion polymorphism (see Tables 1-2)
caaacatctatttcttatagttctgtaggctgcttaagtccagggtcaaggcaccagaagattcatgtctggtgagggcctgcttcctttttcatagatgnctgtcatcattttgttttgttcttcattggtaatggaaggggccgttgatctctctggagcctcttttatcagggcatgaatatcatttatgagggcttg

SEQ ID NO: 11550 - DNA, 201 bp, Homo sapiens
ctgcctcagcctcccgagtagcagggactataggcatgtgctaacattccggctaattttttggatttttagtagagatagggtttcaccatattggccargatggtctcgcacttctggtctcaagtgatcagccttcctcagcctcccgaagtgctaggattacaggcatgagccaccatgcccggccctgagccagtt

SEQ ID NO: 11551 - DNA, 201 bp, Homo sapiens
tgagcctaggaatttgaggctgcagtgagctctgattgtgccactgcattccagcctgggcgacagagcgagatcctatctcaaaaaaaaaaaatatatawatataaagaaatccatcaactcacacaaaaatgttgttgatgggactttgcattattcttataattaagaaaagcaaaatgaaaattcagtaagcaaaac

SEQ ID NO: 11552 - DNA, 201 bp, Homo sapiens
accagtctgaaggcagataaacacaaagcctttgtctatgggacacttatgatttggttgcagagaaggtggaccttcacactgccaatctcagttctcayggccgcctggcatcaggaaggcattaatctctgccaaggctctgtcctcttcacctttcagcaggtgttccttgctggttgtttggcccggttgatagga

SEQ ID NO: 11553 - DNA, 201 bp, Homo sapiens
tatcctaggagcctggtgtgcttaaaagcatggtgtagtcatgggttcgagaaactctccactgggtaaggacactggatatatggacacaagaaactctycattggttaaggacaatgataaggaaactctccattgggtgaggacactgaactctttcacatgagcagagacttatgttaggagttgcagctgggagtc

SEQ ID NO: 11554 - DNA, 201 bp, Homo sapiens
aggggaatctcttgaactagggaggaggaggttgcagtaagccgagcttgggccactgtactccagcctgggcctgggcaacgaaaagagactctgtctcaaaaaaaaaaaaaaaaaaaaagggggtcttgtcactgagtttcctcatcttgcctctgcctctgagcacatttttccttctgcttctccaccataatgaaa

SEQ ID NO: 11555 - DNA, 201 bp, Homo sapiens
tatccacagttggtgcaatgtcatgaaccacatgtaccaagacctgtgccacagactgggggtacaaggagaataaaacaagatccctgccctgaataaastcacctcccagtgacaattacgttccactgtgacaaattctatacaaaaaaaaaaaaaaaatccaggatgttatggtagaggaaaccatggcgtcatatt

SEQ ID NO: 11556 - DNA, 201 bp, Homo sapiens
agatctgtggatcacaaactaatcaaggagacaggagccttgtgttatccacagttggtgcaatgtcatgaaccacatgtaccaagacctgtgccacagaytgggggtacaaggagaataaaacaagatccctgccctgaataaactcacctcccagtgacaattacgttccactgtgacaaattctatacaaaaaaaaaa

SEQ ID NO: 11557 - DNA, 201 bp, Homo sapiens
aataaatctttgagcttattttctatatggtggtgtattgaatttgcacctttcatctgaagacctaggaactaccgcagactgggttttccctcggggakactacaaggttgggcttccagtgccagagcgatgatcaggcagacataaactggacatgggtcagacaagagctgcaagggcatcagcagttataaataa

SEQ ID NO: 11558 - DNA, 201 bp, Homo sapiens
catggcaccggttaggagctgagctgtttggggttagagagcgagtttgatcaacatttacgctgttgagtttggccaggggtaacatttgtgagactccsgctaattctggaaatctgtcattctttgtttccaacagcaaaatggagctaatgataatacccaccccttggggttcctgtgaggatattaaagctacta

SEQ ID NO: 11559 - DNA, 201 bp, Homo sapiens
gcatggcaccggttaggagctgagctgtttggggttagagagcgagtttgatcaacatttacgctgttgagtttggccaggggtaacatttgtgagactcycgctaattctggaaatctgtcattctttgtttccaacagcaaaatggagctaatgataatacccaccccttggggttcctgtgaggatattaaagctact

SEQ ID NO: 11560 - DNA, 201 bp, Homo sapiens
cttcagttgacagaaagggagagttagagatgaacctaatgccctgcttaaatcagagggcgaagtgatatgaagtttgaatttaggaaggactttttttrtctctctctaatggcctggagatatcctacaggctatgctgggtactttgcatagactaccttcaagatgcagagaaaggaaatgcatctaatgctgtta

SEQ ID NO: 11561 - DNA, 201 bp, Homo sapiens
taaaaaagaaactgaaaagcagtgagataattttacttgctgaaaagaggagctatttcttggcatgtagaactgagcaacacagcataggttaccttggrgttacaagagaagcatcacacccaaatggctgaagcccctggccagagataagaactcagaggcatctccccaacctgggagaccaggctccatgctttc

SEQ ID NO: 11562 - DNA, 201 bp, Homo sapiens
ggatgctcaagttcctgatataaaatggtgtagcatttgaatataatctatgcacatcttatactttaaatcatctctagtttacttataatacctaatgsaatataaatgcgatctaaatagttgttacaccgtatggtttaggaaacaatgacaagaaaaaaaagtctgtatatgtttagtgcagacaccattttctcc

SEQ ID NO: 11563 - DNA, 201 bp, Homo sapiens
tagacaaagagagaacagcatcatggtcaggagaagtgggctggcgacttcctcccctgtttcactgagcatggcaccggttaggagctgagctgtttggrgttagagagcgagtttgatcaacatttacgctgttgagtttggccaggggtaacatttgtgagactcccgctaattctggaaatctgtcattctttgttt

SEQ ID NO: 11564 - DNA, 201 bp, Homo sapiens
  misc_feature (1)...(201): n = A,T,C or G, or insertion/deletion polymorphism (see Tables 1-2)
ggacttaaagaatggcatttctggctttgaagtaaaggtgaacaggggatcccataagtcccatctatctcatgcattttgtgattttcaaaaaaatgatngtggggtttgaagaagcagaagaaagaccataaaggtcaaacccttctcatatctgggggccagaacaaaagatactgagaagaacaagaatgcctaatt

SEQ ID NO: 11565 - DNA, 201 bp, Homo sapiens
atacaaaatcaatgccaagagatgaagtgactagtctacgtagacaaagagagaacagcatcatggtcaggagaagtgggctggcgacttcctcccctgtytcactgagcatggcaccggttaggagctgagctgtttggggttagagagcgagtttgatcaacatttacgctgttgagtttggccaggggtaacatttgt

SEQ ID NO: 11566 - DNA, 201 bp, Homo sapiens
  misc_feature (1)...(201): n = A,T,C or G, or insertion/deletion polymorphism (see Tables 1-2)
ggagcctggtgtgcttaaaagcatggtgtagtcatgggttcgagaaactctccactgggtaaggacactggatatatggacacaagaaactctccattggntaaggacaatgataaggaaactctccattgggtgaggacactgaactctttcacatgagcagagacttatgttaggagttgcagctgggagtcaggcaga

SEQ ID NO: 11567 - DNA, 201 bp, Homo sapiens
gagaccggcattaaactgtgttcgttcaaccctgaatccaccactttctaggggtgtgcctactggaaagttttcattttccttggtgcctcagttcctcrtctgtgaaatggggataatgatagtatttacctttgaaggtgggttgcaagggctgaaagttaatttatataaagcacttggaacacatggtaaatgtct

SEQ ID NO: 11568 - DNA, 201 bp, Homo sapiens
cagttcctcgtctgtgaaatggggataatgatagtatttacctttgaaggtgggttgcaagggctgaaagttaatttatataaagcacttggaacacatgstaaatgtctggctgttttgatgagaagattcaatgagatactgacttttcataatgcaaaaggcgctaaaagaaactcagcagaggtggcatttagatca

SEQ ID NO: 11569 - DNA, 201 bp, Homo sapiens
  misc_feature (1)...(201): n = A,T,C or G, or insertion/deletion polymorphism (see Tables 1-2)
attgcctgagaagaccctggtgcttggagggtaagagtgaaggaggtcagagcagaaccgtgctgagaccctcaggccacatttgggtgttgcatctttgntataagagcagaaagaaaccactaaagattttaaagccagggtggatggtggtgaacatgagatttaccttccagaagcatcctctggtggccacgtgga

SEQ ID NO: 11570 - DNA, 201 bp, Homo sapiens
ggtggatggtggtgaacatgagatttaccttccagaagcatcctctggtggccacgtggagaactggctgcaggggagaggagtgcaggcagtaagttacrgttgctaagaaacattcaccattccatgggtaattattgtgcaccactgtctacgggctctctgctgggtgccaggaacgcagcactgaccacgacaaag

SEQ ID NO: 11571 - DNA, 201 bp, Homo sapiens
  misc_feature (1)...(201): n = A,T,C or G, or insertion/deletion polymorphism (see Tables 1-2)
aggaacgcagcactgaccacgacaaagcccctgccttagagagatgacgtttctgtataaggacagagacggcaaatggacaagcaagtgaatgaatgtgncaggaagcagtgtggctgggaagaaatacttaaaagcagggcgagagactagagcatattggctgccatttaggcaggaaaaacctcttgtgctgacatt

SEQ ID NO: 11572 - DNA, 201 bp, Homo sapiens
taaaaagaagggaaagatgagagaggcccctttataactcatcaatgtaaaaaacacaaaataaaaagtcttgagcttaagagagaatgcagtagaaaacrtcaacaagaaaacctttctgtctgaaaacgcctgatccttgtgtgagacctttccaggatatgtgggttttcaggtagcatcttcacccccagggcaaca

SEQ ID NO: 11573 - DNA, 201 bp, Homo sapiens
  misc_feature (1)...(201): n = A,T,C or G, or insertion/deletion polymorphism (see Tables 1-2)
ctaacctgaggttcccacccaacttgattactttataactttctccatcttcctcctcctactgaactctgctgggttttaaagccaatgggctttttttnccttagcttcgtaattcaaaggataatggtagatgctataacaaataagccctcaaatatcagtggtataacatagtagaagtttgcttcctgctgatgt

SEQ ID NO: 11574 - DNA, 201 bp, Homo sapiens
  misc_feature (1)...(201): n = A,T,C or G, or insertion/deletion polymorphism (see Tables 1-2)
taacctgaggttcccacccaacttgattactttataactttctccatcttcctcctcctactgaactctgctgggttttaaagccaatgggctttttttcncttagcttcgtaattcaaaggataatggtagatgctataacaaataagccctcaaatatcagtggtataacatagtagaagtttgcttcctgctgatgta

SEQ ID NO: 11575 - DNA, 201 bp, Homo sapiens
aactttcagatgaagtgactgagccataggggagttaagggaatttgccaagaccacatagtggctgatgtagctaggtagctgaatttctgatcccaagstgtgatcttccattccactaaatcaagcccatactttaatgatgtcatccatcttcaggagggacaagggatcagtttcattttgtgggaggggctgagc

SEQ ID NO: 11576 - DNA, 201 bp, Homo sapiens
gaggcagggagaattgcatgaacctgggaggtggaggttgcagcaagccaacatcatgccactgcgctctagcctgggtgacagagtgagactttgtctcaaaaaaaaaaaaaaaaaaagaaggaaaattaaaatcaataaataagaggtgaaaataatgctcgatgtagatgaagttctaatcttatcttggcttggcca

SEQ ID NO: 11577 - DNA, 201 bp, Homo sapiens
tgacgccagctgaatggcttcagaggacatgcatcatttgtgaggctcctaaaggtgggagctgtgcgcctgtgatttcattactggaattagagtgccgyctttcatttttctattaattccactgatggtattagtcgtgttaaaaagacagcacaaacttggctctaagtgttcttggatgctgaatgccaccagcac

SEQ ID NO: 11578 - DNA, 201 bp, Homo sapiens
aatccttggaggccagaatgtagtctcgattcttcttcaggttggtgtgggagacgatggccactagctcatggcgatcattgaccataggcagcttcccytgctaggctgaaggatctcatttgcctgtttcaatgtcatgcctgctggagccaccatcagcttgatccttggcgtcatcacctcactgaggagggtggt

SEQ ID NO: 11579 - DNA, 201 bp, Homo sapiens
catcctactgaatcagaaagtgaggggcagggattgtcagtctgtgttttaacaagccttttgggtgattctgatcgaggcttatacactgttggtgggaytgtagattagtgcagctgttgtggaagacaatgtggcaatttctcgaagacctaaagacagaaatattcaacccagcaatcccgtttccaggtatatacc

SEQ ID NO: 11580 - DNA, 201 bp, Homo sapiens
atacaaaaattagctgggcatggtggcacacacctgtaataccagctactcatgaggcagaggcaggagaatcgcttaaaaccaggaggcagaggttgcaktgagtcgagattgtgccactgcactccagcctgagggacagagcgagactcaatcacacacacacaaagaatacattatactgcgttggtgtaccatcgt

SEQ ID NO: 11581 - DNA, 201 bp, Homo sapiens
  misc_feature (1)...(201): n = A,T,C or G, or insertion/deletion polymorphism (see Tables 1-2)
ggaggtggaagttggtgctcttgtaacctggcagctccagagtttggatgcgagtgatgggccttcccattaaacactgagagctctcgaaaagggcagangcacagatcggaatgttggtggagcccactcagctcctgctaaagaggcatcaggtagttcctgggagagtggggagacctatctttagtcttttccatg

SEQ ID NO: 11582 - DNA, 201 bp, Homo sapiens
ataactagtatctttaagaataaaggacagaatgattcataaagaaaacacgtgtggcaagatttagacaaagaatagaatgggccagggttcacagaagmctcagccatttattcatccagcaaccagcaactctttattgagtacctcgattctgcttggtccctaaaaggtaacacttgagtgagaacctgaagactg

SEQ ID NO: 11583 - DNA, 201 bp, Homo sapiens
tcctaaaatcgaaacgtttctagtaattcacatatataaatttatatcacacgtgtatatatacacatatgtagacatacatatacacacgtgttatgtaygtggtatatattcttatgtatgtgtatatatatacatacatatatattcttaggtgtgttgggtagataagagaatggtcaaggagaaatacgagacata

SEQ ID NO: 11584 - DNA, 201 bp, Homo sapiens
aaaatatctaatcctaaaatcgaaacgtttctagtaattcacatatataaatttatatcacacgtgtatatatacacatatgtagacatacatatacacaygtgttatgtatgtggtatatattcttatgtatgtgtatatatatacatacatatatattcttaggtgtgttgggtagataagagaatggtcaaggagaaa

SEQ ID NO: 11585 - DNA, 201 bp, Homo sapiens
tccatgttggtcaggctggactcaaattcccgacatcaggtgatccacctgccttggcctcccaaattgctgggactacaggcctgagccaccgcacccgsccaagaaggtacatttttattagtgcttctagtgattcagatgtaggtagtccatgtctttgagaggttagttagttgactattgagaaatggagttctg

SEQ ID NO: 11586 - DNA, 201 bp, Homo sapiens
  misc_feature (1)...(201): n = A,T,C or G, or insertion/deletion polymorphism (see Tables 1-2)
ttattttctttgtagagctgtatttttttccttcatagaattcaacaaaattgataaatatatatttacttgtatgatttatttattgtctatatatccanttgggaagaggccttggatattttgctcctcatctagtggaggccccagaacatttatattggaagggcctaagtgccaccaacatagttacaagtggca

SEQ ID NO: 11587 - DNA, 201 bp, Homo sapiens
  misc_feature (1)...(201): n = A,T,C or G, or insertion/deletion polymorphism (see Tables 1-2)
aaactttttttgcagacctatatgcattctagttttctcctccaagaagcagccccttaagttcaaccaagtttatgtttgggtttttataataacagatncagatatagaaacagaattgtgttgtgttggccaacaatatctcaaatataacatgatacagaatgaagatgaaatcctcctttctaaggccccttacat

SEQ ID NO: 11588 - DNA, 201 bp, Homo sapiens
atatagcattgtaagtttataatttttcagtattccattaatggtggcatccacttatttgttcgattgctctaattctttcctaaaaatttgtctttctstcttcccctttctagatttatggtcaatgttacatgggatggcaaagacttatccttcactgaggaaggctaccaggtgcaccccaggctggtggtgatt

SEQ ID NO: 11589 - DNA, 201 bp, Homo sapiens; identical to SEQ ID NO: 1340

SEQ ID NO: 11590 - DNA, 201 bp, Homo sapiens; identical to SEQ ID NO: 1341

SEQ ID NO: 11591 - DNA, 201 bp, Homo sapiens
gacacacacatgcaaggcagaattaattccttccagctttgtatacttggagcactttaaaaactactttgagttactactcattcattcactcaacaaatatttattaagtgcctactatgggtcagccattgatcttggctctggggatactcctgtgaaaaggcaatgccctgcacccatggagtttttcttcccaat

SEQ ID NO: 11592 - DNA, 201 bp, Homo sapiens
  misc_feature (1)...(201): n = A,T,C or G, or insertion/deletion polymorphism (see Tables 1-2)
attccctcaaactgtactttcccagaacttcagctctccccaccagagggtaagcatcactgtagcaggcactttgcacgttttgtgcacctctgtacccncactgccttgatcagtgtggtcagacaggcactgaaaaatgcctgtgaaatggattcttctttttgttgcttatgaaatctgcaactgtgagttgagtgt

SEQ ID NO: 11593 - DNA, 201 bp, Homo sapiens
cctcccatagtgttaggattacagggattagccactgcatccggactgcctaactgaattccaaaattgtttggatgtggtaacttgttttttcttttcawtgattccttttttgatcaaaaacccctgtaactgatatcccatgcctgttccacaattgcatctggggagcagataatccgttttctagttttacaggtc

SEQ ID NO: 11594 - DNA, 201 bp, Homo sapiens
cgtcagtaatgaaatgaatttcatttattatgtagtgaagagtcttaaggtatggtgaccctaaagttgcttaggttaactgaggagccatggctttaagaaaaaaaaaaaaacaatttaaaaatgtatttcatccttttttattggctgcatcctcagggtggtgataagatgtgatctagatatgccagcaaccagaaa

SEQ ID NO: 11595 - DNA, 201 bp, Homo sapiens
aactgatggtgaagctgtgtcccactttgaacctctctctcacgtagccagagcagtgcagattcggagtcttaggagcagaacattcgggagccagtgcaaaaaaaaaaaatttgcaagaggcctgagagagagcctgctgtacaaaaggatgtaaaccagccagagacccttggtaaacataagaaggaagaacatatt

SEQ ID NO: 11596 - DNA, 201 bp, Homo sapiens
gtcttttctggctttggaagcaggtttagcccacctgcagggggagtgaaggtgctggaagcagccaacggtagggatttgtggataagcactccagtcckttgtcttgtaggcaggataactgtgatgtagagtagatatttcatgctatatcccagatgtctctagtgatcttaaggcccagttgccttaagcagtcac

SEQ ID NO: 11597 - DNA, 201 bp, Homo sapiens
  misc_feature (1)...(201): n = A,T,C or G, or insertion/deletion polymorphism (see Tables 1-2)
aggtgaaagcattaggtcattgcagacctccaggtgtgggtgatatggctcaaactaagatggagaaaataggaacacctgtcagcatgtgtagggggcangaatgtgactttagagtcaggcctgctttcaatccagcctcctcatttaagcaagttactttatcttctctgagcctcatttttgttctccttttaaatg

SEQ ID NO: 11598 - DNA, 201 bp, Homo sapiens
ttataagaatggtcatcatcttggctatttcagatggggaagtacgcatgcctcattttatccaagtttctcacagttctataagtcttttttcacacacagttccatacacaaaaggtggctttgcaaaaaacttcttttaacatagctggcaggctatactgtacatatatctatacacatgtatgcatgtatgtgcat

SEQ ID NO: 11599 - DNA, 201 bp, Homo sapiens
ccggcttccatctctagagaagactcgggatgaactctgaattcttctagaccccagctaccagttcggctccagacccagagtggcactgctttaatctyggcaaagaagactaaagacttttttgtgtaacgaattaaaagtttgcttcaggcttcttttattttatgcctctgctgcactctcgtaacatttagcacc

SEQ ID NO: 11600 - DNA, 201 bp, Homo sapiens
aagctagagaaaaatcagctgaggctcctggagaatgaaccaggtcagagtgagtgatggttggggggaaaacggactggactcagtggatgtatagaatwtcaatagtggagctgggggaagattggcacatgggatccatggagttgaaccatcattatgtccacgttaaatgctaactttggcaaaaataaaccattt

SEQ ID NO: 11601 - DNA, 201 bp, Homo sapiens
gtgaactgaacatgaaaccaagaagggtgatcaagctagagaaaaatcagctgaggctcctggagaatgaaccaggtcagagtgagtgatggttggggggraaacggactggactcagtggatgtatagaatttcaatagtggagctgggggaagattggcacatgggatccatggagttgaaccatcattatgtccacgt

SEQ ID NO: 11602 - DNA, 201 bp, Homo sapiens
tcacaattgcagtaaggatgaaagaaagccacatatgtaaatgtatcttgtagcatatgaatccctctgcagacatgaagcgctattgtgcaagtctgtcrcattatgggatcaaaagtgcaattcctagaagtgattggaggtatggtggaagcagcaggaagcaatgtcctggaagagaggatttttcaagaaagtggt

SEQ ID NO: 11603 - DNA, 201 bp, Homo sapiens
tttattcctcagataatgagcagtgtagaactgtgattaagggcctcaactctggagttagacttgtctgggttcaaagcttgtctcgtccactttctgtwtgacttgcacatcattttacttttctgggcctcaggtgtttattgcaaagtgatgataatagcacctaatttctaggcagtggttctcaagcctcagcag

SEQ ID NO: 11604 - DNA, 201 bp, Homo sapiens
  misc_feature (1)...(201): n = A,T,C or G, or insertion/deletion polymorphism (see Tables 1-2)
ccagctaccagttcggctccagacccagagtggcactgctttaatctcggcaaagaagactaaagacttttttgtgtaacgaattaaaagtttgcttcagncttcttttattttatgcctctgctgcactctcgtaacatttagcacctccccctgttgtcatatcatttatcatatcgtggagtttcaggtgtcttattt

SEQ ID NO: 11605 - DNA, 201 bp, Homo sapiens
tcctcctacactctgcgctcacaagggacatggaaacctgtcctgtttctcctcataccctgccgtcgactgcggcccctgcacacagtggggtctacgawgttgatgggagccaagggattgttgtactgattttttaaggctggatatttatttttcggtatgctttgcactttttgcctagggaatcaggactcagta

SEQ ID NO: 11606 - DNA, 201 bp, Homo sapiens
ccatcttttagggtatggctatggggagagttctgacctcagcactattgcttgtcaagaaggtgacatggatttaactagcggaagagtgggtttatcawtaaaggcaatggtgaactgaacatgaaaccaagaagggtgatcaagctagagaaaaatcagctgaggctcctggagaatgaaccaggtcagagtgagtga

SEQ ID NO: 11607 - DNA, 201 bp, Homo sapiens
cctacactctgcgctcacaagggacatggaaacctgtcctgtttctcctcataccctgccgtcgactgcggcccctgcacacagtggggtctacgatgttsatgggagccaagggattgttgtactgattttttaaggctggatatttatttttcggtatgctttgcactttttgcctagggaatcaggactcagtacaga

SEQ ID NO: 11608 - DNA, 201 bp, Homo sapiens
  misc_feature (1)...(201): n = A,T,C or G, or insertion/deletion polymorphism (see Tables 1-2)
tcttttcactgtctccatagttttgccttttccagaatgtcatatagttggaatcatacagtatgtaaccttttcagattggcttctttcacttagaaatntgcatttaaggtccctcaatgtcttttcacggcttgatgtcacacttcctttttgcgttgaataatattctattgtctggatgtaccatcttttagggta

SEQ ID NO: 11609 - DNA, 201 bp, Homo sapiens
gtcgactgcggcccctgcacacagtggggtctacgatgttgatgggagccaagggattgttgtactgattttttaaggctggatatttatttttcggtatsctttgcactttttgcctagggaatcaggactcagtacagaaacttgtctctgtcatgtgcgcaccctggagaatccaatcattggaaaaaataaaaatac

SEQ ID NO: 11610 - DNA, 201 bp, Homo sapiens
aagggattgttgtactgattttttaaggctggatatttatttttcggtatgctttgcactttttgcctagggaatcaggactcagtacagaaacttgtctytgtcatgtgcgcaccctggagaatccaatcattggaaaaaataaaaatacacatagagaacaccattccttcccataaccacgtaaaattgtgctcgtgc

SEQ ID NO: 11611 - DNA, 201 bp, Homo sapiens
gcctgctttgtctgctttgtaaatttgggagtcacaattgcagtaaggatgaaagaaagccacatatgtaaatgtatcttgtagcatatgaatccctctgcagacatgaagcgctattgtgcaagtctgtcgcattatgggatcaaaagtgcaattcctagaagtgattggaggtatggtggaagcagcaggaagcaatgt

SEQ ID NO: 11612 - DNA, 201 bp, Homo sapiens
gtaaggtcaccttgctttcctctccatctgagggttggtcttaactgctctcctttcaggaggaagagattcaggtgcctctcattgagatccatcaactygaatgcacaaaagccagaaggttttttctctttaactcaaattgtcctctttctcaaagtttttgaaacagaacattaaggttagctctcctagacctaa

SEQ ID NO: 11613 - DNA, 201 bp, Homo sapiens
actgctgccagagataatgtggtaaatcaaatagagattttctatcaggcagtttagaatttagttgtgaaaataacatgtagacacacaaactaataatmacagattataataaatatcaagaagaagaaaaaaacatagtgacatgatagtgatggggtgcagacactacgttagataagatggtccaatgggaaagga

SEQ ID NO: 11614 - DNA, 201 bp, Homo sapiens
gctgtcattttcctccttgttctttccaaccctaggggctttgtcctcatggttccctatgcctggaatgctcttcccactattctgcactggttgacgargacttcttcacaacttggcttttggggcatttcctttgagagggcttcgtgacagtcctgctaaccttttccataggagccctcatgtcattagctgtac

SEQ ID NO: 11615 - DNA, 201 bp, Homo sapiens
gttagctataactcattaaaaggatcccactctagccagggtttatgtcatacacgttatgccattttgagtgggctttcctcagtgggcactaccttctmaatgggtgttatcagaaaagtgtcaggaccaaatctctttcccaaaaaatgacttgatatggtagaggatggaacttgaagtctcatatcccccaaaaag

SEQ ID NO: 11616 - DNA, 201 bp, Homo sapiens
cagtgagtcgagattgtgccactgcactccagcctgagggacagagcgagactcaatcacacacacacaaagaatacattatactgcgttggtgtaccatygtatgaatggttttgggtcactgatattgcttgtaataccagaaaagtatggtttatgtacttcaactgatggataaaacaaaatgaaatattttaatct

SEQ ID NO: 11617 - DNA, 201 bp, Homo sapiens
tgaaaccaatttgtggacaccaactccaagcccattgtcttattcttccactgtcttcatttatatgtaatgttggcatccagtgaaactttcatgtttcrttctcttcagtgaaatattgactaacaggattttggacactgccttacattcagagcgctatggatttactgttttcatttttgataatccatttaagct

SEQ ID NO: 11618 - DNA, 201 bp, Homo sapiens
ccaacctggggctcccattctcctgtgcaccctggagtggagctcccgctatcagccacaggggctgaggatccgcactgggggcgtcgtgggcatcgggmttcagcttcccccctcttgtctagcccccctgggcgcataggggggcttgtgagcactgcagactgcagccttcccctcaaccctccctcccctcgttgg

SEQ ID NO: 11619 - DNA, 201 bp, Homo sapiens
acccagtagtgaaattgctggatcaaatggtagatctacttttagttgtttgagaaatctcccccctgggaaaacagttatattaaagtcaactaactttmttatatttttccagagacaaaaataactttatctcttaaagcaaattgtaaactgaaaccaatttgtggacaccaactccaagcccattgtcttattctt

SEQ ID NO: 11620 - DNA, 201 bp, Homo sapiens
cgcgctccgcggcgcttacccaggaacgtcgaggcctcttggagttcgcctcaacttcccccggctccagcagcgtccgtcccgagaggcgcgcgtcaggrcacgcgtgcacgaccgtgctggtatttgcaggtacgcagggctgtgcacctgccgcagttcatgcgtgtgcaccacctgaggacatgtgaggactccggc

SEQ ID NO: 11621 - DNA, 201 bp, Homo sapiens
aacatagtaaagcattatttttgtctttaaaggaaagtgttgtattaactgtttggttatcataaatgagttttgactgtaactatcttgttgaatatcaygaaattcagatcactaattcccccttggcactcccatataagtgggtttgtcccaaattagggaaggttaagacaaacgtgaatctctggaggaaaactg

SEQ ID NO: 11622 - DNA, 201 bp, Homo sapiens
ttcagaagctcccaatgctatgcctggtggtttccatttgtattcaaacccttccctgcccatggtcttctcttctatttgcttcttgtctgttttgatasaaatcaataatttccctcatcttgctcctgcatttagaaaagtgaaccaactgtccagtttccctgcttcattgacacacagaggttaacatctcgggga

SEQ ID NO: 11623 - DNA, 201 bp, Homo sapiens
tatgtctgttctcaaatcccagtaggaaaggtctgaactaaggataatttaaagacagtgaagtctgggttgcagcattacactaataagtgttgactatrtagcaatgatcatagaagtttgcctaaacttcctaattgtgtaccatagtcattgccatatgaacgaaccctctgtattttcatgtactcagtcttttgc

SEQ ID NO: 11624 - DNA, 201 bp, Homo sapiens
gaaaactcctgaagccatctttgccactggtcattccagtcacagaagcttatgtatctctattgtttaagatggtttgaattttctgtcacttgcaaccrggtgaatcctacctgatagatgcacccaggtagtagataatagagccacaatttaaacccaggacttcatggttccaatattggtgccatttcttctcct

SEQ ID NO: 11625 - DNA, 201 bp, Homo sapiens
  misc_feature (1)...(201): n = A,T,C or G, or insertion/deletion polymorphism (see Tables 1-2)
gaagacagagcaggtttgacccacacctgctctttagtaatttctgcatagaaacttgtttgtgcataccacacaggggaaaattgagttccaaagtgacncttgatttcagcagactggttttctgggatactctttagatcaggtattggtttaaaaaacatcactgaactcaactgcaaagtcctccagatacagcat

SEQ ID NO: 11626 - DNA, 201 bp, Homo sapiens
atataatctgaagaacagtgtttgcgtctcagtaatcactctgctaattccatctgattttactaccaaatggaagaaaagggaacaagtggagaacatgkagatgggaaattaaagaaggagattttaagtaaatccaaagaaaggtgctcaactgcgtatgctaccttcttgattaaaacaatcactgttttggctggg

SEQ ID NO: 11627 - DNA, 201 bp, Homo sapiens
aatgcaagtcacatgtaacttaaattttctggtagcccattaaaaaagtgaagagaagcagataaaattaattttaataatatattttatttaacccaacwtgcctaaactactccaacatgaaatcaacctaaaattatttatgagaccttttactcttttgaaaaatacgaagtcttcaaaattctgtgtgtattttta

SEQ ID NO: 11628 - DNA, 201 bp, Homo sapiens
actgtctcactgtaaagcctattctctttcctcgatgtcatgaaacctcaacaacatagaagcagcaagttattcttttattcattctgcacatgttcagmaccagctctgtggcgcacaccctgtttagcactagaaatataatactaagcaaggcagatgaggtccctgcttccatgattacagtctaccagttaaaaa

SEQ ID NO: 11629 - DNA, 201 bp, Homo sapiens
tagacacccactggacagagagacaaagtagggctcatcatcaaaaggaaaaacgaaagaaaacaaaaagacagagagttgagacttttgttcattccacraatttgcattgagcatctactttataccaggtagtattctaggttcttcaagggagaaaaagcagcagaaggaaaaaccaggcaaaatccctgcttttat

SEQ ID NO: 11630 - DNA, 201 bp, Homo sapiens
  misc_feature (1)...(201): n = A,T,C or G, or insertion/deletion polymorphism (see Tables 1-2)
gggctcacctccttcttttacagtacttcctataagttatgcatatcataccttctgtcttcctattatccagaaaattgtcatagggtcatgcctagctnctagggaagctagaaatgtaagctttattattggaggttctgtgcccctctaaaaatagaatttctgttactaaggcagaagaaaagaggatattgatga

SEQ ID NO: 11631 - DNA, 201 bp, Homo sapiens
  misc_feature (1)...(201): n = A,T,C or G, or insertion/deletion polymorphism (see Tables 1-2)
ctactgctccagccatcatatctgcattgcaactagaaggaaggaggaaggaacaaagacgggctcacctccttcttttacagtacttcctataagttatncatatcataccttctgtcttcctattatccagaaaattgtcatagggtcatgcctagctactagggaagctagaaatgtaagctttattattggaggttc

SEQ ID NO: 11632 - DNA, 201 bp, Homo sapiens
aaaataaagaagtgtgtggtaccacccccccatttttcagagagggcaactgaggtgtagggaggttaaatgagtgctggtgcgccttaattcaaagcctwtgaaatctgaaagattttggttcaaataaccagttgactgcttaactcagctaaaattatttttttaaatggcagaaattctaaaacataaaagtagctt

SEQ ID NO: 11633 - DNA, 201 bp, Homo sapiens
aatatcgtagagttggaaaaataaagaagtgtgtggtaccacccccccatttttcagagagggcaactgaggtgtagggaggttaaatgagtgctggtgcrccttaattcaaagcctatgaaatctgaaagattttggttcaaataaccagttgactgcttaactcagctaaaattatttttttaaatggcagaaattcta

SEQ ID NO: 11634 - DNA, 201 bp, Homo sapiens
  misc_feature (1)...(201): n = A,T,C or G, or insertion/deletion polymorphism (see Tables 1-2)
gtgtagggggaaggctacacacaggaagagatcccccgggatagaatctggatggacctatcatcacaccattactgtaccatttggagtgggaacattgngagtggggagtgttgaatggtgagagcttttagactcagccttttccctgttgtcataagctgacttcaattatagcatctccaacactagtgattactg

SEQ ID NO: 11635 - DNA, 201 bp, Homo sapiens
tatgctttgctatgagtcatagtttagagaaaacccccacgttcctgtgcaatgaaagaagcagcataatgatctcaactcaggcagaatggcctggaaastcacgatatgtggctgcacccagtcggtacctttgctttgcttgtgttggaggtctcttgcattagtgttgtgaaaatagatgatgagctcgtgcctctg

SEQ ID NO: 11636 - DNA, 201 bp, Homo sapiens
agtagagacggggtttcaccatgttggccaggctggtcttgaactcctggcctcaagtgattcgcctgcctcagactcccaaagtgctgggattacaggcrtcatccaccgtgcctggccatagtcctcattaggaaaaaaaaaaaaaaagcagcattgggggttggtttgatcatcgccaagggcctccacagtttcaag

SEQ ID NO: 11637 - DNA, 201 bp, Homo sapiens
tccacagtttcaagatggcatgcctcaatgatcccaggtaccaggaaacatgacctctctccttagcatccagacatttccctgagacgcttttcccatargcacagactctgacagagtatctgtggagtgaatgatgagacttttgggcactcctggccttgggaagttggcctgacatggtctgacttcagggccatc

SEQ ID NO: 11638 - DNA, 201 bp, Homo sapiens
gctaagtgctgtcacatgaggaatggattaagaaaaccaagagaggccgggcacggtgactcacgcctgtaatcccagcactttgggaggccgaggtggcrgatcatgaggtcaggagattgagaccatcctggctaacacagtgaaaccccgtctctactaaaaatacaaaaaaattagctgggcatggtggcacgcgat

SEQ ID NO: 11639 - DNA, 201 bp, Homo sapiens
ctggataaacataaatgacagaagggaagatctgacctttgctcctggtgggaccaaatgtgtgaaagtggaatcctcagagaatagcaggagacaatgtrttgctaagtgctgtcacatgaggaatggattaagaaaaccaagagaggccgggcacggtgactcacgcctgtaatcccagcactttgggaggccgaggtg

SEQ ID NO: 11640 - DNA, 201 bp, Homo sapiens
aagtctgctggataaacataaatgacagaagggaagatctgacctttgctcctggtgggaccaaatgtgtgaaagtggaatcctcagagaatagcaggagrcaatgtgttgctaagtgctgtcacatgaggaatggattaagaaaaccaagagaggccgggcacggtgactcacgcctgtaatcccagcactttgggaggc

SEQ ID NO: 11641 - DNA, 201 bp, Homo sapiens
caaaattatgttttccagcttgagtatggtgtcgcacacctgtaatcccagcactttgaaaggccaaagtgggagtatcacttgaggccaggaggtccagkctgccatgagccatgatcacatcactgcaacccagcctgggcaacagagcaagagcgtgtctcttaaaaaattgttctgtcaaatctgcccaccttcatg

SEQ ID NO: 11642 - DNA, 201 bp, Homo sapiens
gcacatatcccatgactgtacagtgttgaggtcactaatcatcacatgtaaatatacacagatgtggcctcctactacccccccactaagggtggtggatsacagcaggtcatccagcctctaggcaagagagtaaagtctctatggtggtctgggttgacagaagcagagtggttgagtacaagtcactgacaggatgtg

SEQ ID NO: 11643 - DNA, 201 bp, Homo sapiens
aaggtggctattattaagggtggtggacttgattcaagtcctcccagttttgatgtgttccttgaccagttgattcttatttccctgacttgtaaattgcygtcagcttcagcttgccttattaagaattctgtatagttggccgggagtggtggctcacgcctgtaatcccagcactttcggaggctgaggcgggcggat

SEQ ID NO: 11644 - DNA, 201 bp, Homo sapiens
taaactggctgaggtttccagggagaccaaagaatgccactatatgcctgtgaccttgaatcttaaacctggggcacctaaaacttctctctaatcttccrgaaatcttgaccaggtgaaggaagagcctgtgataggggaagaagggaaggaacatagaatgaaggtgatacaaatgaacagaggtagggaaagggcatc

SEQ ID NO: 11645 - DNA, 201 bp, Homo sapiens
ataattggcagatgagaaattgttgcagcactctcaataatcccaggaaggaagtacagatgttgattaattaacaacaaccaaaggtattatcacatctrcagtaattagcatttatcaagtgcctagagtgtgtctggcatactgtgctaaattctatttattaatcaatctaattctcacaacaaacctgtcatgtag

SEQ ID NO: 11646 - DNA, 201 bp, Homo sapiens
ttacttcctcgtttcaaactccagtctcagctattatcacacaagatgcaagtgcccagatctcagtccttgagatcaggattttaaagatataatatgtrattgctaaatgtattgtgaaggcctgttttggtttggagaaaattttatcagtgaggtcacaaatgtcagcctctttgaagttgaaatcctgaatacatc

SEQ ID NO: 11647 - DNA, 201 bp, Homo sapiens
  misc_feature (1)...(201): n = A,T,C or G, or insertion/deletion polymorphism (see Tables 1-2)
ggtacaagtccttctccgactgtgagccggatgacaaccatctcagcatcgtcaccctggaggaggccccattcgtcatcgtggaagacatagaccccctnaccgagacgtgtgtgaggaacaccgtgccatgtcggaagttcgtcaaaatcaagtgagtggcaggaatgctgtcacctgaacgtgcccaaccctttgaaa

SEQ ID NO: 11648 - DNA, 201 bp, Homo sapiens
ccacctgcggggctgtaaaggtatcagtgcctgggcactgcctccagagatgcaggttgattcctctggggatgagggcggctgggatggagaactgcccyatattctgttttctctttatgcccgtttgtcttagcacagaagtagatgcatatgttgagatatgtggcagaaaggcccttgagacggatggatgtctct

SEQ ID NO: 11649 - DNA, 201 bp, Homo sapiens
cattctccccagcctgttacatatcatagcgtgaataaatgaacatgtgtgtgtgtgtttaaccaaattgctctactcgccatcctatcttaaaaagaaakgtatcagcaatgctggacaattttgtaattagccacaggaaatgtttctttatagccagcaaaaattttccagcccatatgatgaggtaatcttagagag

SEQ ID NO: 11650 - DNA, 201 bp, Homo sapiens
agtcattctgttttagccatcattattcctaggctggcactgggacatcgtaggtcttcaataaatctatgtcgaatgaatgaagaatttgatgcgctcarcattctccccagcctgttacatatcatagcgtgaataaatgaacatgtgtgtgtgtgtttaaccaaattgctctactcgccatcctatcttaaaaagaaa

SEQ ID NO: 11651 - DNA, 201 bp, Homo sapiens
acttggatgtgtcaggaacagggagtagaacttggagaagatttaggaagttattgcactctgggggctcataaacctttgcaacttttctctccatgagygagcgttggactgaaacttttgcctgactcccatggtgtgggggttgtgatgtggtcaatgacatcaccaaagattctgctagtctttgccttaatttac

SEQ ID NO: 11652 - DNA, 201 bp, Homo sapiens
gattctgaaccctcttgtcctgtgccatgtaaaggagagaagagaggggttctgtagcaatgaagttgatgcctgaaaactcaatgggatccatatgtgcwtatacatgtacatgtatacagcacacacacacacacacacacacacacacaagcgtgcttgcctgtcctggttgtgtataaatataaccagaagtttggc

SEQ ID NO: 11653 - DNA, 201 bp, Homo sapiens
acacctgctctctcattctccagtgaaatgaaatataacaagggttgcagggtttgagtagctattcagaaacacacattgaggaagaaaagaggtaaacygggtgcatcctcctattgagactttagttcaggaaacatcctgacttgctaagctcagcaagtgttgagattgcagcaccacaaagattttctgttctgt

SEQ ID NO: 11654 - DNA, 201 bp, Homo sapiens
ttctttctttctttctgtttttttaatttcccactggttctttctactcagatatatcactaatcttcccttatagggctgtacttcccacatcagtaagrcaggagtaaaaacacctgctctctcattctccagtgaaatgaaatataacaagggttgcagggtttgagtagctattcagaaacacacattgaggaagaa

SEQ ID NO: 11655 - DNA, 201 bp, Homo sapiens
  misc_feature (1)...(201): n = A,T,C or G, or insertion/deletion polymorphism (see Tables 1-2)
tcttcatgtggggatttaagaactcagtctccactatcttgtggctctgccatcttctaataacttaggattttctgcaagcagccagaaaatccaggaancaggaaggagagaagaaagggtgtcctatctctccaaaactctggcccacatcctgttggatgaacgagtcacatggctacacccagatgcagaggtgct

SEQ ID NO: 11656 - DNA, 201 bp, Homo sapiens
aaaaattattaaatgtgggtaggttctggaagaaaatgcaaagtttttaggtaaagcacaaaagggcagaaaaaatgtcatgcttcctctgactctgcagytagaggaacagaggtggggagtttgagaagccctgggccagaggagcggaggagagacccgttcctcaaggggagtgggtgggagtggaaagaattaact

SEQ ID NO: 11657 - DNA, 201 bp, Homo sapiens
ggagagtctcaaaatgcaagaaagagtgtacaaaaatcagttggctctgaatgagagggagggtcttttttgtggacagcctgggagctttggtttggagwagaagggagagagatttgaagatttgaaggcgatgttatgacagcctggtttgggaattacacagaagtggagggaaggaagaaggctggaatgaagaag

SEQ ID NO: 11658 - DNA, 201 bp, Homo sapiens
gattcgatactcctgattgttgttgggactttcagagttggtcttggagacattggccactctctgtgattctggtggaactgtagggagatgaggcaagktggcagggaagcaaagagctcagtggaggtaacatcggggtatatgtctggtccccatgtggaacggtgatattgagaggagttgggtgataccaagaga

SEQ ID NO: 11659 - DNA, 201 bp, Homo sapiens
gtagggagatgaggcaaggtggcagggaagcaaagagctcagtggaggtaacatcggggtatatgtctggtccccatgtggaacggtgatattgagaggakttgggtgataccaagagaagttggtttaaaaggtcgtattttgagaaactggggatgtatttagaaaggagattgtctgagaggtgaacagcccttcctt

SEQ ID NO: 11660 - DNA, 201 bp, Homo sapiens
aaaacttagaatataatcttatgggaccagcattgtgtacttgtggtccattgttgacctaaacctccttatgcagcacatgactgtactatatatatatrtgtaatttctcagtcaattctccatgtatcttgtttttttttttttccagttctctgtttgtgctgtgtttgggaaggtttcttcaattctatactccag

SEQ ID NO: 11661 - DNA, 201 bp, Homo sapiens
taatcttatgggaccagcattgtgtacttgtggtccattgttgacctaaacctccttatgcagcacatgactgtactatatatatatatgtaatttctcartcaattctccatgtatcttgtttttttttttttccagttctctgtttgtgctgtgtttgggaaggtttcttcaattctatactccagttaactacatcat

SEQ ID NO: 11662 - DNA, 201 bp, Homo sapiens
tttcaacaaggatatactttatttccaagataataattggttcctctttacacctccctgtttttttgtgttataaataatgaaaaactcttctcactttktgcatgtaactccctcccctgtcccttcaaagattaaaaaatatgtattataaagttcttctctgattgctctagcatctttccttcttcagttgtgaag

SEQ ID NO: 11663 - DNA, 201 bp, Homo sapiens
aattggttcctctttacacctccctgtttttttgtgttataaataatgaaaaactcttctcactttgtgcatgtaactccctcccctgtcccttcaaagaytaaaaaatatgtattataaagttcttctctgattgctctagcatctttccttcttcagttgtgaagtccttcatttgtagaatcagttagttggatgttc

SEQ ID NO: 11664 - DNA, 201 bp, Homo sapiens
tgtgtgtgtgtgtgtgtgtgtgtgtgtgtgtgtagaggttcgagtatatgtgtttgtgttaggtatgtgtgtatttgtagttgtacgtgtgggtgtgagcrtatgtgattataatgtgagcgtgggtaggcatgaatgtacctgtatataagtgtgcttttatgtagaggttcatgtatagatgtataggaatatgtatac

SEQ ID NO: 11665 - DNA, 201 bp, Homo sapiens
  misc_feature (1)...(201): n = A,T,C or G, or insertion/deletion polymorphism (see Tables 1-2)
ggctctacttttcactgcaatggcttcactgataggctcacacccccacatgatggtaagtctgcaactccttctatccaagcatccacatctatcccccnctcaaagagtatgatgagcctcacatgaatttcatgccttcctttagatgaatcaatgtgtgcatggagaagagattttctgattggccacttaggacac

SEQ ID NO: 11666 - DNA, 201 bp, Homo sapiens
atattactccaaggtagaaccaaaagagagaaaacactattaactttttagctaattacaagaacccatcacttttaagagcacacaaagaattaaaagtratccaaagaaataggactcctatctttccccagggatctggcaacaaaggaactctggaggactgaagattatacatgaactcctgaagaaaatgatggc

SEQ ID NO: 11667 - DNA, 201 bp, Homo sapiens
aagaaagagtagaaaatgagaagacatatagatggaggtgcttgtatttgggctgcccaggagcccttaagtcattcagttccctggatggatttaaaggyggtgtcactgtgtcatcagaactcttcactgtgactagtaactaaaacccagttctaactacattgaatagactcacacacaaacaaacacacaaggaat

SEQ ID NO: 11668 - DNA, 201 bp, Homo sapiens
gcattatattactccaaggtagaaccaaaagagagaaaacactattaactttttagctaattacaagaacccatcacttttaagagcacacaaagaattamaagtaatccaaagaaataggactcctatctttccccagggatctggcaacaaaggaactctggaggactgaagattatacatgaactcctgaagaaaatg

SEQ ID NO: 11669 - DNA, 201 bp, Homo sapiens
ttttttgccttggaagaacttcattaattaggatttgaaaaatggtgaaaactctttggttaaaaacatctaattgcagcaaaccaacacagcacatgtayacatatgtaacaaacctgcacgttgtgcacatgtaccctagaacttaaagtataataataaaaataaataaataaaaatctaattttatatgctattgtt

SEQ ID NO: 11670 - DNA, 201 bp, Homo sapiens
gctctgctgttagaggtattttctgtggtggaattcaaggtcctcagaagagtcaattcacaggcaaatggaagaagtaaaactgtcatgagtaaaagcamactgtaagaccacctctggctgctttctccccacctcctgtgctccacatggaaagaaaatgttgccccttcccaaagtggaagactgtgcatattgggg

SEQ ID NO: 11671 - DNA, 201 bp, Homo sapiens
  misc_feature (1)...(201): n = A,T,C or G, or insertion/deletion polymorphism (see Tables 1-2)
acttgccatagagtaagagaagtcatatctatagtcatgttcagtcataattttcaggctggtaagaatgaattgattatcacaataaataaaaggctttntcagctgtcagcccaggatcacagtctacctctcttagccactttctaactcttattggcaagtttgctgagggaaaaaaaacttcttaatatcattcag

SEQ ID NO: 11672 - DNA, 201 bp, Homo sapiens
  misc_feature (1)...(201): n = A,T,C or G, or insertion/deletion polymorphism (see Tables 1-2)
ccctttcatttggaagaaggaaaatgtccatctcaaaaacttaaatttattattttgccccagatacagaagaacaaatgcccatcagagacctgctaccnagttccagacatttcacctctcacaacgcaataacttttcacaggcgagggggatgaaatgctgttccactgattgatacctccaggttctgtaacctta

SEQ ID NO: 11673 - DNA, 201 bp, Homo sapiens
agcttctaagcttttgtgcatgctgttctctgatcctacacatcccttctttccactctgacttttcaggtcctttgcaaactgcacaactcccctccatygcactccttcatgatttcttccttccctcatcagatctgcctctcacttctgaagccctctgcatttcttgcacctttcaccctttggctgttagcattt

SEQ ID NO: 11674 - DNA, 201 bp, Homo sapiens
taaatagagacagggtctcaatatattgcccaggttggtctcgaattcctggtctcaagcagtcctccctctcagtctcccaaagtgctaggattacagawgtgagccactgtgccagaccactttttcttatgtgtaaattaaaaaagaatttgaacaggaatgaaagataaaaagaaaaaaaaaaacacttccccaaac

SEQ ID NO: 11675 - DNA, 201 bp, Homo sapiens
aaaaaaaaaacacttccccaaacaaaaaaaaaaaactctttcacttataagaatggtcatcatcttggctatttcagatggggaagtacgcatgcctcatyttatccaagtttctcacagttctataagtcttttttcacacacagttccatacacaaaaggtggctttgcaaaaaacttcttttaacatagctggcaggc

SEQ ID NO: 11676 - DNA, 201 bp, Homo sapiens
aaaaaaaaaaactctttcacttataagaatggtcatcatcttggctatttcagatggggaagtacgcatgcctcattttatccaagtttctcacagttctrtaagtcttttttcacacacagttccatacacaaaaggtggctttgcaaaaaacttcttttaacatagctggcaggctatactgtacatatatctatacac

SEQ ID NO: 11677 - DNA, 201 bp, Homo sapiens
atggggaagtacgcatgcctcattttatccaagtttctcacagttctataagtcttttttcacacacagttccatacacaaaaggtggctttgcaaaaaayttcttttaacatagctggcaggctatactgtacatatatctatacacatgtatgcatgtatgtgcatatacatatacctttgcatatatatgtttatgca

SEQ ID NO: 11678 - DNA, 201 bp, Homo sapiens
ccatacacaaaaggtggctttgcaaaaaacttcttttaacatagctggcaggctatactgtacatatatctatacacatgtatgcatgtatgtgcatatayatatacctttgcatatatatgtttatgcatacattttattttgctttatttagaattattatttttggagatagagtcttgccttgtcaccgaggctggc

SEQ ID NO: 11679 - DNA, 201 bp, Homo sapiens
gaaaaacagtatggcggctcctcgaaaaatttttaaatttttattatcggttggtgcaaaagtaattgtggtttttgcaattaaaagtaatagcaccagcstaatggaactatcttatgatccagcaatcccacttctgggtacatatcccaaagaattgaaatcaggatctcaaagaaatatctgtaccctcatgttcac

SEQ ID NO: 11680 - DNA, 201 bp, Homo sapiens
cattaagcacagtttgcatgttaggcacattgctgggcacaggggatacatggatgaacagggagggcaaaagactaggacctttccatcatggaacttaygtggttagaaaacaattcgaccaggaagaaatgggtgaccccatgttgtaataaaccttgtgatgaacagaaagagagtggtgtgagaagagagtacatc

SEQ ID NO: 11681 - DNA, 201 bp, Homo sapiens
atgaaaaacagtatggcggctcctcgaaaaatttttaaatttttattatcggttggtgcaaaagtaattgtggtttttgcaattaaaagtaatagcaccarcgtaatggaactatcttatgatccagcaatcccacttctgggtacatatcccaaagaattgaaatcaggatctcaaagaaatatctgtaccctcatgttc

SEQ ID NO: 11682 - DNA, 201 bp, Homo sapiens
ccaaatgtgcgtttctcaagggagagggtccaaaggtttcatgagtaaacaacaacaaaagctttcaacaaggtatgggatgtctccaaaagggtgagaayccatgatgatgatactgataatagcaataataaagtaacttttctgagtgcttagaatttgctaaggccaggcgtggtggctcacacctgtaatcctagc

SEQ ID NO: 11683 - DNA, 201 bp, Homo sapiens
gtggggcccaccaaggaagggcaagtgtacatcccatgattcatgattcataattcatcatgattcataattgtgtgaaacagaccatgttttggggtcakgaatgttttaatgatttttgctgaattcctttacagtgaaataacacagacattgttataagtaaaattgttataaataaattgttttaatacagaatga

SEQ ID NO: 11684 - DNA, 201 bp, Homo sapiens
  misc_feature (1)...(201): n = A,T,C or G, or insertion/deletion polymorphism (see Tables 1-2)
aagtggtttgtattcaaggtgtacaatgtgatgttttgatgagtgtgtagactgtgaaatgattaccaccatcgaattaattaacacatctttcacgactnttggttaccattttgggtgtctgtgtatgtggtgtgagtataattaagatctaatcgcttcacaaatttcaagtgtatagtatgatattactaactgtag

SEQ ID NO: 11685 - DNA, 201 bp, Homo sapiens
cttcatttgtagaatcagttagttggatgttcacatatgttctttaatttttgtttgtgaacttattttcaaggcaactttatgatttcttatgccctgtrtctgtgagggtgtgtattttaagccagagcccatgtcagcagctcaggtttgtactctcttcccattctacgtggcctgtggtacaggcttaggagtcca

SEQ ID NO: 11686 - DNA, 201 bp, Homo sapiens
agaggtggggcccaccaaggaagggcaagtgtacatcccatgattcatgattcataattcatcatgattcataattgtgtgaaacagaccatgttttgggrtcaggaatgttttaatgatttttgctgaattcctttacagtgaaataacacagacattgttataagtaaaattgttataaataaattgttttaatacaga

SEQ ID NO: 11687 - DNA, 201 bp, Homo sapiens
  misc_feature (1)...(201): n = A,T,C or G, or insertion/deletion polymorphism (see Tables 1-2)
ggttgatttaatctacttgagggcataccgttttctagccttgggtagataaattgtttatgtacaaggaatgctgctaactagaaatgtgttttatcttntcattaaaatgggtccacaaatttctgcttagaaatacaattttagcttccctctttgaaatccttacagattaaacatttcctccttgctatccttgtg

SEQ ID NO: 11688 - DNA, 201 bp, Homo sapiens
atttatttttagggattactctctatttttgatctgtgattctcttttcttatttgcaagcaatactatgtaaatttaaaaataactaaaggtttctttawaaattctatgtcttaggagcagaaaaggaaggttactgagtgtgttcactcggattttgaccccgttttatttcacaacctgcttttatatattttttta

SEQ ID NO: 11689 - DNA, 201 bp, Homo sapiens
acaaggaatgctgctaactagaaatgtgttttatcttttcattaaaatgggtccacaaatttctgcttagaaatacaattttagcttccctctttgaaatscttacagattaaacatttcctccttgctatccttgtgacaatatcttccatttattgtgcctctgctgtatgccagacggtgatagatgctttccatgca

SEQ ID NO: 11690 - DNA, 201 bp, Homo sapiens
tctagtcattggctccgatgccagcttgttggagcttccggatgaacatatcacaatatggttcagggcattcgtgcagtgtttgttccctcaatgctgastgatttcataggtgtttgccaatttttctcttctctctagtgggcagataattaccagccatcctgaggattagcataaattggggggttacatacgaaa

SEQ ID NO: 11691 - DNA, 201 bp, Homo sapiens
caaactcctgacttcgtgatgtgcccgcctcagcctcccaaaatgctgggattacaggtgtgagccaccatgccgggcctaattgtcctctttatttgtgwgttctcaaccctctccgtgaaactttcccagcccccttttgattccctttcatgggtaatagtgagaggcagcacacacagggaaccaggacagtaaaca

SEQ ID NO: 11692 - DNA, 201 bp, Homo sapiens
aagtcatcagagaccaacaggcgtcctcccggtagcgtgactcacactccaagtagccctcaggggttgctgacaatcgtttgggccctgaagagctgtgrtctggtgggtttgcagcggtgtttatcttctttctcatagcctcagatggaaaatgctactgtaggcagagtgagtggggaaagagagagaaagagggct

SEQ ID NO: 11693 - DNA, 201 bp, Homo sapiens
cctataacacctggccctgttgagcccactggccttaaggccttctcaacacagtactccaggcagccatgatgaatcaacttgagttggaagatccaagraaaccttggacaaagagtctgaagaatgaaattcaattttcaaaaatacctgtgtgaccttagaaaaggcccttcacctgtctgaacctctggttctcct

SEQ ID NO: 11694 - DNA, 201 bp, Homo sapiens
tggcaacaaacataccaaaatatgaatagcagttatctttggggtggtagactcatggctgctttaatcttttaaagaatgtcattatcaagtggttaatrtattgtactttgagttagattgcctgaatttaaattcagggattccacctcttactggctgggtgatcatggggaagttcttaatatcttgagcctcaat

SEQ ID NO: 11695 - DNA, 201 bp, Homo sapiens
tttgtagagttgtgagatttaaatgacatcatggatattagtccatgtctcagtgcctaccttataataaatgcttattacaggaatgctattgttattgygtctgcattttttagtttttatttttctccagtgtacatgtactttttaataaccagaaagagtgattaaggatgatgtggttacatgagggtatgctct

SEQ ID NO: 11696 - DNA, 201 bp, Homo sapiens
  misc_feature (1)...(201): n = A,T,C or G, or insertion/deletion polymorphism (see Tables 1-2)
agaactgtcagaagtggagggtctaacatgaaatgatttgtattttcttaactgagacaatcagaagcttcctttgcctttgtaggacttgctgagagctntatcctggcaaacggaagctaaatgtggccagcatgaaagtgatcgtaggagaagactatctcattgacctttgcactaaatgactccaccaactggacc

SEQ ID NO: 11697 - DNA, 201 bp, Homo sapiens
  misc_feature (1)...(201): n = A,T,C or G, or insertion/deletion polymorphism (see Tables 1-2)
gaggcttagggatttagagtgtggacatatatagtttctcattttatctctgccaaggattaataactcagtgatagcctggggaacctggcagctccaanggtatttgtttaaagaatctctattttcagatgaggaaataaaggatctgggagttgcagtaatttgtgcattgttcaaagctgtaactagaacctaggg

SEQ ID NO: 11698 - DNA, 201 bp, Homo sapiens
gcagtggcatgatcatagttcactgcagcctcaacctcctgggcttaggtgatcctctcatctcagcctcccaagtagctaggaacacaggcgtgtgccaygatatccggctaatttttaaatttttggtagagacgggggtctcaccatgttgcccaggctggtcttgaactcctggactcaagcaatcctcttcccttg

SEQ ID NO: 11699 - DNA, 201 bp, Homo sapiens
ctgaaaagaatcgagatgatgtttcttatatcagactgccctccttacaggcttacaaacctggcttggtttgaggcaacaccgaaaggaagatgttctgrgaatctgatgagtcatagtgagaagacccatttttgtgtcctcccagactccaaagggtctgagcacggtggctcacgcctgtaatcctagcactttggg

SEQ ID NO: 11700 - DNA, 201 bp, Homo sapiens
ctactttcttcaatcaaattctacaaagcaagtgcaattgtgccatgctgtgggagatagagaatttaagtgggaagcgaatggagcttagttttccttgyatcattccaaaaaaaaagtgcctaatagtttttaaactgtgattccatcacaggtcctgagccaaccactttatgtacattaccacattttatgttcact

SEQ ID NO: 11701 - DNA, 201 bp, Homo sapiens
tctgaaccccatttgtctgactccgaagcccatgctttgactactaacttctgctactttcttcaatcaaattctacaaagcaagtgcaattgtgccatgytgtgggagatagagaatttaagtgggaagcgaatggagcttagttttccttgcatcattccaaaaaaaaagtgcctaatagtttttaaactgtgattcca

SEQ ID NO: 11702 - DNA, 201 bp, Homo sapiens
ttttttcttatttgtcagatttattgggcctttgttttgtccttttgagagtttttaaatttgtctttaaaacaacatgggtgttgggtcaccacagggargagagaaaggaatgagtttctcactgctgcatctgggagggtggacttgcctcacatggctttgagtcaagatggtggaattaatgaagttgggccctca

SEQ ID NO: 11703 - DNA, 201 bp, Homo sapiens
tctatgtggtccagcagattatagctgatggcatatgttttctttccacaattaaagtgtgtttgaagaaactaggacaggcagatctaacataggaaagsagggcaacaattagttttgggtatcagatcctgacatccatgctgtatacagggaaagcagaaacatttacctgcttttaataggtgaagagactaagat

SEQ ID NO: 11704 - DNA, 201 bp, Homo sapiens
ggactagatttactcttcttgttctccctggtctttaatactatgcctggcatacacagggggtgccataagtattttgctgagtgagttggtgaatagawgtgttcctttacaaagtactgttttgatcatctcataagaaagtcacatggtacctgggtggcctgagggaaaagcaaggcaggtctccagggttgagtt

SEQ ID NO: 11705 - DNA, 201 bp, Homo sapiens
gagagcagcggtgcaatctcagctcactgcaagctctgccctaccaggctcaagagatcctcccacctcaggctcctgagtagctggggccacaggtgtgyaccaccatgcctgcatgcctggctattttttttttttttttttttttttgtatttttagtagagacggtgtttcaccatgttgcccaagcctggtctcga

SEQ ID NO: 11706 - DNA, 201 bp, Homo sapiens
gctggagtgcagtggcacgatctctgctcactgcaatctctacctcccaggttcaagcgtttctcccaaggcaagtggattttgaaatcaagaaaatgggkttcatgagagaaattcttggcccctgttgctgtcaggaaggcttttagactaaaaagaatggagctaatgaaagcagttggatagggcaagcgtatgagc

SEQ ID NO: 11707 - DNA, 201 bp, Homo sapiens
caataaacacccaaagactttcccatcttgtaccaaggcaggtggatttttttttttttcaagactgaatctctgttgccaggctggagtgcagtggcacratctctgctcactgcaatctctacctcccaggttcaagcgtttctcccaaggcaagtggattttgaaatcaagaaaatggggttcatgagagaaattctt

SEQ ID NO: 11708 - DNA, 201 bp, Homo sapiens
acatacagccaataaacacccaaagactttcccatcttgtaccaaggcaggtggatttttttttttttcaagactgaatctctgttgccaggctggagtgsagtggcacgatctctgctcactgcaatctctacctcccaggttcaagcgtttctcccaaggcaagtggattttgaaatcaagaaaatggggttcatgaga

SEQ ID NO: 11709 - DNA, 201 bp, Homo sapiens
  misc_feature (1)...(201): n = A,T,C or G, or insertion/deletion polymorphism (see Tables 1-2)
actggggttgtcttttggtcttagtggccttggtgttggaccccaggttccaggaagtcttttatcccagcagcagtttttcggagagaagactcacttanatgcaagactgacatgaaaaggggtttgctctgtatgaggctgtgagctcagccccatgcttaaagtgctgagtgggaaaaagggcagagactatgcctg

SEQ ID NO: 11710 - DNA, 201 bp, Homo sapiens
gggatcacagaccctctgaaaccctttcatagacttccttggatttgatttatttattggtttattaaacacagttgatccttgaataatgcaggcgctasttgcattaacccccatgcagtttaaaatccatgtataacttttgattcccataaactatagcccactgttgatcagaagccttaccaataacatagacag

SEQ ID NO: 11711 - DNA, 201 bp, Homo sapiens
agagaggttgggaggtagttagagcttaattccaaggcttctcctcactcctcttctgtaactgagcctcagtggagtcaagacacctcagctcagaaccsagacctccacctgctctaacactgactttgttcttctcatgtgggctccctttctggacactaggctcctgctttgaggaactgagtccctgtcttagaa

SEQ ID NO: 11712 - DNA, 201 bp, Homo sapiens
ttctaggttcaatgcttctcaggaatttttactcaaatagtcctagggggtgtggtaggcagaatcatgtccccaccaccccctcttccccacccaaagayatccacattctaattcctggaacctgtgaatactaaccttatatggctaaagggactttgcaaatataattaaattaaggatcttgaaatggagagactg

SEQ ID NO: 11713 - DNA, 201 bp, Homo sapiens
  misc_feature (1)...(201): n = A,T,C or G, or insertion/deletion polymorphism (see Tables 1-2)
cctcttacagccctggagggcagaagtctgaaatcaggttccctgcaccaaaatgaaggtgtcagcaaagctgtgctccctctggagactctggggaagantctgtttcctttcctttactagcttccagaactgcattccttgacttgcggcaaactctgaaattcagtttctcctgcaagtaagaaagttgggctaaat

SEQ ID NO: 11714 - DNA, 201 bp, Homo sapiens
  misc_feature (1)...(201): n = A,T,C or G, or insertion/deletion polymorphism (see Tables 1-2)
caatctacagttgtagcctcaacctcttgccctgggttcctgacctgttcccctaggtgcttggtgggcttctctccttgacatggccatgggtgcctcanactgaacctgcccaggcctgtcctctttgattcatgcttattctggatttcttctctctgtcaatggtattcctgttgtccaagccttccttgcttggaa

SEQ ID NO: 11715 - DNA, 201 bp, Homo sapiens
  misc_feature (1)...(201): n = A,T,C or G, or insertion/deletion polymorphism (see Tables 1-2)
gcccaggcctgtcctctttgattcatgcttattctggatttcttctctctgtcaatggtattcctgttgtccaagccttccttgcttggaaggaacatganggacggatgtatattgagctccctgatgtgcaggcagagtgttgcaggcagggatccgaggaccaccaccctcattgtagagaggaggaaagtgaagccc

SEQ ID NO: 11716 - DNA, 201 bp, Homo sapiens
caaaaggagaccagtaaccatcaagcagttacgatctatttccccacccctccagctcctggaaacctttaatctgctttctgtatctgtggatttactcrttctagatgggatgggatcgtctgttatgtgaccttttgcatctggcatctttcacttagcataatgttttcaaggtccatccatgtcgtagcatgaatc

SEQ ID NO: 11717 - DNA, 201 bp, Homo sapiens
tgacactatacctggccctctggtgttttccattcttccactgcccaactcttggttcgtctccatccctggcacctggtccttatcaccttccacctgarctttgattccagtcttctgagtttcctgcttatacgggaagctctcctactcaaggggcgcattggacatgttactctccactcttaaagctttggtgat

SEQ ID NO: 11718 - DNA, 201 bp, Homo sapiens
tcttcctcccacctccatctttacttttggaaagcacagttgaaatctacctctcagggttcttattaggatcgaatgaaataaggtgtatgaaaaccctsaaaactgtaagaagaaatacaagtgtgaaacatgtcattgttagtcccgctttgcctttaagtcctttaagttttaagtgtcaagttctccaaggtgcct

SEQ ID NO: 11719 - DNA, 201 bp, Homo sapiens
tttattttggttttgtgacttctcagcattatacagaaatggaatattctgacatttaaataaggaatatttatctcccaaattcaatctatttgtgtccmgaatcttgtactatttcctatcaccaccaccatcaaaagtattttttcacttcggcaaatagttcagtgaccctctgagatcgtgagaacagaggtcaca

SEQ ID NO: 11720 - DNA, 201 bp, Homo sapiens
  misc_feature (1)...(201): n = A,T,C or G, or insertion/deletion polymorphism (see Tables 1-2)
aaatggctgacctcatgcatagcaagagagttgaaaatcactgtgggggacaggagctcttctagggagaaagaagtcaggtatgcgtgcaggtgcagagngggcagatgggcaggaagcctgacagttttcctggaccctgggctagatcacccttttcatcgtccagggtccctcctaccacttaaaatggatttctgt

SEQ ID NO: 11721 - DNA, 201 bp, Homo sapiens
taatcacgtggcctgtgaaatcctgcaatgtgacaagtagcaatgaacttaacaatactcaagtttcatccatggagcagaaatctcagttggaaggtggyggtgaaacatttatgccaaagacagcctgtccctgcctctaactggatacatttaagcctagccctatttttattttggttttgtgacttctcagcatta

SEQ ID NO: 11722 - DNA, 201 bp, Homo sapiens
tcccccaactccatccaacttgtgcgactaatcacgtggcctgtgaaatcctgcaatgtgacaagtagcaatgaacttaacaatactcaagtttcatccayggagcagaaatctcagttggaaggtggcggtgaaacatttatgccaaagacagcctgtccctgcctctaactggatacatttaagcctagccctattttt

SEQ ID NO: 11723 - DNA, 201 bp, Homo sapiens
tagagttgtccaatcttttattgtccaatcctctttttaatttttcttctgaaagagacactggttgggaagctgcacaagttgtagttgggttttttgtkgttgttgtttttgagacagtttcactcttgttgcccaggctggagtgcaatggcgcgatctcagctccctgcaacctccacctcccaggttcaagtgatt

SEQ ID NO: 11724 - DNA, 201 bp, Homo sapiens
cccctggtcatggataggaaaactaggcatgaggttgtctactaggtaaaagaagcatcctgtgaaaggcacgtgtaaacacccagatttacttcccctcrttggtcattagggcagggttgttagctgctgtagtactggaaacccagtttagccagtggctctcaaaacagcacgggatctgaagttattgctatcctt

SEQ ID NO: 11725 - DNA, 201 bp, Homo sapiens
ttataaataagttcctcctgggagagatcccctggtcatggataggaaaactaggcatgaggttgtctactaggtaaaagaagcatcctgtgaaaggcacrtgtaaacacccagatttacttcccctcgttggtcattagggcagggttgttagctgctgtagtactggaaacccagtttagccagtggctctcaaaacag

SEQ ID NO: 11726 - DNA, 201 bp, Homo sapiens
gagaaaaaaatctaaagttggggaaaaacaagagaatcaactcgtattcccttaaagggagttgtagaatgactcatagaaaccaatggcctctcacttaygttgtctttaactttaacattgaaacaaacaatttgaatcggaagaatcctaattcctgttgattcctaccgtgctggcctctatgtggtccagcagatt

SEQ ID NO: 11727 - DNA, 201 bp, Homo sapiens
ctccttgtgtatactaagcaatggggaatacagatcaaatggaagtgatccatttcgcttctggattttacagcttcaaggaacttgttgacaacacttcrataaaaaagaaactgaaaagcagtgagataattttacttgctgaaaagaggagctatttcttggcatgtagaactgagcaacacagcataggttaccttg

SEQ ID NO: 11728 - DNA, 201 bp, Homo sapiens
tggagctcagtggctgctgtctgggcctgcttctcactttctttccattgtctctgttctattatttccccatttgcctgctgatggaacagacaggaatracatctgtccctaagaaaatggacagaacagagagctgctccccccagcaatctgcttctggctacaagtggctctgtcagcctgcctctgtagctacag

SEQ ID NO: 11729 - DNA, 201 bp, Homo sapiens
tccttctctcttcattccacaactaagtctccgatgcccattaagctccttgtgtatactaagcaatggggaatacagatcaaatggaagtgatccatttygcttctggattttacagcttcaaggaacttgttgacaacacttcgataaaaaagaaactgaaaagcagtgagataattttacttgctgaaaagaggagct

SEQ ID NO: 11730 - DNA, 201 bp, Homo sapiens
tgtgaaatgagcataaacaggagaggtgcacatggcacactgggacacctactccagcctgggcactggggaggtgaaaaaacttcctgaaagacctaagytaggaccaagtcctaaaggataaagaagagctatccaaagggtgacagtcatcttatccattctagtaactgaaccacaaacattatttttctttatttc

SEQ ID NO: 11731 - DNA, 201 bp, Homo sapiens
gtaaaccaatttacattcctgccagcagtgcaggtagtttctccaatttgcaagtgctccttttcgactttctgtaagaggtaaagctggcttgtgcaacwgaactctaggtgtcttcatcagtggctgtgtggttggctgttgccaccagtcatttagagatccagattcttgccccaacatcaacattgccttattttg

SEQ ID NO: 11732 - DNA, 201 bp, Homo sapiens
  misc_feature (1)...(201): n = A,T,C or G, or insertion/deletion polymorphism (see Tables 1-2)
ccctgagctccggaagcccacactatttattggtgatcaaacaaagaagcaggtggtgaggacgtgcggatgtgggggtaaacaggtgaggacatgaggangtaggggtagaaaggtagcagtgcatcaagcatagctgtgatggtttagcattttctttgacacatatgtaatatgctctgctacctgagataatggaga

SEQ ID NO: 11733 - DNA, 201 bp, Homo sapiens
ttccaacaattggaagaatttaactaaacatgactggtttccccttatccttaaagaaattttctctttttgtaaagaaatatcacgcttaaaaaagtttrtatttttctctcctctggtttagaaagtctgttttcttcaactttccttattattacctcacttaacccccaaagtaaaagaacacttatacctgtacta

SEQ ID NO: 11734 - DNA, 201 bp, Homo sapiens
  misc_feature (1)...(201): n = A,T,C or G, or insertion/deletion polymorphism (see Tables 1-2)
agtaggtacaggcgaagcagagatgactaataaaatatccccgggattttagggaatgttggggtgatcagacccaacaccaggctgtgggggctacaaantccggcagagtcaaaggaatgggaaaagacaggttaagagtatataaggtgggtccaggaggccaacgctagtgtatggaggctgcaaaggccctgagct

SEQ ID NO: 11735 - DNA, 201 bp, Homo sapiens
  misc_feature (1)...(201): n = A,T,C or G, or insertion/deletion polymorphism (see Tables 1-2)
gccatatgggcatccattcactcttgaacccacccacttacccactattgatctgtttaccaagcattcactgattactgactcagtgccaggcctgtagnaggtacaggcgaagcagagatgactaataaaatatccccgggattttagggaatgttggggtgatcagacccaacaccaggctgtgggggctacaaaatc

SEQ ID NO: 11736 - DNA, 201 bp, Homo sapiens
  misc_feature (1)...(201): n = A,T,C or G, or insertion/deletion polymorphism (see Tables 1-2)
cagccatatgggcatccattcactcttgaacccacccacttacccactattgatctgtttaccaagcattcactgattactgactcagtgccaggcctgtngtaggtacaggcgaagcagagatgactaataaaatatccccgggattttagggaatgttggggtgatcagacccaacaccaggctgtgggggctacaaaa

SEQ ID NO: 11737 - DNA, 201 bp, Homo sapiens
agaaaggattcaaatttaggtcttgtgagtctccaagtttagtgcttgttccagtactttgcacagttcctaggatgaatgatggaaattttcatataggwtgtggagattcacagggatggtatctgccttggaagttgagtggaagttgggggtatgacaatacctaggcttttgtgtggacttaactcgtattcttta

SEQ ID NO: 11738 - DNA, 201 bp, Homo sapiens
gtctgaatatgacgtaaataaatagtaagcatttgttgagcacctattctataccaaaccttacagtatggccttctgtacttattatttcactttagccrcataataaccctgtgaagtgagtctctgatttcatatttgagtcatgcaaacttagagatgttctatgatttttaaaaaattaatagctgagaaaggatt

SEQ ID NO: 11739 - DNA, 201 bp, Homo sapiens
cttcatctgattggtatgttatgttgaggttcaaagtgagcttccatttggggaaaaataaaatatttctaaaataagtttgaaagcaagtagaggaaggrgattgactgtagtagttgtctgaatatgacgtaaataaatagtaagcatttgttgagcacctattctataccaaaccttacagtatggccttctgtactt

SEQ ID NO: 11740 - DNA, 201 bp, Homo sapiens
atttttgctataaaagggaacagagagaaatggagaattatctacagagggacacgaggtcacataagggttttcatttctgtttttaaggtagaagctaygcttgtattttggggtgatcctcctcatgattttgctatggttggaccctgtatacacttcttcttcttcttctttttttttttttttgagacagggcct

SEQ ID NO: 11741 - DNA, 201 bp, Homo sapiens
  misc_feature (1)...(201): n = A,T,C or G, or insertion/deletion polymorphism (see Tables 1-2)
ggtaggacaaggaatgagaattgtcctgtggatttgacaacacagaggttgcaggatacctttcagtagcaccgtcgtggccacacctgaccagagttcgnagaggaaagaatagcacagaagtaggcagggtggttatagccaactctctagatcatttttgctataaaagggaacagagagaaatggagaattatctac

SEQ ID NO: 11742 - DNA, 201 bp, Homo sapiens
  misc_feature (1)...(201): n = A,T,C or G, or insertion/deletion polymorphism (see Tables 1-2)
atttgaggataattttagagttgtagaaaagttgcaaaattagtacagagaatttcagtatatgcttcacccaggttgccccactgggcaaagtcctaganttctttcttaaatttttaaaattgttaattattgtgcatacatagtaggtgtatatatttgttaggtatatgggatattttgacagaggcatgcaaatgt

SEQ ID NO: 11743 - DNA, 201 bp, Homo sapiens
ccctcaatgtttccctgaacctggcctggaaattcagcttgctttaccatttgaaccctgccgtggagtcccagggaccagcgttccaagtctgcctctaycatttcccagccatgtaaccttgaatgagtctcttggcttttctgagtctcattgtctttagcatgtccccatacctatctctccttcttactttcttgt

SEQ ID NO: 11744 - DNA, 201 bp, Homo sapiens
agctgcttgtgggaatccttggaggccagaatgtagtctcgattcttcttcaggttggtgtgggagacgatggccactagctcatggcgatcattgaccaraggcagcttcccttgctaggctgaaggatctcatttgcctgtttcaatgtcatgcctgctggagccaccatcagcttgatccttggcgtcatcacctcac

SEQ ID NO: 11745 - DNA, 201 bp, Homo sapiens
gatccgtcttgagatgagagcctcatccaaaattatctggtgggcccaatataattgtgactgtacttataagaggcgggcatggaagagtcagagaaggrgatgtgaccatggaaacagagttagagtgatgtggccatgagctaaggaatgtgggcagactctacaaactggaaaaggtaagaaatggattctcctcta

SEQ ID NO: 11746 - DNA, 201 bp, Homo sapiens
  misc_feature (1)...(201): n = A,T,C or G, or insertion/deletion polymorphism (see Tables 1-2)
ttaattccttccagctttgtatacttggagcactttaaaaactactttgagttactactcattcattcactcaacaaatatttattaagtgcctactatgngtcagccattgatcttggctctggggatactcctgtgaaaaggcaatgccctgcacccatggagtttttcttcccaatgttttattactactcacttacg

SEQ ID NO: 11747 - DNA, 201 bp, Homo sapiens
acaggcatgagtcactgtgcctggtctgatgagattttgatgaaaattttggactttgacactatcgtgagttagttttggggagatggagtgaatctttsggagcaagatggtggcctggcaggcagaactacgacctctcaaagatgttcaccttctaaactctgactcctgtataaatgttatgatttatggcaaaag

SEQ ID NO: 11748 - DNA, 201 bp, Homo sapiens
  misc_feature (1)...(201): n = A,T,C or G, or insertion/deletion polymorphism (see Tables 1-2)
caggtgcagagtgggcagatgggcaggaagcctgacagttttcctggaccctgggctagatcacccttttcatcgtccagggtccctcctaccacttaaantggatttctgtgcgattatttattcttgccccttcttttgaagtcctttgagcctttgaacttgatatggtttggctgtgtccccacctaaatctcacct

SEQ ID NO: 11749 - DNA, 201 bp, Homo sapiens
  misc_feature (1)...(201): n = A,T,C or G, or insertion/deletion polymorphism (see Tables 1-2)
ttgccttcagataaaatgtaaactcctggctgcacaaatccctgatttctgacccctgctgaccttttgagcttcaactcagttctctcctcattttgcantttgctctagactttcccaaagagggctctgaggaatatgaccctacagaaaaaagtttaagccaaaataaatttaagagatgctgtacatcatgggatc

SEQ ID NO: 11750 - DNA, 201 bp, Homo sapiens
  misc_feature (1)...(201): n = A,T,C or G, or insertion/deletion polymorphism (see Tables 1-2)
agccaaaataaatttaagagatgctgtacatcatgggatcctcagatatttacaatgcacatgagcctcttcaaagctctgagaagtcctgcgctacaganacggtttaaacttatttcctgctgtttgaacgaatgtttcccaaatctatttgatcagaagactccccttctgttttttatacaacacttgttcttgttg

SEQ ID NO: 11751 - DNA, 201 bp, Homo sapiens
  misc_feature (1)...(201): n = A,T,C or G, or insertion/deletion polymorphism (see Tables 1-2)
caaagctctgagaagtcctgcgctacagacacggtttaaacttatttcctgctgtttgaacgaatgtttcccaaatctatttgatcagaagactccccttntgttttttatacaacacttgttcttgttggcttgataaaatatgacaaaaaccattgccctgattgctaaaatataacaaaaacccacattgctctaaat

SEQ ID NO: 11752 - DNA, 201 bp, Homo sapiens
cccttctgttttttatacaacacttgttcttgttggcttgataaaatatgacaaaaaccattgccctgattgctaaaatataacaaaaacccacattgctytaaatgtgcctctttcacattttctggcacttgtctgtgctgctatttctgtctgtctcatatccttcaaaactcatctcagaagccatgccctctgaga

SEQ ID NO: 11753 - DNA, 201 bp, Homo sapiens
  misc_feature (1)...(201): n = A,T,C or G, or insertion/deletion polymorphism (see Tables 1-2)
cagctgccttgggaaaagctgtagtgtcagatgaggagggtcggaggtcagacagaggctgggctgttttggtgactcagattctttcgtttataacacgntggtaattccacttggggagcctttaatgcctcgaactcggaggccttggtagagactaagttaatggatttgaaatttctttgaaaagctgaaattact

SEQ ID NO: 11754 - DNA, 201 bp, Homo sapiens
aagctgcctctttacatactttaaaggtttctccataagtagtgaactgcaacctaactggatgtgtaaacagactgtaacccactgttgtccaaacaacygagtttcagccaatcaagggggaccaactgttcaaactgggctcaagtagggcaaatgccaagctgtaatggatccagctgtttctgcacctcgcttcca

SEQ ID NO: 11755 - DNA, 201 bp, Homo sapiens
gtgtcctatagctgtctctgagtaagactgaattcataagaatttattaatttctctaaagagaggagactcagggtcccagtaactgaatgctgttcttmtttcagtctttcctgtatcaccttcctggattttgccatatcaaggtatcacctactttacggatctataaactatggcctgccacctgtctttgtaaat

SEQ ID NO: 11756 - DNA, 201 bp, Homo sapiens
agaggagactcagggtcccagtaactgaatgctgttcttatttcagtctttcctgtatcaccttcctggattttgccatatcaaggtatcacctactttasggatctataaactatggcctgccacctgtctttgtaaataaagttttattagaacagaattgcacccatctgtagatgtgctttctatgggtgctttcgt

SEQ ID NO: 11757 - DNA, 201 bp, Homo sapiens
attagcaaacatacaagaatagagagaatgtgtaatgaacactcatgtaccctcaattcagcttcaactcatggtcaattttttttttttaaaaacagctscattgacatctaaataatattaaaaactgcgtgtgtttaatatacataatttgatgagtttggatgtatgcatgtgcctgtgaaaccatggccacaatca

SEQ ID NO: 11758 - DNA, 201 bp, Homo sapiens
aagttttactggaacacaaccacactcattcctgtattacgcattgtctatggctgtttttgtgctacaaaggcagagttgagtagttgtgatagagaccrtatggcctgtagtgctgaaaatatttactaattggccgtttaccataaaaaaaaaaaaaaaaagattagtgacctctggcttaaacaataaaagtgacat

SEQ ID NO: 11759 - DNA, 201 bp, Homo sapiens
tttaattataattattggttatatatacttttatagtccatgatttttcacttattattacattttaagcattcttatgtaactatactatctgctttcayaattattttaattttttgcataaaatgtcatcatctttattaaaccagaaaccattacattattttccaaatgctacacattttgatatttggctagtat

SEQ ID NO: 11760 - DNA, 201 bp, Homo sapiens
ctttaacataattgtttttaatttatgtattatctcctgatccctgttacttgcagacacatttctttaattataattattggttatatatacttttataktccatgatttttcacttattattacattttaagcattcttatgtaactatactatctgctttcacaattattttaattttttgcataaaatgtcatcatc

SEQ ID NO: 11761 - DNA, 201 bp, Homo sapiens
  misc_feature (1)...(201): n = A,T,C or G, or insertion/deletion polymorphism (see Tables 1-2)
tagtacaaggtcagcatgccaggcccatgcctgacaagcagtgaattgctcaaaccagagaaagtcaaatgtcaagagaaccatcaaagtggaaataaganataatgaatggcttgttggtaagtcaaacattgatgtcacataggcttgtgcaaaatttatggcatggataaacagtggccccaaatccctctcagtcta

SEQ ID NO: 11762 - DNA, 201 bp, Homo sapiens
tgagaataatggtcttcagctccatccataaggtttaagaatcactctttaaagtaacaatatttaccatttagaaacattttatcctgtgattggcagaygttgagtacacatatcagttgccatccaatcactcagttggggtccatgatattgaatctttgccctgagttttattcattctctttctctcagggcttc

SEQ ID NO: 11763 - DNA, 201 bp, Homo sapiens
aggggagagagaggggggagagggagagaggaagacggaactggggagaggaagggggagagagaagggggaagagggagacgagagagagagaacaaagwaacagtggactttaaggcaaattttcttttctaattatattcccttgaatgctgattcctttcagaacttagagtgccaccagggtctctgggtgggtag

SEQ ID NO: 11764 - DNA, 201 bp, Homo sapiens
agtatctctgtgttggagttattatttttctgtcttgacttttttttttttttttttttttttttttttgagacggagttttgctcttgttgcccaggctrgagtgcaatggtgcgatctccactcaccacaacctccacctcctggattcaagtggttctcctgtctcagccacatgagtagctgggattatagatgcct

SEQ ID NO: 11765 - DNA, 201 bp, Homo sapiens
  misc_feature (1)...(201): n = A,T,C or G, or insertion/deletion polymorphism (see Tables 1-2)
ctcatcctttagctctcccttgaaagtgagaacatggggtatttggttttctgttcctttgttagtttactgagaataatggtcttcagctccatccatanggtttaagaatcactctttaaagtaacaatatttaccatttagaaacattttatcctgtgattggcagacgttgagtacacatatcagttgccatccaat

SEQ ID NO: 11766 - DNA, 201 bp, Homo sapiens
cagtacaatatgttaggtcacagtgaggaaaatatagtagatctctagcaaattaacacattcaactgaaataagtgatgccatctcccaaagcatgtgtstgtgcaactgtgtgtgcgtgtgtgtgtgtgtgtgtgtgtgtcttgcactggttcttttgttgttgctgttgttgttgttgttgttgcagttgtaacatca

SEQ ID NO: 11767 - DNA, 201 bp, Homo sapiens
  misc_feature (1)...(201): n = A,T,C or G, or insertion/deletion polymorphism (see Tables 1-2)
ctgcatgttttataagcctccctagtgattctcatgcccattaaagatgtaaagctactgctttagggcatagacttactctgtgtaaccctgaaatggtnttatttaggtcatcctgttatcaagattcttgcttcttagcttttgtgcttctttcttcctttggaatatactgctcagtagcaatgcttaggagaaact

SEQ ID NO: 11768 - DNA, 201 bp, Homo sapiens
  misc_feature (1)...(201): n = A,T,C or G, or insertion/deletion polymorphism (see Tables 1-2)
acattctaccggcagggagaaacatattacaactctctttgcttagaaagacaatagcagcccattggtaaagccatgaattctggccacggctagcactnagagctcatggtgtgttttcagtctctcctttaccattatatctctggtattcaatagcagaggctcaataaggatttggagaatgaatggaaagactct

SEQ ID NO: 11769 - DNA, 201 bp, Homo sapiens
taattatagaatgctatagctccctcctatctaaattattgtattttagctccctctccttgccatctctttcccatcactactaccacatttagcctagyagggcccagtgagtttcaagatctcaagaaaacatgcaggttgttagtgtcagtttgcttctgtgtgtgtttgtgtgtgtgtgtgtgtgttgtgtgtgtg

SEQ ID NO: 11770 - DNA, 201 bp, Homo sapiens
ggaggtattctagaggagaaatttagggagttcctcctcctacccttagaaaggtgtctgcttcctttcctctcactggatgcaattgattctacctgaamccagctaattagaactcagggtataggcatttattgcatctcccagaccttgtaatttttaacttttttttagagacatggtctcactctgttaccaggc

SEQ ID NO: 11771 - DNA, 201 bp, Homo sapiens
tgacaattttacattcattatctcatttagtcatctgagtaggtatttgtttaatagcacttctaaagtaggtattcttctccctgcttcagagatggaarttctggttcagagaaccagagtttctctctggttagtgaccagcttaagatctcccagctggtgtgtgatggaagaaggatgtaagtggaggtccgcctg

SEQ ID NO: 11772 - DNA, 201 bp, Homo sapiens
tgggtgacagagcaaggttttgtctcaaaacaaaacaacaaaaccttaaatccttcagatcgggatacccagcacaattaactaacagttttcactgagcwttcatatttaaccccctgacatgaataccaattataataacaatatccattgcttattgatcacctcttgtattgatccttcagttgatccaccggagcc

SEQ ID NO: 11773 - DNA, 201 bp, Homo sapiens
ggtggctcatgcctgtaatcctagcactttgggaggccaaggcagtcagattgcctgagctcaggagttcaagaccaacctgggcaacatgatgaaatctygtctctactgaaatacaaaaaattagcccggcatggtggtggtgcctgtaatcccagctactcaggaggctgaggcaggagaatcacttgaacctgggag

SEQ ID NO: 11774 - DNA, 201 bp, Homo sapiens
  misc_feature (1)...(201): n = A,T,C or G, or insertion/deletion polymorphism (see Tables 1-2)
tacttgggtgaggaggtactggtggaggtggtgaaactgaccagtttggggatgtgcttggaaagtggactgctctgtacttgctgatggatttgatgtgnggagtaacagaaagaaaagaatgagagagaaagaatgattcttagggcttttatttaatcaactttaaaatttgaggataattttagagttgtagaaaag

SEQ ID NO: 11775 - DNA, 201 bp, Homo sapiens
acctcgcttccattttctgtctgccactttccttctctgtccataaattttctttgtggtagaaatggagcctcttcacacctgttctggttcgagatctstacaattcttgaatcattctttgttcaattaaacacaattaaactttttaaaagagcagtttgggttttatttcaactgtgatggaaaaccactggaggg

SEQ ID NO: 11776 - DNA, 201 bp, Homo sapiens
acagaatgtacagagatatcccaaataccccctgccctacacatgaatagccatccctgtgatccacatcccccaccagaatagtaccaacttgtaacaayattaattgttacaactgataggcctacatggacacaaaattatcgcctaaagtccatagtatacattaaaattcacccttggtgttgtacattctatggg

SEQ ID NO: 11777 - DNA, 201 bp, Homo sapiens
tctcaagtgattctcccacctcagcctcctgagtaggttggactacaggcatgcaccaccatacccagctaatctgtttttgtattttttttttctttttyagaggtggggtttcaccacgttgtccaggttggtctccaatgtctgggctcaagcattccaaccaccttggcctcccatagtgttaggattacagggatt

SEQ ID NO: 11778 - DNA, 201 bp, Homo sapiens
ctcccgctcatctgttcctttaattgaaccctcaataatacagattttggtgccaagaatagggctctgttgtaacaaataccttaaaaagtggcagtggycttggaattgtgtgttgggcagaggctagaataatttggagacacatcagagaaaaagactagacatccttcaacagactgtgagtggaaatacgaatgc

SEQ ID NO: 11779 - DNA, 201 bp, Homo sapiens
actaatgaaacagcatcattaccctgcagaaggtactgggcaaaatcactttgcgacagaagtttagggtgggagagaaaatgacctacactttttttccrttgttcatggtgaaggagactcgtccatgcctcaggccccagcaccgtgggagcaggcccagcctaatttttgagatcattcaaccctgccagtttgggg

SEQ ID NO: 11780 - DNA, 201 bp, Homo sapiens
  misc_feature (1)...(201): n = A,T,C or G, or insertion/deletion polymorphism (see Tables 1-2)
atgacatctcatccatccttcagcctctgcgctcctctgtgaatactcccataaagacctctaagctagataccctgcctgtgaactcccttatctctacncttgtggcatttagcaaagcaagagaagtgaaataagtaagatgaaggttctgcagtttcctagtggtgtgacctggggcaaattaatttcttagagtct

SEQ ID NO: 11781 - DNA, 201 bp, Homo sapiens
gctaattttttatatttttggtagagatagttgcaccatgttggccaggctggtctcagactcttgacctcaagtgatccacccgcctcagcctcccaaaktgctgagatcacaggcgtgagccacgcgcctggccaaaaactgtgtgtgtgttttttttgtttgttttttaataaacgtacacatacacacacaaatctt

SEQ ID NO: 11782 - DNA, 201 bp, Homo sapiens
gcatttattttcctcatggtagtgcaggttgagtggagaagctctgcctggggtggggatagtgcctctgcttcctgccacaagcgtacgaatcagtggtrtggtctctgctccacacgtgtttctgctgtgtctcgggctgaaaaggtagcagctacctggggaagctcttttcctggccatggcagaagcacagaaagg

SEQ ID NO: 11783 - DNA, 201 bp, Homo sapiens
aaacaaaagtctcaatgtgtttagaagaattgaaataatggagggtgcattctttgatcataacagcattaaaataaaaattagtaacaaaaatatatctrgaaaatctccaaatatttggaaatggcaacacacttctaaacctataggtcaaagaagaaatcagaaagacattagaaaatactttagtcagaatgataa

SEQ ID NO: 11784 - DNA, 201 bp, Homo sapiens
aacatgtgagtctttgaattctccatagggcatttgtaccttcctcagatcactggccatgttctctgctgtgtaataatgatttgtggctgtgttggtcmgctttttgctgtgagatcttagaggcgtacaacagtaagcatttattttcctcatggtagtgcaggttgagtggagaagctctgcctggggtggggatag

SEQ ID NO: 11785 - DNA, 201 bp, Homo sapiens
gcacttcctcagccttgcctcacccctatttcactttcttatagcatactctcccgtcccttgtatcatttgtcataaatctgtgtttaatcaattcatgwctatcctcccccttagactctaaacttcttgagggtgggaatcatgttcattttcttatttaccctgaaccaactagctgagtcctgacatatagcaaat

SEQ ID NO: 11786 - DNA, 201 bp, Homo sapiens
agattctcacagtgccatcaggcattctaaatgtgttttatatttaactcccaaatgagaacatgtgagtctttgaattctccatagggcatttgtacctycctcagatcactggccatgttctctgctgtgtaataatgatttgtggctgtgttggtcagctttttgctgtgagatcttagaggcgtacaacagtaagca

SEQ ID NO: 11787 - DNA, 201 bp, Homo sapiens
gggtttctccatgttggtcaggctggtctcgaactcctgacttcaggtgattcccctacctcagcctcccaaagtgctgggattacaggtgtgagccaccrtgcctgcaccttcccacggttttaagacagacatttaacatggtctctaaaatcctgcactttctgttcctattcatcttctcagcctcacctgatctca

SEQ ID NO: 11788 - DNA, 201 bp, Homo sapiens
atgattacagaacgtgttatgccaggctacaggtgggagagaaaaatctagttaccactacagtgaaatgcaatatcaaaataggcagaggttagctagtkcatagggttagtgtgaattcgaatgaagtgcacaattacttgtggcttcttatcttctttctattcacagagttaaatcctagattctcacagtgccatc

SEQ ID NO: 11789 - DNA, 201 bp, Homo sapiens
tttcatggcatagttctggtacagggtgtgatacataggagatgctcaaacatgcctaatggatggaagaatggatgaacgtattaatgaatgtattgacrgatagatggatggatggatggattaatggattgatgaatgtattgatagatggatgaatggacaggtaaatgtattgatggattgatggatagatgaatg

SEQ ID NO: 11790 - DNA, 201 bp, Homo sapiens
gatagtgaataagtctcatgagatctgatggttttaaaaaggtggagtttccctgcacaaactctttttgcctgctcccttccatgtaagacatgacttgstcctccttgccttccaccatgattgtgaggcctccccagccacatggaattataagtccattaaacctctttttcttcccagttcaggtatgtctttatc

SEQ ID NO: 11791 - DNA, 201 bp, Homo sapiens
gtcgtctctattccttgcttgcgttactacaaagcctcatctgtttgcccatctgcctcttacaaacttgcatttcaagcctccattccaaataaacacargatgaagtctaaactcagtctatatagtacttgcttatctgactcctgcgtctgtctctagcgtcctctcccaagttactttcccacttgcccccaactt

SEQ ID NO: 11792 - DNA, 201 bp, Homo sapiens
agtttttgtactgaaattccattgcagttgcctgcctatctgtccaatctcttcattccacctgttgctttctttgaccgtcgtctctattccttgcttgsgttactacaaagcctcatctgtttgcccatctgcctcttacaaacttgcatttcaagcctccattccaaataaacacaagatgaagtctaaactcagtct

SEQ ID NO: 11793 - DNA, 201 bp, Homo sapiens
taaaagcagaaggatttctgagacatcttggacatgtgagcaggtgactcacagacgttctagaaaccatatttcaaagacaatatttttggcagaatcayatggttgctttgtggtcgtttcagggagttccagcaataacataaagaaaattaacagaaaccaacaaatggtagggaaaaacgttggtgatacgtgcca

SEQ ID NO: 11794 - DNA, 201 bp, Homo sapiens
aagacagagagttgagacttttgttcattccacaaatttgcattgagcatctactttataccaggtagtattctaggttcttcaagggagaaaaagcagcrgaaggaaaaaccaggcaaaatccctgcttttatgaattctatattccagtatgtgaatatccagaaattctgaaataaaaatcgcaccttgaattgaatg

SEQ ID NO: 11795 - DNA, 201 bp, Homo sapiens
atatccagacactaaagaactgcatgttccccagacagcccgcggccccaggatcagacgctgatcttgtggagcacagattaagagatgccgcaggtctygggtgggtatagattgttgtgtctgccatcctcactcacagccctgagcacagaggtgaggacgcagccaggggccagcactctccttccatgtgtgcca

SEQ ID NO: 11796 - DNA, 201 bp, Homo sapiens
tgttcttcagttgacagaaagggagagttagagatgaacctaatgccctgcttaaatcagagggcgaagtgatatgaagtttgaatttaggaaggactttdtttttctctctctaatggcctggagatatcctacaggctatgctgggtactttgcatagactaccttcaagatgcagagaaaggaaatgcatctaatgct

SEQ ID NO: 11797 - DNA, 201 bp, Homo sapiens
  misc_feature (1)...(201): n = A,T,C or G, or insertion/deletion polymorphism (see Tables 1-2)
aagagcagtcttaggttcacagcaaaattgaacagaatgtacagagatatcccaaataccccctgccctacacatgaatagccatccctgtgatccacatnccccaccagaatagtaccaacttgtaacaatattaattgttacaactgataggcctacatggacacaaaattatcgcctaaagtccatagtatacattaa

SEQ ID NO: 11798 - DNA, 201 bp, Homo sapiens
tctccttgtgtatacctgatgggtttatcatatttgaaatgacttcatcactgtccagattccctgctaaactccacctgggcaggagcatatccccttcrtagagtccccccagcacctagatactgcctggcaagtgatggatggccaatatatccagtacttgtggactggttggcagagggagggaaagctatgcag

SEQ ID NO: 11799 - DNA, 201 bp, Homo sapiens
acaaaatttattttgacttgtcctctgactcaaggccaggatcttatgttctagcacaagaaacaaggcagaaatatgtaaaatcaccctaactatagtasagtgtttagaaaaatgtttataaaatacctataaaaatgaaaattagcttttctccttgtgtatacctgatgggtttatcatatttgaaatgacttcatc

SEQ ID NO: 11800 - DNA, 201 bp, Homo sapiens
gctcaaattctttttcagggcctcaggtcataataatgataaaacgaaacattgtatgttaagtgcttagcacagtcgtgaggcccaaggtcagttccccsataaatggtagctgctataaacatcatcatcattaccatccttgtgaaggtggagtgaacttattctttcaagacatttccactgacagataaattcatc

SEQ ID NO: 11801 - DNA, 201 bp, Homo sapiens
atatttgttgattgaaaaggtagatgtccacatggtatttatgatactctgtattatgtgggagccgtatgttcaagtgacagaaaccctactcaaactcyttaaatgaacatagaaactcactggcttgtataacaaaggggtccaggagaaatggcttcatacttggcagactctaggggctccaaatatatcgttaga

SEQ ID NO: 11802 - DNA, 201 bp, Homo sapiens
  misc_feature (1)...(201): n = A,T,C or G, or insertion/deletion polymorphism (see Tables 1-2)
tcctcttaccagtgtttcctgggatcatttctcaaaccactgggagctcaaattctttttcagggcctcaggtcataataatgataaaacgaaacattgtntgttaagtgcttagcacagtcgtgaggcccaaggtcagttccccgataaatggtagctgctataaacatcatcatcattaccatccttgtgaaggtggag

SEQ ID NO: 11803 - DNA, 201 bp, Homo sapiens
  misc_feature (1)...(201): n = A,T,C or G, or insertion/deletion polymorphism (see Tables 1-2)
ttcagcccttactttgtgctaagcatgtcacactctctcatttaatgctcttaaccctacaattacccccattttacagaggaggaaactatagtgtctcncacagaataggtgcacagtgaatttttattgaaaagaagaaaaatggcacgtgagttgaattaaggaaatgtaggccagggctggggcaggaaggcatac

SEQ ID NO: 11804 - DNA, 201 bp, Homo sapiens
acaggggctgaggatccgcactgggggcgtcgtgggcatcgggcttcagcttcccccctcttgtctagcccccctgggcgcataggggggcttgtgagcamtgcagactgcagccttcccctcaaccctccctcccctcgttggtgggctgaccctgcctctccttctctcctccgccccgttagagccctgctgcagagc

SEQ ID NO: 11805 - DNA, 201 bp, Homo sapiens
ccaaaaatgagctcggtatgaggaggatagaaaggctcaagccagagggcagaagccccgttcaaatagtggaggctatattcagagatgattacagaacrtgttatgccaggctacaggtgggagagaaaaatctagttaccactacagtgaaatgcaatatcaaaataggcagaggttagctagtgcatagggttagtg

SEQ ID NO: 11806 - DNA, 201 bp, Homo sapiens
gcttggaatggcaggttggtttcctttcaattgccaacacggaggaaataggaaaagcaaagtcagctcagatagcaggttaacaccaaaaatgagctcgstatgaggaggatagaaaggctcaagccagagggcagaagccccgttcaaatagtggaggctatattcagagatgattacagaacgtgttatgccaggcta

SEQ ID NO: 11807 - DNA, 201 bp, Homo sapiens
  misc_feature (1)...(201): n = A,T,C or G, or insertion/deletion polymorphism (see Tables 1-2)
ggtaagtcaaacattgatgtcacataggcttgtgcaaaatttatggcatggataaacagtggccccaaatccctctcagtctatattttttaaacactttnatttggaaaggcaatatattatatatacagttgtccctcagtattgtggaggattggtttgagggtctcctacagacaccaaaatctgtggatgctcaag

SEQ ID NO: 11808 - DNA, 201 bp, Homo sapiens
tcatgttcttatcccgtggaggaatgaaggaaaggcaatctctattgcagtctaatgagactgtggcatttatagaactgtaaagccgcttgggccagctrtgtcaccagaagcatttcctcctgtctgccctttctacttcatagctggtgatctcactatagcccggggtttcctggcatggcctctagaggctggccg

SEQ ID NO: 11809 - DNA, 201 bp, Homo sapiens
  misc_feature (1)...(201): n = A,T,C or G, or insertion/deletion polymorphism (see Tables 1-2)
ctcaaaccagagaaagtcaaatgtcaagagaaccatcaaagtggaaataagatataatgaatggcttgttggtaagtcaaacattgatgtcacataggctngtgcaaaatttatggcatggataaacagtggccccaaatccctctcagtctatattttttaaacactttcatttggaaaggcaatatattatatatacag

SEQ ID NO: 11810 - DNA, 201 bp, Homo sapiens
tcactaacatgttaacaaaggttgaatctgagttatagaattataggtagctttaattttaattgtatttttaatacttttctatattatttggatttttwaaaattctgcaataatttctgtatgataaataagcagcacatgtatttcttttgggaggaaaaaatattcctatttagttcctttccccttcatacacac

SEQ ID NO: 11811 - DNA, 201 bp, Homo sapiens
agacaactaacattatttttttaattgaccacaatagaatttgtgttgaaagaataaacaatacttttctccttataaaaatccttttcttctttctgttyctttatgttgtggtttctgagcccattttagagtatctctgtgttggagttattatttttctgtcttgactttttttttttttttttttttttttttttt

SEQ ID NO: 11812 - DNA, 201 bp, Homo sapiens
gcagagtttaatagctgcaacagagacggtatgtcctacaaagcctcaactatttattatcttgtctttatagaagaaagtttgccaatctctgtgtatgygtgtttgtgcatactcactaaaacatttggaaggctgttcactaacatgttaacaaaggttgaatctgagttatagaattataggtagctttaattttaa

SEQ ID NO: 11813 - DNA, 201 bp, Homo sapiens
gccaaggcaggtggatcatttgatgtcaggagttcaaaccagcctggccaacatggtgcaaccctgtctctactaaaaatataagaattagccgggagtgrtggcaggtacctgtaatcccagctactagtgaggctgaagcaggataattgcttgaacctgggaggtgaaggttgcagtgagctgagattacaccactgc

SEQ ID NO: 11814 - DNA, 201 bp, Homo sapiens
caaagttcgtttgtttacacattctctatggctgctttggcactatgtcttggtttcctagggcagccataacaaaggaatgcaacctgagcagcttaaasaacagaaatgactgtctcgcagctctggaggctagatgtccaagatcagggcatctgcaggaccacgcttccaccgaaggctccagggagggatctgttc

SEQ ID NO: 11815 - DNA, 201 bp, Homo sapiens
ctactaaaaatataagaattagccgggagtggtggcaggtacctgtaatcccagctactagtgaggctgaagcaggataattgcttgaacctgggaggtgraggttgcagtgagctgagattacaccactgcactccatcctgggtggcagagtgagaccctgtttccaaaaaaaaaaaaagttgctgtgacattcagttc

SEQ ID NO: 11816 - DNA, 201 bp, Homo sapiens
actaaaaatataagaattagccgggagtggtggcaggtacctgtaatcccagctactagtgaggctgaagcaggataattgcttgaacctgggaggtgaasgttgcagtgagctgagattacaccactgcactccatcctgggtggcagagtgagaccctgtttccaaaaaaaaaaaaagttgctgtgacattcagttcat

SEQ ID NO: 11817 - DNA, 201 bp, Homo sapiens
agtgagaccctgtttccaaaaaaaaaaaaagttgctgtgacattcagttcatgttacgcaaccttgtgaatggctctccccaggagcaagtgtctttatcraaaccaaaacatttgttccctgatccagcatttccaaacagataacaaactggatatttccaaatttcttgataatttactaaatttttcagttttccca

SEQ ID NO: 11818 - DNA, 201 bp, Homo sapiens
cctggcccatcttttcatttctttggtatactgtttttttcctcccagctttattgaggtttaactgacaaataaagtggtttgtattcaaggtgtacaawgtgatgttttgatgagtgtgtagactgtgaaatgattaccaccatcgaattaattaacacatctttcacgactgttggttaccattttgggtgtctgtgt

SEQ ID NO: 11819 - DNA, 201 bp, Homo sapiens
  misc_feature (1)...(201): n = A,T,C or G, or insertion/deletion polymorphism (see Tables 1-2)
atcttaatggcttataacaataaaggcttatttctcgttcatgcaacgtgcccaccgagggttggctacgacttctgcgccatatcgcctcacttgtgggnccagatggagcatggctggttgttgtggtgtaggtggggagggggatgtggtgagtcatacgctggctcttaagggcttcagctcacatttgattgccac

SEQ ID NO: 11820 - DNA, 201 bp, Homo sapiens
atgtgatgttttgatgagtgtgtagactgtgaaatgattaccaccatcgaattaattaacacatctttcacgactgttggttaccattttgggtgtctgtrtatgtggtgtgagtataattaagatctaatcgcttcacaaatttcaagtgtatagtatgatattactaactgtagtcaccatcctcagaacttattcatt

SEQ ID NO: 11821 - DNA, 201 bp, Homo sapiens
  misc_feature (1)...(201): n = A,T,C or G, or insertion/deletion polymorphism (see Tables 1-2)
agttaccagtctccgatatgtctttattatcagtgtgagaacagactaatacagagctctttcagtggaaaagataatacattaaatcgttataccaaacnttataatcatggatggtattgcagtcacattatctgccaggagaattggcagggactgtagaagggatgtccactatttaacttgaaccatcatacagat

SEQ ID NO: 11822 - DNA, 201 bp, Homo sapiens
  misc_feature (1)...(201): n = A,T,C or G, or insertion/deletion polymorphism (see Tables 1-2)
aatgcttgaggtgatggaaacctcattttaccctgatgcgattattatgcattaaatgcctgtaccaaaatatctcatgtactccataaatatatacaccnactatgtacccataacattttttaagaaataaaatgaaatttacatgattgggttcttctagccacagccagaatgtcatctctttaggagtgatagatc

SEQ ID NO: 11823 - DNA, 201 bp, Homo sapiens
ttataaattacccagtctcagatagttctttacattgtgaaaatgaaccaatacagtctcacagttgaatagtgatcgaatgtggtttcaaactcagccckctctgacttctgagtcttcagtgttaaccatctcacacacttatatgatttaggcttgatggaaacagcccacttttcatgaagcattatctacagagcc

SEQ ID NO: 11824 - DNA, 201 bp, Homo sapiens
aagaaactatgccaggtactttaaatatctcatttaatcctcacagtaagtctgggatgctggcactattcttacccctgcttgacagatgggaaaactgrggctcatagaaggaaacagagtgcacagtgtctctgatatggtttggctctgcgtccccacccaaatctcatctcaaattgtaatccccacgtgtcaggg

SEQ ID NO: 11825 - DNA, 201 bp, Homo sapiens
tagcatctccatggcccctcactactacagcccactctacatgctgttctgggcctcattaaaacctgttctccactagcctcggtgtttaatatttatckatcacccacagcatgcaagctggtcaataagtgttttcagaagcctcactccatgccatcttgatcagcccctgccgctattttccatcatgccagctct

SEQ ID NO: 11826 - DNA, 201 bp, Homo sapiens
cgatgaatttccccccgagttggtttgctttgtctttgtaactgagaacagcctagggagaagcatggacatgggggacctgcaggcatgagactggttgsttagcatctccatggcccctcactactacagcccactctacatgctgttctgggcctcattaaaacctgttctccactagcctcggtgtttaatatttat

SEQ ID NO: 11827 - DNA, 201 bp, Homo sapiens
aaaaaaaaaaaaaatgggataagtggtgagaagagactggagcggcaggccttggccatgctaggagggaccctttagcttccaacttcccgatgaatttscccccgagttggtttgctttgtctttgtaactgagaacagcctagggagaagcatggacatgggggacctgcaggcatgagactggttgcttagcatctc

SEQ ID NO: 11828 - DNA, 201 bp, Homo sapiens
cgacctctcaaagatgttcaccttctaaactctgactcctgtataaatgttatgatttatggcaaaagggattttgaagatgtgattaagttatggatccrtcttgagatgagagcctcatccaaaattatctggtgggcccaatataattgtgactgtacttataagaggcgggcatggaagagtcagagaaggagatgt

SEQ ID NO: 11829 - DNA, 201 bp, Homo sapiens
gaacttggtaaagtgttgaaggggcagcctggtttcttcttgctccttttagtaaaatgtgagaggaaagagattgaagcaagaactgttaagcaaaaagmaagcaagatttgatgacttgggaaattctcagcctatctggattgcaaaagatgctaaaattaggagatttactatcaggaaagcatgttaggaaagggt

SEQ ID NO: 11830 - DNA, 201 bp, Homo sapiens
tgggcctgattcaatcagtcagatgccttaagagtagagctgaggcttctctgaagagtaaattccacctgaggagagaaggtttagctcatgcccagaarttccagcctgccctgtggatattggacttacctacccattccccacaatcatgtaagccaattccttgtcatgtatttcttaatatatgtctcccgctca

SEQ ID NO: 11831 - DNA, 201 bp, Homo sapiens
ttacaatattggctttccaaagcagaagatgatgggctttctgggagggtggttcaataggaaaccttcagaaccagtggggttggatggtggagcagagkgtaaaagggagagtgatgaaaagtagagtgattgaaaggataagcgcatctgcttttagacttgctcacttaacttatatgtgcttatctggaccttggc

SEQ ID NO: 11832 - DNA, 201 bp, Homo sapiens
tttagttttcttacccattttagagttgagacattcatccctgcattccacagtgatcatttcagcctcgttaaataactttaacatttggaaacaatatmcaggactactgatagggatctaatcataattagcacctgtaatcccagcactttgggaagccgaggtgggtggatcacttgaggccaggagttcaagacc

SEQ ID NO: 11833 - DNA, 201 bp, Homo sapiens
tgcccagttctcttctgctgctgcttgatctgattccctttaatactctcagagcctaaaaccaagtctctgatacccctaccttgagatcaaagcttcakagtgtttctgtggatgagacaagtcctacagttttgcgccacctcaaaccattatagaaacaaaaaaaaattaaaatgaagaacacggctgtaaacctgc

SEQ ID NO: 11834 - DNA, 201 bp, Homo sapiens
cttgctactggacagttgtgaggcctcagtgggatgatgtctgtgaaatgctaagtattattttataaaacatcttgcagacaatggccatctcttttttwaaagtgattattagtgattccatttgttattatttattttaattcatagtttgttcctgcatcagtttgctcaggataatggtgtgcacctccattcatg

SEQ ID NO: 11835 - DNA, 201 bp, Homo sapiens
  misc_feature (1)...(201): n = A,T,C or G, or insertion/deletion polymorphism (see Tables 1-2)
caagccccaggctgccttaggctttctgaaccttgtctgcttatagacagaatagaaaaataataacaataataatatcttgctactggacagttgtgagncctcagtgggatgatgtctgtgaaatgctaagtattattttataaaacatcttgcagacaatggccatctctttttttaaagtgattattagtgattcca

SEQ ID NO: 11836 - DNA, 201 bp, Homo sapiens
ggttttataatataaagtctggaaatatcaccaacaagccccaggctgccttaggctttctgaaccttgtctgcttatagacagaatagaaaaataataayaataataatatcttgctactggacagttgtgaggcctcagtgggatgatgtctgtgaaatgctaagtattattttataaaacatcttgcagacaatggcc

SEQ ID NO: 11837 - DNA, 201 bp, Homo sapiens
ggggtttctccatgttggtcaagctggtctcaaactcccgacctcaggtgatccgcccacctcggcctcccaaagtgctgggactttaggcgctagccacygtgcccggcaagttggctccatttttcatagggaaaactgagcctgagaaatgcagttgctttgcccaaagtccctgttgacaaatctcagagatttagg

SEQ ID NO: 11838 - DNA, 201 bp, Homo sapiens
tccattaaacctctttcccttataagttaccagtctccgatatgtctttattatcagtgtgagaacagactaatacagagctctttcagtggaaaagatartacattaaatcgttataccaaacgttataatcatggatggtattgcagtcacattatctgccaggagaattggcagggactgtagaagggatgtccacta

SEQ ID NO: 11839 - DNA, 201 bp, Homo sapiens
tggttccctatgcctggaatgctcttcccactattctgcactggttgacgatgacttcttcacaacttggcttttggggcatttcctttgagagggcttcstgacagtcctgctaaccttttccataggagccctcatgtcattagctgtaccacaactttaacttgtatgtgttcatttacatgtttctgtctcttctgt

SEQ ID NO: 11840 - DNA, 201 bp, Homo sapiens
cctcatccctagtagagcatatcaatatatccaaggaatagaaagtgttcttgcctgcaagaggtggcatcatgaagtattgcctatgaattgtcaacatyatcagatttaaaactcaataataattgaaattttctacaattgaaaaacagctttggtttttgctacccccaggaaacaaaaactcatttattgctggcc

SEQ ID NO: 11841 - DNA, 201 bp, Homo sapiens
agtcacttgaggattttttttccaattcttttctttttgttgttaaagctgtacttcagtgaacagaaaaattgccaagcaaactaatggctataaaagcrtaatttgcatgtgtgggcataaactacagagcctcattgccatgaggtattgtacaaagttttaatacattttgtaaataaaattgtaaagaaagaattc

SEQ ID NO: 11842 - DNA, 201 bp, Homo sapiens
cttacctcataggattgttgagagttttaaataaaataattcacaaatgcatgtaaacacttagagcagtgccagggccatcagtgagctttcttcgtggrccctggagtcaagagcccgagagaggccctccatactgttcattctcctctggagcaggcactgccctggcacacaaatggcacatacctatttctttgt

SEQ ID NO: 11843 - DNA, 201 bp, Homo sapiens
tagcatcacacacttaaataatgcacatttcaaacattttttttttttgagatggagtttcactctcgttgcccaggctggagtgcaatggcacgatctcrgctcactgcaacctccgcctcccgggttcaagtgattctcctgcctcagcctcccgagtagctgggattacaggcatctgccaccacgtctggctaattt

SEQ ID NO: 11844 - DNA, 201 bp, Homo sapiens
gaatattatctctgggaggtaacctggaataattcacaataaattaacacttcccatcagagggacattgcagcttataagaatgtcactttgtgagaagygggagtcctgaagccatgtgatttccatctacagtttttaagcccattcagagtctaccaggggataattacttgctaagatgtaaccatcccagcagaa

SEQ ID NO: 11845 - DNA, 201 bp, Homo sapiens
tctcaatccattgctccatccactatccaaggatgcatttctggagattctgaatgggtgcaatttttctcctccatattcttgctattctagtgcatttkcttttagttccagaacctgctggtttcaagctttcttttttgaagctcatttggaaaacagtcactctgattcctctccttacaacctactccctccctt

SEQ ID NO: 11846 - DNA, 201 bp, Homo sapiens
taggtgtgtgccaccacacccagctaatttttgtattttcaatagagacaagagtttcaccatgttgccctggctggtcttgaactcctgacctcaaatgrtccacccgccttggcctcccaaagtgtgggattacaggaatgagccaccgtgccaggccgatttttcatatttctgtggtatcaattgtaatgtctcctt

SEQ ID NO: 11847 - DNA, 201 bp, Homo sapiens
atcaccattttaccagagagtcttctgagataaagaaatgggtgtgaggctgggcatggtggctcactcctgtaatcccagcactttgggaggctgaggcrggtggatcacctgaggtcgggagttcgagaccagcctgaccaacatggagaaacctcgtctctactaaatatacaaaaattagccgggcatggtggcgca

SEQ ID NO: 11848 - DNA, 201 bp, Homo sapiens
  misc_feature (1)...(201): n = A,T,C or G, or insertion/deletion polymorphism (see Tables 1-2)
atcagaaatgattcttgccatgtgaaaatctcaggtttaggaaaaggcaataagtcatccatattggtattgagttgccttattgccttacctctcagggnaataagagaacaaccaggggaaaggaaaagaaattgatcaaaatccctcaccgtaaattcatagcatttccacttacaaggctgggttgtggctaggggc

SEQ ID NO: 11849 - DNA, 201 bp, Homo sapiens
ttgtacatgacaacagcctctagcaacttgtttttttttttttttttttgtaaaatttatttttttattatactttaagttttagggtacatgtgcacaaygtgcaggtttgttacatatgtatacatgtgccatgttggtgtgctgcacccattaactcgtcatttagcattaggtatatctcctactgctatccctccc

SEQ ID NO: 11850 - DNA, 201 bp, Homo sapiens
agagagactcagtattatcaacttgaggcacttttttttttttttttgagacacagtctcactctgtcacccaggctggagtgcagtggcatgatctcagytcactacaacctccgcctcctgggttcaagctattcttgtgcctcagcctctcaagtagctgggactacaggtgtgcaccaccacacctggttaattttt

SEQ ID NO: 11851 - DNA, 201 bp, Homo sapiens
ttttgtagtgctagtgtatttgcaaaggttttagagagactcagtattatcaacttgaggcacttttttttttttttttgagacacagtctcactctgtcrcccaggctggagtgcagtggcatgatctcagctcactacaacctccgcctcctgggttcaagctattcttgtgcctcagcctctcaagtagctgggacta

SEQ ID NO: 11852 - DNA, 201 bp, Homo sapiens
ctggaagctccgcctcccgggttcacgccattctcctgcctcagcctcccgagcagctgggactataggcgcccgccaccatgcccggctaattttttttrtatttttagtagagacggggtttcaccgtgttagccaggatggtctcgatctcctgaccttgtgatccgcccgcctcggcctcccaaagtgctggtagta

SEQ ID NO: 11853 - DNA, 201 bp, Homo sapiens
ctgcccttttacaaactttgtctcctaatattcctcttcttatcactcccctcttcttttcattcactctttttttttttttttttttgaggcagagtctkgctctgtcgcccaggctggagtgcaatggcgctatctcggctcactggaagctccgcctcccgggttcacgccattctcctgcctcagcctcccgagcag

SEQ ID NO: 11854 - DNA, 201 bp, Homo sapiens
tggttccatatgaactttaaagtagttttatccaattctgtgaagaaagttattggtagcttgatggggatggcattgaatctataaattaccttgggcartatggccattttcacgatattgattcttcctatccatgagcatggaatgttcttccatttgtttgtgtcctcctttatttcgttgagcagtgttttgtag

SEQ ID NO: 11855 - DNA, 201 bp, Homo sapiens
  misc_feature (1)...(201): n = A,T,C or G, or insertion/deletion polymorphism (see Tables 1-2)
gcctaggattgtcttggcaatgcaggctcttttttggttccatatgaactttaaagtagttttatccaattctgtgaagaaagttattggtagcttgatgnggatggcattgaatctataaattaccttgggcaatatggccattttcacgatattgattcttcctatccatgagcatggaatgttcttccatttgtttgt

SEQ ID NO: 11856 - DNA, 201 bp, Homo sapiens
tagccagttttctcagcaccatttattaaacagggaatccttttcccatttcttgattttgtcaggtttgtcaaagatcagatggttgtagatgtgtggtrttacttctgaggcctctgttctgttccattggtctctatctctgttttggtgcaagtaccatgctgttttggttactgtagccttgtagtatagtttgaa

SEQ ID NO: 11857 - DNA, 201 bp, Homo sapiens
ggatccagtttcagctttctacatatggctagccagttttctcagcaccatttattaaacagggaatccttttcccatttcttgattttgtcaggtttgtyaaagatcagatggttgtagatgtgtggtgttacttctgaggcctctgttctgttccattggtctctatctctgttttggtgcaagtaccatgctgttttg

SEQ ID NO: 11858 - DNA, 201 bp, Homo sapiens
ttcttttttttttcttttttatatttatatatataccttaagttctagggtacatgtgcacaacatgcaggtttgtgccatgttggtgtgctgcacccatyaactcatcatttacattaggtatttctcctaatgctatccctcccctagccccccaccccacaacaggccccggtgtgtgatgttccctgccctgtgtcc

SEQ ID NO: 11859 - DNA, 201 bp, Homo sapiens
tctggggctgagactatggaattttctagatataggatcatgtcatctgccaacagggatagtttgacttcctctcttcctatttggatgccctttatttmtttctcttgcctgattgccctggccagaacttccaatactatgctgaataggagtggtgagagaaggcatccttgtcttgtgctgattttcaagggggaa

SEQ ID NO: 11860 - DNA, 201 bp, Homo sapiens
cagcgaattctttttctttttctattattattttgacgactcctgagttgcgcccatgctcttgtcagcttcgttttaggcgtagcatggccaggcagaaraaaatggggcaaagcgtgctccgggcggtcttctttttagtcctggggcttttgggtcattctcacggaggattccccaacaccatcagcataggtaagc

SEQ ID NO: 11861 - DNA, 201 bp, Homo sapiens
ttttgttttttgttttttgtttttttgacacggagtctcgctctgtcgcccaggctggagtgcagtggcgcgatctcggctcactgcaagctccgcctccyaggttcacgccattctcctgcctcagcctcccgagtaaatgatgctgatttttaatggatattactgtctctttaatgagacttctctggagaaagaata

SEQ ID NO: 11862 - DNA, 201 bp, Homo sapiens
aacttagccaggcatggtggcatgtgcctgtagtcccagctacttgaggggctgaggcagaagaatcgcttgaacctgggaggtggaggttgcagtgagcygagatcgtgccactgcactccagcctgggtgacggagcaagactctgtctcaaaaaaaaaaaaaaaaaaggacacctttgtgaatctggttttgaaaaaa

SEQ ID NO: 11863 - DNA, 201 bp, Homo sapiens
aactcaaaatgtcttttaaaatatattccctgtaatccttccaaagctgctcatgttaagatcttcagagaaaaagcacaataaaaacctcataatacatragcatacagcaatccaacctccagaaaaacgggagagttggtgcttggcaactgatgaacatgaaacacaatacattaaaaaaaacacattcttctttct

SEQ ID NO: 11864 - DNA, 201 bp, Homo sapiens
tgagttctagtgaagtcactgaagccaacttgccaatgagtaagaggtaaagacctagggtgtgaggaaggacttgcattcaaggctgtctgaactttccstgttaagccttcgcttccattttggagactggagcctttcagctcctcctgtccttctggcaactcttaggaaaaaatgcttaaataacaataacagagc

SEQ ID NO: 11865 - DNA, 201 bp, Homo sapiens
gtttttgtctttaattctgtttatctgatgaatcacatttattgatttgtgtatgttgaaccaatcttgcatcccagggataaagccaacttgatcatgarggattagtttttggatgtgctgctggattcggtttgctagtattttgttgaggattttgcacgtatgttcatctgggatattggcctgaagttttctttt

SEQ ID NO: 11866 - DNA, 201 bp, Homo sapiens
ccttgaaaagccttcttacattactgtactaggatcctgttccaaaattttcaatggctttctattgcccatattgaaaaaagcagtctattcttcaagarttggcatgagtatgcctcaaccaactaacaaacccattctccctatgctacccaatgagaacctcccattgtaggaagctcccattttccactgctgcct

SEQ ID NO: 11867 - DNA, 201 bp, Homo sapiens
tatgtttttagtgtatgtatgaatttgaggcatacttatactaaaaaattatttacctgaaattcaaatttaattgaaaatcttgtttttatttgctaaasctcgaaaccctatctcttgtggagcaatgattactttttaataacattattggatttgagtacatgtgagtgtgagttttggatcaagcacactcagatt

SEQ ID NO: 11868 - DNA, 201 bp, Homo sapiens
attttgataaggattgtattgaatctgtagatttctttgagtagtatggacattgcaacaatattgattcttccaatccatgaacatggaatatctttccmttttttgtgtgtccttgtgaatttctttcatcagagttttatagcgttcattgcagatatcttttacttttttggttaagtcatttcctaggtatgtaac

SEQ ID NO: 11869 - DNA, 201 bp, Homo sapiens
ttggttcccttgcatttggggtagagaggagctcagtcaaaatgctgacttggtatgtcaagggccatttataactcttgagttccaacaaaaggtgatayctggaaaattattaagtgttcaatttaagagaacattgagtaagcttatcctgcattcctacacgtagagtgtaacagcaatatattccacaacagtaaa

SEQ ID NO: 11870 - DNA, 201 bp, Homo sapiens
ggtatgatctgatttatgcttttttaaaaatccgtgtcaaatggatgagttttatgtgatataaattatacctcaatgaagctgttagtaaaaaaaaaaaagagagagagagagagagagatcagtggctatttccccattaatagaacttatgccacgttgtaattatttatttattcatacaaataacccccactgaac

SEQ ID NO: 11871 - DNA, 201 bp, Homo sapiens
atcaattacatccccatcactccctgctgtctaaccattttccttccctcctctctctctctctctctctctcacacacacacacacacacacacacacayacacacacacacacacattttcattccccttttttcttatgcttcgtcttctctctccctcctcatccaacctcacttatgccagaaaataatgatggaa

SEQ ID NO: 11872 - DNA, 201 bp, Homo sapiens
ccaacatgaactgtatcttaacaggcatcaattacatccccatcactccctgctgtctaaccattttccttccctcctctctctctctctctctctctcacacacacacacacacacacacacacacacacacacacacacacattttcattccccttttttcttatgcttcgtcttctctctccctcctcatccaacctc

SEQ ID NO: 11873 - DNA, 201 bp, Homo sapiens
agcccaacatgaactgtatcttaacaggcatcaattacatccccatcactccctgctgtctaaccattttccttccctcctctctctctctctctctctcwcacacacacacacacacacacacacacacacacacacacacacacattttcattccccttttttcttatgcttcgtcttctctctccctcctcatccaac

SEQ ID NO: 11874 - DNA, 201 bp, Homo sapiens
gctacttgaggggctgaggcagaagaatcgcttgaacctgggaggtggaggttgcagtgagctgagatcgtgccactgcactccagcctgggtgacggagyaagactctgtctcaaaaaaaaaaaaaaaaaaggacacctttgtgaatctggttttgaaaaaaaccatccaaaagcccaacatgaactgtatcttaacagg

SEQ ID NO: 11875 - DNA, 201 bp, Homo sapiens
ttttccaaaattttactaaaacaagagcattactcataagattgaacccaaacaggcagccaggagcttcaacaagcttgaggaagtgaactctgcagctyaccagatctcagaatgtacttgaaaaacagaagggcctattttgcttagagagaaaacaagtttaaataagatttagttatgctgttttgcttgccaata

SEQ ID NO: 11876 - DNA, 201 bp, Homo sapiens
cagaaatgtggctcataatttaaattaatcaaaaactgctctcttgtcctctctctctctctctcatacacacacacacacacacacacacacacacacamaaacacacacacacacacatacttaaaatgacttgttgaaatgacttgagggcttgtaatgccagcatcatagtcaaatgtatggttccacttctctggg

SEQ ID NO: 11877 - DNA, 201 bp, Homo sapiens
ccccagctgccactgtggcctggacagtgtacatcaaggttcaccctctttcctcaatcttgaagtgccccctttccacccttccgctgaaggagacctarggccagaagcagcttcccctcaccttgtcacccccacaggtcctgctgaaagggactacctgccttggccaggaagcatcagggaaaacaattggacagc

SEQ ID NO: 11878 - DNA, 201 bp, Homo sapiens
ggggagtatctgcttcaaaactagggactatgggaaacatactgcctcaatttcaaggaaagatacttaaataggagtgtttctggatattactctcagartggctgttcactctacccaaactaaaggtcagctggctttggtcatagaagacttttacaggccaaagtacaagtctaactgcccatagtaggttgggtg

SEQ ID NO: 11879 - DNA, 201 bp, Homo sapiens
  misc_feature (1)...(201): n = A,T,C or G, or insertion/deletion polymorphism (see Tables 1-2)
aggtgggttctaggcaacattcagggagaaaagataaatggataggaaaggtgtggtcatgctgtcactggaccagttatgagttccctagcaggaggtcntatgaaagggaacttgagagtagaactctgtatatctccagcatctggcacagtacttgatgctgttcaataaatgtttaatttaaaatatctaccaaat

SEQ ID NO: 11880 - DNA, 201 bp, Homo sapiens
  misc_feature (1)...(201): n = A,T,C or G, or insertion/deletion polymorphism (see Tables 1-2)
tcccctttgtctctgcgttcaaatgccaaaaggtccccatgcagaggtatccccaactggagagtcattctcctagaggacaactaaaagactcagatctnccctgactgtcactaacggccctcaaaattttatctgacctgtgtcctgtttcctcagtgcctggttctcgtcagaactaatctgacaaaccaatccata

SEQ ID NO: 11881 - DNA, 201 bp, Homo sapiens
agggtgacatttgacaaactggaacacatccagagaaggatggccagagtggtgaagagcctgggatctctgaagaacagttggcgataggctgaaaaaargaagtcatagacaggtgggatgcatattgtcagatgtttgaaagcctgtcatttgaagatgaagtagattgtttctgcatacttcagacaaaaaaaaaat

SEQ ID NO: 11882 - DNA, 201 bp, Homo sapiens
  misc_feature (1)...(201): n = A,T,C or G, or insertion/deletion polymorphism (see Tables 1-2)
ctttaaatccttctgcctcaaaggatgcatggtttccagaaaccactgaaagggtctctccaagggcacaggtttcttggctttgaagacttgggccaagnggatgggggtaacatactctgcaagaaatatgacagttgtcagctttaagaaaattttagctgaagatacagatccttatatgaacgtgttctgagatac

SEQ ID NO: 11883 - DNA, 201 bp, Homo sapiens
caccacgtctggctaattttgtatttttagtagagatggggtttctccatgttgttcaggctggtctcaaactcccaacctcaggtgatccgcctgcctcrgcctcccaaagtgctgggattacaggcgtaagccaccgcacccagcctcaaacacttttggagacattatccagtttgatcccagcaacacttctgatat

SEQ ID NO: 11884 - DNA, 201 bp, Homo sapiens
gacttgggccaaggggatgggggtaacatactctgcaagaaatatgacagttgtcagctttaagaaaattttagctgaagatacagatccttatatgaacrtgttctgagatactccatatttgactttctttggctttctgacattgacaaaaataggaatttattaattccagctagtgtgaaagttacgaaatgtctg

SEQ ID NO: 11885 - DNA, 201 bp, Homo sapiens
taaaaaataaaagtaatagtaattttagaacctaatttttcaagctatgtaggccctccctgaaaaagcagtttggaatacctcttgattgagtcaccatwgttgaaaaagaacgcctcccccatcaaaaattttatctggtctaaaatgtatgaagtaaaagcagcttagtctaagtagagagaggcttaaattggaaag

SEQ ID NO: 11886 - DNA, 201 bp, Homo sapiens
acattctcttctctgacccactcatccccatcaaaatttacccatctgatttcccactcatccttgcatctaatcagacattaatttatcttaccacagtyactgctaaataagattctatttaatcactctcccaggccacagacttcttttaaacacttgaagaagtaaacttaacagtggtatttagggttttctagt

SEQ ID NO: 11887 - DNA, 201 bp, Homo sapiens
atttcctaagcatttgtgcattttcttacaagttatgttttatcgtttcaagaaatgctgttaacctggcagtattaaaactgaatgagcaaggcctcttrgacaaattgaaaaacaaatggtggtacgacaaaggagagtgcggcagcgggggcggtgactccaaggtcagcctcaatgtcaccacaaccgggtaccctt

SEQ ID NO: 11888 - DNA, 201 bp, Homo sapiens
ttttttttttttgagatggagtttcactctcgttgcccaggctggagtgcaatggcacgatctcagctcactgcaacctccgcctcccgggttcaagtgaytctcctgcctcagcctcccgagtagctgggattacaggcatctgccaccacgtctggctaattttgtatttttagtagagatggggtttctccatgttgt

SEQ ID NO: 11889 - DNA, 201 bp, Homo sapiens
cacatttcaaacattttttttttttgagatggagtttcactctcgttgcccaggctggagtgcaatggcacgatctcagctcactgcaacctccgcctccygggttcaagtgattctcctgcctcagcctcccgagtagctgggattacaggcatctgccaccacgtctggctaattttgtatttttagtagagatggggt

SEQ ID NO: 11890 - DNA, 201 bp, Homo sapiens
aataatgcacatttcaaacattttttttttttgagatggagtttcactctcgttgcccaggctggagtgcaatggcacgatctcagctcactgcaacctcygcctcccgggttcaagtgattctcctgcctcagcctcccgagtagctgggattacaggcatctgccaccacgtctggctaattttgtatttttagtagag

SEQ ID NO: 11891 - DNA, 201 bp, Homo sapiens
ttaaataatgcacatttcaaacattttttttttttgagatggagtttcactctcgttgcccaggctggagtgcaatggcacgatctcagctcactgcaacrtccgcctcccgggttcaagtgattctcctgcctcagcctcccgagtagctgggattacaggcatctgccaccacgtctggctaattttgtatttttagta

SEQ ID NO: 11892 - DNA, 201 bp, Homo sapiens
tttctgaacctgaaaaacaatgtctcaatgaatgaccccttcccacatttatatagcatcacacacttaaataatgcacatttcaaacattttttttttttgagatggagtttcactctcgttgcccaggctggagtgcaatggcacgatctcagctcactgcaacctccgcctcccgggttcaagtgattctcctgcctc

SEQ ID NO: 11893 - DNA, 201 bp, Homo sapiens
cccaacatgaactgtatcttaacaggcatcaattacatccccatcactccctgctgtctaaccattttccttccctcctctctctctctctctctctctcwcacacacacacacacacacacacacacacacacacacacacacattttcattccccttttttcttatgcttcgtcttctctctccctcctcatccaacct

SEQ ID NO: 11894 - DNA, 201 bp, Homo sapiens
gaggcggaatttcactctatcgcccaggctggagtgcagtgacgcgatctcagctcattgcaacctccacatcccgggttcaagcgattctcccgcctcascctcccaagtagctgggattacaggcacttgccaccatgcccagctaatttttttctatttttagtagagacagagtttcaccatgttggccaggctggt

SEQ ID NO: 11895 - DNA, 201 bp, Homo sapiens
tatgacctgtgctcctttgtctctgagtgggagccccccttcacaacacacacacacacacacacacacacacacacacacacacacacacacacacacacctccttcccaaacaaggctactgtagagtttgagttcatggttttgatcaatgctaggggcgggagaggatggcgcaggggaaggtggcagtgcgggtta

SEQ ID NO: 11896 - DNA, 201 bp, Homo sapiens
cgggcatagtggcaggcgcctgtagtcccagctactcgggaggctgaggcaggagaatggcgtgaacctgggaggtggagcttgcagtgagccgagatagygccactgcactccagcctgggtgacagtgtgagactccatctcaaaaaaaaaaaattaggtacacaggtgaaacactgccacctcaagtaatacagcact

SEQ ID NO: 11897 - DNA, 201 bp, Homo sapiens
agcaagagtaaacactgccttgtagagctttccatatttttcaaagatttttcctgaagtagcttcttcatcctctgaagtagataggactaagagtgggkttttttttttcattacatagatgagaaacagacataagaaggttaaataacttgcctaagaccacatggttaaaagcactaaattttaatccttatttcc

SEQ ID NO: 11898 - DNA, 201 bp, Homo sapiens
ggcgggcatagtggcaggcgcctgtagtcccagctactcgggaggctgaggcaggagaatggcgtgaacctgggaggtggagcttgcagtgagccgagatmgtgccactgcactccagcctgggtgacagtgtgagactccatctcaaaaaaaaaaaattaggtacacaggtgaaacactgccacctcaagtaatacagca

SEQ ID NO: 11899 - DNA, 201 bp, Homo sapiens
  misc_feature (1)...(201): n = A,T,C or G, or insertion/deletion polymorphism (see Tables 1-2)
tcatgactaatcacactgcctatctctgtagtcctggataaggactagtaaagaaaaagtgaaaaaccaataagacatagttccaggcctcaagaaactcntagttcatagggaagcagccaagtaaacagatgatcatagtctagtgtgataagagcagtggcagaggggaacacagatcttaatggaaatgtagaagaa

SEQ ID NO: 11900 - DNA, 201 bp, Homo sapiens
ggctcacgcctgtaatcccagcactttgggaggctgaggcgggtggatcacgcagtcaggagatcgagaccatcttggctaacacggtgaaaccctgtctstactaaaaatacaaaaaattaggcgggcatagtggcaggcgcctgtagtcccagctactcgggaggctgaggcaggagaatggcgtgaacctgggaggtg

SEQ ID NO: 11901 - DNA, 201 bp, Homo sapiens
taatttcatattcaaggctgtcttgattgctaataaatgatcctagggaaggagctttcacattatccttagcactctaacagatatggtgagtaagaacrtacaacttcccacaatcatgatcctttcaatgtctttccagggttttactgatattttactggaaagagtcatgcatgggggagccaacattacaggttt

SEQ ID NO: 11902 - DNA, 201 bp, Homo sapiens
  misc_feature (1)...(201): n = A,T,C or G, or insertion/deletion polymorphism (see Tables 1-2)
ctgagcttaagaatggggacacagaaaaaggataactaggtgaacggatttgcaaatcagaacctggggattatgctatctaaaagacatacacatttgcnaggtaaataagagaaaaaccaaaatagagtgtgacctcagtaatactctgtcttggattaagagataaggatctagagacactgaaacaatggactaggt

SEQ ID NO: 11903 - DNA, 201 bp, Homo sapiens
ggcacggtggctcacgcctgtaatcccagcactttgggaggctgaggcgggtggatcacgcagtcaggagatcgagaccatcttggctaacacggtgaaascctgtctctactaaaaatacaaaaaattaggcgggcatagtggcaggcgcctgtagtcccagctactcgggaggctgaggcaggagaatggcgtgaacct

SEQ ID NO: 11904 - DNA, 201 bp, Homo sapiens
tctactaaatatacaaaaattagccgggcatggtggcgcatgcctgtattcccagctacttgggaggctgaggtaagagaattgcttgaacctgggaggcrgaggttgcagtgagccgagatcgggccattgcactccagcctgggcgacaagagcaaaactccatctcaaaaaaagaaagaaagaaagaaaaaaagagaa

SEQ ID NO: 11905 - DNA, 201 bp, Homo sapiens
ttaagcagttcttttgaaatacatcaaaagttttatttattttgttttttaaaaaaattaagttttggctgggcgtggtggctcacacctgtaatcccagsactttgggaggctgaggtgggcggatcacaaggtcaagagattgagaccatcctggccaacatggtgaaaccccatctctacgaaaaatataaaaaatta

SEQ ID NO: 11906 - DNA, 201 bp, Homo sapiens
gtacaacccagagatgtgatctactcaggctagaagtggacatcccaatagagcaagtaagtctcttagaaattcttgtatcagttgatgatgtcattttmtaggagttgttctgtaattaattgttgttttatcttccaggactctctctaacatggcgctgtttgtcaacgttagtcccagaattagccatcatgtgta

SEQ ID NO: 11907 - DNA, 201 bp, Homo sapiens
ctttaaaataaattaagcagttcttttgaaatacatcaaaagttttatttattttgttttttaaaaaaattaagttttggctgggcgtggtggctcacacbtgtaatcccagcactttgggaggctgaggtgggcggatcacaaggtcaagagattgagaccatcctggccaacatggtgaaaccccatctctacgaaaaa

SEQ ID NO: 11908 - DNA, 201 bp, Homo sapiens
acttcaagcagggcagagacacaactaaggggaagcaattctacagttcttcctctgatgactttaactgtcctttccccacctctgagcaggttttagaytttcatatcagatgcccaggcagataggactgatgactgtcctctggatctcttgcccctccctactctaggattcagtccagcatcttcactacatgca

SEQ ID NO: 11909 - DNA, 201 bp, Homo sapiens
gggagggagggagggagggagggaaagaaagaaagaaagaaagaaagaaagaaagaaagaaagaaagaaagaaagaaagaaagaaagaaagaaagagagaraaagaaagaaaaagaaagaaagaaagaaagagaaagaagagagagaaagaaagaaaaagagagaaagaaagaagagaaagaaagaaaaagaaagagaaag

SEQ ID NO: 11910 - DNA, 201 bp, Homo sapiens
gtacacagagatgaaaaggcaagtcctgccctcaagttgctcatatcatagtagtgaaaatacctagtgtgtcagaaaatgggaactctttttctgggggscagagagatggacgcagctggtcacagaggcaagccaaactgatgcaaaatgcattatggctaagttaaatcagagaatccaaggacacccaatgtcatc

SEQ ID NO: 11911 - DNA, 201 bp, Homo sapiens
tgcacacctgtaattccagctgtctcaaaaacaaaacaaaacaaaaaaaaacacaacaaacaaaaaataatacatgagatttggaaatgcaacctgggctytcagtttctctcttctaagttctttacgattcaacatggcttccttctgcagtttgactatttatcttcactgaataaaggtgatagctgtatcagaaac

SEQ ID NO: 11912 - DNA, 201 bp, Homo sapiens
taagcatttgtgcattttcttacaagttatgttttatcgtttcaagaaatgctgttaacctggcagtattaaaactgaatgagcaaggcctcttggacaarttgaaaaacaaatggtggtacgacaaaggagagtgcggcagcgggggcggtgactccaaggtcagcctcaatgtcaccacaaccgggtacccttagtgac

SEQ ID NO: 11913 - DNA, 201 bp, Homo sapiens
aagcatttgtgcattttcttacaagttatgttttatcgtttcaagaaatgctgttaacctggcagtattaaaactgaatgagcaaggcctcttggacaaaytgaaaaacaaatggtggtacgacaaaggagagtgcggcagcgggggcggtgactccaaggtcagcctcaatgtcaccacaaccgggtacccttagtgacg

SEQ ID NO: 11914 - DNA, 201 bp, Homo sapiens
gggctagtatggacatttttttagggtagaagcacttagcaggtgagccaaaaatgaatattttttatagaaagattcaataacaccattgagtgtactgsctggcctcagtgatgccttctggtattaaggatccattcaaaagcagatgtctaaatctgaggttttatgacaatgcctcaccatatccaaaatcattca

SEQ ID NO: 11915 - DNA, 201 bp, Homo sapiens
attctgtttatctgatgaatcacatttattgatttgtgtatgttgaaccaatcttgcatcccagggataaagccaacttgatcatgatggattagtttttmgatgtgctgctggattcggtttgctagtattttgttgaggattttgcacgtatgttcatctgggatattggcctgaagttttcttttattgttgtgtcgt

SEQ ID NO: 11916 - DNA, 201 bp, Homo sapiens
gcccatcactgctcagcaccgcccaccccatgcccccgcaagccggcctcagcactagtttaaggggagggacacgcctcccaaagctgcggggatggggktgggggttgctcactcgccctcggatctctgctgtaaaagcggagcggcagagaccgggcatgcgcagcatcttcgggcgcattgtgatgggaactgctt

SEQ ID NO: 11917 - DNA, 201 bp, Homo sapiens
cttccaatactatgctgaataggagtggtgagagaaggcatccttgtcttgtgctgattttcaagggggaatgcttctcactttttcccattcagtatgarattggctgtgggtttgtcatatatgacttactattttgaggtatgctccttcaatacctagtttatttagagttttttaacataaacagatgttgaattt

SEQ ID NO: 11918 - DNA, 201 bp, Homo sapiens
gttctaaactatctaagaaagcatctaatgatgctgatttttttgttttgttttgttttttgttttttgtttttttgacacggagtctcgctctgtcgccmaggctggagtgcagtggcgcgatctcggctcactgcaagctccgcctcccaggttcacgccattctcctgcctcagcctcccgagtaaatgatgctgatt

SEQ ID NO: 11919 - DNA, 201 bp, Homo sapiens
ggacttaggaatctgcattttaataagtatcccagatcacttatatgcacagtaaagtgtgagaatcactacacaaagcaatgaaagtctcaagccttgtrttctgaatttaggatgctcagacacagataagctgaatttattttcaaggaaggaaagtctcctttaatttaattaatattaacaacctacttaacataa

SEQ ID NO: 11920 - DNA, 201 bp, Homo sapiens
aattttaacttcaatttagagacgaagggaccacggtgatgttaacagacatggtggaggaaaatcacctcagtattataatttgcaaaaaaaaaaaaaaatctatgaaccaaaagaacagcagtttcaactgattgcagaagaccacacctttcattttttcttcctatgactcctttgtagatactgctaggaatagta

SEQ ID NO: 11921 - DNA, 201 bp, Homo sapiens
aaattttaacttcaatttagagacgaagggaccacggtgatgttaacagacatggtggaggaaaatcacctcagtattataatttgcaaaaaaaaaaaaaaatctatgaaccaaaagaacagcagtttcaactgattgcagaagaccacacctttcattttttcttcctatgactcctttgtagatactgctaggaatagt

SEQ ID NO: 11922 - DNA, 201 bp, Homo sapiens
attaccttatgtacatatatttatatattttatatatatacatataagtcattatatatgagcccatatatatacatatacacacacacacatacatacayacacacacacacacacacacacacacacacgcaaccattatacaactttatgcattgaggtggattcccaattcactaaggcttactattatacctcaac

SEQ ID NO: 11923 - DNA, 201 bp, Homo sapiens
tctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggca

SEQ ID NO: 11924 - DNA, 201 bp, Homo sapiens
caaatgtaccccctgtgtctaaaataaaagttgaaattgtaaaaaggaatgggagttatagaaaaacaaagatcatctcagaataaggaggtactttcttrcaataattgatatctcatgctggactgggctgactaaaatagctgtacactaccttataatggtctttgattaggcatatcctgctacgattagataaac

SEQ ID NO: 11925 - DNA, 201 bp, Homo sapiens
aaggaaggaaggaagggagggagggagggagggagggagggagggagggaaagaaagaaagaaagaaagaaagaaagaaagaaagaaagaaagaaagaaakaaagaaagaaagaaagaaagagagagaaagaaagaaaaagaaagaaagaaagaaagagaaagaagagagagaaagaaagaaaaagagagaaagaaagaag

SEQ ID NO: 11926 - DNA, 201 bp, Homo sapiens
ccggagatcacctgaggtcaggagttcgagatcagcctggccaacatggtgaaaccccgtgtctactaaaaatacaaaaattagccaggtgtggtggtgtrtgcctgtagtcccagctactcaggagtctgaggcaggagaatcgcttgaacccaggagacggaggttgcagtgagctgagatcgtgtcactgcactccag

SEQ ID NO: 11927 - DNA, 201 bp, Homo sapiens
aaatctacagcactagcctggttaaatcaagtttctcaactaacattctcttgagctacacaaatgatctacctgccccttcccccccacaaaaaaaaaaataccttcctttgattttcttagatcttgaaagtgaagaatcaggtcagtgatgttggtgtatgtactacatgccctctaaaattttataccaaaatagcc

SEQ ID NO: 11928 - DNA, 201 bp, Homo sapiens
cacacacacacacacacacacacacacacaaacttctcctccatacccaattaatgtgtccaccattaggctatcattcctttagctgtggtttgatcctrtgaggagatcacacttttgtatattgttcatcatttctacctcagtgtgaatgtttccaattcttttctgagcacaggatggggtggggagggcatcttt

SEQ ID NO: 11929 - DNA, 201 bp, Homo sapiens
gtaatcccagcactttgggagaccaaggccggagatcacctgaggtcaggagttcgagatcagcctggccaacatggtgaaaccccgtgtctactaaaaayacaaaaattagccaggtgtggtggtgtgtgcctgtagtcccagctactcaggagtctgaggcaggagaatcgcttgaacccaggagacggaggttgcagt

SEQ ID NO: 11930 - DNA, 201 bp, Homo sapiens
aaaaaataataaaaaaagaaaataggttctgcaatctaaaggtgaaggtacatagcaaagtcaggttttcaacacacacacacacacacacacacacacamaaacttctcctccatacccaattaatgtgtccaccattaggctatcattcctttagctgtggtttgatcctatgaggagatcacacttttgtatattgtt

SEQ ID NO: 11931 - DNA, 201 bp, Homo sapiens
aagtctctaggaggttccaaactttcccacattttcctgtcttcttctgagccctccaaactgttccaacctctgtctgttacccagtttgaaagtcgctyccacatttttgggtatcttttcagcaacgccccactctactggtaccaatttactgtattagttcattttcacactgctgataaagacatacccgaaagt

SEQ ID NO: 11932 - DNA, 201 bp, Homo sapiens
cgacactattcacaatagcaaagacttggaaccaacccaaatgtccatcaatgatagactggattaagaaaatgtggcacatatacaccatggaatactaygcagccataaaaaaggatgagttcatgtcctttgtagggacatggttgaagctggaaaccatcattctgagcaaactatcaaaaggacagaaaaccaaac

SEQ ID NO: 11933 - DNA, 201 bp, Homo sapiens
ccctaaatcatctctctcaagttcaaagttccacagatctctagggcaagggcaaaatgccaccagtctctttgctaaaacataacaagagtcacctttgmtccagttcccaacaagttcctcatctccatgtgagaccacctcagcctggaccttattgttcatatcactatcagcatttttgtcaaagcaattcgacaa

SEQ ID NO: 11934 - DNA, 201 bp, Homo sapiens
caaggatctagaactagaaataccatttgagccagccatcccattactgggtatatacccaaaggattataaatcatgctgctataaagacacatgcacaygtatgtttattgcgacactattcacaatagcaaagacttggaaccaacccaaatgtccatcaatgatagactggattaagaaaatgtggcacatatacac

SEQ ID NO: 11935 - DNA, 201 bp, Homo sapiens
tagaaatttcttctgccagataccctaaatcatctctctcaagttcaaagttccacagatctctagggcaagggcaaaatgccaccagtctctttgctaamacataacaagagtcacctttgctccagttcccaacaagttcctcatctccatgtgagaccacctcagcctggaccttattgttcatatcactatcagcat

SEQ ID NO: 11936 - DNA, 201 bp, Homo sapiens
tgcttagaaatttcttctgccagataccctaaatcatctctctcaagttcaaagttccacagatctctagggcaagggcaaaatgccaccagtctctttgytaaaacataacaagagtcacctttgctccagttcccaacaagttcctcatctccatgtgagaccacctcagcctggaccttattgttcatatcactatca

SEQ ID NO: 11937 - DNA, 201 bp, Homo sapiens
gtgtttttgaagcagcatcctaaatgattacaacacaggtaaccaagagccactctttgatgaatatttgacgattttctgctttgcttttttttttttttccctatgcaaaggatgcagcggggaggctggaagttgggcctgtggtgtagagagaagcctgagtagaagtagctggggcctgtctgacatgaagtggtg

SEQ ID NO: 11938 - DNA, 201 bp, Homo sapiens
  misc_feature (1)...(201): n = A,T,C or G, or insertion/deletion polymorphism (see Tables 1-2)
ccagatgaatactttagaaatattttcttccattctgtaggttgtctgtttgttgacagtttcttttgctgtgcagaaactctttaagtttaattagatcncatttgtcaatttttgcttttgttgtgattgcttctggtgtgtttgtcacaaaatctttgcctgttcctatgtccaggatggtattgcctaggttgtcta

SEQ ID NO: 11939 - DNA, 201 bp, Homo sapiens
atctaatacctaaatccaataagcaaaaatagtctgttagttatctctctgttaggggtatgcttgttacactcaactcatattcttgttcttttttttttatttattttcattttaggtttgtgaaggtttgttatataggtaaatttgtgtcaaaggggtttgttgtatagattatttcatcacccaggtattaagtcc

SEQ ID NO: 11940 - DNA, 201 bp, Homo sapiens
aaattagctggacatggtggcatgtgcctgtagtctcagctacttgggaggctgaggcaggaggatcacttgaacccgggaggcggaggttgcagtgagcmgagatcatgccactgcactccagcctggcaacagagcgagactctgtctcaaaaataaataattaataaaaatttaaaaaaaaaataagtttctactttc

SEQ ID NO: 11941 - DNA, 201 bp, Homo sapiens
gtcgtggggtggggggagaggggagggatagcattaggagatatacctaatgtaaatgatgagttaatgggtgcagcacaccaacatggcacatgtatacrtatgtaacaaacctgcacgttgtgcacatgtaccctagaactgaaagtataataaaaaataaaaaataataaaaaaagaaaataggttctgcaatctaaa

SEQ ID NO: 11942 - DNA, 201 bp, Homo sapiens
tgtaagtttcctttccctgggatggtatgtggaatgccacgtttaagaggtaacatccctctcaccgtcactaaatagtatctctggaggtatttggaagygtagttaagcagtatctcctcctccctccatccttcccttaccttgtctcaaacatacactctggcctccctcccagtggaaataaccagcatattctct

SEQ ID NO: 11943 - DNA, 201 bp, Homo sapiens
gagtgcttttaacagcacccaagttttaaatgctttgctgcttagaaatttcttctgccagataccctaaatcatctctctcaagttcaaagttccacagwtctctagggcaagggcaaaatgccaccagtctctttgctaaaacataacaagagtcacctttgctccagttcccaacaagttcctcatctccatgtgaga

SEQ ID NO: 11944 - DNA, 201 bp, Homo sapiens
ctttcagccatggctggagcagctgggacacaaggcaccaagtccctgggctgcacacagcacggggaccctgggcctggcccacaaaaccactttttctycctaggtctctgggcctgtgatgggaggggctgctgtgaaggtctctgacatggcctggagacattttccccccatggtcttggggattaacgttaggct

SEQ ID NO: 11945 - DNA, 201 bp, Homo sapiens
tttaaagctccaaaatgatctcctttgactccaggtcacactgatgcaagaggtgggttcccatggtcgtgggcagctccacccctgtggctttgcagggyacagccttcctcccagctgctttcatgggctagtgttgagtgtctgcggcttttccaggtgcacggtgcaagctgtcagtggatctaccattctgggatc

SEQ ID NO: 11946 - DNA, 201 bp, Homo sapiens
gggaggcaaaaggcacttcttacatggtggcggcaagaaaaaatgaggaggaagcaaaagcagaaacctctgataaacccatcagatctcttgagacttaytcactatcatgagaataggatgagaaaaaccagcccccatgatctaattaactcccctgggcccctcccacaacacagggaaattctaggagatacaatt

SEQ ID NO: 11947 - DNA, 201 bp, Homo sapiens
gatggagtcttgctctgtcacccaggctggagtgcagtggcacaatctcagctcactgaaacctctgcctcctgggttcaagcaattatcctgcctcagcytcccaagtagctgggattacaggcgcatgccaccacgcccaactaatttttgtatttttagtagagatgtgtttttaccatgttggcccctgacctcgtg

SEQ ID NO: 11948 - DNA, 201 bp, Homo sapiens
tgattagatatgcttagatacacaaatatttaacactgtgctacagttgcctactgtattagttcgttttcatgctgctgataaagacatacccaaaactrggaacaaaaaaaggtttaattggacttacagtcccacatggctggggaggcctcagaattatggcgggaggcaaaaggcacttcttacatggtggcggca

SEQ ID NO: 11949 - DNA, 201 bp, Homo sapiens
aaaattgctggatcatatgtcaattctatgtttatctgctataacttttttttttccaagatggagtcttgctctgtcacccaggctggagtgcagtggcrcaatctcagctcactgaaacctctgcctcctgggttcaagcaattatcctgcctcagcctcccaagtagctgggattacaggcgcatgccaccacgccca

SEQ ID NO: 11950 - DNA, 201 bp, Homo sapiens
ttctgagaaacttggaagaactctggccaccacaaacagcctgacttctctgcagctcacacaagattcagccactctttctggaacccaaggccttgacmttagcctataacccgcctccataatgccaaattcactctcatatccccattggaaaaaactcaattgaaagtaaacaactaatcaaagtgagttgatctt

SEQ ID NO: 11951 - DNA, 201 bp, Homo sapiens
taaaggaaggaagaaaaccactgtggctgaagaatagtagcctacattagaattatagtgatggagactgtgtgaaggaatcagatttatgattcattttsgaggtagagtcacagaatttgctgatggattggataacatttatgagcaaaaggaaagagccaaggatgactctcagattttgggcctacatcccttttc

SEQ ID NO: 11952 - DNA, 201 bp, Homo sapiens
ggctcatacctgtaatcccaacattttgggaggctgaggcaggtggatcacttgaggtcaggagctcaagaccagcctggtcaacgtggtgaaaccctgtytctactaaaaatacaaaaaaattaacagggcctggtggcacatgcctgtagtcccgagaggtggaggttgaacctgggaggtggaggttgcagtgagcca

SEQ ID NO: 11953 - DNA, 201 bp, Homo sapiens
accctgtctctactaaaaatacaaaaattagctgagtgtggtggtgcatgcctgtaattccagctactcgggaggctgaggcaggagaatcgcttgaaccmgggattcagaggttgcagtgagctgagatcttgccacaacactacagcctggcaatagagtgagactctgtctcaaaaacaaaaacaaaacaaaacaaaa

SEQ ID NO: 11954 - DNA, 201 bp, Homo sapiens
agtggctcatacctgtaatcccaacattttgggaggctgaggcaggtggatcacttgaggtcaggagctcaagaccagcctggtcaacgtggtgaaacccygtctctactaaaaatacaaaaaaattaacagggcctggtggcacatgcctgtagtcccgagaggtggaggttgaacctgggaggtggaggttgcagtgag

SEQ ID NO: 11955 - DNA, 201 bp, Homo sapiens
ctgaggcagcagaatcacttgaacctgggaggcggagattgcagtgagccgaggttgcgccattgcactccagcctgggcaacaagagcaaaactcagtcycaaaaaaaaaaaaaaaagttatgctaagtgaaataagccagatgcaaaaggccacatatcatgccatttgaatcccatttattgaatatctcatattgta

SEQ ID NO: 11956 - DNA, 201 bp, Homo sapiens
gctacatgagaggctgaggcagcagaatcacttgaacctgggaggcggagattgcagtgagccgaggttgcgccattgcactccagcctgggcaacaagascaaaactcagtctcaaaaaaaaaaaaaaaagttatgctaagtgaaataagccagatgcaaaaggccacatatcatgccatttgaatcccatttattgaat

SEQ ID NO: 11957 - DNA, 201 bp, Homo sapiens
tgggccgggcgcggtgattcatgcctgttatcccagcactttgggaggccaaggcaggtggatcacctgaggtcaggatttcaagaccagcctggccaacrtggtgaaaccccgtctctactaaaaatacaaaaaattagctgggcatggtggtgggcacttgtaatcccagctacatgagaggctgaggcagcagaatca

SEQ ID NO: 11958 - DNA, 201 bp, Homo sapiens
acacatctataacatggatgaaccttaaaaatgttatgctgggccgggcgcggtgattcatgcctgttatcccagcactttgggaggccaaggcaggtggrtcacctgaggtcaggatttcaagaccagcctggccaacatggtgaaaccccgtctctactaaaaatacaaaaaattagctgggcatggtggtgggcactt

SEQ ID NO: 11959 - DNA, 201 bp, Homo sapiens
tgccctgtgaatttgtagctgaaaagaagctggatgagatcacctttgaatacccacaatgctgccttgggcataagaggtttgcttggggacaaaaaaamagtggggaaagaaagaatttgcttgatacctcaaaaaagccagggcacacataccactaagcctaatcatgccaccattaagtggaattgtccagaagga

SEQ ID NO: 11960 - DNA, 201 bp, Homo sapiens
agggctgaaaaggtatactaggactggttaagaaattttccaaagcgttggagaacgttagctgtctgaagggaagattgccgttgttataactgttttamacacatctattgagatataattcatatatcacacaattcatccatttaaagggtataatggttttgttatatcacattattagtttttttaagttgtgat

SEQ ID NO: 11961 - DNA, 201 bp, Homo sapiens
gggatttcagccaactgtacaaacaggaaggttgggaacaccatggtcaataaccaaggaaaaatataaataaattcaaggagacttggataaattcatayaatacggatacgtggaaagttgttaaagttaagggacaggtacttgaaggacactttcacgaaggacactttcacttttagagttgacatccagaagaca

SEQ ID NO: 11962 - DNA, 201 bp, Homo sapiens
attttcctctttttatcaaatagggatgacactacttcctacttcatgggctggcataggaagaaaacagtattatacataagactattcgaacattccartaccctccaaatacatgaggaaatatgactgtctcagagatgctcaatgagtacatggaaaccagcacttatagcacttatcaagcacctactatgtgcc

SEQ ID NO: 11963 - DNA, 201 bp, Homo sapiens
ggggccccaagggacagaacaaagatcaaagagtggatattacagggatagagattttagatcaatgtaagaagaacattctaatatagcaatccatagayaaaatgagctatattcatagatagtgaggtgttcatcattgaagggactcaagaataggccacttatcagagatgttgaatagaggactcagtaatctga

SEQ ID NO: 11964 - DNA, 201 bp, Homo sapiens
  misc_feature (1)...(201): n = A,T,C or G, or insertion/deletion polymorphism (see Tables 1-2)
ccttttctctttccttcctttacctgctgggtcttgggtattcaggactgttatgttagtgtctgtacagaggcttcagggaaactccccacaagcactcntacctgaaagaatttagatgaatagccatagatattagtcagcatgggaaaataagagccacagaacctggaaagaagtagggacataagcaacttcata

SEQ ID NO: 11965 - DNA, 201 bp, Homo sapiens
  misc_feature (1)...(201): n = A,T,C or G, or insertion/deletion polymorphism (see Tables 1-2)
agtatttccaccacaaattatttggatatctgatggatatttaagaggagccatcccttctttctaactttctttggagtgccatcatctcccaaacatanggatcctggcttctgcagaaaagagaactctgcccttcccctccctggaaagtaatactccgccttttatgaagaccagatcagtttttataaggctagg

SEQ ID NO: 11966 - DNA, 201 bp, Homo sapiens
gaggagggctttcagaaataaacataaaacaacctatgcatcaatagaaaaataaaatttgattttcaaaaacgaatctaatttatggcacagcttttttytaggaattcccctgttatataacggaagacatactattttctaggcaaagcagcacaaatcagggaaaggaacatttaaaagtgttggaaaacttacttg

SEQ ID NO: 11967 - DNA, 201 bp, Homo sapiens
aaagtggaagtacaagagcactgaatgccttggagatgagccgggagggttttgaaagggagtaagacgactttcacctctatttttcccacattttcttrgtttccagctcattgtgcacatagagaatgtgtacctgtatcaaattaattctcttccctttcttactcttctcctgttgggtaactgggttttcagggg

SEQ ID NO: 11968 - DNA, 201 bp, Homo sapiens
gtgggcagtcaaaggtctgccattgattgatcagagctgggatagaaggcaatcaggtgagtcttaaaggagaaccacataattttttttaagtattaatrgcccactccacttttctggaataacaaaatatattaataataatgcccttgctcaagatatagagggcctgtttttcaagttactgtatttctttggtaa

SEQ ID NO: 11969 - DNA, 201 bp, Homo sapiens
gcaacctgggctttcagtttctctcttctaagttctttacgattcaacatggcttccttctgcagtttgactatttatcttcactgaataaaggtgatagytgtatcagaaactcaagtcaaaccaaataatggtgtgatttgtttactttggagggttttcagactttggttttgtttctgttcgacggtggtaataaaa

SEQ ID NO: 11970 - DNA, 201 bp, Homo sapiens
ttacccacctgtacagttgaaaatccacatataactttggactctctcaaaacttaactactaatagcctactattatctggaagccttaccagataacaraaatgattcattaacacgtattttatatgctatatctattatatactgtattcttacaataaagtgagctagagaaaagaaaatgtcattaagaaaatca

SEQ ID NO: 11971 - DNA, 201 bp, Homo sapiens
  misc_feature (1)...(201): n = A,T,C or G, or insertion/deletion polymorphism (see Tables 1-2)
aataacatttaaatttctttttacagtaaaatctctatcaaacagagtctgatgggtcagaatcttcaaatagccaaaatttctgcctagagattttaggnaaaaaaaaatgatttcaaaaggagcgggtgatatcagggatttagtaaaagtgacagtctccttgggctgctccagggtcagtacacatttagccagttg

SEQ ID NO: 11972 - DNA, 201 bp, Homo sapiens
atcctctccagcatctgttgtttcctgactttttaatgatcgccattctaactgtgtgagatggtatctcattgtggttttgatttgcatttctctgacgrccagtgatgatgagcattttttcatgtgtctgttgaactggcatttctaacaagttcccaggtgactcttttgctgctaatctaggacccatactttaag

SEQ ID NO: 11973 - DNA, 201 bp, Homo sapiens
cccacctatgagtgagaacatgtggtgtttggttttctgtccttttgatagtttgctgagaatgatggtttccagcttcatccatgtccctgcaaaggacrtgaactcatccttttttatggatgcatagtattccatggtgtatatgtgccacattttcttaatccagtctatcattgatggacatttgggttggttcca

SEQ ID NO: 11974 - DNA, 201 bp, Homo sapiens
taggcttgactgttgtttgtgtataggaatgctagtaatttttgcacatggattttgtatcctgagactttgctgaagttgcttatcagcttaagaagctytggggctgagactatggaattttctagatataggatcatgtcatctgccaacagggatagtttgacttcctctcttcctatttggatgccctttatttat

SEQ ID NO: 11975 - DNA, 201 bp, Homo sapiens
tcccatacatctggggtggagcccgagaactggcatttctttttctttttcttttttattttttttattatactttaagttctagggtacacgtgcacaaygtgcaggtttgttacataggtatacatgtgccatgttggtttgctgcaccaatcaacacgtcatttacgttaggcatttttcctaatgctatccctcccc

SEQ ID NO: 11976 - DNA, 201 bp, Homo sapiens
agtgtctttttattttatttattatttatttatttttgagacagagtcttgctctgtcaaccaggctagagtgcagtggcatgatcttggctcactgcaamctctgcctcccaggttcaagcgattctcctgcctcaagttcctgagtagctgggactacaggcacctgccaccttgcccagctaatattaaaaatatttt

SEQ ID NO: 11977 - DNA, 201 bp, Homo sapiens
gcgtaagtgtctttttattttatttattatttatttatttttgagacagagtcttgctctgtcaaccaggctagagtgcagtggcatgatcttggctcacygcaacctctgcctcccaggttcaagcgattctcctgcctcaagttcctgagtagctgggactacaggcacctgccaccttgcccagctaatattaaaaat

SEQ ID NO: 11978 - DNA, 201 bp, Homo sapiens
agtttaataggaatagcattgagtctataaattgctttgggcagtatggccattttcacgatattgattcttcctatccatgagtatggaatgtttttccrtttgtttgtgtcatctctgatttctttgagcagtggtttgtagttctccttgtagagatcttttggctccctagttagctgtattcctaggtattttatt

SEQ ID NO: 11979 - DNA, 201 bp, Homo sapiens
tggtggcatgcgcctgtaatcccagctacttgggaggctgaggcacgagaatcgcttgaacccggggggtggtgtggaggttgcagtgagccgagatcacrccactgcactccagcctgggcgacacagcgagactctgcactccagcctgggtaacagagcgagattctatctcaaaaaaaaaagaaagattcatttatg

SEQ ID NO: 11980 - DNA, 201 bp, Homo sapiens
ttaaaatacttttttatagttttgtgaagaaactccatggtagtttaataggaatagcattgagtctataaattgctttgggcagtatggccattttcacratattgattcttcctatccatgagtatggaatgtttttccatttgtttgtgtcatctctgatttctttgagcagtggtttgtagttctccttgtagagat

SEQ ID NO: 11981 - DNA, 201 bp, Homo sapiens
ttatcctcagcattttatttgaatataagtttaaggagtgagaatggagagttgggtaacagttaggcttaaaccccaatggtagcctctgctagactttytacacaagtgaggctctctgctgaatttattacagggggaataaaatgggagaaaacactgagtcttattttccctcatgaagaaagcctttgggagaaa

SEQ ID NO: 11982 - DNA, 201 bp, Homo sapiens
tcctctcccttctcccaccctccaccctctgagaggcccccgtatgtgtttttcccctctatgtgcctgtgtgttctcatcatttagctcccacttataartaagaacatgcggtatttgtttttctgttcctgtgttagtttgctaaggataatggcctccagctccatcaatgtctcctcaaaggacacgatttttttt

SEQ ID NO: 11983 - DNA, 201 bp, Homo sapiens
tgtatttttagtagagacgaagtttcaccatgttagccaggatggtctcgatctcctgacctcgtgatcctcctgccttggcctcccaaagtgctgggatyacaggcatgagccaccgcgcctggcccagtctatatcttttaagtagaaagtttaatctatttatattcaaagttattattaatatttgaaggctcattt

SEQ ID NO: 11984 - DNA, 201 bp, Homo sapiens
gcgaactcagctcactgcaagctccacctcctgggttcgccattctcctggctcagcctcccaagtagctgggactacagacacccgccaccacgcccggstaatttttttgtatttttagtagagacgaagtttcaccatgttagccaggatggtctcgatctcctgacctcgtgatcctcctgccttggcctcccaaag

SEQ ID NO: 11985 - DNA, 201 bp, Homo sapiens
gtgcagtagtgcgaactcagctcactgcaagctccacctcctgggttcgccattctcctggctcagcctcccaagtagctgggactacagacacccgccaycacgcccggctaatttttttgtatttttagtagagacgaagtttcaccatgttagccaggatggtctcgatctcctgacctcgtgatcctcctgccttgg

SEQ ID NO: 11986 - DNA, 201 bp, Homo sapiens
caccttggagaagtaaaataacttctataagtattagttaacttctcagtaaaatggagataatattggtttcacaaggttgttttaagaattagcaatcrtgtatataatgcacgaagcaccattcctgttgcatgtaagtgcttaataaatggtagccctctcattgtcagtatttatgcactaattggtagctagttg

SEQ ID NO: 11987 - DNA, 201 bp, Homo sapiens
tcccaggtacatagtatttcctgctgacaagctggctttaacagaacttctcttcagattagttccagctcaccttttaggaaactaacactccccccccmaaaaaaaaaaactctaaatggaaaatttgggctcttttggataaccccaagcaaattgcttcttcttttcttcattgcttttttctccccttagtaagaa

SEQ ID NO: 11988 - DNA, 201 bp, Homo sapiens
ttgattcaagaataacaatagtattgaacttctcttttgaatatcttagtaatagaaaataaaaatacatttaatccaattggtcaatggtaattggcttkggattgctggagatgccgtttcattgaaaaatagaactctagaaggctgagggaagtgaccttggagtgttcaatagtgatagcagtcctagaagcaatc

SEQ ID NO: 11989 - DNA, 201 bp, Homo sapiens
tatttcatagagttgttgtgagaattacatgagttaacacatgtaaaacccttgaaatggacctggaacaaaaagtatgtattcaattaaatgttagttaygatgggttttcttacttaaagatggcttaatcaaagtccatatagcagagtttctcaaccttagcaccattgacatttggggccggataattactggtgg

SEQ ID NO: 11990 - DNA, 201 bp, Homo sapiens
atgtctaggcgaaaggtgacctccaactccaatgaagttatctaaaagcccagccctcaaaataactcagtcaggctcataacacacaagtagaaaaactragaatagaaaccagaatttctttcccttcctttcccctgtgttcaccaatacacagtctcatgacagctgctgattgtctgaagcaaaaggacacagaca

SEQ ID NO: 11991 - DNA, 201 bp, Homo sapiens
ctgcacttaccctcccttaccctcagttccatcttttataaaatgggaattcattctttcattcaatatatatttatggggcactactgggcacacacacygttctcagtgctggggagtaagcagtgaaaaaacaatagctactgcacccacctcacagggctgctgtggggtttaaatgagatggtgtgtgttaaatca

SEQ ID NO: 11992 - DNA, 201 bp, Homo sapiens
tctgttgataaacatgcttccaatttattagtccattttggtaattcagttaattctgcactatcaacatatgggaaagtggatgttgaaccctgtcaaaytgaggaattgtgctcatgtcaagaccacgagaagagatggttccattgtcctttatgttaatgtcactatatcaagcatattgtgctcaatttgggaggc

SEQ ID NO: 11993 - DNA, 201 bp, Homo sapiens
aagtaatgattccgtaaatatggcactgaagtaatttataataccattaaaataaattctgtcagtaaaacaaattatactttctttattataaagatatrtaatgtttttcccacttcctgtgtttcagggattcttctaagtatgtattaacccatttaatttctcccaataaacctttgaagtatacacttaaaaaat

SEQ ID NO: 11994 - DNA, 201 bp, Homo sapiens
  misc_feature (1)...(201): n = A,T,C or G, or insertion/deletion polymorphism (see Tables 1-2)
gcaatggcctgtttgcaaatagtgtaaaagacaaatatgtctgaagtctccccttcctggacccccactttgtattcaggtctggttgggccaagatgaanaacacaaaacagctctttataaatgcacaaaaatgcatacccactacagggttttctataatgccaaaaataatggaaattatctaagagcccttcaaaa

SEQ ID NO: 11995 - DNA, 201 bp, Homo sapiens
  misc_feature (1)...(201): n = A,T,C or G, or insertion/deletion polymorphism (see Tables 1-2)
ttttctgcctctcatctttagttactgagccaccctcatcactcttcaagccaaatgacagtgaagatggccacagatcttttcttccacctcctcttacngctggccaagcatggctggggacgtggctactttcaggagtgaagtgagacatgctgaaagtcactttctcctcgtacaaaatatattgttcactcacat

SEQ ID NO: 11996 - DNA, 201 bp, Homo sapiens
gatagcattaggagaaatacataatgtagatgatgagttgatgagtgcagcaaatcaccatggcacgtgtatacctatgtaacaaacctgcacgttctgcwcatgtatcccagaacttaaagtataatttaaaaaaaatatatatatatatataaagataaagataataataaataacggaaattgcagtgacccactaca

SEQ ID NO: 11997 - DNA, 201 bp, Homo sapiens
ttgaacaatgagaacacatggacacagaaaggggaacatcacacgctggggcctttcagggtctggggcactaggggagggatagcattaggagaaatacmtaatgtagatgatgagttgatgagtgcagcaaatcaccatggcacgtgtatacctatgtaacaaacctgcacgttctgctcatgtatcccagaacttaaa

SEQ ID NO: 11998 - DNA, 201 bp, Homo sapiens
  misc_feature (1)...(201): n = A,T,C or G, or insertion/deletion polymorphism (see Tables 1-2)
catagctttggtgaaatttccaatgtgagaggtttattgtgtattgcctcttttaagtcaaggacaacggaagaggacaattatgctaactgaagtttctngctaaacaaaatttaatgtaacaatacattcaacttttccatacattttcacacctggattcacttgatcttcattatactctcgggagactgactcttc

SEQ ID NO: 11999 - DNA, 201 bp, Homo sapiens
acttcatgtccttttcagggacaaggatgaagctggaaaccatcattctcagcaaactgatgcaggaacagaaaaccaaacactgcattttctcactcacragtgggagttgaacaatgagaacacatggacacagaaaggggaacatcacacgctggggcctttcagggtctggggcactaggggagggatagcattagg

SEQ ID NO: 12000 - DNA, 201 bp, Homo sapiens
ccacacatctacaaccatctgatctttgacaaacctgagaaaaacaagcaatggggaaaggattccctatttaataaatggtgttgggaaaactggctagyattatgcagaaaactgaaactggaccccttccttacaccttataaaaaaattaactcaagatggatcatagacttaaatgtaagacctaaaaccatcaaa

SEQ ID NO: 12001 - DNA, 201 bp, Homo sapiens
gtcaggtagtatgatgcctccagctttgttctttttgctcagggttgctttggctacttggactctttattcattccaagtgaattttaggatttttttttctattttctgtgaaatatgacattggtattttgacaggaattgcatgaaatctgtagattgttttgagtagtatggtcattttaacaatattaattcttt

SEQ ID NO: 12002 - DNA, 201 bp, Homo sapiens
gtatatttagaaaaccccatcgtctcagcccaaaatctccttaagctgataagcaacttcagcaaagtctcaggatacaaaatcaatgtgcaaaaattacragcattcctatacaccaataatagacaaacagagagccaattcatgagtaaactcccattcacaattgctacaaacaggatataatacctaagaatacaa

SEQ ID NO: 12003 - DNA, 201 bp, Homo sapiens
ccttttcggccaggcgtggtggctaacgcctgtattcccagcactttgggagaccaaggcgggtggatcacctgaggtcgggagttcgagaccagcctggycaacatggtgaaaccccgtctctactaaaaatacaaaaattagccgggcgtggtgacacacgcctgtaatcccagctacttgggtggctaaggcagggga

SEQ ID NO: 12004 - DNA, 201 bp, Homo sapiens
taacttattttatgaggccagcatcatcctgataccaaaacctgggacagacacaacaaaaaaagaaaatttcaggccaatatccctgatgaacatcgatrcaaaaatcctcaataaaatactggcaaaccaaatccagcagcacatcaaaaagcttatccaccacgatcaagttggcttcatccctgggatgcaaagctg

SEQ ID NO: 12005 - DNA, 201 bp, Homo sapiens
gggtacatgtgcaggtttgttatataggtaaacttgtatcacaggagtttgttttgtaaattattttgtcacccaggtactaagcctaggacccaatagtwattttttctgatcctctccctcctctcagcctccaccctccaataggccccagtgtctgtagttctactctatgtgtccttgtgttctcatcatttctct

SEQ ID NO: 12006 - DNA, 201 bp, Homo sapiens
tctccctaacttattttatgaggccagcatcatcctgataccaaaacctgggacagacacaacaaaaaaagaaaatttcaggccaatatccctgatgaacrtcgatgcaaaaatcctcaataaaatactggcaaaccaaatccagcagcacatcaaaaagcttatccaccacgatcaagttggcttcatccctgggatgca

SEQ ID NO: 12007 - DNA, 201 bp, Homo sapiens
agttgtccattgtgtgtatataccacattttttgaaggccattaaactttttaagttttttttaatcttttttttcaacttttatttttggttcaagggtrcatgtgcaggtttgttatataggtaaacttgtatcacaggagtttgttttgtaaattattttgtcacccaggtactaagcctaggacccaatagttattt

SEQ ID NO: 12008 - DNA, 201 bp, Homo sapiens
aactacagaaaaagagggacatctccctaacttattttatgaggccagcatcatcctgataccaaaacctgggacagacacaacaaaaaaagaaaatttcrggccaatatccctgatgaacatcgatgcaaaaatcctcaataaaatactggcaaaccaaatccagcagcacatcaaaaagcttatccaccacgatcaagt

SEQ ID NO: 12009 - DNA, 201 bp, Homo sapiens
attagatcccatttgtcaattttggctttcattgccattgcttttggtgttttagacatgaagtccttgcccatgcctatgtcctgaattgtattgcctargttttcttctagggtttttatggttttaggtctaacatttaagtctttaatccatcttgaattaattttcgtatagggtgtaaggaagggatgcagtttc

SEQ ID NO: 12010 - DNA, 201 bp, Homo sapiens
caagagcaaacaaattcaaaacctagcagaagacaagaaataactaagatcagagcagaacgaaaggagatagagacacgaaaaacccttcaaaaaatcartgaatccaggagctgctgttttgaaaagattaacgaaatagaccactaaccagactaataaagaataaaagagagaagaatcaaatagacacaataaaaa

SEQ ID NO: 12011 - DNA, 201 bp, Homo sapiens
gttttcttttttttcttttttttcagagagctgatatagctgttgctccactcactataacattggtccgtgaagaagtcatagatttttcaaagccattmatgagcctgggcatctccatcatgataaagaagcctcagaaatcaaaaccaggcgtattctcatttctggatcccctggcttatgaaatctggatgtgca

SEQ ID NO: 12012 - DNA, 201 bp, Homo sapiens
ttcatccatgtccctacaaaggacatgaactcatccttttttatggctgcatagtattccatggtgtatatgtgtcacattttcttaatccagtctatcaytgatggacatttgggttggtttcaagtctttgctattgtgaatagtgccacaataaacatatgtgtgcatgtgtcttcatagcagcacgatttataatcg

SEQ ID NO: 12013 - DNA, 201 bp, Homo sapiens
ccctccccctccccccaccccacaacaggccccggtgtgtgatgttccccttcctgtgtccatgtgttctcattgttcaattcccacctatgagtgagaayatgcggtgtttggttttctgtctttgtgatagtttgctcagaatgatggtttccagcttcatccatgtccctacaaaggacatgaactcatcctttttta

SEQ ID NO: 12014 - DNA, 201 bp, Homo sapiens
gaggaaagagggggcacacatagagactacttcactccctgtcttcctggatcctttccaatcaataggttgccagtgtcggctgctgtcctgctttgtcractccacaaacgatctgattaattctctggtgctaactgcctcagcaggctttctcagcagtagaacagaggctaattaagatcatgtcaggcgaggagg

SEQ ID NO: 12015 - DNA, 201 bp, Homo sapiens
ttggtgtgctgcacccattaactcgtcatttagcattaggtatatctcctactgctatccctccccctccccccaccccacaacaggccccggtgtgtgaygttccccttcctgtgtccatgtgttctcattgttcaattcccacctatgagtgagaatatgcggtgtttggttttctgtctttgtgatagtttgctcaga

SEQ ID NO: 12016 - DNA, 201 bp, Homo sapiens
catttagattttattcagatattgggttgcaggatctagtaagagtgtgtccaagctcctgatcaatcacattggaaagcagaattctcagtagtgggaaraatctagatttgtcattgactaaccaaacaagtcataaaatcattcacttgtttttagagcagtgctttggttcagctaggaaggcttagttccttctag

SEQ ID NO: 12017 - DNA, 201 bp, Homo sapiens
atgtgccatgttggtgtgctgcacccattaactcgtcatttagcattaggtatatctcctactgctatccctccccctccccccaccccacaacaggcccyggtgtgtgatgttccccttcctgtgtccatgtgttctcattgttcaattcccacctatgagtgagaatatgcggtgtttggttttctgtctttgtgatag

SEQ ID NO: 12018 - DNA, 201 bp, Homo sapiens
tagtaaaagtgacagtctccttgggctgctccagggtcagtacacatttagccagttgcctccattttaacttctacagtcctgggtaatgaatacccagwatattcagaaagatgaccctgagacattgtaatatccttgggcaccaaaaaagattctgcaatattcagttggttatatttatcaaggaagaaaagtggg

SEQ ID NO: 12019 - DNA, 201 bp, Homo sapiens
  misc_feature (1)...(201): n = A,T,C or G, or insertion/deletion polymorphism (see Tables 1-2)
tcatcagggcttgtttgctatcttcccaaaacacatctggaatccagccttttctttctacctccattgctcccaccctagtccaagccacagtcatctcncctctggaatatcagaatagcctcctaactaatttccctttcttccactctgacccaactcatagtctattctccatatggcagtgagagtaatctttaa

SEQ ID NO: 12020 - DNA, 201 bp, Homo sapiens
ctaaataaataatcaagaaagttggggtgggggccaggaaaccccacaaaaagacatttgaaaacatggtatatgtttatggtttctgccatgctatctcracctctggtcaagtatcaccttagaatttttttctaggattttcattcctaaggacctagctcccaagtcaattggaagtttttgagtcattgagtctac

SEQ ID NO: 12021 - DNA, 201 bp, Homo sapiens
aaaccttgattaaccagaactcacctaaccagtaccccaactaactgaattgccccttcagtacttcacattgatgagaaagcagcaatagtattccaaamaagaagactgcaaggaattgatttttttaaaaaatacttaccaagagatgacctatggttgggtcacattcggctctttctcctctatcttctctccatc

SEQ ID NO: 12022 - DNA, 201 bp, Homo sapiens
gtgaatcatacttcacagaaaatctacagcactagcctggttaaatcaagtttctcaactaacattctcttgagctacacaaatgatctacctgccccttyccccccacaaaaaaaaaaataccttcctttgattttcttagatcttgaaagtgaagaatcaggtcagtgatgttggtgtatgtactacatgccctctaaa

SEQ ID NO: 12023 - DNA, 201 bp, Homo sapiens
taaactagacagggaccagtctacaagttaactttatattatcaggcatgaggacaagaaaggtttgttaagcaaatgaagagtttagactggaatgtcarttgaattttttcttaagagaacaaacccttttcaaatgttagaagcacttattagatataatcatattcgttacatatctataggctaaagtagctctca

SEQ ID NO: 12024 - DNA, 201 bp, Homo sapiens
  misc_feature (1)...(201): n = A,T,C or G, or insertion/deletion polymorphism (see Tables 1-2)
tcaaaggcccagagtaaacagatggtggttctaaacctcctttttaaataatcaataagaaatacatttctacatgtattatcatgagatttgtccaattncttcacagtaaaccaggaagagtacatttcttgacattacagcaattaactacaaacagttttcactccctgaaagagaatgtattagtcctgggaccct

SEQ ID NO: 12025 - DNA, 201 bp, Homo sapiens
  misc_feature (1)...(201): n = A,T,C or G, or insertion/deletion polymorphism (see Tables 1-2)
aggggccaaaacagcttcagagattgaaattatagtgagcagctattgcctgggagagctgttttatagcaaattaaatattaataatttgtcagatatgnccccataagaagagaaatgcaaacaaaaataggtgacaaaaggaaagagaagggaagagacggaaggaagggaggaaaggacaaagggagaaaaggaagg

SEQ ID NO: 12026 - DNA, 201 bp, Homo sapiens
tttaaacctattttgtaatgcaggacttgctttactcattcagacaatcctttccctctgttcctccaaatcagtgaggttttactgtattagcaaaatgrcttgagatttacatctcttcattgtgtcccatctcgttaacatgaaaattgactgttgaatataccatcatttcacagagaaagtgcgatccagagatgg

SEQ ID NO: 12027 - DNA, 201 bp, Homo sapiens
tgtcaatattagacagatcaacaagacagaaaattaacaaggatattcaggacttgaactcagctctggaccaagtggacctaatagaaatctacagaacyctccaccccaaatcaacagaatatacattcttctcagcaccacatcacacttattctaaaactgaccacatgattggaagtaaaacactcctcagcaaat

SEQ ID NO: 12028 - DNA, 201 bp, Homo sapiens
ccatctcacatgcaaagacacacataggctcaaaataaagggatggaaaaatactttccaagcaaatgaaaagcaaaaaaaaaaaaaaaaaaaaaaagcargggttgcagtcctagtctctgataaaacagactttaaaccaacaaagaccaaaaaagacaaagaagggaattacataatggtaaagggatcaatgcaaca

SEQ ID NO: 12029 - DNA, 201 bp, Homo sapiens
taaattgtaaagaccattgacactatgcagaaactgcaccaaccaatgggcaaaataaccagctggcatcataatgacaggatcaaattcacacataacartattacccttaaatgtaaacaggataaatgccgcaattaaaagacacagactggcaaattggatcaagagtcaaggcccatcggtgtgctgtattcagga

SEQ ID NO: 12030 - DNA, 201 bp, Homo sapiens
ataaattgtaaagaccattgacactatgcagaaactgcaccaaccaatgggcaaaataaccagctggcatcataatgacaggatcaaattcacacataacratattacccttaaatgtaaacaggataaatgccgcaattaaaagacacagactggcaaattggatcaagagtcaaggcccatcggtgtgctgtattcagg

SEQ ID NO: 12031 - DNA, 201 bp, Homo sapiens
caacctagcaagacaggccaacattcaaattcaggaaatacagagaacaccacaaagatactcctcgagaagagcaaccccaagacacataatcatcagaytcaccaaggttgaaatgaaggaaaaaatgttaagggcagccagagagaaaggtcgggttacccacaaagggaagcccatcagactaacagtggatttctc

SEQ ID NO: 12032 - DNA, 201 bp, Homo sapiens
cactattcaggatactatccaggagaacttccccaacctagcaagacaggccaacattcaaattcaggaaatacagagaacaccacaaagatactcctcgmgaagagcaaccccaagacacataatcatcagattcaccaaggttgaaatgaaggaaaaaatgttaagggcagccagagagaaaggtcgggttacccacaa

SEQ ID NO: 12033 - DNA, 201 bp, Homo sapiens
agttggaaaacactattcaggatactatccaggagaacttccccaacctagcaagacaggccaacattcaaattcaggaaatacagagaacaccacaaagwtactcctcgagaagagcaaccccaagacacataatcatcagattcaccaaggttgaaatgaaggaaaaaatgttaagggcagccagagagaaaggtcggg

SEQ ID NO: 12034 - DNA, 201 bp, Homo sapiens
aaaaaagaatgtaaaggaacaaacaaagcctccaagaaatatgggactgtgtgaaaagactaaaccggcatttgattggtgtacctcaaagtgacagggasaatggaaccaagttggaaaacactattcaggatactatccaggagaacttccccaacctagcaagacaggccaacattcaaattcaggaaatacagagaa

SEQ ID NO: 12035 - DNA, 201 bp, Homo sapiens
ggcctgactgttagaaggaaaactaacaaacagaaaggaatagcatcaacatcaacaaaaaggatgtccacacagaaaccccatctgaaggtcaccaacarcaaagaccaaaggtagataaatccaagaagataagaaaaaccggcacaaaaaggctgaaaattccaaaaaccagaatgcctcttcaactccaaaggatca

SEQ ID NO: 12036 - DNA, 201 bp, Homo sapiens
taaaagtgacagtctccttgggctgctccagggtcagtacacatttagccagttgcctccattttaacttctacagtcctgggtaatgaatacccagaatrttcagaaagatgaccctgagacattgtaatatccttgggcaccaaaaaagattctgcaatattcagttggttatatttatcaaggaagaaaagtgggctt

SEQ ID NO: 12037 - DNA, 201 bp, Homo sapiens
  misc_feature (1)...(201): n = A,T,C or G, or insertion/deletion polymorphism (see Tables 1-2)
gaaatctgaattccagaactgagtcttaattcccagttttatcaaaattcttatgtgtttatagcctgatttatttgactctcaactttacttcctttgantctggtctgggttacagactattatttttatgagaaatattttattttgtttttttttttaattaaggtatgttacaaataaaacttacatatcctgtca

SEQ ID NO: 12038 - DNA, 201 bp, Homo sapiens
cataatcaaaagagtgaagaagttaaagctgaccttagtgagaagcttgcatgaaagaggactgctggagtagcccaagcatgtaccaataataacttcaraatagctggtactaattagagcgtaaagaatgtggcagaacacaaagaattaatatatttgactttgtgtactcttagggcagtggaaggctccaagata

SEQ ID NO: 12039 - DNA, 201 bp, Homo sapiens
  misc_feature (1)...(201): n = A,T,C or G, or insertion/deletion polymorphism (see Tables 1-2)
gttaaagctgaccttagtgagaagcttgcatgaaagaggactgctggagtagcccaagcatgtaccaataataacttcaaaatagctggtactaattagancgtaaagaatgtggcagaacacaaagaattaatatatttgactttgtgtactcttagggcagtggaaggctccaagatagtattcaaattttgtaactag

SEQ ID NO: 12040 - DNA, 201 bp, Homo sapiens
ggattgttgaaggttatttttgttgcattaatcccacctcaaggtctctgtgtagccacttcttgcaagaaatgaattctggcaagagttatgaacaaatyaaatgtcttaaaataatcatacaagtggagaaagtaaaccaggagccagccaacttctcccctgaatcagaacatttctcctaacttctatcaccctacc

SEQ ID NO: 12041 - DNA, 201 bp, Homo sapiens
tgtatgcattttcattggattaaggttttgctctttgtaaggaggaattcataaggtaaacctttggttctcaatgtgggagatgagctatgttgccctcrtgagggatatttgatgatgttctgaggcattttgggttgtcacaacaggtagtaggagtggtgcccatggcatttagagggtagaagtcagtgatgttgc

SEQ ID NO: 12042 - DNA, 201 bp, Homo sapiens
attatgttaaggatttttgcatcaatatttatcagagatattggcctctagctttctttttttgatgtgtctttattgggttttggtatctggttaatacygcccttggagaataagtttgtaagtctagggataatttatgagcaattaaaatgcttttaaatgatacgataggaaaatgagcaggataagaggcagcca

SEQ ID NO: 12043 - DNA, 201 bp, Homo sapiens
aggaggcaggaaaagcgatacttgattgactgcgaagtcgaaaggattaacacaattttggaacaggtacgtttgagatttatttcaccgccagccaacaygttaaattatcaacctaagtcagctcccatatctgctaataaattaagtagccaacagactaaacgtgccaacagtttttgatagtctctctaatccttt

SEQ ID NO: 12044 - DNA, 201 bp, Homo sapiens
gtaatagcaacctcctccgagctaaaggagcatgttttaacccaatgcaaggaagctaagaaccttcaaaaaaggttagaggaattgctaaccagaataaycagtttagagaagaacataaatgacctgatggagctgaaaaacacagcacgagaacttcatggagcatacataagaatcatagctgaatcgatcaagcag

SEQ ID NO: 12045 - DNA, 201 bp, Homo sapiens
aattatctctgtaacattagtatcttttgagagatttgagagagtttccaccttgaagtctgaggtcacaacatcaaacagagaagcttagcaagcattayagaaaagtgaaattccttaaaataattaaataacaagaaagtatgaaccatgagccagccaatttttgtctttgtgccaaactatttatcctaacttcca

SEQ ID NO: 12046 - DNA, 201 bp, Homo sapiens
ttatatttttagtagagacggggtttcaccgtgttagccaggatggtctcgatctcctgaccttgtgatccgcccgcctcggcctcccaaagtgctggtaktacaggcgtgagccaccgcgcctgtcctcttttcgttcactcttttcccttgtggatatttgttggtcacttctgttatattactttctttgctgaagct

SEQ ID NO: 12047 - DNA, 201 bp, Homo sapiens
ttaatgaaataaagcgtgaagacaagattagagaaaaaagaatgtaaaggaacaaacaaagcctccaagaaatatgggactgtgtgaaaagactaaaccgrcatttgattggtgtacctcaaagtgacagggagaatggaaccaagttggaaaacactattcaggatactatccaggagaacttccccaacctagcaagac

SEQ ID NO: 12048 - DNA, 201 bp, Homo sapiens
tttagttactgagccaccctcatcactcttcaagccaaatgacagtgaagatggccacagatcttttcttccacctcctcttacagctggccaagcatggmtggggacgtggctactttcaggagtgaagtgagacatgctgaaagtcactttctcctcgtacaaaatatattgttcactcacatgaaatcaaaactaaaa

SEQ ID NO: 12049 - DNA, 201 bp, Homo sapiens
cagaggggcctgactgttagaaggaaaactaacaaacagaaaggaatagcatcaacatcaacaaaaaggatgtccacacagaaaccccatctgaaggtcaycaacatcaaagaccaaaggtagataaatccaagaagataagaaaaaccggcacaaaaaggctgaaaattccaaaaaccagaatgcctcttcaactccaaa

SEQ ID NO: 12050 - DNA, 201 bp, Homo sapiens
gacttccagcaaactccagcagactggcagcagaggggcctgactgttagaaggaaaactaacaaacagaaaggaatagcatcaacatcaacaaaaaggaygtccacacagaaaccccatctgaaggtcaccaacatcaaagaccaaaggtagataaatccaagaagataagaaaaaccggcacaaaaaggctgaaaattc

SEQ ID NO: 12051 - DNA, 201 bp, Homo sapiens
gtattttatatgctatatctattatatactgtattcttacaataaagtgagctagagaaaagaaaatgtcattaagaaaatcataaagaagagaaaatatrtttactattctttaagtggaagttgatcatcataaaggtcttcatcctcattgttttcatattaagtaggctgaagaggaagaggaagaggagaagttgg

SEQ ID NO: 12052 - DNA, 201 bp, Homo sapiens
ctatgccaccagggccctgggtttcaagcacaaaactgggcagccatttgggcagacaccgagctagctgcaggatttttttttcataccccagtggcatmtggaatgccagcgagacagaaccattcactgccctggaaagggggctgaagccagaaatccaagaggtctagctcagcagaccccaccctcatggagccc

SEQ ID NO: 12053 - DNA, 201 bp, Homo sapiens
  misc_feature (1)...(201): n = A,T,C or G, or insertion/deletion polymorphism (see Tables 1-2)
taaatactgtcatattttacagctgtcatgcaaagctgaaaaaaggcttcactgtgattagatcctgtttactgtaatatttccagctcagactcagaaangcagttttcctataaaggtattttccataagtagaatatttctccagaaaatgacgattaattttaatgtatttttaactccttggtggcagtgaatttg

SEQ ID NO: 12054 - DNA, 201 bp, Homo sapiens
gtcaagtcataaaggcaattttaaaaactaactcctggccaggtgtagtggctcacacctgtagtcccagcactttgggaggccgaggcaggcagatcacragctcaggagattgagaccagcctggtcaacacggtaaaaccctgtctctactaaaaatacaaaaattagctgagtgtggtggtgcatgcctgtaattcc

SEQ ID NO: 12055 - DNA, 201 bp, Homo sapiens
gacagacagacagacagacagacagaaagaaagaaagaaagaaagaaagaaagaaaggaaggaagaagaaaggaaagaaagaaagaaagaaagaaagaaasaaagaaagaaagaaagaaagaaaggaaagaaagaaagaaagaaagaaaaaaaggacagactatcatggattctttttcttcttcactttaagaactgatt

SEQ ID NO: 12056 - DNA, 201 bp, Homo sapiens
ggggctaatgagctaaagtggtagtggctgacagtgagttaaattcttgacccttcaaattagagcagtttgattggcaaggaatgcctttctaatgatarcattttaagcttgtactaggctggaggagatggcacttgtgtgtaacggggtgctgcttgacacacctccagtcacacagtggaaatggctgcctacttt

SEQ ID NO: 12057 - DNA, 201 bp, Homo sapiens
gcacaaaatacctctctctctctccctctttctctatcttccttctctttcttcgcctcctttcctcctttctcctctccactccttacgcccttttcttyctctctacacacacactcatgcgcgcgcacacacacacacacacctcaataccaatcaatgacacatgtcaacaaatctgttattgttatcattttattc

SEQ ID NO: 12058 - DNA, 201 bp, Homo sapiens
ctgtggttttgatgcatttctctaatgatcagcaatgctgagctttttttcatgtgcttgttggccacacacttgttttcttttgaaaggtgtctgttcgygtcctttgtcaatttttcaatggggttgtttgagttttttgtgtaaatttgttttaattgcatatagatgctggatattagacctttgtcagatgtatag

SEQ ID NO: 12059 - DNA, 201 bp, Homo sapiens
tttttttattatactttaagttttagggtacatgtgcacaatgtgcaggtttgttacatatgtatacatgtgccatgttggtgtgctgcacccattaactygtcatttagcattaggtatatctcctactgctatccctccccctccccccaccccacaacaggccccggtgtgtgatgttccccttcctgtgtccatgtg

SEQ ID NO: 12060 - DNA, 201 bp, Homo sapiens
tcaccaagacgttccagaagacaatgttactttatcactcatttgcctgtggttccatttataggctgggggtggttctctctaactcagaatttttaaamtcagaaggattaaatgaaaggcttatctgcctgaggggtacctgtagaagaggtccttctaagtaacttaacttgaacggccattttgctcttgggaatc

SEQ ID NO: 12061 - DNA, 201 bp, Homo sapiens
actgtcagtctaatgggaactcccatcagactaagtgactagatgcttttctcttgctatttttagaattatctttgacttttgacagtttgactacaatrtgccatggagaagacctttataaagatttagggatctctgagcttcctgtatttgtatgtctaaatcttttgctacatctggaaagttttcagctattat

SEQ ID NO: 12062 - DNA, 201 bp, Homo sapiens
cccagctaattttcgtatttttagtagagacggggtttcaccgtgttagccagggtggtctcgatctcctgacctcgtgatctgcctgccttggcctcccraagtgctgggattacaggcgtgagccaccgcgacgggatttttccttttaatataaagacgtttcctgtgcatgtgtctgagggtcacttagaattcttc

SEQ ID NO: 12063 - DNA, 201 bp, Homo sapiens
ttgactcataccccacttatgaaaagaagaggaaggggctgtaagtaataactgaaaaagctgtttcactaaaatgttttctaagactgtcttgttatccrtggtaaagaaatgtaaaattaagagaagcacggatggaggtgctgactctacagatattgtttatgtttagtttgtgaataaattcaccaagctatacac

SEQ ID NO: 12064 - DNA, 201 bp, Homo sapiens
aagactgtcttttccccaatatatgttcttggcatctttgttgaaaatgagttaactgtaggtgtgtggatttgtttctgggttctctattctgttacatyggtctgtatgtttttatgccagtatcatgctgttttggttactgtagctctgtagtataatttgaagtcaggcaatgtgattcctccagttctgttcttc

SEQ ID NO: 12065 - DNA, 201 bp, Homo sapiens
ctcatcattccaaataaaaatgacagtcacagttctgtcccaaatgaacaacagataataaacaataattatacaaatatgtttggttttcatgccactayatttctcagtgtttggagaaaatttgtaccttctataacttgcacaccattttggattttcttatacaaaatacgggtattttatactacaaaaatgtgg

SEQ ID NO: 12066 - DNA, 201 bp, Homo sapiens
gaaaatattcagcccactcacatattttgagataataaaaatgtacttcgtgaactgtacaaagtacatttttattaatacaaagcctattattagacttkgtactaatatagcattattcataaaaattatggtaagaatgatgatactgaggaagggtttctcaaccttagcactactgacattttgggcctgagaatt

SEQ ID NO: 12067 - DNA, 201 bp, Homo sapiens
  misc_feature (1)...(201): n = A,T,C or G, or insertion/deletion polymorphism (see Tables 1-2)
aggcaagttcacagtgcttttaagggagagttgggaaagagtgggaatgttatcaaaggagagcatcttaaatactgggctgcttggttggtgatctactncattgtcgtttagaaccaagacttgagtaagacataacaagctgcatgtcaagggcactgagtttggactcccaggtttgaatcccaaccctgccacaaa

SEQ ID NO: 12068 - DNA, 201 bp, Homo sapiens
cataatgttaatgaaagcaataagttcaagggataattttataaaactgtcattagagtatttgccaaagagagagttgcattatctctatcatatctctyatttcactataccagagcctgcataactgcagtgattattttaggacttaagacaaatactttatttattctaagaacacattgatatacaacttatata

SEQ ID NO: 12069 - DNA, 201 bp, Homo sapiens
  misc_feature (1)...(201): n = A,T,C or G, or insertion/deletion polymorphism (see Tables 1-2)
taaaattcgacttacgaaaactcaactaacaaggacaattaactggaatgcttggttgcactccacttttgaaaggaaaaggcaacttagacacacaaaancttgataagaattttttccccaaaagcctactagatgatgtcctgcagtcagattcattctagtcttcaacatcattcacactttggtcagagagtaaat

SEQ ID NO: 12070 - DNA, 201 bp, Homo sapiens
ataaatttcttgctaatttggggagatagctaatatcagagaagctacagaagtcataaacatggtcgtgttaaagaaaaactaatttccctttgctgtgrtactctagattgaatactagttaaaaatcactccaattctgccttccaaaaaaaatctagaatatttccaaatataaacagggtgccatgaaaagtcctc

SEQ ID NO: 12071 - DNA, 201 bp, Homo sapiens
  misc_feature (1)...(201): n = A,T,C or G, or insertion/deletion polymorphism (see Tables 1-2)
ttgctaataaatgatcctagggaaggagctttcacattatccttagcactctaacagatatggtgagtaagaacatacaacttcccacaatcatgatcctntcaatgtctttccagggttttactgatattttactggaaagagtcatgcatgggggagccaacattacaggtttccagattgtcaacaatgaaaacccta

SEQ ID NO: 12072 - DNA, 201 bp, Homo sapiens
  misc_feature (1)...(201): n = A,T,C or G, or insertion/deletion polymorphism (see Tables 1-2)
atgctcctaatccagtaggaaagttagaaacacatagattataaaaatgttatgtctaagtcttgcacaggatgctatgaattaaagaagggatcccagangggatgcggggaaactgtcactaacattcaatactggaccacatccttaaaaatagatttctctgagtggtagtccaattctacttctggtcaccaaacg

SEQ ID NO: 12073 - DNA, 201 bp, Homo sapiens
aagtgttctggcttccagtacttctacatttcttgtctagtgctccatactcctgaccccttaggcttaataaatttcatcagtctttggattatccctcyatggcttagctctcttgtctgttacctgtctgtagctgagtgtgggttaaataagagggaaagctcatccctgtcactgtagtagctggcaaatgtgtaa

SEQ ID NO: 12074 - DNA, 201 bp, Homo sapiens
atggcttagctctcttgtctgttacctgtctgtagctgagtgtgggttaaataagagggaaagctcatccctgtcactgtagtagctggcaaatgtgtaamcctctcaagaaacagaactaaatccattttggttaataataattaatatagctagcatgtattctgatgcttaatagatgccacatactgttctaaacat

SEQ ID NO: 12075 - DNA, 201 bp, Homo sapiens
  misc_feature (1)...(201): n = A,T,C or G, or insertion/deletion polymorphism (see Tables 1-2)
ttttgttccacaacagcacttcaatttcatgcagtacttttctgagggaaaaataggcatccaggtcaaatgtcttctctttctaggctggctactggaangagtatgaaaggtttgtgcctttctcagatcagcaaatcagcaatgacagtgcatcctcagagaatcggaccatagtagtgactaccattctggtaagtg

SEQ ID NO: 12076 - DNA, 201 bp, Homo sapiens
  misc_feature (1)...(201): n = A,T,C or G, or insertion/deletion polymorphism (see Tables 1-2)
gcaatgacagtgcatcctcagagaatcggaccatagtagtgactaccattctggtaagtgtgaacagaaggtaggtgggctttctgtccagcaagacttcngttttctgaaaagtatttttccaccagtagaaaagacctcaagttcaaacagtaaaaacttccaacagggaagctcaggaaactctcaaagtatcttgcc

SEQ ID NO: 12077 - DNA, 201 bp, Homo sapiens
tgggggttaatttccccctgacttgcctatgctgtttcccagtgatcattttttaactttcccagaggggtaaaatggtatacattaataaaaatgtcaasaatattatctctgggaggtaacctggaataattcacaataaattaacacttcccatcagagggacattgcagcttataagaatgtcactttgtgagaagt

SEQ ID NO: 12078 - DNA, 201 bp, Homo sapiens
  misc_feature (1)...(201): n = A,T,C or G, or insertion/deletion polymorphism (see Tables 1-2)
gactaggctgaagtttgcctttcatctaagcatacatatcaaatactccctttgtcttaagtactatactaggccctggagatataaaaatgtaaatgccncggacgctgacctcacagggatcacaatgcttccccagggctttgcctcaactacctgcaattcctacataataaatcttgagaaatgaaaggcacttca

SEQ ID NO: 12079 - DNA, 201 bp, Homo sapiens
cccagaatgggttgactatgattcactaacttctttgacaaataatttgatgctatatgcatcactctgtgtgttagtatgtaagagctctttcttctacraatgaaactctactgataaagcttcagtgaataaggattgtggcatttttttctttcagatcctatatgtgaggattaaaataaatttccttaaaacaat

SEQ ID NO: 12080 - DNA, 201 bp, Homo sapiens
ccaggcttcccaaggtttgcaactcttcctgacataacacttaagcctagggataccccttactgaacagccttccgaatgccacaggccctgcttagtcktcattagtgcatttcagatattccatgttcacatcctagctctgacatatgctagctatgttgaacaagttgggttacttctctgaacctcagtttcctt

SEQ ID NO: 12081 - DNA, 201 bp, Homo sapiens
tgaaaaatgaacagaatggctctgccaggggcttatctatagtccaactgcaaaagaattaatatgggcaattagggcttttaagaaaggtacagtgataycttcagagctcctggttcacttagtattaaatggttttggcctctgattgtgaatgacagatcttgggcagcttaatgaggcacatgtaaataagcagaa

SEQ ID NO: 12082 - DNA, 201 bp, Homo sapiens
ctacggccataccactctaaatatgcccagtctcctctaatagtgagacaatatattgaggatacactctattaaaacaggctcagaaattaagagtctgmtcttaaataatatacagtaaggtctattgattaatttgctagagcacacacatcataattcatctaatcaggctcctccaacacccagttgtctttgacg

SEQ ID NO: 12083 - DNA, 201 bp, Homo sapiens
caggtgcccgccaccatgcccagctaattttcgtatttttagtagagacggggtttcaccgtgttagccagggtggtctcgatctcctgacctcgtgatcygcctgccttggcctcccaaagtgctgggattacaggcgtgagccaccgcgacgggatttttccttttaatataaagacgtttcctgtgcatgtgtctgag

SEQ ID NO: 12084 - DNA, 201 bp, Homo sapiens
tccttttatttatttatttgtttatttttgagacggtgtctcactctgtcggtcgcccaggctggagtgcagcggcacgatctcggctcactgcaacctcygcctcccgggttcaagcgattctcctgcctcagcctcccgagtagctgtgactacaggtgcccgccaccatgcccagctaattttcgtatttttagtaga

SEQ ID NO: 12085 - DNA, 201 bp, Homo sapiens
ctaacgcctgtattcccagcactttgggagaccaaggcgggtggatcacctgaggtcgggagttcgagaccagcctggccaacatggtgaaaccccgtctytactaaaaatacaaaaattagccgggcgtggtgacacacgcctgtaatcccagctacttgggtggctaaggcaggggaatcacttgaacccgggcagcgg

SEQ ID NO: 12086 - DNA, 201 bp, Homo sapiens
gcgggtggatcacctgaggtcgggagttcgagaccagcctgaccaacatggagaaacctcgtctctactaaatatacaaaaattagccgggcatggtggcrcatgcctgtattcccagctacttgggaggctgaggtaagagaattgcttgaacctgggaggcggaggttgcagtgagccgagatcgggccattgcactcc

SEQ ID NO: 12087 - DNA, 201 bp, Homo sapiens
ccattttaccagagagtcttctgagataaagaaatgggtgtgaggctgggcatggtggctcactcctgtaatcccagcactttgggaggctgaggcgggtrgatcacctgaggtcgggagttcgagaccagcctgaccaacatggagaaacctcgtctctactaaatatacaaaaattagccgggcatggtggcgcatgcc

SEQ ID NO: 12088 - DNA, 201 bp, Homo sapiens
ggcctcagtgatgccttctggtattaaggatccattcaaaagcagatgtctaaatctgaggttttatgacaatgcctcaccatatccaaaatcattcactstcatccctcacccctcagtaactaggcaaggacacataaaacatatccagtccaaaggcacaaatcaggcagttgtcctagtagggttggagaaggtggg

SEQ ID NO: 12089 - DNA, 201 bp, Homo sapiens
catttggggcactattttaaaacatagactactgggtctcatgccccacctcaagatgctaattccatgcatctgtgtttttccaataatctgtgtttttraagcagcatcctaaatgattacaacacaggtaaccaagagccactctttgatgaatatttgacgattttctgctttgcttttttttttttttccctatgc

SEQ ID NO: 12090 - DNA, 201 bp, Homo sapiens
gaacataggtaaggaagaatggtgatagttaatcagcagtcctggagacacaaatttgtggtcgccttgtgatacaggtaaattatacaatgagtttctgyttgctgtccttatgtgtatcttaagaaataactccttcattctacctcaggtaaaagctcactctttctcccaatgcaccttggctactgtcaaccttgc

SEQ ID NO: 12091 - DNA, 201 bp, Homo sapiens
tagagagaagcctgagtagaagtagctggggcctgtctgacatgaagtggtgtcttgagagtgatcacagctgactggctgaggtcaagccacccgctctstgtgttcctgtcagggattgagaaaaaggaaaaacctttcctctaatcaacagggaccagtgggagataattgtttcaggggctggaatctgaggtcgaa

SEQ ID NO: 12092 - DNA, 201 bp, Homo sapiens
gaaaatcctttacatctgaaaagcagaaattatctagtccacctgagtgccctgggagtgggtctgtattcttagcctcatgcttccagtgctgagtttaraacaaaagcctctattcaaggtcatatggtgagtcagctactgaacagggagtgaaaagaaagggggaacaaacaacccacaacaggattagcttgagct

SEQ ID NO: 12093 - DNA, 201 bp, Homo sapiens
  misc_feature (1)...(201): n = A,T,C or G, or insertion/deletion polymorphism (see Tables 1-2)
aaggaaagttcattaaaatatggttggaagctatgggcaagagaaaggtccttaaaaatgaaaagggacagaatgagagattgcaccaagagctttgaacncttaacctttagccaaagatctctcctactatcatgttatccctcctccccctccctccttctttgtccttacacttgccttttatgatgaggcagctct

SEQ ID NO: 12094 - DNA, 201 bp, Homo sapiens
gaggcttcagagagcctcatgcctccaagttcccaatctagaggactgtagctgggtagacataaacctggttaccaagaagagctcaaaattaggaggaygtaaatgttatcaggaaaagaaacagattttaaaactgatacagaaggaaaagaaccaggagccaggaaattcctgccctgtagccagaagcacaaccct

SEQ ID NO: 12095 - DNA, 201 bp, Homo sapiens
taatgtcttaaaatgttaggataagaagtgaaagagacctagaagccaaacaaatcctgcccttgtacagtacctctctcctaatttccatcatccctctytaccttttctcctttcccctcttactgttgaatatcagctctgctgtgttagtgtctctgaagaggctgtggagagaatcagtctttaatttttgcaata

SEQ ID NO: 12096 - DNA, 201 bp, Homo sapiens
ttcagagcatggactctggagccagtctgcatggattctgtcacttactatctttgtgacccaaggcaagttattcaattctctgtgcctccattttttcrtagtaaagtgagagtgataactgtactatgatgagttaatatatgcaaaccatttagaaaggtgcctgacacgtagtgtttatatagtgctttgatgcca

SEQ ID NO: 12097 - DNA, 201 bp, Homo sapiens
aacaagagaacttttcccttctatctaactgtatgtttatactcattaaccagcctctcttcatcctgccccctctctcacccttcccagcccctactaavtatcattctactctctacttccgtgagatcaaaatttttagctcccagatatgagtgaaaatatacaatatttgtctttctgagcatggcttatttcact

SEQ ID NO: 12098 - DNA, 201 bp, Homo sapiens
  misc_feature (1)...(201): n = A,T,C or G, or insertion/deletion polymorphism (see Tables 1-2)
atatttccctttcttagtgtctcatacacaaggcagccttctccagcccttgaaaggcaccttttataatgccaagaagcccactctcctttttggggtangaatcccctattcaaatcaaaatgaccccttgctcaggggtaacagaagccattatactgttagtgaacacctctatgaggaccatgactgctgatacca

SEQ ID NO: 12099 - DNA, 201 bp, Homo sapiens
tgcagtaaggaaattgcaggcagttgtaagaagttcttgattttattccatagatattttgagagtgcatgtcaataaaaacaattagataatataattcmgctgtgagctctcatgtagccacttgatgcggggtgcccaaaagttgtagaatcttctttcctttgcaacaaaatgaaagtgcaaactgtctggagggtt

SEQ ID NO: 12100 - DNA, 201 bp, Homo sapiens
aatttactctgatctgtaattttgagctcctgtgctgaaattgctcatttggaaattaccaagtgcttgggtctcatttgtgatcttcttcctgcatacayccagcacacaaaggagtcataatgaccggctgagtcactgctgccatctccctgaagcgtgctcttcaaatgtcaataccattttctatggtacaatgaa

SEQ ID NO: 12101 - DNA, 201 bp, Homo sapiens
aggaaaaaaaaaaaaaaaaaggcctgctttaatatgccacatttgtattgggtagcccttagaataggtcagtgattctccactctggctgtacatgagamtcccccagggagattaaaataaaacaaaacaaagcccaggaatcactttgagaaatcattattttattgctccagagtaagccttggccatccatttttc

SEQ ID NO: 12102 - DNA, 201 bp, Homo sapiens
  misc_feature (1)...(201): n = A,T,C or G, or insertion/deletion polymorphism (see Tables 1-2)
aaaaagtatgtattcaattaaatgttagttatgatgggttttcttacttaaagatggcttaatcaaagtccatatagcagagtttctcaaccttagcaccnttgacatttggggccggataattactggtggtgggggctgtcctgtgcattgtaagacatttaacagctccgctggcttctacccactagataccagtag

SEQ ID NO: 12103 - DNA, 201 bp, Homo sapiens
ccaacaaacatatgaaaaaaaaagctcatcactactggttattagagaaatgcaaatcaaaaccacaatgagataccatctcaagccagttaaaatggcgwtcattaaaaagtcaggaaacaacagatgctggagaggatgtggagaaataggaatgcttttacactgttggtgggagtgcaaattagttcaaccattgtg

SEQ ID NO: 12104 - DNA, 201 bp, Homo sapiens
gtgaaaaaacaatagctactgcacccacctcacagggctgctgtggggtttaaatgagatggtgtgtgttaaatcaccctggcacccagaaagctttatgsaaatataaagtttaaagatattcagctatctcctgcttctagtcatgacaaatctaaggcctctctgaataagggagtatttgaaaagttgtatggcagg

SEQ ID NO: 12105 - DNA, 201 bp, Homo sapiens
gccaacatggcgaaaccctgtctctactaaaaatataagaactagttgtgtgtggttgcacgtgcctgtaatcccagctactggggagactgaggcaagasaatcgcttgtaccagggaggtggaggttgcagtgagccgagattgcaccactgcacttcatcctgggtgacagagtgagacaatgtctcaaaaaatataa

SEQ ID NO: 12106 - DNA, 201 bp, Homo sapiens
  misc_feature (1)...(201): n = A,T,C or G, or insertion/deletion polymorphism (see Tables 1-2)
caaacaaagattacctgtaataataactctctgtctagacaatatctacactaagtaaggggaagacagaggaatctaggaggtagagatactgagaagcnccagctggcaagaagcaaacaaccaggttatttatttattggactgaggttcaggagaaggactctagtgcttgggatggaaaccagcaagaataaggta

SEQ ID NO: 12107 - DNA, 201 bp, Homo sapiens
tttttatgccagtttcatgctattttggttgttatggctttgtagtatactttgaaatcaagtaatgtgatgcctccagctttgttctttttgctcagaaktgcttgggctattctgggccttttgtggttccatataaattttagcatttttttctatttttatgaagaatattattagtatttcaatagggattgcatt

SEQ ID NO: 12108 - DNA, 201 bp, Homo sapiens
  misc_feature (1)...(201): n = A,T,C or G, or insertion/deletion polymorphism (see Tables 1-2)
tggatctagggcagaaggagcctagtgactttctcagcatcatcatgttctaattaaatgaactaaccaccactgggctcttgaaagtatcctagaactangaatttaaagtgtgaattacacggacacttaaagagatcatacatatctgatagtactttggaacttggaactgaccttgatctgttaagttggctgata

SEQ ID NO: 12109 - DNA, 201 bp, Homo sapiens
tactactactactattaccactactattactactactactgccattattagctaccatttgttgcatatttactggctgccagatactgtactaagtgctyttatatgtaatttaatcctcacaacacgcctctggggaaggtgccattattaaactctttctacatgtgagaaaattgaagcctagagaggtgaagtcac

SEQ ID NO: 12110 - DNA, 201 bp, Homo sapiens
ttattagctaccatttgttgcatatttactggctgccagatactgtactaagtgcttttatatgtaatttaatcctcacaacacgcctctggggaaggtgycattattaaactctttctacatgtgagaaaattgaagcctagagaggtgaagtcacatgctaaagaccaaacagtttacagtgactatcttagtttgttt

SEQ ID NO: 12111 - DNA, 201 bp, Homo sapiens
acttctctaatctgttcttgaagacattttcccagaagtgggatggatttactgagcccttcccaccacattttccagtatttcactggtgcaagagacayccatttgtcaaacaggtagaaaggttaaaggtacactgcatggatctagggcagaaggagcctagtgactttctcagcatcatcatgttctaattaaatg

SEQ ID NO: 12112 - DNA, 201 bp, Homo sapiens
  misc_feature (1)...(201): n = A,T,C or G, or insertion/deletion polymorphism (see Tables 1-2)
aaaaacagcattttttgctagcagggctcttaaacatccttaatcctaccttaccattcattttttacaaatgcatatggggaccagccaagatcagacancagaactgcccctcaggtaatcaggaatccaaagcctgataaaggacacaggtacagcagtggcagcaggattggacaaagtcacaaaatcccacaactt

SEQ ID NO: 12113 - DNA, 201 bp, Homo sapiens
atgatatcttgtttttcatgcatccatttcagtatacatctgcattgacacacgacgcaatactggtcatagcagaagctttccgctacctgaggaggcarcgagtagatgtgtcccggagaggaagtgctggagactgcttagcaaatcctgctgtgccctggagtcaaggaattgatattgagagagctctgaaaatgg

SEQ ID NO: 12114 - DNA, 201 bp, Homo sapiens
ttgctatttttcatccaagatactcatcctgcttatttatggcctccaggataatgtaatccacatttctagttatcactcgaaatatttgaaaacccaayatagacagctgggggttctgcccttagagaggagatatgatctaagggaaaaagagagtcaggagaaaggctaaaaggaaattgaggccccaattaacag

SEQ ID NO: 12115 - DNA, 201 bp, Homo sapiens
  misc_feature (1)...(201): n = A,T,C or G, or insertion/deletion polymorphism (see Tables 1-2)
ccccaagagaggcacttcattgttgagtcagaatttcacctactccctaaccccatccataattcttaccactctctctcccagcctacagctggctttcntaagagcagagactaggaaaggaattccatttgaggacttacctttttcagtttttcatcagtgtgggcctcctcaatctttaagttgccttgaaagtga

SEQ ID NO: 12116 - DNA, 201 bp, Homo sapiens
tagaaagaaacaatccagaaaaaaaaaatacagaaatgccaggctgaggaaaaaaaaaggcagtgcctaagggaagcagatgattcttcctgttgtctttkgtgatttcagaagtacttcaaactaggaatggccttctttgggaatctgttcttttgatgaatgttcctgggaatcagacaacaaaaagtcctgctttat

SEQ ID NO: 12117 - DNA, 201 bp, Homo sapiens
agtacttcaaactaggaatggccttctttgggaatctgttcttttgatgaatgttcctgggaatcagacaacaaaaagtcctgctttatccatctggccaygtcttgttagtatttagtggtgcttaccatgtagtaggtgtttcaattaccaagtagggtttttttaaaggggtcaagattctcaaactcctttctgtac

SEQ ID NO: 12118 - DNA, 201 bp, Homo sapiens
atccagagactaaaatatggaacggcatggttggggaacttgtctatggggtgagttttttccaattctgttttcatttattctgtgctttccaattaacmaagaagagagaagatttaattttcaagtgcagtgtttatccaattgtatagtttacatatagtctacaagaaaaatatattcttctacagttgcgctctg

SEQ ID NO: 12119 - DNA, 201 bp, Homo sapiens
gtgagatggaaacacacagaagaaatgtataaagatgctgcaatatgttgacaaagttgggggagggggaactgagatgatagagcttatatcaaatggcytccatcttctcagtaaagaaagaggcaagatcatctgcagagaggataggactgataaggattaggaactgggaaaagtttgaaataagcatcatccaca

SEQ ID NO: 12120 - DNA, 201 bp, Homo sapiens
  misc_feature (1)...(201): n = A,T,C or G, or insertion/deletion polymorphism (see Tables 1-2)
acttcatatatgatataccatccaaaagcctttccttagtcagaaggatttttctttgtgtgcattttaaggcctggcttcagactatgacttactactgntggaaaggaacaattacagaaaacaaaagaaataaatgtagaaaatcctagtgcctattttcaagggattaatataaaaaacattgcctgcctttgccta

SEQ ID NO: 12121 - DNA, 201 bp, Homo sapiens
atggatagaaagaatcaatatcgtgaaaatggccatattgcccaaagtaatttatagatttaatgctatccccatcaagctaccattgactttcttcacakaattagaaaaaactactttaaatttcataagggaccaaaaaagagcccatatagccaagacaatactaagcaaaaagaacaaagctggaggcatcacgct

SEQ ID NO: 12122 - DNA, 201 bp, Homo sapiens
gattaaatgacagaattcatatcaaatccttagcataatgcctgccataaagtaaatgctgccactagtgggcgtcttttcctgttctccactaaatagaygttgagttaaaaattaaaaccaataaatcaataaatattgagctaataatcaaggctcaacttttaagttgtggcaaattatttggagtctcagggcccc

SEQ ID NO: 12123 - DNA, 201 bp, Homo sapiens
ataatgcacatttcaaacattttttttttttgagatggagtttcactctcgttgcccaggctggagtgcaatggcacgatctcagctcactgcaacctccrcctcccgggttcaagtgattctcctgcctcagcctcccgagtagctgggattacaggcatctgccaccacgtctggctaattttgtatttttagtagaga

SEQ ID NO: 12124 - DNA, 201 bp, Homo sapiens
ctttcctgttcaaggcgttacaggtgaactgtaagatgagaacaagatcacaagtcagcactacctcctcccttcttgagttctcaactgagtgagcatcrtggagggagaagaaagaaagaagttcagcctgggtgtgtgaagctgtaaagttgcaggttgaacccaaacccattttagagacagaagaaactaccctct

SEQ ID NO: 12125 - DNA, 201 bp, Homo sapiens
cctttttatacgttaacgatttcctaagcatttgtgcattttcttacaagttatgttttatcgtttcaagaaatgctgttaacctggcagtattaaaactsaatgagcaaggcctcttggacaaattgaaaaacaaatggtggtacgacaaaggagagtgcggcagcgggggcggtgactccaaggtcagcctcaatgtca

SEQ ID NO: 12126 - DNA, 201 bp, Homo sapiens
tttttatacgttaacgatttcctaagcatttgtgcattttcttacaagttatgttttatcgtttcaagaaatgctgttaacctggcagtattaaaactgartgagcaaggcctcttggacaaattgaaaaacaaatggtggtacgacaaaggagagtgcggcagcgggggcggtgactccaaggtcagcctcaatgtcacc

SEQ ID NO: 12127 - DNA, 201 bp, Homo sapiens
tatacgttaacgatttcctaagcatttgtgcattttcttacaagttatgttttatcgtttcaagaaatgctgttaacctggcagtattaaaactgaatgarcaaggcctcttggacaaattgaaaaacaaatggtggtacgacaaaggagagtgcggcagcgggggcggtgactccaaggtcagcctcaatgtcaccacaa

SEQ ID NO: 12128 - DNA, 201 bp, Homo sapiens
  misc_feature (1)...(201): n = A,T,C or G, or insertion/deletion polymorphism (see Tables 1-2)
aacacagtaacaccccatgctcaatgacttttagctcttattattttattaccattatggaacagtggtcctcaatagagagtgagggtaattttcccccntcagaggacatttggcaatgtctagggacattttagtagtgggtagaggccaggaatgctggtacacatcctacaatgcacaggacagtatccttctcca

SEQ ID NO: 12129 - DNA, 201 bp, Homo sapiens
  misc_feature (1)...(201): n = A,T,C or G, or insertion/deletion polymorphism (see Tables 1-2)
caattaaagccaaggcagggttgttgtgagagtttaacaagataatgcctctaaagcctttatcatcaagctgaacacagtaacaccccatgctcaatganttttagctcttattattttattaccattatggaacagtggtcctcaatagagagtgagggtaattttcccccctcagaggacatttggcaatgtctaggg

SEQ ID NO: 12130 - DNA, 201 bp, Homo sapiens
ttccttggggcagggatggacagcggtatagacctgcaactgtgactttgaggtttgtcccttgaagccctttagacaacaattaaagccaaggcagggtygttgtgagagtttaacaagataatgcctctaaagcctttatcatcaagctgaacacagtaacaccccatgctcaatgacttttagctcttattattttat

SEQ ID NO: 12131 - DNA, 201 bp, Homo sapiens
  misc_feature (1)...(201): n = A,T,C or G, or insertion/deletion polymorphism (see Tables 1-2)
cagctggcagggttgcttttgctctgaccttctattgctttttatcaagctccttgagggaattaaccctcactaagctgaatatctagtttttaatgaanaggtagttaattaacccattaagggttatctggagtagtctataaattcagggtttgggcctgaaacatccttgaaaaggttcttccaaatgttccttgg

SEQ ID NO: 12132 - DNA, 201 bp, Homo sapiens
atggtgatgccatttactgaggtgactggacaggaggagacttagttttgaggagcagagatcttgcctacctctaaacacccacagaacccttctgtccrtgtcattcatctggcattgaatataactgccttctgctgttatttcactggctatgatctatactataccttcccaagcatttctctccagtgtgataat

SEQ ID NO: 12133 - DNA, 201 bp, Homo sapiens
tctttcttgtggattttgaggtaacttttaaaagtttaaaatctacaatattccatggagttaaataagacggtaaattatggtttcatctatttaatgcmtccattttttttaatgttctctctctgtgttgtcctctctgactgtttgttgctgttttaattttacagttcaacggctttttcaatttaaatggtaaaa

SEQ ID NO: 12134 - DNA, 201 bp, Homo sapiens
ccttctgtggggccctgcacacatcctttgttacgcctagcttccccactgacgcagatgtgcagtttgtcatccagatgcgcccagccttgaagggcgckattctgagtcttctgggtcattacaagtgggagaagtttgtgtacctctatgacacagaacgaggtaagaagaggcacctgctctgctctttagatattc

SEQ ID NO: 12135 - DNA, 201 bp, Homo sapiens
ctggagatggagaaaaagaggtggagttgaagtatactttggagacagaattgacagaacttggggacagattgactgtgggatgtgaaggagaggaaggmttcatggatgattactatgtgtttggcttgagagattgggtaagatggtaagatggtgatgccatttactgaggtgactggacaggaggagacttagttt

SEQ ID NO: 12136 - DNA, 201 bp, Homo sapiens
agaggaagtgctggagactgcttagcaaatcctgctgtgccctggagtcaaggaattgatattgagagagctctgaaaatggtaaagaccacaatgggttmttggggtggaagaaacttataaagacataaaaaagatgagaccttgatcttgagagaagacatactaaaaggaataggaccagattatgtagaatctcag

SEQ ID NO: 12137 - DNA, 201 bp, Homo sapiens
tttatttaaaattttgatattatgcattaattttttaaatattggactaaaattctatttatcttgattaatgagattttgatgcccctttaaactttgcrtgtggggaagttgcctcacttgcctcatcctagtcctaggcctgccaggattaactgcaaatgagcatgaaggaactttttagggtgataaaaatgctct

SEQ ID NO: 12138 - DNA, 201 bp, Homo sapiens
attaccctagttaagggggtagcctgcagagtatttttaggaaggggctagtggaaatttcaggtccttgaaaaagtggcggtagagccctcattatattrtataagtaacagcatcttacacctactcaatgcttcaaaactaaaaggcatgccaagaaaatactgtggaggaaatgaagatcttgtatagactcgatct

SEQ ID NO: 12139 - DNA, 201 bp, Homo sapiens
tgttttgaggcgagaatgttgaatgcaagcttgtgcattccacactgattccactgaagctccttttctatctctgctgaggtatgcaggtactgttatascatttttatgtgggtaatcacccaaattctccatgatcataggtatatcatgacattaaccacaaaattgccaaagtcaataaccatgtagacaagaggc

SEQ ID NO: 12140 - DNA, 201 bp, Homo sapiens
agcctcctgaaaacaacacagagcgtgattccaatagaatttctccatcagaccaggaggatgattttgttttcgttttctgtgtgtgggggtggaagggsgtgtggaggaagcaagccttttgatgcctctaatcccactatacaggtagtttcctacttcacttggagtctgccctgagtggttaaggcttagttgtca

SEQ ID NO: 12141 - DNA, 201 bp, Homo sapiens
  misc_feature (1)...(201): n = A,T,C or G, or insertion/deletion polymorphism (see Tables 1-2)
ttgactatgtttctctcatgacattaccttgtagcagtggttttcaaccttggttgcactttgtaatcacctggtgagctttaaaaaatttaaatgtctgngtcctacctcccaagttctgatttaattggtgggcctgggcatgagtttttttttaagatcctaggtgattttaatgtggagccaaggctgaaaaccatt

SEQ ID NO: 12142 - DNA, 201 bp, Homo sapiens
  misc_feature (1)...(201): n = A,T,C or G, or insertion/deletion polymorphism (see Tables 1-2)
taggtgattttaatgtggagccaaggctgaaaaccatttgcttctacaggtgtgcccagcaaacttcacaggaagagaactcaataagttaaattattacntgtggaagcaggagatggtaaaaaaaatatatattttttcctgtaattaaaaggaaaaatcctgctaggagtgcacttgtagtcccagctattcaggagg

SEQ ID NO: 12143 - DNA, 201 bp, Homo sapiens
gataaatagctaatgtatgcagggtataatacttaggtgatgggttgataggtgcagcaaaccaccatggcacaagtttacctatgttataaacctgcacrtcctgcacatgtatcctggaacttaaataaaataaaataaacctaaagactctccagacacagttctgtagagatgtgaggggtacttcacaaaaataaa

SEQ ID NO: 12144 - DNA, 201 bp, Homo sapiens
ggaagagaaagaaagctcattcaatattttccccatcctcttgatcccacttctacccttaaatataaaatattactattgtgctcatctcctagttgatycatctttagctattcctttgtggcctgcagattcaacaacttcaatatgcacaatttagagctgcccttgaagaccatctagaaactttaggtgcttcca

SEQ ID NO: 12145 - DNA, 201 bp, Homo sapiens
aaatattactattgtgctcatctcctagttgattcatctttagctattcctttgtggcctgcagattcaacaacttcaatatgcacaatttagagctgccsttgaagaccatctagaaactttaggtgcttccaaggtggcctgccggccatctgcccaaagtaaccaaccatatggattttattaaactatctccattag

SEQ ID NO: 12146 - DNA, 201 bp, Homo sapiens
  misc_feature (1)...(201): n = A,T,C or G, or insertion/deletion polymorphism (see Tables 1-2)
gaaagcctaagggggttaagtctccattctttctgaggctgccaactctcacagacagcatcagggtaattaacatcacacaggacccccagatctttgtnagaactctgaaactctgtttcctagaagaactcatctaaggatctcactttcttttcttatctgacacagtcaaatcatctaatagccttccagttaaag

SEQ ID NO: 12147 - DNA, 201 bp, Homo sapiens
  misc_feature (1)...(201): n = A,T,C or G, or insertion/deletion polymorphism (see Tables 1-2)
gtcctggggcagaaacaatcctggaatgtttaaaggaaggaagaaaaccactgtggctgaagaatagtagcctacattagaattatagtgatggagactgngtgaaggaatcagatttatgattcattttggaggtagagtcacagaatttgctgatggattggataacatttatgagcaaaaggaaagagccaaggatga

SEQ ID NO: 12148 - DNA, 201 bp, Homo sapiens
aaatgtttaatattcatttttgtagtgctagtgtatttgcaaaggttttagagagactcagtattatcaacttgaggcacttttttttttttttttgagayacagtctcactctgtcacccaggctggagtgcagtggcatgatctcagctcactacaacctccgcctcctgggttcaagctattcttgtgcctcagcctc

SEQ ID NO: 12149 - DNA, 201 bp, Homo sapiens
aatgtttaatattcatttttgtagtgctagtgtatttgcaaaggttttagagagactcagtattatcaacttgaggcacttttttttttttttttgagacrcagtctcactctgtcacccaggctggagtgcagtggcatgatctcagctcactacaacctccgcctcctgggttcaagctattcttgtgcctcagcctct

SEQ ID NO: 12150 - DNA, 201 bp, Homo sapiens
atgtttaatattcatttttgtagtgctagtgtatttgcaaaggttttagagagactcagtattatcaacttgaggcacttttttttttttttttgagacasagtctcactctgtcacccaggctggagtgcagtggcatgatctcagctcactacaacctccgcctcctgggttcaagctattcttgtgcctcagcctctc

SEQ ID NO: 12151 - DNA, 201 bp, Homo sapiens
agttatgttttatcgtttcaagaaatgctgttaacctggcagtattaaaactgaatgagcaaggcctcttggacaaattgaaaaacaaatggtggtacgayaaaggagagtgcggcagcgggggcggtgactccaaggtcagcctcaatgtcaccacaaccgggtacccttagtgacgagtaatcggcaagactgttatct

SEQ ID NO: 12152 - DNA, 201 bp, Homo sapiens
taacgatttcctaagcatttgtgcattttcttacaagttatgttttatcgtttcaagaaatgctgttaacctggcagtattaaaactgaatgagcaaggcmtcttggacaaattgaaaaacaaatggtggtacgacaaaggagagtgcggcagcgggggcggtgactccaaggtcagcctcaatgtcaccacaaccgggta

SEQ ID NO: 12153 - DNA, 201 bp, Homo sapiens
caatagtttttccgtgacaaatgcttgtaagtagatctgcttttcctccctttgggacgttggggacctcatttgcatctttcttgtggcacttagggtcygtgtatgtgctgggagatgattgcttcagtagatattttaggggctctaatccatccggtttcatgttgcataaatcaactccaaatgatactgctgagg

SEQ ID NO: 12154 - DNA, 201 bp, Homo sapiens
  misc_feature (1)...(201): n = A,T,C or G, or insertion/deletion polymorphism (see Tables 1-2)
ccccttttagaaacaacctgcccaagagagcgaaggttggcatgcagttccaactgcctttccactttgcttctctgggtcaaggcatgccagaaggaggnatgtaacatctgctcctcagctgtctgacttcccttaaacagggttagaaacaagaagtacaacacaacctgaattctatctggttccctaagagactga

SEQ ID NO: 12155 - DNA, 201 bp, Homo sapiens
gtgtaggggctctgaccccacatttcccttccgcattgccctggcagaggttctccatgagggtcccacccctgcagcaaacttttgcctgggcatccagdcatttccatacatcttctgaaatccaggcagaggtttccaaaccccaattcttgacttctgtgctgccacaggctcaacaccacatggaagccgccaagg

SEQ ID NO: 12156 - DNA, 201 bp, Homo sapiens
  misc_feature (1)...(201): n = A,T,C or G, or insertion/deletion polymorphism (see Tables 1-2)
aagaaccaaagattgattctgcacattttttaaaaatctgccacagacatggcattaaatggagtatagaaatgatgcatactttggaagaaagaagaganaaaaaggaatgataaagagtttgtacaatagagaagcagttttcagtcccagctcttcatcttgtaaagctagtaaagtgaagattataaaatttactta

SEQ ID NO: 12157 - DNA, 201 bp, Homo sapiens
cactgagaaggcacagaggccccaggtagggacagcatttcaccagcacaaaggcattatatagggagggaagagacagaggacaatggcatcttcttgakccaaattggcagagtttctttaacccattaccacccagaagtgagactaggaaagaagaaatggataggaaaagtgaaagagatggaaagtgatatcctg

SEQ ID NO: 12158 - DNA, 201 bp, Homo sapiens
aggaacctgaaatttatttaatgaatgaataagcaaaaaattaaagcccacgcctgactcctgagtcccaatgcttaaccatattatctcgatataaaagrgcctaaaaagcaccctcttagcccaacccatttcaacacctttcccgtcatctctgacattgctatggaaggatgatttacatttacatgtgcaaaatga

SEQ ID NO: 12159 - DNA, 201 bp, Homo sapiens
  misc_feature (1)...(201): n = A,T,C or G, or insertion/deletion polymorphism (see Tables 1-2)
gactaataaacatgcttatccagatgatttccctgtcaacttcttagattgagactgcaaaataaatttgaaggacctttcataaaaccatctatcttcantgaaggtcaagcaaataatctgtatactttacctgctccattaaaaaatcaagttttgactttattcctttggctttgttactttgggtcttattagata

SEQ ID NO: 12160 - DNA, 201 bp, Homo sapiens
gcgtgaacctgggaggtggagcttgcagtgagccgagatagtgccactgcactccagcctgggtgacagtgtgagactccatctcaaaaaaaaaaaattargtacacaggtgaaacactgccacctcaagtaatacagcacttccatagggagaggtggttcttttaagtaaacagtgtataagtctgagataattcactt

SEQ ID NO: 12161 - DNA, 201 bp, Homo sapiens
agactccatctcaaaaaaaaaaaattaggtacacaggtgaaacactgccacctcaagtaatacagcacttccatagggagaggtggttcttttaagtaaasagtgtataagtctgagataattcacttaagctttgagttcttttgttgtcccttccttggaactggtgcacaggtaagtgtctatcaaaggatagtctag

SEQ ID NO: 12162 - DNA, 201 bp, Homo sapiens
ccttgaccaactaaaatgtcacctcctgtgtaaaatctccaggcagaattaatcgtggtttcctctgaactttctgcaaaccataactgtagcacttatgmacattgttttacaattaggtgcgtgaaacctctttaaagatggggattctgccacagacttcatgtttaatatgtctggttctggaatcagagacttgga

SEQ ID NO: 12163 - DNA, 201 bp, Homo sapiens
aataaatgaacctcaagtccccagcctcccctacctcagcaacttgtcaagagagttggagattttttccatcgttatttttcaaaaccaatttcctaacwgttgcatgacaatcagcagtcaaactaattggaatgttactttaacatttcttcctccttttagcattttttgtgctgtgttgtggggaggaagggatgt

SEQ ID NO: 12164 - DNA, 201 bp, Homo sapiens
tcacttaaatcttcagcaaacctatgacataggtactattgttagctccaatttacaaacaaggtcgccaagacctagagaagtgagggtgtccacagcargggtccccaacccctggtaccagttcatgacctgttaggaaccaggacacacagcaggtgagccatgagcttgcattactgcctgagctctgcctcctgt

SEQ ID NO: 12165 - DNA, 201 bp, Homo sapiens
caaggtagtttccctaattaattagctccaaccaggagtaaatatgtatggtggctttttgaaaaatattcccaaggtatatttcaaccttattatgggakaaaaaggttaacaaatgggatggtaaggtttcagtacaaatttcaggttgtgtgggggaggtactgagtccatatgcctgtcaaaaataatgacagacag

SEQ ID NO: 12166 - DNA, 201 bp, Homo sapiens
aggacatgatcccttctgatattttttttctctaaactggacatgatttgggtaaagcagcatggatagtaatatgataaccttagcacttgctggctcaraggaaagaataatctttcttcaaatgtgacctctattttaatgtgtttaaagtgggagcatggaagagtggatcccagatcctggatcctgatcctgcac

SEQ ID NO: 12167 - DNA, 201 bp, Homo sapiens
attgactccattttcaaggcctgtgccaggcactcactgatgggagggatgggagggaagggaagtaatgtcactttctagcagacctgagccgagaactsctccagggaagccattaaaagcttacccagtgtcatttgaggatcgcaaaatagcaaaattccccagaaaaattgccccccaacagtgtgccattagtct

SEQ ID NO: 12168 - DNA, 201 bp, Homo sapiens
ggcatggcagctcaggcctgtaatcccagcactttgggagaccaaggccggagatcacctgaggtcaggagttcgagatcagcctggccaacatggtgaarccccgtgtctactaaaaatacaaaaattagccaggtgtggtggtgtgtgcctgtagtcccagctactcaggagtctgaggcaggagaatcgcttgaaccc

SEQ ID NO: 12169 - DNA, 201 bp, Homo sapiens
tttattaaagaggctggtgtggagactgaacctgcctatgtgggcactgtcaggagatgtactggcacaaaaggaaggttataggagaggataagggtggragagaagctatctctccagctgtaagtttcctttccctgggatggtatgtggaatgccacgtttaagaggtaacatccctctcaccgtcactaaatagta

SEQ ID NO: 12170 - DNA, 201 bp, Homo sapiens
ttgtcttcctttttacagttaaagagatttgtcatttttatacagttggtttaaggattaaatgatggcatagattttaagacagggccagaattttagamgatagaattccataactttgggggagactaataaacatgcttatccagatgatttccctgtcaacttcttagattgagactgcaaaataaatttgaagga

SEQ ID NO: 12171 - DNA, 201 bp, Homo sapiens
catcagtcaggggcctaggctgctaagtccagaggcaacaccaagggatcaatgcagctaggtacagttttctccagcctcaactttcaatccccaccccmagaccagctcattcccacacctccctcctccttggtcagtgagcctgagcgtccttttcattaaccttttagttactacctctacgcacatactttttcc

SEQ ID NO: 12172 - DNA, 201 bp, Homo sapiens
ccgagcagctgggactataggcgcccgccaccatgcccggctaattttttttatatttttagtagagacggggtttcaccgtgttagccaggatggtctcsatctcctgaccttgtgatccgcccgcctcggcctcccaaagtgctggtagtacaggcgtgagccaccgcgcctgtcctcttttcgttcactcttttccct

SEQ ID NO: 12173 - DNA, 201 bp, Homo sapiens
ccactgtctcatttgtaaaataaacttttccatataaaatttcatttggagaaaggatttcaccactaaaaactatgcttgagaaacaagtgaataaaaaytaagttccttctagctcaaacattctaagaatctaaaatcatagacattgtgggtgggtcaactcagtgttccattcaaccctacttttgacagccagga

SEQ ID NO: 12174 - DNA, 201 bp, Homo sapiens
tcaccccaccatatccatcctctatctaatttcccctctcctacatccccaggctaaacacaaataactcattaaagggcaggatcaggaagatagctgcrtgtatggtaggcttggaagagtccagaatatccaccctttttaagtttctactgctaaagtaactcctttggggttttctagatatgtatgcattttcat

SEQ ID NO: 12175 - DNA, 201 bp, Homo sapiens
cttccaaatttctcaataaataaatcaagatggctgggcgtggtggctcacacctgtcatctcagcactttgggaggccaaggcgggtggatcgcttgagmccaggagtttgaggccagcctgggtaacatggtgagaccctgtctctaagaaaaataaaaataattagctgggtgtggtggcacacgcctgtagtcccag

SEQ ID NO: 12176 - DNA, 201 bp, Homo sapiens
tgtggtggcacacgcctgtagtcccaggtactcaggaggctgaggtgggagaatcgcttgagcccaggaggcatagattgcagggagctgacatcacgccrctgcattccagcctaggtgatgagcaagactctcaaaaaaataaaaataaaaataaataaatcaagagcagtggttctcaacctggggcaattttttcct

SEQ ID NO: 12177 - DNA, 201 bp, Homo sapiens; identical to SEQ ID NO: 1380

SEQ ID NO: 12178 - DNA, 201 bp, Homo sapiens
gatgagcaagactctcaaaaaaataaaaataaaaataaataaatcaagagcagtggttctcaacctggggcaattttttcctctagggggtagttggcaaygtctggagataattttggttgtcacactggaagtgggtgctactggcatctagtgggtagagaccagggaggctgctaactaaacatccttcaatgcaca

SEQ ID NO: 12179 - DNA, 201 bp, Homo sapiens
ggacccggcgccccaacatggagctgtgcagggacatcccgcagttgaagtaagtgagggaggccagaggaggcaggagaacccctgggaatccaggaacsggaaggggtgagtctcaggagcttctaggtgcactgggtctgaaaaatggaccctccttcaatcaggacatccagtcccacaactcagtagagtgcaggg

SEQ ID NO: 12180 - DNA, 201 bp, Homo sapiens
aactaaacatccttcaatgcacaggacggtctcctccacaaattttatcaaagagtctatcaaaatgtcagtagtgctgaggtcaagataccctcatcacrgatgatttgctatgaactctttggtcatatatgacaactcatttgggattaggttcagccacatgtaatagaagaccccaaataacaccagtttaagtaa

SEQ ID NO: 12181 - DNA, 201 bp, Homo sapiens
tgggaatttgttagaaatgcacgttctcaggctccatccaggacccactgaatcagaaagtctgccagtggggtctagcgagctgagttttaacaagccckctaggtatatcttccaggtgtagacatgcaacaattatctgttgttccctccctccctcttccttccctccctgcagcagatatgtacttagcccatcct

SEQ ID NO: 12182 - DNA, 201 bp, Homo sapiens
ccatccctggcgtgtccaactggagtgagggcttctgctcctgccaacgaatggcgaaggggcatcgtgcaccagttaagtgggaagtggcatggttgaayggggatcctctagcgcaggcggcagaatccaagtcgggttagcttaagacaagatggaatttaccggaggaggtatgggggagccacgaactcaagggga

SEQ ID NO: 12183 - DNA, 201 bp, Homo sapiens
catcagcatcagcattacctgggaatttgttagaaatgcacgttctcaggctccatccaggacccactgaatcagaaagtctgccagtggggtctagcgakctgagttttaacaagccctctaggtatatcttccaggtgtagacatgcaacaattatctgttgttccctccctccctcttccttccctccctgcagcaga

SEQ ID NO: 12184 - DNA, 201 bp, Homo sapiens
cctcgaagacaaaagctcggcccagtgtatcgatgagaagtgctttaacctgagaaatacgtcagactgcatcagcttcttccacggcatggagaaaattsacggcacgtaagtatcagactccccctccccatccctggcgtgtccaactggagtgagggcttctgctcctgccaacgaatggcgaaggggcatcgtgca

SEQ ID NO: 12185 - DNA, 201 bp, Homo sapiens
gtgcaccagttaagtgggaagtggcatggttgaacggggatcctctagcgcaggcggcagaatccaagtcgggttagcttaagacaagatggaatttaccrgaggaggtatgggggagccacgaactcaaggggaaagcgggaaggaaaggttctggcagtaggagctgtgtggtcagagcgccttcatctttccatcctt

SEQ ID NO: 12186 - DNA, 201 bp, Homo sapiens
tgaatgtattcccagcctaggacagggcgaagcacagagtaggcattcaataaatacatgctgaataaatgagtaaatatctaaatgtgactgggcacagwggcttacacctgtaatcccagcactttgtgaggccagggcaggtggatcacctgaggtcaggagtttgagaccagcctggtcaacatgatgaaaccccat

SEQ ID NO: 12187 - DNA, 201 bp, Homo sapiens
aggctcggagaggtgaatcgattggctcaagctcacacagcaaatggcagagctgtgattctgaatctacattgaatactgagcctgtgtgttttaccaawggtgccttcctgcctctccagcaaagccagctgtcctctccatctttagagaacaaagactccagaaagcacttccccctactgagacacactgcctgct

SEQ ID NO: 12188 - DNA, 201 bp, Homo sapiens
atcccgccactcaagaccttcagaagttacccaggacctgaagccagctcaaagaaatgcatgcccttcctcaaagccttcccagatgagaaaaccccacrtagtccattggttgcttgttgcagggatttacatgctctgccaggaagaactttactgaggagttcctcatgtgtcaccacctctaagaagccttccctg

SEQ ID NO: 12189 - DNA, 201 bp, Homo sapiens
gatcctaaacttcattacagctgcaaagaccctatttcctaataacattacacgcaccagggcttaggacttgaacatatctttctgaggaacaccacccratccgctccatgtggattcacaataacctcctaacctttctcctgcctctactcttgcccccttccaatctcatcttacacagcagcctggaggttatcc

SEQ ID NO: 12190 - DNA, 201 bp, Homo sapiens
ttcccagatgagaaaaccccacatagtccattggttgcttgttgcagggatttacatgctctgccaggaagaactttactgaggagttcctcatgtgtcascacctctaagaagccttccctgcctgcctttgctaatgtagcctgtgtccatgtccattgatctccccagatccattctccagctaccacgctgtgtgtc

SEQ ID NO: 12191 - DNA, 201 bp, Homo sapiens
atagtccattggttgcttgttgcagggatttacatgctctgccaggaagaactttactgaggagttcctcatgtgtcaccacctctaagaagccttccctrcctgcctttgctaatgtagcctgtgtccatgtccattgatctccccagatccattctccagctaccacgctgtgtgtcctgcacggccgactatcctctg

SEQ ID NO: 12192 - DNA, 201 bp, Homo sapiens
tcaccacctctaagaagccttccctgcctgcctttgctaatgtagcctgtgtccatgtccattgatctccccagatccattctccagctaccacgctgtgwgtcctgcacggccgactatcctctgcagacctctcctgggctctctgtcctttggtttccagatggtttcagcctggaggaggggtaccagcagaagaca

SEQ ID NO: 12193 - DNA, 201 bp, Homo sapiens
gtcaagacagcctgtcctcaaagggccttgtcgcagaagagggacaccgtgaccagcagaactgctcacaggtcaagggccactgggtgacaatagggtagagagtggatgtttcagtcacggtcaggtgacatcgtttagtgccagtgtctcagttccgggtgtttgtggttggccaagtgcaaggacagcttccttctg

SEQ ID NO: 12194 - DNA, 201 bp, Homo sapiens
caagacagcctgtcctcaaagggccttgtcgcagaagagggacaccgtgaccagcagaactgctcacaggtcaagggccactgggtgacaatagggtagagagtggatgtttcagtcacggtcaggtgacatcgtttagtgccagtgtctcagttccgggtgtttgtggttggccaagtgcaaggacagcttccttctgga

SEQ ID NO: 12195 - DNA, 201 bp, Homo sapiens
agaagtgctttaacctgagaaatacgtcagactgcatcagcttcttccacggcatggagaaaattgacggcacgtaagtatcagactccccctccccatcmctggcgtgtccaactggagtgagggcttctgctcctgccaacgaatggcgaaggggcatcgtgcaccagttaagtgggaagtggcatggttgaacgggga

SEQ ID NO: 12196 - DNA, 201 bp, Homo sapiens
accacccccttttaaaagagacttcccaagagtcccaaacaacattttgattcctttccactggctagaattagtcacatggcctggagctacaagggagyctggaaaatgtagtcttttatagtgttccacaggttaagaggaagtgggtattaatattgccctttctatgtgtcaactagccacaatgccacaaacata

SEQ ID NO: 12197 - DNA, 201 bp, Homo sapiens
catggcctggagctacaagggagcctggaaaatgtagtcttttatagtgttccacaggttaagaggaagtgggtattaatattgccctttctatgtgtcarctagccacaatgccacaaacatataaacatacataatcttacataaccctcacaataatcctatatggcaggccttaaaaatattatttcataattttaa

SEQ ID NO: 12198 - DNA, 201 bp, Homo sapiens
agctaaagcagagagagcgaattcacccttcctctgcctttttgttctgttcggaccctcagtgggttgggtgatgcctgcctacgttggacatgaccgcwgagttcatcaattcaaacgttagtttcttccagaaacaccttcacagacacacctcaaaataatggtttaccagctatctggctgtccctttaaattaac

SEQ ID NO: 12199 - DNA, 201 bp, Homo sapiens
accgctgagttcatcaattcaaacgttagtttcttccagaaacaccttcacagacacacctcaaaataatggtttaccagctatctggctgtccctttaarttaacatatacaattaacccagtcaagccagtcaaattgacatataaaattaaccactggctgggtgcagtggctcacatctgtaatcccagcactttgg

SEQ ID NO: 12200 - DNA, 201 bp, Homo sapiens
caagctctctgccttcccgtttcccgttcaacagtcataccactgaggaggacagacagaaagcaaggaggtggagcatgtttggttcaggagccgggccktgtgtgtgtgtgtgtgtgtgtgtgtgtgtgtgtgtgtgtgtgtctgcatctgtgtatgttgtgttttggtttgtatgcatggctgtcttcggaattgagc

SEQ ID NO: 12201 - DNA, 201 bp, Homo sapiens
gaattgaacctacatctgtgcaactgtagagaggctcaggaaggtgaagtaacctgtccccaggtgtacagcacatgggaggcttaggactcctgctcccyagtcttgcctcatctccactggcaggcagcctactgtatgcaaagcacagagtttgggcgggaaagggagtgaggtgagccgtctacgccaccaccctct

SEQ ID NO: 12202 - DNA, 201 bp, Homo sapiens
tttctaacaaaggcatcaggcctcaggcttagaagctttggaaagcaatagaacctagatataattattaacttcttttttccagctaggtgtggtggctsacatctgtaatcccagcactttgggaagccaaggcaagcagatcacctgaggtcaagagttccagataagcctggccaacatggtgaaacctccgtttct

SEQ ID NO: 12203 - DNA, 201 bp, Homo sapiens
gtcaggctggtctcgaacccctgatctcaggtgatcctcccacctcggcctcccaaagtgctgggattacaggtgagagccaccacacccggctgtgtacycttgtctttaacgcacactccatggtgtatatttatccatccagggagccagtgtttgctgagcacccactaattgactaatatatgcaaagcccttgga

SEQ ID NO: 12204 - DNA, 201 bp, Homo sapiens
gccctagcctgaaggaggtgagagaatgaggcatgtggatacctggggaggtgcatcccaggtgaatcggcagctccccgatttgatcttgttgcattggrttgccctgcagaaagaccgtgtcactaaactgtccctcctgctcaggatgacggtcccctgggcttcctcctcagcatgaagcttcaggctgctctgtct

SEQ ID NO: 12205 - DNA, 201 bp, Homo sapiens
tattggatcaggacagtggttctcaacaaggggcgactgcaccctcccatttggcagggtcatttggcgatgtctggagccattttttggttgtcacaacrgggtggttggggagctactggcatctagtgggtagaggccagggatgctgcttaaacatcccaagcaccctacaatgcacaggacagagaataatcccga

SEQ ID NO: 12206 - DNA, 201 bp, Homo sapiens
acatgaagcacccaggtttccgggagaaaggaacagattgtggcaagggtggatgtgagtcccttctgctcagggtctacatacagctacaggaagaataygttctttctgctgcttcccacaggtggccttggagtgtctgtaccatcgagagaagaggattgggattgatttggtccatgacaacgtggagaaaaacct

SEQ ID NO: 12207 - DNA, 201 bp, Homo sapiens
caatgtaagccacctggtctcccaattcctgctcccttccaatccattgtccttacagcagccactggttcccttgatggcctcccagaaattaacaacctttttttttttttttttgagatggagtctcgctctgttgcccaggctggagtgcagtggtgcgatctcggctcactgcaagctccgcctcccgggtccacg

SEQ ID NO: 12208 - DNA, 201 bp, Homo sapiens
ctaatgctatccctcccccctccccccaccccacaacagtccccagagtgtgatgttccccttcctgtgtccatgtgttctcattgttcagttcccacctrtgagtgagaatatgcggtgtttggttttttgttcttgtgatagtttactgagaatgatgatttccaatttcatccatgtccctacaaaggacatgaactc

SEQ ID NO: 12209 - DNA, 201 bp, Homo sapiens
aatgtaagccacctggtctcccaattcctgctcccttccaatccattgtccttacagcagccactggttcccttgatggcctcccagaaattaacaacctttttttttttttttttgagatggagtctcgctctgttgcccaggctggagtgcagtggtgcgatctcggctcactgcaagctccgcctcccgggtccacgc

SEQ ID NO: 12210 - DNA, 201 bp, Homo sapiens
gctggagtgcgcggccaatgaggtgaactgcccattgcaggtgagtacaggggtggggacagggctgtggctgtgtcatggggatactgcacgctcattcygcttcccttgactgaagatgaaggtggcaggcaccttgcaggtcggtttgagctgcatcatcgaatacgatcagtaatacaatcttagtcaattcaggat

SEQ ID NO: 12211 - DNA, 201 bp, Homo sapiens
aacttggagacggtcaagaggcggctggagtgcgcggccaatgaggtgaactgcccattgcaggtgagtacaggggtggggacagggctgtggctgtgtcmtggggatactgcacgctcattccgcttcccttgactgaagatgaaggtggcaggcaccttgcaggtcggtttgagctgcatcatcgaatacgatcagtaa

SEQ ID NO: 12212 - DNA, 201 bp, Homo sapiens; identical to SEQ ID NO: 1383

SEQ ID NO: 12213 - DNA, 201 bp, Homo sapiens
gattttggctcattagttgacctcctggagttaagagatcctccgacctcagcctcctgaggagctgggactataggcatgcaccaccatggctggctaattttaaaattttttgtagagatggggtctcactatgctgcccaggctgagcttaagtaatcctcccaccttggcttcccaaagtgttgagattaaaggcat

SEQ ID NO: 12214 - DNA, 201 bp, Homo sapiens
ggtgcgatcatggctcactgcagtcccggactcctgggctcaagcgatcctcccacctccgcctcccaagtagctgggaccacaggcatgcaccaccacaygtaggtacttttttttttgacattttttatagagatgtgggtttcaccacattgcccagggtggtcttgaactcctggactcaactgatctgcctgcctt

SEQ ID NO: 12215 - DNA, 201 bp, Homo sapiens
tgcattatttaatgtaatgataatctataagtgagtgcttggcacatggtaggtgctaaattttcttttattctgggagtctataaaaagaaagtagggcaaaaaaaaaaaaaaaaaaaaaggtggagcctccacaatcaacccttagctgcctggccctggggtcacgtggattgaggcggggccccacgctgacatttc

SEQ ID NO: 12216 - DNA, 201 bp, Homo sapiens
gcctcccaagtagctgggaccacaggcatgcaccaccacacgtaggtacttttttttttgacattttttatagagatgtgggtttcaccacattgcccagkgtggtcttgaactcctggactcaactgatctgcctgccttggcctcccagtgtgctgggattagaggcatggctggcccagccctccagtttctaaatcc

SEQ ID NO: 12217 - DNA, 201 bp, Homo sapiens
gcattatttaatgtaatgataatctataagtgagtgcttggcacatggtaggtgctaaattttcttttattctgggagtctataaaaagaaagtagggcaaaaaaaaaaaaaaaaaaaaaggtggagcctccacaatcaacccttagctgcctggccctggggtcacgtggattgaggcggggccccacgctgacatttca

SEQ ID NO: 12218 - DNA, 201 bp, Homo sapiens
atggctctctcctaactgcctggaacaatgcttggcatgtcgtagaagttgaagaaatattccatgaatgaatggcagtgaaagtagcgtggccacattcycatcgcagagttagggggttcagggaccccaatgaagaagcaggcccaaagcctgcttcttggcttgtccacgttgtgtttctggtggtggtggtgtggg

SEQ ID NO: 12219 - DNA, 201 bp, Homo sapiens
ggcgatgtctggagccattttttggttgtcacaacggggtggttggggagctactggcatctagtgggtagaggccagggatgctgcttaaacatcccaarcaccctacaatgcacaggacagagaataatcccgacccagaggccaagactgccaaggcggagaaaccgcagattctgaggtctcccaggactgctgcaa

SEQ ID NO: 12220 - DNA, 201 bp, Homo sapiens
agaggccagggatgctgcttaaacatcccaagcaccctacaatgcacaggacagagaataatcccgacccagaggccaagactgccaaggcggagaaaccrcagattctgaggtctcccaggactgctgcaactcacccttgtgcctttgcaggatctccgtacctgagacctgggccaagttcagtaacgacaacatcaa

SEQ ID NO: 12221 - DNA, 201 bp, Homo sapiens
gcttaaacatcccaagcaccctacaatgcacaggacagagaataatcccgacccagaggccaagactgccaaggcggagaaaccgcagattctgaggtctyccaggactgctgcaactcacccttgtgcctttgcaggatctccgtacctgagacctgggccaagttcagtaacgacaacatcaaacactctcagaacatg

SEQ ID NO: 12222 - DNA, 201 bp, Homo sapiens
tcacccttgtgcctttgcaggatctccgtacctgagacctgggccaagttcagtaacgacaacatcaaacactctcagaacatgcgggccaactccatccrgctgcgggaggaggcggagcacctctttgagaccttgtcggatcagatgtggaggcagttcacagacaccaacctggccttcaacgcccgcatctctgag

SEQ ID NO: 12223 - DNA, 201 bp, Homo sapiens
gggtgctttttggatctgaggagtctgcagcactgcccgattctgtcgtctgcgtgctatgcctacaccagtgtgccctttaggcgttttgcgtcatgctktttcacacctctgggttggctcttggagtcctctttggatggaatttatagtccctgctcaatgcaaatttagattcccactgggtgccagatgctgcgc

SEQ ID NO: 12224 - DNA, 201 bp, Homo sapiens
gaagattgcttaagcacagaagttggaggctgcagtgagctataatcgtgccactgtactccatcctggggaacaatgcaacaccctgtcaaaaaaaaaaycataaactgaattttaatgaaaattaaataaagttaaaaattcaattccttattcacaataaccacatttcaagggctcagtatccacatgtggctaggg

SEQ ID NO: 12225 - DNA, 201 bp, Homo sapiens
gattgcttaagcacagaagttggaggctgcagtgagctataatcgtgccactgtactccatcctggggaacaatgcaacaccctgtcaaaaaaaaaaccawaaactgaattttaatgaaaattaaataaagttaaaaattcaattccttattcacaataaccacatttcaagggctcagtatccacatgtggctagggttc

SEQ ID NO: 12226 - DNA, 201 bp, Homo sapiens
gcttgtaatcccggcactttgggaggccaaggcaagtggatcaactgaggtcaggagttcttgaccagcttgaccagcatggtgaaaccctgcctctaataaaaaaaaaaatacaaaaattagctgggtgttgtggtgcatgcccgtaatcccagctactcgggaggctgaggcagaattacttgaacccgggaggcagag

SEQ ID NO: 12227 - DNA, 201 bp, Homo sapiens
tctacatgggccttgcatctccggatgccttggtcatatgacaacccacagctctcatccggggagaaggggaggcagaagcccatccaatgcccagtagygaggtcacatgaagcacccaggtttccgggagaaaggaacagattgtggcaagggtggatgtgagtcccttctgctcagggtctacatacagctacagga

SEQ ID NO: 12228 - DNA, 201 bp, Homo sapiens
aagacatttacttgtcacaaatgggggtgcgtgctaccgatgattagcatccagtgagtagaggccagggatgctgccaaacatcccacagtgcacaggamagtccctaccccccaccatggagaatcacccagcctcaaatgtcaatagtgccaaggctaagaaaccctgatctgctagcattaaggtttaatttaagaa

SEQ ID NO: 12229 - DNA, 201 bp, Homo sapiens
gaggagaaattgagccactgcactccagcctgggtgacagagaacctgtgttaaaaagaaaaagaaaattaaaaaaataataatttaaaagagacacagcrgagtgcattggttcatgcctataatcccagaactttgggaggctgaggcaggaggatggcttgaggctaggagttcaagaccagcctgggcaacatagca

SEQ ID NO: 12230 - DNA, 201 bp, Homo sapiens
cccccatagggtctggagacaaactgattcatgcagacaaatagatccaggaagaaagggggaagccaggtgaggggtgcagtgatggaggtggctgtccrttttgaatagagtagacagggaagctctttctttggaggtgacatttaagcaaggacctggagaggtgagatttggatgcagtaagtgtgtagggctcaa

SEQ ID NO: 12231 - DNA, 201 bp, Homo sapiens
gtgtggtggcttatgcctgtaatctcaaccctttgggaaactgaggcagggggatcacttgagcctaggagttcaagaccagcctgcgcaacacagcaagrccatgtctacaaaaatatttaaaaagttagtcgggcttggtggcccatgcctgtagccctagctactcaggaggctgaggtgggaagagtgcttgagcct

SEQ ID NO: 12232 - DNA, 201 bp, Homo sapiens
ttctcctgcctcagcctcccgcgtagttgggattacaggcgcctgccaccacatctggctaattttttttctatttttagtagagacgggggtctcactaygtggcccaggctggtctggaacttctgacctcaggtgatccacctgtcttggcctcccaaagtgctggtaaaacaggcgtgagccaccccgcccggcgtg

SEQ ID NO: 12233 - DNA, 201 bp, Homo sapiens
ttgagtagttgcaacagagaccatatgacccacaaagcctaaattatttatcatgtaaccctttacggtaagtgcttacccatccttcttctaaaggacarcaggggccaggtgtggtggcttatgcctgtaatctcaaccctttgggaaactgaggcagggggatcacttgagcctaggagttcaagaccagcctgcgca

SEQ ID NO: 12234 - DNA, 201 bp, Homo sapiens
cttacggctcatctcaatttgcactagccacattcaagggcttaacagccatatgtggccctcggcctcatgttggacagcacaggctatagcatgaataktatgtgaagagctggcctcattgttttaaaacacagtgtattagtggaaattttgaggtataatcatacagtaaatttttttatatttatattttacttt

SEQ ID NO: 12235 - DNA, 201 bp, Homo sapiens
ctcattgttttaaaacacagtgtattagtggaaattttgaggtataatcatacagtaaatttttttatatttatattttactttttttttttttaagagayggagtctcgctctgtcgcccagcctgcagtgcaatggtgccatcacagctcactagagcctcaaactcataggctcaagccatcctctcacctcagcctt

SEQ ID NO: 12236 - DNA, 201 bp, Homo sapiens
gcttaggaatggctaatgaggatcatttcagtgggctctgggggagagggactgtccctagttgaatagtacctggcctggggtgattagagcaggtgtaytgtggcctggtggacagtgaatgcccagtaaaggaggtggttggactatgggctctaggttggttgctttgcatttgaagagtgtgctccagggtgactt

SEQ ID NO: 12237 - DNA, 201 bp, Homo sapiens
agagagcagcaagggcaaaggaagcgtccgggatgaagctggaggaaggggcaggtgggtctgggtaggcctggtgaagggtttggattcctacctaagarcaatggggagcctttgaagattttaagcaggacagtgtttggatccaagcttgtccttttgttgatttcttttctgcctgcgtggcagaagggacgcaga

SEQ ID NO: 12238 - DNA, 201 bp, Homo sapiens
cagaacccacctcctcctctaggagcccttggatcccccgaaggggttagttctgggtgttagggagaaagacatcgcaggcaagctacccatagagcaawgagcttggtcacggacagacacattggagacccctagaaagacatcggggtggaggtgtacagagaagatgcaaatatagcaggagggatgatggctgaa

SEQ ID NO: 12239 - DNA, 201 bp, Homo sapiens
tttgttgatttcttttctgcctgcgtggcagaagggacgcagaggttaagaatggatgcagcggccgggcgtggtggttcacggctgtaatcccagcactktggaaggcagaggcaggaggattacttgaggtcaggagttcgagaccagcctggccaagatagtgaaactccatctctactaaaaatacaaaaaatcagc

SEQ ID NO: 12240 - DNA, 201 bp, Homo sapiens
ggaaggaatctacaatgttgaggtggtttttttgagacagtctcgctctgtaacccagtctggagtgcagtggcgcaatctcggctcactgcaacctctgyctccctggttcaagtgattctcctgcctcagcctcctgagtagctgggattacagacaccccccgccatcacgccccagctaatttttgtattttttgta

SEQ ID NO: 12241 - DNA, 201 bp, Homo sapiens
ctggttcaagtgattctcctgcctcagcctcctgagtagctgggattacagacaccccccgccatcacgccccagctaatttttgtattttttgtagagayggcgttttgccatattgcccaggctggtcttgaacttccgggcccaagttccctgggctcaagtgatccacctgcctctgcctcccaaagtgctggaatt

SEQ ID NO: 12242 - DNA, 201 bp, Homo sapiens
ttttaaccactcttaagtgtacagttctgtggcattaagtacattcatacattgtgcatccatcaccacaatccatctccagaacttttccatcttcccartctgaaactctgcacccattaaacactccctccccttttccatctccccccatatccatggtaatatcatttggctgtgtttccacccagatctcatctt

SEQ ID NO: 12243 - DNA, 201 bp, Homo sapiens
cagatctcatcttgaattatagctcccataaaccacatgtgtcagtgggagggactcagtgggaggtaattgaaccatgggggcaggtttttcccgtgctkttctcgtgatagtgaataagtctcttgagacctggtggttctataaaagggagttcccctgcacattctcttttgcctgctgccatgttagacgtgcgtt

SEQ ID NO: 12244 - DNA, 201 bp, Homo sapiens
tcatcttgaattatagctcccataaaccacatgtgtcagtgggagggactcagtgggaggtaattgaaccatgggggcaggtttttcccgtgctgttctcrtgatagtgaataagtctcttgagacctggtggttctataaaagggagttcccctgcacattctcttttgcctgctgccatgttagacgtgcgtttgctcc

SEQ ID NO: 12245 - DNA, 201 bp, Homo sapiens
ctgttctcgtgatagtgaataagtctcttgagacctggtggttctataaaagggagttcccctgcacattctcttttgcctgctgccatgttagacgtgcstttgctcctcctctgccttccaccatgattgtaaggccttcctagtcatgtggaactgtgagtccattaaatctctttttctctataaatatcccagtct

SEQ ID NO: 12246 - DNA, 201 bp, Homo sapiens
atctctttttctctataaatatcccagtcttgggtatgtctttattagcagcagcattagaacagacaaatacaagtaactaccattctgctttctgtctytgataatttgactactctatggacttcatataagtggaatcatacagtagttgtcctcctgtgactggttaatttcacttggcataatgtcttcaaggct

SEQ ID NO: 12247 - DNA, 201 bp, Homo sapiens
ctttttctctataaatatcccagtcttgggtatgtctttattagcagcagcattagaacagacaaatacaagtaactaccattctgctttctgtctctgakaatttgactactctatggacttcatataagtggaatcatacagtagttgtcctcctgtgactggttaatttcacttggcataatgtcttcaaggctcatc

SEQ ID NO: 12248 - DNA, 201 bp, Homo sapiens
accttgcaggtcggtttgagctgcatcatcgaatacgatcagtaatacaatcttagtcaattcaggataatcccagtcaaatcagggtttcttggactgartagaatttccttttctccttgaagctacatcaaagttgcaggggtttcatgaaaatattgtgtgcatacttatgcatgcctgagcatgtgtgtgttctgg

SEQ ID NO: 12249 - DNA, 201 bp, Homo sapiens
agctgacgcaccagatgcaggagggcacctgccggaacctgggccagaggctgtcggacattggcttctggaagtcagagctgagctatgagctggacagscttctgactgagaaccagaacttggagacggtcaagaggcggctggagtgcgcggccaatgaggtgaactgcccattgcaggtgagtacaggggtgggga

SEQ ID NO: 12250 - DNA, 201 bp, Homo sapiens
atttctgggattacaggtgtgagccaccacccctggccttagggttttcttaaagcagggctatgtctgggcggatgaaacaggacgtttggtgactgtcygaattgcagtatctctattcactgcagttctcattaccatggattaacaatgatgataatgatgatggcagtagacaccttttttttttttttttagaca

SEQ ID NO: 12251 - DNA, 201 bp, Homo sapiens
tcgaagacaaaagctcggcccagtgtatcgatgagaagtgctttaacctgagaaatacgtcagactgcatcagcttcttccacggcatggagaaaattgayggcacgtaagtatcagactccccctccccatccctggcgtgtccaactggagtgagggcttctgctcctgccaacgaatggcgaaggggcatcgtgcacc

SEQ ID NO: 12252 - DNA, 201 bp, Homo sapiens
ctgtaccacctgggctaatccacatgcttctctgaagacttgctcttcaaagagacaagcacaatgcaaattaaaaccataatataccactacatgttcaygagaatggctgaaattaaaaagactgaccacactaagtgttgacgaaggtggggagcaactggcagtcgtgaatactgctggtgggaatgaaaactagaa

SEQ ID NO: 12253 - DNA, 201 bp, Homo sapiens
tgggaagagtgcttgagcctgggaggtcaaggctgcagtgagccatgactgcaccactgcactccaacctgggtgacagagtgagactctgtctggaaacaaaaaaaaaagaataaaggacaaatctgtttggattggggggagcctctgggtatgtggtgggacatggaggtgggaagaggactgagaagctactgggtg

SEQ ID NO: 12254 - DNA, 201 bp, Homo sapiens
ttcacgagaatggctgaaattaaaaagactgaccacactaagtgttgacgaaggtggggagcaactggcagtcgtgaatactgctggtgggaatgaaaacwagaaacctgggggaaaactttgacagtttctaaaaaagtgaaacattgacctattctatgatccagctattccactcctaggcatttacccaaaagaaat

SEQ ID NO: 12255 - DNA, 201 bp, Homo sapiens
agtcgtgaatactgctggtgggaatgaaaactagaaacctgggggaaaactttgacagtttctaaaaaagtgaaacattgacctattctatgatccagctrttccactcctaggcatttacccaaaagaaataaagtatacatctccccaaagactcagatacaaatattcatagcagctcttatttgtaatagccccaaa

SEQ ID NO: 12256 - DNA, 201 bp, Homo sapiens
aaggccagcaggtcagagaaattactgagctacctgtcaggagcagaagccacacgtgtcactgtgtggaaagtgagggctcaggaagcataggtggaggyctagtttgcaatttaggaacagggagtaatggagttatttgaccctcagtcttttcatctccaaaatgggcatgataataatataccaataacaataata

SEQ ID NO: 12257 - DNA, 201 bp, Homo sapiens
tactgtcagattctgatgctagaaaggcaaactaatgcaccgtgacagaagtgtttatctatgatcagtggttgcctagggtaggcggaggcaggagagayggattgtaaagcggtatacagaaacctttgggagtgatggattcattcactatcttgattatggtgatgatttcatgggtatatacataagtcaaacctc

SEQ ID NO: 12258 - DNA, 201 bp, Homo sapiens
gataaacactcagtaaaaaggtaactgtaagtattaatataattactgatggagagagaaaggatcttttgaatggaggtggggagagcaaaaccttttcrctttccaaattcctctagtgaggatcccttgagccccggagtttgatgctgcagtgagctatgatcgtggcactgcactccagcctgggtgacagagcaa

SEQ ID NO: 12259 - DNA, 201 bp, Homo sapiens
ggaggcgggaaggccagcaggtcagagaaattactgagctacctgtcaggagcagaagccacacgtgtcactgtgtggaaagtgagggctcaggaagcatrggtggaggcctagtttgcaatttaggaacagggagtaatggagttatttgaccctcagtcttttcatctccaaaatgggcatgataataatataccaata

SEQ ID NO: 12260 - DNA, 201 bp, Homo sapiens
tatggtgatgatttcatgggtatatacataagtcaaacctcagctaattgtaaacattaaacgtgtaatttattgtatatcaactatgcctcaacaaagcygtaaagcttaaaaaaatctattttttaaaaagtcacgtacagaccagtcatggcggctcacatgcctgtattctcagtgcttcaagaggttgaggtggca

SEQ ID NO: 12261 - DNA, 201 bp, Homo sapiens
cagacccgtaattccagcactttgggaggctgaggtgggcgaatcacgacgtcaagagatccagaccatcctggccaacatggtgaaaccccgtctctacwaaaaatgcaaaaattagccaagtgtggtggcactcgcctgtagtcccagctacatgggaggctgaggcaggagaattgcttgaacgtgggagacagaggt

SEQ ID NO: 12262 - DNA, 201 bp, Homo sapiens
aggtggccttggagtgtctgtaccatcgagagaagaggattgggattgatttggtccatgacaacgtggagaaaaaccttatccgggtaaggcatctcctkgttctgcccagccccctgaaggaggcgggaaggccagcaggtcagagaaattactgagctacctgtcaggagcagaagccacacgtgtcactgtgtggaa

SEQ ID NO: 12263 - DNA, 201 bp, Homo sapiens
cctcatcactacagactggagggtttttgcaacctcatggatttttattaatagtcataatttaatcaccagctgttctgcaaataagttagcacccatckgaaatgcaccaaactccaaccctacgctattgacattttcctgagcaaggatttgtcttctggttggtgaatttcacatggtgttattctaaaataataa

SEQ ID NO: 12264 - DNA, 201 bp, Homo sapiens
gtaattccagcactttgggaggctgaggtgggcgaatcacgacgtcaagagatccagaccatcctggccaacatggtgaaaccccgtctctacaaaaaatrcaaaaattagccaagtgtggtggcactcgcctgtagtcccagctacatgggaggctgaggcaggagaattgcttgaacgtgggagacagaggttgcagtg

SEQ ID NO: 12265 - DNA, 201 bp, Homo sapiens
gtgttattctaaaataataaaggaatttgatgcaatgaagataaatgtatagcaaccatttcacttttcaacagtttactttggctagaggatttgaaatkctctcttctttttttgaggtggagtctcactctatcgtgcaggctggagtgcagtgacgagatcttggcttactgcaacctctgccttccaggttcaagt

SEQ ID NO: 12266 - DNA, 201 bp, Homo sapiens
tgaaagctctgaacctgacttagtgccactcctatctccagaagcccgagatgcctgtttattgcttgatttttaactcctgcaaaagccaagcaaaacartcacacacgctatatgatttttaaaactttctatgcaccatgcaacctaagtgtgctttaaaatgtctgaaaagaggccgggtgcggtggctcagacccg

SEQ ID NO: 12267 - DNA, 201 bp, Homo sapiens
ggctaatttttgtatttttagtagagatgaggtttcaccatgttgaccaggctggtctcaaactcctgatcccaggtgatccacccgccttggcctgccamagtgctgggattacaggcttgagccaccgtgcccggactgaaatgctctctttaaaaatgtaactgttattagttgagcttagcctgatagtccttggca

SEQ ID NO: 12268 - DNA, 201 bp, Homo sapiens
atcccagcactttgggaggctgaggcgggcagatcacttgaggccaggaatttgagaccagcctggccaacatggtgaaaccctggctctactaaaaatasaaaaaattagccaggtgtggtggtgcttgcctgtaatcccagctacttggggaggttgaggtgggagaactcgcttgaacttgggaggcagaggttgcag

SEQ ID NO: 12269 - DNA, 201 bp, Homo sapiens
ctgaacctgacttagtgccactcctatctccagaagcccgagatgcctgtttattgcttgatttttaactcctgcaaaagccaagcaaaacaatcacacamgctatatgatttttaaaactttctatgcaccatgcaacctaagtgtgctttaaaatgtctgaaaagaggccgggtgcggtggctcagacccgtaattcca

SEQ ID NO: 12270 - DNA, 201 bp, Homo sapiens
atggtttttgggggtaggatgtgtggggtcagggatacttctatggagaaagtgcttattctgacattgtgggaactagaccctggcaggtgaaatattakatgtgttacatggatatagcattaatatcactgaatcatacaatgagaaggttattccttcttcattgcttctgaccatctcaaaagtgctagaatgcct

SEQ ID NO: 12271 - DNA, 201 bp, Homo sapiens
actgtttgggttttttgttttttgttttttggagatagggtttttgttttttggactccaggctggagtgcagtggtgcgatcatagctcactgcaacctkgaactcctgggctcaaacagttctccatcctcagcctcccaagtagctgggactacaaacgtgcaccaccatgcctggctaacttttaaaattattttgt

SEQ ID NO: 12272 - DNA, 201 bp, Homo sapiens
gttgaattaattacccccatcacttgcagatagtactttttgttttacatcatagtcttgtctgtctctttccccagacttccatggttttgatgatgaayctttcaagtaaggcttcactggttgtttctttgaattatcctcttcattaattatggtgaacagggtagaaatggtcaaagatgttgactcactgtggtc

SEQ ID NO: 12273 - DNA, 201 bp, Homo sapiens
gcatgcaccaccttgcccagctattttttttttgtatatttagtagagatagggtttaaccatggtggccaggctggtcttcaggtgatccaccggcctcrgcctcccaaagtgctaggattacaggcgtgagctaccgtacgtggcctcacctgttgataagcatttcggttgtttccagtttggggctgttacaaataa

SEQ ID NO: 12274 - DNA, 201 bp, Homo sapiens
taacattctcagactggcttttgaaggaagtggcggctccgggcatgtgtgggagtttgaaggtggaattcatagagaacattacctggccagtctctgtytcccggatgaggagatagcggctcagagcagtcaggggttctgagtgggggtctgggccccacagttggtttgtgttagggctgagatgggaacctgggc

SEQ ID NO: 12275 - DNA, 201 bp, Homo sapiens
gtagagatagggtttaaccatggtggccaggctggtcttcaggtgatccaccggcctcggcctcccaaagtgctaggattacaggcgtgagctaccgtacrtggcctcacctgttgataagcatttcggttgtttccagtttggggctgttacaaataaagctgctgtgaacactcatgtacacatatttgtatgcactct

SEQ ID NO: 12276 - DNA, 201 bp, Homo sapiens
tgagatgggaacctgggcctcctgactgaccttttacctccaggacaccctgcacagaattctgccagcaggtgggggtggggtggggggagttacttaayatgaaaccctttggtcagccaaaggtgggggcatgtggcccaaagagccacctgccacctgccttgggcaggctctttttctgagccacattccaaagac

SEQ ID NO: 12277 - DNA, 201 bp, Homo sapiens
cctgttgataagcatttcggttgtttccagtttggggctgttacaaataaagctgctgtgaacactcatgtacacatatttgtatgcactctcacagagtkcaaaaaatatttggtaaaaaatggtgatttcacataaaaaaatttcagatttccagcgtctcttgaaaaattagtagctctagcaattcagagctcatgt

SEQ ID NO: 12278 - DNA, 201 bp, Homo sapiens
cttgaaattcatattgatagaatcatgcagtatgttcttttcttgtgcttggctgcttctactcaatatagtattggtgaggttcatccattgtattggtrtgtgtgtgttagaagttgttttttaccgctggatagtggtctattgtggggctattccacaattgatccatcctcctgttgatagatgtttaagttgtta

SEQ ID NO: 12279 - DNA, 201 bp, Homo sapiens
aaatattgtgtgcatacttatgcatgcctgagcatgtgtgtgttctggtccttaaagcacatgcttaaaataactgacttatttatttattttttacacasagtctccctctgtcacccaagctggagtgcagtggctcgatcttggctcgctgcgacttccgcctcctgggttcaagcgactctcgtgcctcagcctcct

SEQ ID NO: 12280 - DNA, 201 bp, Homo sapiens
atggagtgtctgggcaaatgaaatcgaactcttcatgatcatgagttgcactggcacatccttctgatcattgaaggccatcatggcaggacatcactgcmtcatttctaggcttctcagggactgagcacatgcaacctcaccattgtgtcctgctgagtctgggaaggggtgtcaagacagcctgtcctcaaagggcct

SEQ ID NO: 12281 - DNA, 201 bp, Homo sapiens
ttctaggcttctcagggactgagcacatgcaacctcaccattgtgtcctgctgagtctgggaaggggtgtcaagacagcctgtcctcaaagggccttgtcrcagaagagggacaccgtgaccagcagaactgctcacaggtcaagggccactgggtgacaatagggtagagagtggatgtttcagtcacggtcaggtgaca

SEQ ID NO: 12282 - DNA, 201 bp, Homo sapiens
gtgagccaccatgcccagcctgcaatgttgagttttgtactgaggtttttttttaaagaatgaagcatgcatgaatgaatgccttaaatgtccctttttctttttttcatgcaaagacccatttttattatggtaaaatacacataacataaaacttagcattttaaccactcttaagtgtacagttctgtggcattaagt

SEQ ID NO: 12283 - DNA, 201 bp, Homo sapiens
cggagtttgatgctgcagtgagctatgatcgtggcactgcactccagcctgggtgacagagcaagacattgtctctaaaaaattaaaattaaaataagttkaaataaataaataaatacataaataaataaataaataaaaataaaaattcctccagggaagttttgaattattactaacaacctcatcactacagactgg

SEQ ID NO: 12284 - DNA, 201 bp, Homo sapiens
ctcggctcactgcaacctccgcctgccaggttcaagcgattctcctgcctcagctttccgagtagctgggattacaggcatgcaccaccttgcccagctattttttttttgtatatttagtagagatagggtttaaccatggtggccaggctggtcttcaggtgatccaccggcctcggcctcccaaagtgctaggattac

SEQ ID NO: 12285 - DNA, 201 bp, Homo sapiens
tccagtttggggctgttacaaataaagctgctgtgaacactcatgtacacatatttgtatgcactctcacagagttcaaaaaatatttggtaaaaaatggkgatttcacataaaaaaatttcagatttccagcgtctcttgaaaaattagtagctctagcaattcagagctcatgtttctacaggggaacagtgggtaagg

SEQ ID NO: 12286 - DNA, 201 bp, Homo sapiens
cctatccttcctttgcccgtctgcctttctaacaaaggcatcaggcctcaggcttagaagctttggaaagcaatagaacctagatataattattaacttcttttttccagctaggtgtggtggctcacatctgtaatcccagcactttgggaagccaaggcaagcagatcacctgaggtcaagagttccagataagcctgg

SEQ ID NO: 12287 - DNA, 201 bp, Homo sapiens
aggaaaccagcagagaggttaagcagtttgcccaaatgcacacaataggaagtggtcaagccccgattgaagtcagaagagaagctacatggaagatggcmgccaacactgtcttatctgaaattattatgaagttttattctatgtattattgtattgtgggaaggcttggggctgctgatgcaattatgggaatcaaaa

SEQ ID NO: 12288 - DNA, 201 bp, Homo sapiens
ttctacaggggaacagtgggtaagggttgagtggctgctgcctctctttgggtcaggtgctccagttagcctcagaccccaccactccctattacagcacrcttccctcatttgcattatttacttgatcctgtagccctgtatttgtgcactctgctttatatatcagaggaaactcagacaggcagataaacaaaacat

SEQ ID NO: 12289 - DNA, 201 bp, Homo sapiens
tcctgctgtgctaaagaggctggtgtctgttgacgaagggctttctcacaggacaggggtcaaaagctcatgccagcccagaaaggaggtttgtggggggyggggggtggggattgtaataggatgatggccaggccaagaaggaacaggtcatcagatatggggattatttcccatgaacgtgctgtatgacttggggca

SEQ ID NO: 12290 - DNA, 201 bp, Homo sapiens
tttatatatcagaggaaactcagacaggcagataaacaaaacatccaggcataggaagaggttgaacagaacagagaagggctatgaattttaaccttgawgggctttggtttcattctgaagtttctttggggttttgactcccaagcagccattgttagcatcagcaaaaccaccccttcccaggaaggcctgggcagg

SEQ ID NO: 12291 - DNA, 201 bp, Homo sapiens
tcaaggctggactggggaaggttccacatccaagctcactcccatgcttgttggtagaactcagttctttgctggctgttggctggcagccaccctcattyacccatgggtctctccagcatggtggcttgcttcaacaaagcatgcaaaccagaaggacaatgacagtaccagccacaaggatgtcacagtcttttgtaa

SEQ ID NO: 12292 - DNA, 201 bp, Homo sapiens
agccaaggcaagcagatcacctgaggtcaagagttccagataagcctggccaacatggtgaaacctccgtttctactaaaaatacaaaaattagctgggcrtggtggcgcatgcctgtagttccagctacttgggaggctgaggcaggagaatgacttgaacctgggaggtggaggttgcagtgagccaagatcatgccac

SEQ ID NO: 12293 - DNA, 201 bp, Homo sapiens
gaaggcctggcgtctgaggggtgagggcccctgctggtgatctgaggccctgcgtgtctactgccaacccctctgtttgtccaaggaggtctggaacccaytgtgcagtgggaaatgcttttgtgctttgcagccgattccttccagcactggagcctgcagccaagctactgacggctggtttctaaaaccggcccagcc

SEQ ID NO: 12294 - DNA, 201 bp, Homo sapiens
gagttggaggctgcagtgagctatgattgcgccattgcactccatcctgggcaacagagcaacacccagcagacctgctgctggcttgctaggtcttcagycctggaagtgagatggatagggtctaggtcctgggtgcaggagagtgggggctgggctctgctgacctctcttccctctgcccctgcttcttcgatgctc

SEQ ID NO: 12295 - DNA, 201 bp, Homo sapiens
gcaagcagatcacctgaggtcaagagttccagataagcctggccaacatggtgaaacctccgtttctactaaaaatacaaaaattagctgggcatggtggygcatgcctgtagttccagctacttgggaggctgaggcaggagaatgacttgaacctgggaggtggaggttgcagtgagccaagatcatgccactgcactc

SEQ ID NO: 12296 - DNA, 201 bp, Homo sapiens
tgcgtgtctactgccaacccctctgtttgtccaaggaggtctggaacccattgtgcagtgggaaatgcttttgtgctttgcagccgattccttccagcacyggagcctgcagccaagctactgacggctggtttctaaaaccggcccagccctggggaagtggagctggcagcctggccctgtgctaccctcctcatgaga

SEQ ID NO: 12297 - DNA, 201 bp, Homo sapiens
tgatccagccaccttggcctcccaaagtgctgggattacaggcatgagccacagtggcggccccgccaggggacttctacagaacagggcttctgggggasttgcctggaggacctactgctttggggcaagctctctgccttcccgtttcccgttcaacagtcataccactgaggaggacagacagaaagcaaggaggtg

SEQ ID NO: 12298 - DNA, 201 bp, Homo sapiens
aggtctggaacccattgtgcagtgggaaatgcttttgtgctttgcagccgattccttccagcactggagcctgcagccaagctactgacggctggtttctraaaccggcccagccctggggaagtggagctggcagcctggccctgtgctaccctcctcatgagacaccactgcatcccagggagaaagtctctctcttct

SEQ ID NO: 12299 - DNA, 201 bp, Homo sapiens
gcagccgattccttccagcactggagcctgcagccaagctactgacggctggtttctaaaaccggcccagccctggggaagtggagctggcagcctggccmtgtgctaccctcctcatgagacaccactgcatcccagggagaaagtctctctcttctctgatggtgtcacggaggaagactcatcatgatgccgacctct

SEQ ID NO: 12300 - DNA, 201 bp, Homo sapiens
ctgcatcccagggagaaagtctctctcttctctgatggtgtcacggaggaagactcatcatgatgccgacctctctttaacacctatccttcctttgcccrtctgcctttctaacaaaggcatcaggcctcaggcttagaagctttggaaagcaatagaacctagatataattattaacttcttttttccagctaggtgtg

SEQ ID NO: 12301 - DNA, 201 bp, Homo sapiens
cgatctgatcttcccgccttgacctcctagagtgctgggattgcaggcatgggccactgtgcctggcccataactgccttatttttccccgtaatacttaycatttaacatgctctatacttgattgaatattagaatacagtatagtctccatcaaggtagagatttttgcctgctttgtcactgatgtattcaagactg

SEQ ID NO: 12302 - DNA, 201 bp, Homo sapiens
catctctgggtggccactgcgttctgagactgtgttttcattgctccttccatctcatatcttttggctagaagcactgaccctgagccagactgcatggktatgatgaatcctctataaacttggacaactttcttaacttctctgagcctcagtctccttgtttgtagaatgaggataggaattactgtcacaggaggc

SEQ ID NO: 12303 - DNA, 201 bp, Homo sapiens
ccaccttttggttatcgtgaatagggctgccgtgaacattcatgtacatattttggtttgaacgcctgttttctgttcttttgggtatatacccgggagcrgaactgctggactgtgtggtaagtctatgtctaacttatcgaggaatctccagattggtctcctatcctgttttaccatcctgtcttatttcttcctttg

SEQ ID NO: 12304 - DNA, 201 bp, Homo sapiens
tgacttgaacctgggaggtggaggttgcagtgagccaagatcatgccactgcactccagcctgggcgacagagcgagtctccatctcaaaaaaaaaaaaaattaaattatttttcccattttgcctattgttatggtaccctctattggtggaaaacaatagtagttttccacttgtggaaataatttaaagatttcattt

SEQ ID NO: 12305 - DNA, 201 bp, Homo sapiens
ttgaacctgggaggtggaggttgcagtgagccaagatcatgccactgcactccagcctgggcgacagagcgagtctccatctcaaaaaaaaaaaaaattawattatttttcccattttgcctattgttatggtaccctctattggtggaaaacaatagtagttttccacttgtggaaataatttaaagatttcatttcaaa

SEQ ID NO: 12306 - DNA, 201 bp, Homo sapiens
gatcatgagttgcactggcacatccttctgatcattgaaggccatcatggcaggacatcactgcatcatttctaggcttctcagggactgagcacatgcarcctcaccattgtgtcctgctgagtctgggaaggggtgtcaagacagcctgtcctcaaagggccttgtcgcagaagagggacaccgtgaccagcagaactg

SEQ ID NO: 12307 - DNA, 201 bp, Homo sapiens
tggacaacatagcaagaccccatctctacaaaaaatacaaaaattagccaggcatggtggcatgcctatagtccaagctacttaggaggctaaagcaggargattgcttaagcacagaagttggaggctgcagtgagctataatcgtgccactgtactccatcctggggaacaatgcaacaccctgtcaaaaaaaaaacca

SEQ ID NO: 12308 - DNA, 201 bp, Homo sapiens
tgaacctgggaggtggaggttgcagtgagccaagatcatgccactgcactccagcctgggcgacagagcgagtctccatctcaaaaaaaaaaaaaattaaattatttttcccattttgcctattgttatggtaccctctattggtggaaaacaatagtagttttccacttgtggaaataatttaaagatttcatttcaaat

SEQ ID NO: 12309 - DNA, 201 bp, Homo sapiens
aagctgtaaagcttaaaaaaatctattttttaaaaagtcacgtacagaccagtcatggcggctcacatgcctgtattctcagtgcttcaagaggttgaggyggcaggatcactttaggtcaggagtttgagaccagcctgggcaacagaaagttagctgagtgtggtggcaggcacctgtagtcccagctactgaggaagc

SEQ ID NO: 12310 - DNA, 201 bp, Homo sapiens
aaataaaccccatctctataaaaacttttttttttaattagccaggtgtggtggtgcctgcctgtagcctcagctatttgggaggctgagacaggaggatstcttgaacccagaggtttgaggctgcagtaagctatggtggcaccactacactccagcctaggtgacagagggagatctggtctaaaaaaaaaaaaatta

SEQ ID NO: 12311 - DNA, 201 bp, Homo sapiens
tgaggtacgagaattgcttgaacccaggaggcagaggttgcagtgagctgagatggcaccactgcactccagcctgggtgacagagtgagactctgtctcaaaaaaaaaaagaaaaagaaatatctagtcctaaatgtcactgaatgtcaataggtgatgaggttgggaaaccctgttccagatcaaaggctaggacattt

SEQ ID NO: 12312 - DNA, 201 bp, Homo sapiens
gaggcaggagaatcgcttgaacctggcaaacggaggttgcagtgaaccaagatcacaccattgcactccagcctgggcaacaagagtgaaactctgtctcaaaaaaaagaaaaaaaaaaaaaaggcagacctaatttttggctttatatacaactaattgtccatcaatctgagtctaggcttgaatttcaagtcaaaaat

SEQ ID NO: 12313 - DNA, 201 bp, Homo sapiens
ggcgcccgccactatgccccgctaatcttttgtagttttagtagagatagggtttcaccgtgttagccaggatggtcttgatctcttgacctcgtgatccrcccacctcagcctcccaaagtgctgggattacaggcgtgagccaccgtgtctggtcccccagaaattaacatcttaattccggaattcctccacccctcc

SEQ ID NO: 12314 - DNA, 201 bp, Homo sapiens
agaatcgcttgaacctggcaaacggaggttgcagtgaaccaagatcacaccattgcactccagcctgggcaacaagagtgaaactctgtctcaaaaaaaagaaaaaaaaaaaaaaggcagacctaatttttggctttatatacaactaattgtccatcaatctgagtctaggcttgaatttcaagtcaaaaatataggctg

SEQ ID NO: 12315 - DNA, 201 bp, Homo sapiens
gattacaggcgtgagccaccgtgtctggtcccccagaaattaacatcttaattccggaattcctccacccctccccataacccctgtccccgctattgctstagactcgcttcctctattccagggccaatggcttcctgtctgtttctctgctgacctcagggcctttgcacctgctgttttcccttgtggtgcattcct

SEQ ID NO: 12316 - DNA, 201 bp, Homo sapiens
ttcatttcaaatacatatgttaaagcctgaaacaggctgatttgaagaaaaatattaaatgattatgtagatggtatgtggatatgggaaatatgatgacratgctgcccagtacctgaaatttgggaatgttaaaagaaaaacttaaagcagattaaatttaacagaatttaattgagcaaagaatgattcgtgaattgg

SEQ ID NO: 12317 - DNA, 201 bp, Homo sapiens
attcgtgaattgggcagccccctgaaccagaatggattcagagcaaccccaaagctgccacgtggtcggatgatatttacagacagaaaaaggaaagtgaygcacagaagacggaagtcaggtacagaaacagccagattggttactgctcattgtttgtttgccttatttgaacatgatttgaacagttggctgcctgcg

SEQ ID NO: 12318 - DNA, 201 bp, Homo sapiens
ttttgtagagatggggtctcactatgctgcccaggctgagcttaagtaatcctcccaccttggcttcccaaagtgttgagattaaaggcatgaaggaggcrctgtgcccagcctgactgagtttcttatgggtgttctctcccctagtagaacacaggctgtgtgagagcagggactctcagcctggttcgttgtgctatc

SEQ ID NO: 12319 - DNA, 201 bp, Homo sapiens
gcctgtgcaacagagtgagaccctgtctcaaaaaaaaaaaaaaaaaaaaaaagtaaggagccagtgttaggctgaatgaagtttagttcatttcatcggamtccctggcagaatagttacccctgcatcagtgtagatagttcatatggggaactgtgccatgaaagtgactgccatgttttaggaaaacacacccgcatc

SEQ ID NO: 12320 - DNA, 201 bp, Homo sapiens
ttcacaggtaatatttaggggcagtgttctcagtgatttacacttgtcaagccgacttcacctgcacaatgaacctgtgagataggcaccaatatggcacscatctgcagaggaggaaaccagcagagaggttaagcagtttgcccaaatgcacacaataggaagtggtcaagccccgattgaagtcagaagagaagctac

SEQ ID NO: 12321 - DNA, 201 bp, Homo sapiens
aagtaaggagccagtgttaggctgaatgaagtttagttcatttcatcggactccctggcagaatagttacccctgcatcagtgtagatagttcatatgggsaactgtgccatgaaagtgactgccatgttttaggaaaacacacccgcatcagtattcaaataaggaaacagccgtatgtcctgatggagggatgaccagg

SEQ ID NO: 12322 - DNA, 201 bp, Homo sapiens
gccagcaggtcagagaaattactgagctacctgtcaggagcagaagccacacgtgtcactgtgtggaaagtgagggctcaggaagcataggtggaggcctrgtttgcaatttaggaacagggagtaatggagttatttgaccctcagtcttttcatctccaaaatgggcatgataataatataccaataacaataataaaa

SEQ ID NO: 12323 - DNA, 201 bp, Homo sapiens
gctccgtaggagcagggtccctgcccctcagtgtcctcctcctagctctgcttcaattctctctcacctgcattatctacgtaccaagcgcaggaatgccrtgttctcaattttaccatattcgtgtgccacctggaccattactgattttgtatttctatttaaactgagtcacctaaaaatttcaaaaaataggccgag

SEQ ID NO: 12324 - DNA, 201 bp, Homo sapiens
ctgtgccatgaaagtgactgccatgttttaggaaaacacacccgcatcagtattcaaataaggaaacagccgtatgtcctgatggagggatgaccaggttkcaagggcacttttgacgagacacagttctcacgccttgtattgacttcagaacaacaccccatccctggcttcataaggtgatccacccatgcagacact

SEQ ID NO: 12325 - DNA, 201 bp, Homo sapiens
agtctcattctgctgcccagactggagtgcagtggtatgggctcagctcactgcaacctccacctcccagattcatgcgtttctcctgcctcagcctcccsagtagctgggattacaggcccatgccaccacactcagctattttatgtatttttagtagagacagtgttttgccatgttggccaggctggtctcaaactc

SEQ ID NO: 12326 - DNA, 201 bp, Homo sapiens
tcccattctgtggctcgattacattgtgcttatccactcatccatccatccacagacatttgagctgcttccaccttttggttatcgtgaatagggctgcygtgaacattcatgtacatattttggtttgaacgcctgttttctgttcttttgggtatatacccgggagcggaactgctggactgtgtggtaagtctatgt

SEQ ID NO: 12327 - DNA, 201 bp, Homo sapiens
cctcccgagtagctgggattacaggcccatgccaccacactcagctattttatgtatttttagtagagacagtgttttgccatgttggccaggctggtctsaaactcctgacctcaggtgatctgcccacctcaggctcccacagtgctgagtgctgagattataggcatgagtcactgcgcctggcctaaatactcttat

SEQ ID NO: 12328 - DNA, 201 bp, Homo sapiens
ggtgtggtggtgcctgcctgtagcctcagctatttgggaggctgagacaggaggatctcttgaacccagaggtttgaggctgcagtaagctatggtggcaycactacactccagcctaggtgacagagggagatctggtctaaaaaaaaaaaaattaaaatcagctgggtgcggtggctcatgcctgtaatctcagcattt

SEQ ID NO: 12329 - DNA, 201 bp, Homo sapiens
ctcccgagtagctgggattacaggcccatgccaccacactcagctattttatgtatttttagtagagacagtgttttgccatgttggccaggctggtctcraactcctgacctcaggtgatctgcccacctcaggctcccacagtgctgagtgctgagattataggcatgagtcactgcgcctggcctaaatactcttatt

SEQ ID NO: 12330 - DNA, 201 bp, Homo sapiens
aaaagtcgcttcctccaggaatccttcctaaactccacggtttatttgcactcaccatctctgggtggccactgcgttctgagactgtgttttcattgctycttccatctcatatcttttggctagaagcactgaccctgagccagactgcatgggtatgatgaatcctctataaacttggacaactttcttaacttctct

SEQ ID NO: 12331 - DNA, 201 bp, Homo sapiens
ccgcagaaccctggacagcctgagttggggatatccgaggggctgctggcccaggccccatgcctggtaggtcagcacctggcagtgtgtgtgtgtgtgtgctgggagtgggtgtctgcagccgcccctgctgggccctgggttgttggtggtctcggaagataagggagacccatcagctgagggtgtgaatgagagaga

SEQ ID NO: 12332 - DNA, 201 bp, Homo sapiens
ggagacccaggaaacctggtggtgtaattgagttccagtcctaaggtctaagagtcaggggctgaggctgtaagcttccgtctgagtctgaaccagcaacwctgatgtccaagggtaggagaagatggatgtcccagctaaagcagagagagcgaattcacccttcctctgcctttttgttctgttcggaccctcagtggg

SEQ ID NO: 12333 - DNA, 201 bp, Homo sapiens
gccgcagaaccctggacagcctgagttggggatatccgaggggctgctggcccaggccccatgcctggtaggtcagcacctggcagtgtgtgtgtgtgtgtgctgggagtgggtgtctgcagccgcccctgctgggccctgggttgttggtggtctcggaagataagggagacccatcagctgagggtgtgaatgagagag

SEQ ID NO: 12334 - DNA, 201 bp, Homo sapiens
cacacacctgtaatcccagctactgtaatcccagctacttgtcgcacacacctgtaatcccagaggcaggagaattgcttgaacccaggaagcggaggttscagtgagccgagattgcgccactgcactccagcgtgggcaatagagcaagacttcgtctcaaaaaaaataataataaaaagaaaaataaaaaaagaaatg

SEQ ID NO: 12335 - DNA, 201 bp, Homo sapiens
ttgactccactcctcactagctgtgttgccctgggaaagtcactgagtcactgaactcagtttccctatctgtcagagggggccaatattcatttctcccrttcatgggtgactgtgaggactaagtttggatgataggactaatacctcccatatctaaggggtattcagtaatatattaagaataacagctcatattta

SEQ ID NO: 12336 - DNA, 201 bp, Homo sapiens
aataaaaaaagaaatggcagggggagtgggaggagaccagggggaggaagaaagtggaacggggttgggggtggtggagaaacaggcagctgtcagttccrgtctccaacctgggaaggatatggggtaggaacaggctccgtaggagcagggtccctgcccctcagtgtcctcctcctagctctgcttcaattctctctc

SEQ ID NO: 12337 - DNA, 201 bp, Homo sapiens
cactcagtaatcaatggctgctgttcattcctgtgcaggcgttccctctctctgcagtctgcattttcttagaagttgtggcctgagtaattcttcactgyagtggttgtcagctgaaggcagttgtgtcccccagaggacacttgaaatgttcggaggcatttttggttgctatagtttggtgagggggtgctgctggca

SEQ ID NO: 12338 - DNA, 201 bp, Homo sapiens
gggggtggtggagaaacaggcagctgtcagttccagtctccaacctgggaaggatatggggtaggaacaggctccgtaggagcagggtccctgcccctcartgtcctcctcctagctctgcttcaattctctctcacctgcattatctacgtaccaagcgcaggaatgccatgttctcaattttaccatattcgtgtgcca

SEQ ID NO: 12339 - DNA, 201 bp, Homo sapiens
gcagtctgcattttcttagaagttgtggcctgagtaattcttcactgcagtggttgtcagctgaaggcagttgtgtcccccagaggacacttgaaatgttyggaggcatttttggttgctatagtttggtgagggggtgctgctggcatctactgggcagaggccagggatactgctaaacatcccacacggcgcagggca

SEQ ID NO: 12340 - DNA, 201 bp, Homo sapiens
cttgagagaaacggctgcgagcaggacctgctcaacatttatctcctggagtagtggttcccaaccagggtgaatttgcaccccactggcatttgccaatrtctggagacatttttggttgttgaaatggctgggggtggagaatgctactaacatctagtgggtagagaccagggatgctgtgctaaacagcccccaatg

SEQ ID NO: 12341 - DNA, 201 bp, Homo sapiens
cctgcattatctacgtaccaagcgcaggaatgccatgttctcaattttaccatattcgtgtgccacctggaccattactgattttgtatttctatttaaaytgagtcacctaaaaatttcaaaaaataggccgagtgcagtggctcatacttgtaatcccggcactttaggaggccagtgtgggaggatcacttgaggccc

SEQ ID NO: 12342 - DNA, 201 bp, Homo sapiens
ttttgtgatcttctatttatggcaagagagaatggttttccatttgtagctgcgatgggatgtgaaaaaccgtggcgctggtggggacaggagggctgacrtttgggaagtgggatagtttgagccggcagagtgaactaatcccagacttgaagtggggagctggacctcagaggagaaatcctgagactgggatcagga

SEQ ID NO: 12343 - DNA, 201 bp, Homo sapiens
gagcgctcctctcctctttctctctctccttgctcctgaatttggctgaacttgaaaatcttccaccatttgaccagaaaaggatttcaagctgccttccyctttcctgagctggggatctgcactgagccaagcatctccttggaaactccttggcttcatgcaatttggaaaacaataaatttgcaaggttgcacaaaa

SEQ ID NO: 12344 - DNA, 201 bp, Homo sapiens
gactgagacagatggagacagtcccagagactgagagacacagagagagagatgagcactgacatcaaaagagacagagacatgaagagataaacagagaygggtggggagtagggagacagacggacagagaggcacagagtcagatatgccagaagtatctggcaagagatgagatagagacagagaaaggcaaagaga

SEQ ID NO: 12345 - DNA, 201 bp, Homo sapiens
gaacttgaaaatcttccaccatttgaccagaaaaggatttcaagctgccttcccctttcctgagctggggatctgcactgagccaagcatctccttggaawctccttggcttcatgcaatttggaaaacaataaatttgcaaggttgcacaaaacatccagaagcctaaagctggctggaactactaaatccatttttttc

SEQ ID NO: 12346 - DNA, 201 bp, Homo sapiens
gacagcaggagagagagaaagcaagcacagagtgagtgaggaagaggatgagagcaggtcagggcagcatttcactttgtggagactggaggccgagccaygccggatggaggctgtttgtcgctgggcagtggctgtgtgtcagatgactcctgccatctcacagcttgtgctgccagagggattggggttatactaatt

SEQ ID NO: 12347 - DNA, 201 bp, Homo sapiens
tccttggcttcatgcaatttggaaaacaataaatttgcaaggttgcacaaaacatccagaagcctaaagctggctggaactactaaatccatttttttccytccacatcaaacataatttcttggccttagaggctttctccactgtcacaagacacaggcagatagttttacatggtgaacaaccctgccaaacatatct

SEQ ID NO: 12348 - DNA, 201 bp, Homo sapiens
gctaattgtaaacattaaacgtgtaatttattgtatatcaactatgcctcaacaaagctgtaaagcttaaaaaaatctattttttaaaaagtcacgtacaraccagtcatggcggctcacatgcctgtattctcagtgcttcaagaggttgaggtggcaggatcactttaggtcaggagtttgagaccagcctgggcaaca

SEQ ID NO: 12349 - DNA, 201 bp, Homo sapiens
caggcagagtctggtgtgtcctcacccccttggggaagctctgccactgacctgctcaggtggccaacaccaggctcttggctcatggttttctgcgaagyctgaggcccgcatctgggcagggtggggtccttgctgcaccaggtgagaaaaggctcttcctgatagagaaggagccacgtttggtcttttcctggtggg

SEQ ID NO: 12350 - DNA, 201 bp, Homo sapiens
tgcaatttggaaaacaataaatttgcaaggttgcacaaaacatccagaagcctaaagctggctggaactactaaatccatttttttccctccacatcaaamataatttcttggccttagaggctttctccactgtcacaagacacaggcagatagttttacatggtgaacaaccctgccaaacatatctctgctttcagag

SEQ ID NO: 12351 - DNA, 201 bp, Homo sapiens
gatctgcatagataataagccattctggaagaatccgatgtggggatctgcgaacgccactttgagaaaaatgactttagggtttcaagcctcatgtccayctctgatgatgcacttagctgtttacagctcctctctgggcctcagttgacttcatatgtgcaatgggaatagtagtcactgactcactttctcacaggg

SEQ ID NO: 12352 - DNA, 201 bp, Homo sapiens
ttggagcacagccatgcccaatacattttcatgttgtctgcagctgcttttgtgctacagtggtcaggttgagtagtttcaacagagatcataaagctgtwtattgagacttgcagcaatttaaagaggatggacttgaagaagaaaaaacaaaacacagccgggcgcggtggctcacgtctgtatcccaacactttggga

SEQ ID NO: 12353 - DNA, 201 bp, Homo sapiens
aaacactgttctaggcgataggagaacagtgtgaacaaaacacagcccctgatttctgatagcttatgttatagtcaggaagccatttcctggtgcccccrtagggtctggagacaaactgattcatgcagacaaatagatccaggaagaaagggggaagccaggtgaggggtgcagtgatggaggtggctgtccgttttg

SEQ ID NO: 12354 - DNA, 201 bp, Homo sapiens
atttttacatatctgcgactgctctcgtgcacagttgagtagttgcaacagagaccatatgacccacaaagcctaaattatttatcatgtaaccctttacrgtaagtgcttacccatccttcttctaaaggacaacaggggccaggtgtggtggcttatgcctgtaatctcaaccctttgggaaactgaggcagggggatc

SEQ ID NO: 12355 - DNA, 201 bp, Homo sapiens
tctcaagtagcttggattacaggcacctgccaccacacctggctaatttttttgtatttttagtagagacggggtttcgccatgtttgtcaggctggtctygaacccctgatctcaggtgatcctcccacctcggcctcccaaagtgctgggattacaggtgagagccaccacacccggctgtgtactcttgtctttaacg

SEQ ID NO: 12356 - DNA, 201 bp, Homo sapiens
cgagtggggctcatgagggaggatggagtttcttgggactactcagaccgccagttactgtggtcccaagaaatgctgtggcttgacctcactgccagctrtacaggcgccagtgatccaggaatgctatcagccctactacctgcccgggtaccgctacctcaattcatggaggcctagcctcttctacaagatagccaa

SEQ ID NO: 12357 - DNA, 201 bp, Homo sapiens
taaccctttacggtaagtgcttacccatccttcttctaaaggacaacaggggccaggtgtggtggcttatgcctgtaatctcaaccctttgggaaactgargcagggggatcacttgagcctaggagttcaagaccagcctgcgcaacacagcaagaccatgtctacaaaaatatttaaaaagttagtcgggcttggtggc

SEQ ID NO: 12358 - DNA, 201 bp, Homo sapiens
gcttatgcctgtaatctcaaccctttgggaaactgaggcagggggatcacttgagcctaggagttcaagaccagcctgcgcaacacagcaagaccatgtcwacaaaaatatttaaaaagttagtcgggcttggtggcccatgcctgtagccctagctactcaggaggctgaggtgggaagagtgcttgagcctgggaggtc

SEQ ID NO: 12359 - DNA, 201 bp, Homo sapiens
ttggggggagcctctgggtatgtggtgggacatggaggtgggaagaggactgagaagctactgggtggctttctgggagtccagggcttgcaacacacacmtgctgtgtggcccaagctgggtactctgtgcaggtgcatagtccaggaatgactcctccctccctgcagggataaccgggatgctcagcacgtgctggag

SEQ ID NO: 12360 - DNA, 201 bp, Homo sapiens
tcatacctgtaatcccagcactttgagaggctgtggtgggaggatcacttgagcccaggagttcaagaccagcttgggcaatctagcagaccccatctctrcacaaaataataaattagccaggcatggtggtgtgcatctgtagtcccagctactcaggaggtggaggtgggagggtcacttgagcccaggagatcaaag

SEQ ID NO: 12361 - DNA, 201 bp, Homo sapiens
gctgtggtgggaggatcacttgagcccaggagttcaagaccagcttgggcaatctagcagaccccatctctacacaaaataataaattagccaggcatggyggtgtgcatctgtagtcccagctactcaggaggtggaggtgggagggtcacttgagcccaggagatcaaagctgtggtgaggagtgattgcaccattgcc

SEQ ID NO: 12362 - DNA, 201 bp, Homo sapiens
tctagcagaccccatctctacacaaaataataaattagccaggcatggtggtgtgcatctgtagtcccagctactcaggaggtggaggtgggagggtcacytgagcccaggagatcaaagctgtggtgaggagtgattgcaccattgccctccagcctgggcaacaaagcaagaccctgtttcaaaaacaaaacaaaaagt

SEQ ID NO: 12363 - DNA, 201 bp, Homo sapiens
cacacacacacacacacacacacacacacacacacacagccttgcactcctgctggtaacattctcagactggcttttgaaggaagtggcggctccgggcmtgtgtgggagtttgaaggtggaattcatagagaacattacctggccagtctctgtttcccggatgaggagatagcggctcagagcagtcaggggttctga

SEQ ID NO: 12364 - DNA, 201 bp, Homo sapiens
tccagcctgggcaacaaagcaagaccctgtttcaaaaacaaaacaaaaagtagtttgcatgtacccagttgaatacctttctagagagatcagtataaccyaaatgtttgtgtctttggttatcttttcctcttgacatcagtttattatatctcaggtgtttgtattcatttctaggggttcacttctataggccttacc

SEQ ID NO: 12365 - DNA, 201 bp, Homo sapiens
caattcagcactcctattattcccaatctgtctctggtgtgtgagtgtgtggatggagaatatattggaatgtacaactgtttgggttttttgttttttgttttttggagatagggtttttgttttttggactccaggctggagtgcagtggtgcgatcatagctcactgcaaccttgaactcctgggctcaaacagttct

SEQ ID NO: 12366 - DNA, 201 bp, Homo sapiens
ttatatctcaggtgtttgtattcatttctaggggttcacttctataggccttacctctttggcttccaaatttctcaataaataaatcaagatggctgggygtggtggctcacacctgtcatctcagcactttgggaggccaaggcgggtggatcgcttgagcccaggagtttgaggccagcctgggtaacatggtgagac

SEQ ID NO: 12367 - DNA, 201 bp, Homo sapiens
catggcctgtgtaccagactactctttttttttttttttaaaaaaaagaatatttgcactcattgatttaccgtgattatccatattcctttcttcactgktttaatattgttaagcaaaaattgtcaagttttccttttggctcactttgtgaaaaccctaagaagtaaaacagaatgtcttcaatatttttggagagta

SEQ ID NO: 12368 - DNA, 201 bp, Homo sapiens
acacatgtgcctgcaatgtgatgcaggtggggggtggagggttgctgtgtgtctgagagatgctgcagtgtggagagggagcaggtgggccggtgcatggycatggcggctgcctcgctggggctttctgccggttaggcacagtttgccagtgcaggagctgtgatgcgggccccacggcacccgaggttgcccagcaga

SEQ ID NO: 12369 - DNA, 201 bp, Homo sapiens
  misc_feature (1)...(201): n = A,T,C or G, or insertion/deletion polymorphism (see Tables 1-2)
agagagtcctgaagtctgctttaatgaagaggtagttttatttcttttctactgaaattcaactggttttcctggtcaaataaaataaaacagaaccctgnaggacactgcttcctctctgcagtgtctaccaggactacatttgagagcacaattgctacacaactaatatgtagacatctctgaaatacactttgagca

SEQ ID NO: 12370 - DNA, 201 bp, Homo sapiens
tatttttatatacataattaaaaaattaagttcttgcacgtgcttgtaaaaagtgccctgaatttagtgtaataatgagaatttgaaaataccatagaaayaagaaatgctattctacacattgatgtaaagcttatggttaaattttagataaaatgtttgtaaccatgattattcttattttcaggaagacaaattcaa

SEQ ID NO: 12371 - DNA, 201 bp, Homo sapiens
attttttccatatgattttagctatttacacattttctgtgaaaaatctgttcatgtgtactacccattttcctgttgaaattagtgtttttcatataaawtcatatgtatttctgaatacatattagagaaattaataatttgacattttttgatttatttctccttcctttgatatgtgctacttttgctttagcaaaa

SEQ ID NO: 12372 - DNA, 201 bp, Homo sapiens
tttaaatgatggtatcccatcataattatttaatttatttaactgatttcctactgtgtgtttgacattttggatgtttgcttagggtgtttttcactttktaagtgaccctgagatgaacgtctccttccatttatctttattaatatttatggcttttttcttaggatggattatcagaaggaaaattattggatcaaa

SEQ ID NO: 12373 - DNA, 201 bp, Homo sapiens
gttccattgttgtaggttcagaaaatcaaaaaagaacaactagaaaacacttaaaaattgatatcagagttttgctgcagtctgggggtagaaaatgtgaytggctaatctgagtccactgtagattcagcctaagaagattattgggaaggccaatgtcatcagtttggctgatgcataatgttttggactactaatcca

SEQ ID NO: 12374 - DNA, 201 bp, Homo sapiens
tcccatagttggcaagtgacaggatgtagtaatgggcaaagcttgctccctatctctcacgaagaccacattgtgggcgggaaggaagccatattcccagmatgtcaagttggaaatctgaatgcatcttcaaacataattataagcaatatgtattttttaaagtatattcacaatttattatttccaatgttttataga

SEQ ID NO: 12375 - DNA, 201 bp, Homo sapiens
acagagtaagaatttgactccaggaagcctggcctagcaagttgcaggcttaactgctatgctatgccatctacaactgttaaggggaagactagtgaacytggagccacagggactatatttgagttctggttgagttgctgggacaagttaacctttctgtgctttttttttttgtcatatataaaattcatataagaa

SEQ ID NO: 12376 - DNA, 201 bp, Homo sapiens
agacagaggagaaaattagcttttgaaagcagagtcagtattagatctgactggattacaaaatagtggaattgggttttttgctctttctctaatttctmatatacaaaattttacacattgcaggtttacttttgaatactcaaggagacatccagacctgtctataccagagcttttaagaattgttcaaatatacaa

SEQ ID NO: 12377 - DNA, 201 bp, Homo sapiens
ttcagaaaatcaaaaaagaacaactagaaaacacttaaaaattgatatcagagttttgctgcagtctgggggtagaaaatgtgactggctaatctgagtcyactgtagattcagcctaagaagattattgggaaggccaatgtcatcagtttggctgatgcataatgttttggactactaatccaatgtgttaattcaaaa

SEQ ID NO: 12378 - DNA, 201 bp, Homo sapiens
gctctgaaatatgtacaaggtgataataaaaaaatttggacttttaaatttagcaagaaatatatttttatatacataattaaaaaattaagttcttgcaygtgcttgtaaaaagtgccctgaatttagtgtaataatgagaatttgaaaataccatagaaataagaaatgctattctacacattgatgtaaagcttatgg

SEQ ID NO: 12379 - DNA, 201 bp, Homo sapiens
gccagaaggaacccatttgtcttcgcccctacacttctaactgttgctgttcattttgaggaggtggccaaatcatgttgtgaagaacaaaacaaagtcawctgccttcaaacaagggtgggtatagcatttgttccatgaagaggataagaaatcactcaataccacagatccagaccctgacttatattatagcaaaag

SEQ ID NO: 12380 - DNA, 201 bp, Homo sapiens
tgccagaaggaacccatttgtcttcgcccctacacttctaactgttgctgttcattttgaggaggtggccaaatcatgttgtgaagaacaaaacaaagtcwactgccttcaaacaagggtgggtatagcatttgttccatgaagaggataagaaatcactcaataccacagatccagaccctgacttatattatagcaaaa

SEQ ID NO: 12381 - DNA, 201 bp, Homo sapiens
gttttctataactggaaacctttcttccttttaccttgttttacaacttgctcttcttgtctctttctattttttcttttccttcccatcttaccctcccytcccttcccttcccttcccttgtctacattcattgcttcctgtttcttccctcacccgtcttctctctttcatttttattttttatagctttttatatga

SEQ ID NO: 12382 - DNA, 201 bp, Homo sapiens
aattatctatgcctgccatgagcttacagtaggaagtggtggccttacacagcatgtcttactataataattatggaagaaagcacacctctcagttttgttttttttcacatccaggactttggggctcttaaaatatcaccctaagattttcaaagtgatcatgtaggctgtgcaccaactatttgataaagacttcta

SEQ ID NO: 12383 - DNA, 201 bp, Homo sapiens
agtcttccccttgctgaccttggtgggctctctagcatccttcatattctttacgacaagcctatgtgtcccaaaactaaataatgacagatgttttgggsttgtttttcaggcaaatatgtctctctcacttgtgatatatttttgcttagaaaaatggtattgagaatatgtgagtagcagaattaagtaagatactgt

SEQ ID NO: 12384 - DNA, 201 bp, Homo sapiens
agagacctggacctcaacagaaggtaggttgggatttacaagggacaaaacacggttaccactaatagttttttcaaatactcgactttctatcacccaastttcaacatttcatgtttttttgatgcatgaaatactatcttctctttccagggaaggcttcctatctgtgtggtgatgaatcgcatttcctgagaacaa

SEQ ID NO: 12385 - DNA, 201 bp, Homo sapiens
gacagttgcaaagtctcctatggccttcttactttgtcccatccacccttcttttgcccatttatttgacaatagttctttctacctttttctatttgtcwggcactgtggaaagtcccatgacattacatataccactacctgactcgtatttcttagtgtatagaaatgatcagattactatcctatataaacattttc

SEQ ID NO: 12386 - DNA, 201 bp, Homo sapiens
aaagcgatatgtttgtgatttcaaaaagatatataaagatgccctcccctttgtggcttatgtaagacctgaaacacaaactttagcaacaaaatgttgcrtagatataggagttatatacagtgtcagtgaagagagacctggacctcaacagaaggtaggttgggatttacaagggacaaaacacggttaccactaata

SEQ ID NO: 12387 - DNA, 201 bp, Homo sapiens
tgataggttgcacctgtaattgcagctactcaggactcaggaagctaaggagggaggcttgcttgagtccaggagttcgaggatacagtacagtgagctahcaacaccctcagcaacagaatgaaaccttatttcaaaaaaaaaaaaaaaagaaagaaagaaagattcaacttttaggcttacagtgaagatagcatgtca

SEQ ID NO: 12388 - DNA, 201 bp, Homo sapiens
gcagacagacctcagtgaccctttccaataatcttttaagaatattgctttactgagatatgattcacatacaaaccaagggtattgctacagcatttacrtgaacaaaaagcgatatgtttgtgatttcaaaaagatatataaagatgccctcccctttgtggcttatgtaagacctgaaacacaaactttagcaacaaa

SEQ ID NO: 12389 - DNA, 201 bp, Homo sapiens
  misc_feature (1)...(201): n = A,T,C or G, or insertion/deletion polymorphism (see Tables 1-2)
aagttcttcatttctctcaaatgatagaacactttccataaaggttctcacgaagtaatgaagactgctaaacccacatcttttcttgttttcttcagctncattaaatgtcaatctcgttagagaagtttactagatgcgggtggaaaatcctatttacaatttacatattccaggtataaggataagataagtaagcca

SEQ ID NO: 12390 - DNA, 201 bp, Homo sapiens
tgggggtacatgtgatattttgataactgcataaatgtgtaatgatcaagtcagggtaattggaatgtccatcatctaaaacatttatcttttctttgtaytgggaacattacaattctcctcttctagctattttgaaatatacaataaattactgttaactttaattttcctactatactactgaatactagaacttat

SEQ ID NO: 12391 - DNA, 201 bp, Homo sapiens
tttcattttctcaataaatgctttaaaatgccaggaaattagacctagttttttggatttagacagagtctgcctaatgtgtagtggagacaacattcagytaccaaatatgaggaaatggaggttgttttggacatgaattttctggaaagatcagacgtagtcatgtataccataatacttggcataataaaggcctaa

SEQ ID NO: 12392 - DNA, 201 bp, Homo sapiens
gagcttttaagaattgttcaaatatacaaagatctcctgagaaattgctgcaacacagaaaaccctccaggttgttaccgttacgcggtaggttccattgytgtaggttcagaaaatcaaaaaagaacaactagaaaacacttaaaaattgatatcagagttttgctgcagtctgggggtagaaaatgtgactggctaatc

SEQ ID NO: 12393 - DNA, 201 bp, Homo sapiens
catccagacctgtctataccagagcttttaagaattgttcaaatatacaaagatctcctgagaaattgctgcaacacagaaaaccctccaggttgttaccrttacgcggtaggttccattgttgtaggttcagaaaatcaaaaaagaacaactagaaaacacttaaaaattgatatcagagttttgctgcagtctgggggt

SEQ ID NO: 12394 - DNA, 201 bp, Homo sapiens
agtgaaaatgtgtgtcaagaacgagatgctgacccagacaccttctttgcgaagtaatataactctttattgaatttataagggaaacagaaagaaacttrtaagatttgacttttgttgctaatttaggtggaaggacatggtaccgtttatttcactaggtatcatataatttttttttaaatcatggctatagagtgt

SEQ ID NO: 12395 - DNA, 201 bp, Homo sapiens
  misc_feature (1)...(201): n = A,T,C or G, or insertion/deletion polymorphism (see Tables 1-2)
agatattatagtaacatgtctttggtggcctccactgaaaacacaagtggactcttatggaaaagaaacaacatttagaatataagatgtaaatatatcantgtaggagggttatttaaaagactaatgcttaataatggatgtgaatctatagtacagcctattttttcataattatatcatcttaaatcctgagaagtt

SEQ ID NO: 12396 - DNA, 201 bp, Homo sapiens
tcaatctcctttgcgatttatttttgtattgcttgattgttcttggtgatgtaggattttgtttgtttgtttgttttttgagacggagtctggctctgtcrcccaggctggagtgcagtgacaatgatctcggctcactgcaagctccgcctcctgggttcacgccattctcctgcctcagcctcctgagtagctgggact

SEQ ID NO: 12397 - DNA, 201 bp, Homo sapiens
ttattctcaagttgccctgatatgtggttactttgccacaatgaaatcagaatgtgatttaacttttgaatgaaagcataaaatgaaatataaacattttyataaataaaccttgggattttttatacttggaatttttaaagattactgaatagattgtatattatatggctaaatgtcttgatgtaaaacttcagaaat

SEQ ID NO: 12398 - DNA, 201 bp, Homo sapiens
  misc_feature (1)...(201): n = A,T,C or G, or insertion/deletion polymorphism (see Tables 1-2)
tgtgtgtcagatactgtgctcagtgttcaggatataactatgatcaagatatggaccctgcttacaagaccattatattaacgaattttatcttctaattngtaagtcctagagcagaggtgtgtacatggtgttaaattggtaggatgcacagtagaggaaataatatactcttcccaaggggaagttgctgttttcacc

SEQ ID NO: 12399 - DNA, 201 bp, Homo sapiens
tattttgatgcacagaaggagattgctgtgtatttgcagtatgtatacagtatgccctatatgttcaggcagaagaggaagccatagcttgaaactgcacrtgaaattacagaggtacctccttagctgcctctctcaatatgtattctattgttacatcccttttctgggcctcctccaagtagaatcactatctgcatc

SEQ ID NO: 12400 - DNA, 201 bp, Homo sapiens
aatgctattctacacattgatgtaaagcttatggttaaattttagataaaatgtttgtaaccatgattattcttattttcaggaagacaaattcaatgagwcaactgagaaaagcctcaagatggtacaacaagaatgtaaacatttccagaatttggggaaggatggtttgaaataccagtatgttgtttgcacaagtgg

SEQ ID NO: 12401 - DNA, 201 bp, Homo sapiens
aatgcttctcaaaagtaatttaactaaatagaagccatatccaagaagacaactttaattataaaattcaggcaaagaagttgtaaaatttatagccattrcaatagataatttcctgaggctagtcaggatgttcctgtgactttttcttgaccataaatggaaactctgcaactgatctttgtataccccatgtgaact

SEQ ID NO: 12402 - DNA, 201 bp, Homo sapiens
atattttagtcattgttgattgcttcacagggtccagcacaacactttgcaaaaaataaatgtagcttatgtgaacaaacataaatatgctccaattagtrtatgctcattgggagggaatccatgattttaggtggatctggagatgacctaaatagctgtgactgagtagcgctaaaaactatgctgaccaccagcatg

SEQ ID NO: 12403 - DNA, 201 bp, Homo sapiens
gccatctacaactgttaaggggaagactagtgaacttggagccacagggactatatttgagttctggttgagttgctgggacaagttaacctttctgtgctttttttttttgtcatatataaaattcatataagaatactcattcatctataatcccagctaatcaggaggctgaggcagagaattgcttgaacctgggag

SEQ ID NO: 12404 - DNA, 201 bp, Homo sapiens
acttgcttttttcaccctctcactaatttacataggctaaccagttatccaaaactaaccttttcagaatttttattttgatggtaatttttatattaccragtctatatgaagaaagagttgtcacatctgaagaataatcagcagtctatgacaggacagaaagtgttgctgggagatacatttggattttaatgttgg

SEQ ID NO: 12405 - DNA, 201 bp, Homo sapiens
ggtgggtatagcatttgttccatgaagaggataagaaatcactcaataccacagatccagaccctgacttatattatagcaaaaggcttgcttaccatatrtgatgttctcttgtcacattcagtgattttcaaaccattggtcaccaggtgctgatctaaatattctctttacttgagactcttgaatgacagccagtca

SEQ ID NO: 12406 - DNA, 201 bp, Homo sapiens
aaggccagttgcctttacttaaaaatggagataacaactgctcttgccacttcaaagtgacaactgaatgttattattttcaacatacaatttaaattctrttttgtaatttggaaggctctgaaatatgtacaaggtgataataaaaaaatttggacttttaaatttagcaagaaatatatttttatatacataattaaa

SEQ ID NO: 12407 - DNA, 201 bp, Homo sapiens
aaagacagatgtatggctgacaagacgctcccagagtgttcaaaattacctgtaagtaaattgcttgtgtttcttttccttttatcttatgtctttctttytttctttctttctttctttctttctttctttctttctttctttctttctttctttctttcattctttctttcttctttctttctttctttccttcttttt

SEQ ID NO: 12408 - DNA, 201 bp, Homo sapiens
gcgagaaaatggtgacagctttcactacttgctgtacgctaagtgaagagtttgcctgtgttgataatttggtgagcatggcctgtgtaccagactactctttttttttttttttaaaaaaaagaatatttgcactcattgatttaccgtgattatccatattcctttcttcactgttttaatattgttaagcaaaaattg

SEQ ID NO: 12409 - DNA, 201 bp, Homo sapiens
aagacagatgtatggctgacaagacgctcccagagtgttcaaaattacctgtaagtaaattgcttgtgtttcttttccttttatcttatgtctttctttctttctttctttctttctttctttctttctttctttctttctttctttctttctttctttcattctttctttcttctttctttctttctttccttctttttt

SEQ ID NO: 12410 - DNA, 201 bp, Homo sapiens
tatttcaactctttacccacacccaagctgagactcaagacgtgattctgtaacaagcattttggagtagagacgcttcagaaagaaagcgttaattaatkttatttgacatcttttggccacaggtttcttgtcaacttagtgaagctgaagcatgaactcacagatgaagagctgcagtctttgtttacaaatttcgca

SEQ ID NO: 12411 - DNA, 201 bp, Homo sapiens
agacagatgtatggctgacaagacgctcccagagtgttcaaaattacctgtaagtaaattgcttgtgtttcttttccttttatcttatgtctttctttctttctttctttctttctttctttctttctttctttctttctttctttctttctttctttcattctttctttcttctttctttctttctttccttcttttttt

SEQ ID NO: 12412 - DNA, 201 bp, Homo sapiens
atttcagaaatagattaaataggttacttttttactgataatgtgaaagaatgatataaaaacttgattttcctcaacaacattactttcttttgtaaatrtggtttctacaaagatgaaactactaaaacttacaggttttatttttttcttgttttttttgactgaatccctaaccctgcccacacaacctcgggatat

SEQ ID NO: 12413 - DNA, 201 bp, Homo sapiens
ctcatttcaatgtcacttttaccaacattgcacatggaaattaactttgctagatttatatgtaaataacagtgtttgtgtttttaaaacacctttatttratttttaaattgttaaattttttccatatgattttagctatttacacattttctgtgaaaaatctgttcatgtgtactacccattttcctgttgaaatta

SEQ ID NO: 12414 - DNA, 201 bp, Homo sapiens
acagctttcactacttgctgtacgctaagtgaagagtttgcctgtgttgataatttggtgagcatggcctgtgtaccagactactcttttttttttttttwaaaaaaaagaatatttgcactcattgatttaccgtgattatccatattcctttcttcactgttttaatattgttaagcaaaaattgtcaagttttccttt

SEQ ID NO: 12415 - DNA, 201 bp, Homo sapiens; identical to SEQ ID NO: 1391

SEQ ID NO: 12416 - DNA, 201 bp, Homo sapiens
cgcacaggcaggaagcccagggactgtgccactgaggaggacgagccaccagcacccgaactgcatcaggacgcagccagggagcttcagcccccagctgyaggagacccccaagccaaagcaggcggagacacacacctcggaaaagccccacaggagagccaggtggtggtggaggggggcagcggcgagggacagggc

SEQ ID NO: 12417 - DNA, 201 bp, Homo sapiens
ctgcagctgccgcctcttccaggcgcaccaggtctggcgggtgccagccccctcctcctcctccggcgcggggacagcggacggggagtggcggggctgtkggtgttgtctcgaatggctccgggatgcaccgggcccgaaggagtgcagggaccgctgagggcgggtctcattggggtcgcccccgcataacgttctgag

SEQ ID NO: 12418 - DNA, 201 bp, Homo sapiens
  misc_feature (1)...(201): n = A,T,C or G, or insertion/deletion polymorphism (see Tables 1-2)
cccagcctgacagcttccagcagaaagtgtcagaaccagaggcccagccaaggcccaggcagggcaggcggtcctcctgggccctggcattgttcttacanatggagggcatggccatcttctctttcagggacaggctggcctgacatggaaggtgaaacaaggcagcagcccctgcctccaggagaactctgcagactg

SEQ ID NO: 12419 - DNA, 201 bp, Homo sapiens; identical to SEQ ID NO: 1397
  misc_feature (1)...(201): n = A,T,C or G, or insertion/deletion polymorphism (see Tables 1-2)

SEQ ID NO: 12420 - DNA, 201 bp, Homo sapiens
tggttcttgtacaaaccagaggtaatggttctgcggaggtggcctcttgtgaattgtagcaggtagtgggagaatccggttgagtatagcatcctttacgsagagcctaccccacgaagtagcgctgtcgcagtttcagtgagagggggaggacggttcttagagaccgagcgcgccgcggcggcgtccctgctccacacc

SEQ ID NO: 12421 - DNA, 201 bp, Homo sapiens
tgccatcttgagctgcttctattccctgaggctcatctgtagctgcttctagccactgtgcttctagccactgagaagggcaggtgcttggaggagctacygagaggctttgagggccaggctgggaagcaagtgacagtgccatggaaagaggctggtttcgtggccacccctgaccacacgcacactggaaaatgacat

SEQ ID NO: 12422 - DNA, 201 bp, Homo sapiens; identical to SEQ ID NO: 1399

SEQ ID NO: 12423 - DNA, 201 bp, Homo sapiens
aatggttctgcggaggtggcctcttgtgaattgtagcaggtagtgggagaatccggttgagtatagcatcctttacgcagagcctaccccacgaagtagcsctgtcgcagtttcagtgagagggggaggacggttcttagagaccgagcgcgccgcggcggcgtccctgctccacacctgggcgccctctccgtcgccccg

SEQ ID NO: 12424 - DNA, 201 bp, Homo sapiens; identical to SEQ ID NO: 1401

SEQ ID NO: 12425 - DNA, 201 bp, Homo sapiens
agtctcttggtgggccgtgccctgccgccttcccgaggcctgtgccagtgagcactgtcctgccagcattgcatagtattggcgtccatcaccttccagcyggtgcctttcctagagtggagctggacatgactcctgagatcctcaggcccaagagttgggctaggggttttcgataaaactgcctggtttccagtactg

SEQ ID NO: 12426 - DNA, 201 bp, Homo sapiens
gcgtcgcttcagcgttctcgggtgctacgctgctgcagctgccgcctcttccaggcgcaccaggtctggcgggtgccagccccctcctcctcctccggcgyggggacagcggacggggagtggcggggctgtgggtgttgtctcgaatggctccgggatgcaccgggcccgaaggagtgcagggaccgctgagggcgggtc

SEQ ID NO: 12427 - DNA, 201 bp, Homo sapiens
cagggcctctgctgcctccagcagtggggcaccagtgagccactgtgagcgtcagccaagcgcgggaagcctaggtggcaagtgccagcaggtgggaaatygggcagctgctgccactgctggccccacagcccacctgggcattgggcactgctggtgcagaggcgaaggctgggcaggacacccgtgtgcacacccttt

SEQ ID NO: 12428 - DNA, 201 bp, Homo sapiens
cctgggtggcagtgctgcagggacccactctatcgctgctttcacattgcttttccctttgtaagcagcacaacccaactgttttttttttttttttttttgagtaggagtttcactcttgttcccctggctggagtgtaatggcacgatcttggctcactgcaacctccgcctcccaggttcaagcgattctcctgcctc

SEQ ID NO: 12429 - DNA, 201 bp, Homo sapiens
gagcctcttctgtactgcctgggtggcagtgctgcagggacccactctatcgctgctttcacattgcttttccctttgtaagcagcacaacccaactgttktttttttttttttttttgagtaggagtttcactcttgttcccctggctggagtgtaatggcacgatcttggctcactgcaacctccgcctcccaggttca

SEQ ID NO: 12430 - DNA, 201 bp, Homo sapiens
gggttcacaccattctcctgcctcagcctcctgagtagctgggactacaggtgcctgccatcacgcccagctaattttttgttttttttttgttgttgttktttttttagtagagacggggtttcaccgtattggccagggtggtctcgatctcctgaccttgtgatccgccagcctcggcctcccaaggtgctgggatta

SEQ ID NO: 12431 - DNA, 201 bp, Homo sapiens
acattcaaggaaatacaccaccaggagcaaaagatcaacagtcagaaaagtcagacccataaagacttcagaatacatgatattgcatgtttaatatatttaatccaataaaagaagtgggtgataagatgagggccttcaaaaaataggtgtatttgagagcttttttggaggttctagcaggggagtgcagctactcat

SEQ ID NO: 12432 - DNA, 201 bp, Homo sapiens
cggagtgcagtggcgtgatctcagctcactgcaacttctgcctcctgagttcaagcaattctcctgcctcagcctcccaagaagctgggattacaggcacscaccaccacgcccggctaatttttgtatttttagtagagacggggtttcaccatgttgcctaggctagtcttgaactcctgagctcaggtgacccgcccg

SEQ ID NO: 12433 - DNA, 201 bp, Homo sapiens
tgcctggtttccagtactgagaatcaacttttttctcaatctggcaggaaaaatcgcagccctcagagagtcgctggctgaagtatctagaaaaggactcscaagaactggagctggaaggaacaggagtgtgtttcagcaaacagccttcatccaaaatggaggagccaggcccccgcttcagtcaagacctgcctagaa

SEQ ID NO: 12434 - DNA, 201 bp, Homo sapiens
tctttcctcctttcgacagagtctcgctgtgtcccccagccggagtgcagtggcgtgatctcagctcactgcaacttctgcctcctgagttcaagcaattytcctgcctcagcctcccaagaagctgggattacaggcacgcaccaccacgcccggctaatttttgtatttttagtagagacggggtttcaccatgttgcc

SEQ ID NO: 12435 - DNA, 201 bp, Homo sapiens
taatttttgagacagggtccctctctgtcacccaggctggagtgtggaggcatgatcgctgctcactggagccccaacgtctcaaaaaacaaaagtatttrcagaatgtagtagatgcaccagtattgattccttattatgtggcatttaggttgtttccacacttctgcttgcctgcttgcctgcctccctccctccctc

SEQ ID NO: 12436 - DNA, 201 bp, Homo sapiens
tttttttcttttttgtagaggcagggtctccctgtgttgtctaggctggtctcaaactcctgggctcaggccatcttcccacctcagctcccaaagtactrggattacaggcatgaaccactgcacctggccagactcacactttgttataagcagaggaagatgctcttctggtacctgtgcctgtgcttccaattcagt

SEQ ID NO: 12437 - DNA, 201 bp, Homo sapiens
acgtcttttcagtccatccgtattgcccctcctgaactctaggaccccaaactgtcctgcatcctttgccttactgaacttgctcttttcctgctccagcsccagtgccacctctcccttcacctctcatctttcctctccttctacagccatgtgctttctttctgaccttaaacccaaatttgctccctcttcaggcct

SEQ ID NO: 12438 - DNA, 201 bp, Homo sapiens
cagctaattttttttcttttttgtagaggcagggtctccctgtgttgtctaggctggtctcaaactcctgggctcaggccatcttcccacctcagctcccraagtactgggattacaggcatgaaccactgcacctggccagactcacactttgttataagcagaggaagatgctcttctggtacctgtgcctgtgcttcc

SEQ ID NO: 12439 - DNA, 201 bp, Homo sapiens
cccagcactttgggaggctgaggcaggaggatcatttgatcctccagtccgggcaacatagggagaccctatctgtacaacagattttttaaaacaaattcatggggcatggtggtgcatgcctgtggtcccagctacttgggaggctgaggcaggaggatcacctgagcccaggaggtcaaggcggcagtgagccattgc

SEQ ID NO: 12440 - DNA, 201 bp, Homo sapiens
aggctggaatgcagtggcgcgatcatggttctctgcagccttgacttcctgggctgaagtgatcctcccacctcaggctcctgagtaactgggactacaastgtgccctaccacgcccagctaattttttttcttttttgtagaggcagggtctccctgtgttgtctaggctggtctcaaactcctgggctcaggccatct

SEQ ID NO: 12441 - DNA, 201 bp, Homo sapiens
  misc_feature (1)...(201): n = A,T,C or G, or insertion/deletion polymorphism (see Tables 1-2)
cagctactcatataccctggaccaaagaccgctcctcctctattggaggtggtcgtcctcttcgaccaagcgcacagcttcaggagggacgcacatggagnggtgagggaagaaggggacaccacctagccatccagatcagctaaccaaccctggtgattgatggagtgacagatggtgcagccacatcaccctcacatc

SEQ ID NO: 12442 - DNA, 201 bp, Homo sapiens; identical to SEQ ID NO: 1392

SEQ ID NO: 12443 - DNA, 201 bp, Homo sapiens
  misc_feature (1)...(201): n = A,T,C or G, or insertion/deletion polymorphism (see Tables 1-2)
catgcatctgcataatttaaaactcggctgagcacaaggaaaggaaagcactggggactgtgagaagatgacagaggaatcagggcagccggggaagggcngaggccgttggtggaggtggaggtgtgggatagtgggctcaggaagtggaggcaggcaggggcaggctgtaaatgctctcatccagctgtttgcagctgg

SEQ ID NO: 12444 - DNA, 201 bp, Homo sapiens
ggcgggacaaatgcagagcgcacgcgcttggctgcctggcgactgcacaagcagggatggcgtcgcttcagcgttctcgggtgctacgctgctgcagctgycgcctcttccaggcgcaccaggtctggcgggtgccagccccctcctcctcctccggcgcggggacagcggacggggagtggcggggctgtgggtgttgtc

SEQ ID NO: 12445 - DNA, 201 bp, Homo sapiens
ggagagtagcacgggactactgacggtcctgtcctgacaggaagtggagcgggagcaccgtccagcctccgtgcagccgtggcgtgcaggactcgggtggytctgaggtcgcctggggaccccagaaggtcagtgacaaacagtttctctctggtcccagtgaccactgagcgtgtgtgtgataattctgtcttttgtcac

SEQ ID NO: 12446 - DNA, 201 bp, Homo sapiens
  misc_feature (1)...(201): n = A,T,C or G, or insertion/deletion polymorphism (see Tables 1-2)
gttgaggaacactggacacgtatagtgtgtgtgtctgatcacagatgtgctccattgtcccagcacacttcacttaaaaaacacaggttcaaaggccagantgttaagaatttcaagatggcgacagcagagcggctgtcacaccctgaagctgattctgcctgtgccatagcaggacgcatgctctcaaattccatctcg

SEQ ID NO: 12447 - DNA, 201 bp, Homo sapiens
acaaattccatctcttaccatctgcctgtgtcattgcaggatccatgctctcaaattccgtctcgtaccatctgcctgtgccatagcaggacccatggtcwcaaattccatctcttaccatctgcctgtgtcattgcaggatccatggtcacaaattccatctcttaccatctgcctgtgccatagcaggacccatggtct

SEQ ID NO: 12448 - DNA, 201 bp, Homo sapiens
ccaggaggcagaggttgcagtgagccgagatcgcgccattgcgctccagcctgggcgacagaacgagactatctcaaaaaaaaaaaaaaaaaaaaaaaaargtaagtaactctcagaggtcaaaaatgaagaagcgggtctgatggtggtgggttatgagaactgattaacattagtgtcactaacgttggtatacaactc

SEQ ID NO: 12449 - DNA, 201 bp, Homo sapiens
gaagacaaaacctacggcagtgtgggcggaccagtaggacacctcctaacaaaactgagctcccggaggactacaccctcggtgtacaaatgaactagatycactctgcaacaggcagcttgcctgtattgaccttggcaatggctgaagagggggaaatatctctaagattttggaaataaaaggaagtagttgcatggt

SEQ ID NO: 12450 - DNA, 201 bp, Homo sapiens
gctgcagtgttccgaggtggtgccactgcactccagcctgccaatagagtgagactccatctcaaaaaaaaaaaagaaaaaaagaatccccaaagaaaaarttccaagtagcataatatactcaggagtttaaaatcatttaacattcaaggaaatacaccaccaggagcaaaagatcaacagtcagaaaagtcagaccca

SEQ ID NO: 12451 - DNA, 201 bp, Homo sapiens
caccagagaggccctggtaggacagaccccactgggcctgggtcagtggagaagtcccttagacttccacgtcttacaatatggcagtcaaacaccctgarcaattctcccactgaaaataactaaaaatgctagctattttaaatgcactgatgagctgacaagaaagtaactctcggccaggcgcagtggctcatgctt

SEQ ID NO: 12452 - DNA, 201 bp, Homo sapiens
  misc_feature (1)...(201): n = A,T,C or G, or insertion/deletion polymorphism (see Tables 1-2)
catcagcttttcctgcccatcacccagcttctccctatatctttactctattttctcctctccttccctttctgtttctccccagactgttcagtcagatnctctgctccaagtccatagaatctcattccaagccaactggaagagctgagtctcaattataaattcctaggagaagcaacctggttggcccaggctgac

SEQ ID NO: 12453 - DNA, 201 bp, Homo sapiens
gcccacctctggtccagtcaactgggattgggtctcagaagagaggggctggcttaccaggtaggcagacaccccacatggtgagcatggcttgtttgagrtgtatatatttctacattctccttgaggaagccttcttactcccctcaatgcctctgtgctgtgtgtggtatgtggtgtatggctgactaggccacagta

SEQ ID NO: 12454 - DNA, 201 bp, Homo sapiens
  misc_feature (1)...(201): n = A,T,C or G, or insertion/deletion polymorphism (see Tables 1-2)
ggaagcacctgagctgctggggtgattgaagcccggtgctctggagcctccatttcgacggctgggagaggggcaggaggccctcagaagacaaaacctanggcagtgtgggcggaccagtaggacacctcctaacaaaactgagctcccggaggactacaccctcggtgtacaaatgaactagatccactctgcaacagg

SEQ ID NO: 12455 - DNA, 201 bp, Homo sapiens
  misc_feature (1)...(201): n = A,T,C or G, or insertion/deletion polymorphism (see Tables 1-2)
ccaccagcacccgaactgcatcaggacgcagccagggagcttcagcccccagctgcaggagacccccaagccaaagcaggcggagacacacacctcggaanagccccacaggagagccaggtggtggtggaggggggcagcggcgagggacagggctcaccctcccagctgctgtctgacgatgaaaccaaagacgacatg

SEQ ID NO: 12456 - DNA, 201 bp, Homo sapiens; identical to SEQ ID NO: 1394

SEQ ID NO: 12457 - DNA, 201 bp, Homo sapiens
accatctcggctcactgcaggccccgcctcccgggttcacaccattctcctgcctcagcctcctgagtagctgggactacaggtgcctgccatcacgcccrgctaattttttgttttttttttgttgttgttgtttttttagtagagacggggtttcaccgtattggccagggtggtctcgatctcctgaccttgtgatcc

SEQ ID NO: 12458 - DNA, 201 bp, Homo sapiens
tcaaggaaatacaccaccaggagcaaaagatcaacagtcagaaaagtcagacccataaagacttcagaatacatgatattgcatgtttaatatatttaatccaataaaagaagtgggtgataagatgagggccttcaaaaaataggtgtatttgagagcttttttggaggttctagcaggggagtgcagctactcatatac

SEQ ID NO: 12459 - DNA, 201 bp, Homo sapiens
  misc_feature (1)...(201): n = A,T,C or G, or insertion/deletion polymorphism (see Tables 1-2)
cagcaatcttggctcactgcagcctctgccttccgggttcaaacattatctgcctcagcctcctgagtagctgggaatataggtatgcaccaccgtgttcntcagacttgtctcgaactcctgacctcaggtgatccacctgcctcagcctcccaaagtgctgggattacaggagtgagccactgtgcccagcccctggtc

SEQ ID NO: 12460 - DNA, 201 bp, Homo sapiens
ttcaaggaaatacaccaccaggagcaaaagatcaacagtcagaaaagtcagacccataaagacttcagaatacatgatattgcatgtttaatatatttaatccaataaaagaagtgggtgataagatgagggccttcaaaaaataggtgtatttgagagcttttttggaggttctagcaggggagtgcagctactcatata

SEQ ID NO: 12461 - DNA, 201 bp, Homo sapiens
attcaaggaaatacaccaccaggagcaaaagatcaacagtcagaaaagtcagacccataaagacttcagaatacatgatattgcatgtttaatatatttaatccaataaaagaagtgggtgataagatgagggccttcaaaaaataggtgtatttgagagcttttttggaggttctagcaggggagtgcagctactcatat

SEQ ID NO: 12462 - DNA, 201 bp, Homo sapiens
ctacaccctcggtgtacaaatgaactagatccactctgcaacaggcagcttgcctgtattgaccttggcaatggctgaagagggggaaatatctctaagawtttggaaataaaaggaagtagttgcatggtttttcagccttttacataccctgtgtgaaaagcctcaagcagaaaatttatgttttaattgtcccaggaa

SEQ ID NO: 12463 - DNA, 201 bp, Homo sapiens
tgagcctgggaggcagaggttgcagttagccaacctccgcctcccaggctcaagtgaggcctgcaccagagtgagactctgtctttaaaaaataaaagagwttgtagaacttaaaagtataatcattgaaattaaaaattcatttcaggccgggtgcagtggctcatgcctgtaatcctagcaatttgggaggccaaggca

SEQ ID NO: 12464 - DNA, 201 bp, Homo sapiens
cattcaaggaaatacaccaccaggagcaaaagatcaacagtcagaaaagtcagacccataaagacttcagaatacatgatattgcatgtttaatatatttaatccaataaaagaagtgggtgataagatgagggccttcaaaaaataggtgtatttgagagcttttttggaggttctagcaggggagtgcagctactcata

SEQ ID NO: 12465 - DNA, 201 bp, Homo sapiens
ggagctggacatgactcctgagatcctcaggcccaagagttgggctaggggttttcgataaaactgcctggtttccagtactgagaatcaacttttttctmaatctggcaggaaaaatcgcagccctcagagagtcgctggctgaagtatctagaaaaggactcccaagaactggagctggaaggaacaggagtgtgtttc

SEQ ID NO: 12466 - DNA, 201 bp, Homo sapiens
gtttcttaccatctgcctgtgccatagcaggacccatggtcacaaattccatctcttaccatctgcctgtgtcattgcaggatccatgctctcaaattccrtctcgtagcatctgcctgtgccatagcaggacccatggtcacaaattccatctcttaccatctgcctgtgccatagcaggacccatggtcacaaattcca

SEQ ID NO: 12467 - DNA, 201 bp, Homo sapiens
gccttcatccaaaatggaggagccaggcccccgcttcagtcaagacctgcctagaaaaaggtaccaagtgcgtctccgttccagccctggcccagggcctmtgctgcctccagcagtggggcaccagtgagccactgtgagcgtcagccaagcgcgggaagcctaggtggcaagtgccagcaggtgggaaatcgggcagct

SEQ ID NO: 12468 - DNA, 201 bp, Homo sapiens
tggggtgttgaggaacactggacacgtatagtgtgtgtgtctgatcacagatgtgctccattgtcccagcacacttcacttaaaaaacacaggttcaaagsccagactgttaagaatttcaagatggcgacagcagagcggctgtcacaccctgaagctgattctgcctgtgccatagcaggacgcatgctctcaaattcc

SEQ ID NO: 12469 - DNA, 201 bp, Homo sapiens
aaacgtgggacaccagcaggctgggaatgtgaagcagcaggtaagcctcaggcccacctgccccaggctggctctgtgtcagggaagggatgaatgcacasatgtatccagtagtcattatagcaaatgtgtgttgatgccacccaatgacaggcagttggcttaaagctgcagggaacacaaaaataaataaacctgtac

SEQ ID NO: 12470 - DNA, 201 bp, Homo sapiens
actacagatgcatgccaccacacccagctaatttgttttttgtatgtttaatagagacggggtttcaccatgttggccaggctggtcttgaactcctgacstcaaatgatccacctgcctccgtagacaaaaacatttcataatgttggtgagtgccttcacctgatattttttatttttttatttttttttagacggagt

SEQ ID NO: 12471 - DNA, 201 bp, Homo sapiens
tcagtacgtcttttcagtccatccgtattgcccctcctgaactctaggaccccaaactgtcctgcatcctttgccttactgaacttgctcttttcctgctycagccccagtgccacctctcccttcacctctcatctttcctctccttctacagccatgtgctttctttctgaccttaaacccaaatttgctccctcttca

SEQ ID NO: 12472 - DNA, 201 bp, Homo sapiens
ggggtgagagaagccagaccccagcaccagtcctatcccacagggagctcggtgctgccacctctgcagctgcagaacccggcaggctctggagagctgcyccccggtgggaggtagcagaatggagccagcgcacccctttcccgatgtctcgaggcccttctgctcaaaattcttttgtaggcaccggtaacctgattc

SEQ ID NO: 12473 - DNA, 201 bp, Homo sapiens
ggcattttatatgttaagagagaacacatctagtcaggtttaacaagaattgaaaataaatgttacggaattttttttagacccaagtttaacaagaatttaaatattatggaattttttttacagcttcaatttgagtcttacggagtgtttttgttttgtttggatttggttttgcgagacaggaatattatggaattt

SEQ ID NO: 12474 - DNA, 201 bp, Homo sapiens
agctcggtgctgccacctctgcagctgcagaacccggcaggctctggagagctgccccccggtgggaggtagcagaatggagccagcgcacccctttcccratgtctcgaggcccttctgctcaaaattcttttgtaggcaccggtaacctgattctaaggtccccaggagatggatcacctgatgacatgagaatgtctt

SEQ ID NO: 12475 - DNA, 201 bp, Homo sapiens
ctacaagtgtgccctaccacgcccagctaattttttttcttttttgtagaggcagggtctccctgtgttgtctaggctggtctcaaactcctgggctcagrccatcttcccacctcagctcccaaagtactgggattacaggcatgaaccactgcacctggccagactcacactttgttataagcagaggaagatgctctt

SEQ ID NO: 12476 - DNA, 201 bp, Homo sapiens
ttctcagccacagtagctcaaacgtagaaatgaaggaaaaccacccaaatgagaaacagtattcagagcttgctacagcaagggagtcagcaacatccccsgtgtgggtaggcgcaaggacgcagggggtggaaaacggggaaggctccaggtggttctgaccgcaggctgttggaaactggaggtgagctaacaagaagc

SEQ ID NO: 12477 - DNA, 201 bp, Homo sapiens
acccgagcctgtgggccatgtgatcgtggagtcaggctcggggtgccactggagagtagcacgggactactgacggtcctgtcctgacaggaagtggagcrggagcaccgtccagcctccgtgcagccgtggcgtgcaggactcgggtggctctgaggtcgcctggggaccccagaaggtcagtgacaaacagtttctctc

SEQ ID NO: 12478 - DNA, 201 bp, Homo sapiens
  misc_feature (1)...(201): n = A,T,C or G, or insertion/deletion polymorphism (see Tables 1-2)
ggaccccagaaggtcagtgacaaacagtttctctctggtcccagtgaccactgagcgtgtgtgtgataattctgtcttttgtcacagttgacgaagtgtgngattcctacccgcagaaagcccatcttcccacccgggtttcttgtcttttctgtctgaagccaactccttcctcgggtctgtacccccttttccctccca

SEQ ID NO: 12479 - DNA, 201 bp, Homo sapiens
tatttttagtagagacggggtttcaccatgttgaccaggaaggtctccatctcttgacctcgtgatctgcccgcctcggcctccgaaagtgctgggattayagtgctggtgttacgggtgtgagccactgcgcccggcctctatttccttgtttgttttcctgtttcactcttccatgttcaccagtgttatttatttatt

SEQ ID NO: 12480 - DNA, 201 bp, Homo sapiens
cagttcccacaattaattcctttaccaggttctgtgagtcctaaacttttaaaaaggcttttcttggccgggtgcggtggctcacacctgtaatcccagcrctttgggaggccgaggggggcagatcatgaggtcaggagttcgagaccagcctgggcaatgttgtgaaaccccgtctctactaaaaatacaaaaaataca

SEQ ID NO: 12481 - DNA, 201 bp, Homo sapiens; identical to SEQ ID NO: 1400

SEQ ID NO: 12482 - DNA, 201 bp, Homo sapiens
cgactgcacaagcagggatggcgtcgcttcagcgttctcgggtgctacgctgctgcagctgccgcctcttccaggcgcaccaggtctggcgggtgccagcyccctcctcctcctccggcgcggggacagcggacggggagtggcggggctgtgggtgttgtctcgaatggctccgggatgcaccgggcccgaaggagtgca

SEQ ID NO: 12483 - DNA, 201 bp, Homo sapiens; identical to SEQ ID NO: 1393

SEQ ID NO: 12484 - DNA, 201 bp, Homo sapiens
ttaggcattttatatgttaagagagaacacatctagtcaggtttaacaagaattgaaaataaatgttacggaattttttttagacccaagtttaacaagaatttaaatattatggaattttttttacagcttcaatttgagtcttacggagtgtttttgttttgtttggatttggttttgcgagacaggaatattatggaa

SEQ ID NO: 12485 - DNA, 201 bp, Homo sapiens
tttaggcattttatatgttaagagagaacacatctagtcaggtttaacaagaattgaaaataaatgttacggaattttttttagacccaagtttaacaagaatttaaatattatggaattttttttacagcttcaatttgagtcttacggagtgtttttgttttgtttggatttggttttgcgagacaggaatattatgga

SEQ ID NO: 12486 - DNA, 201 bp, Homo sapiens
ttttaggcattttatatgttaagagagaacacatctagtcaggtttaacaagaattgaaaataaatgttacggaattttttttagacccaagtttaacaagaatttaaatattatggaattttttttacagcttcaatttgagtcttacggagtgtttttgttttgtttggatttggttttgcgagacaggaatattatgg

SEQ ID NO: 12487 - DNA, 201 bp, Homo sapiens
tccagtgttagcccccacatggggctgctcttgcttctactaaaagatacagcagttacccccttatccacaggggatacagtggatatctaaaaccagamccccagtggatgtctaaaaccacagataataacaaaccttatacatactgttttttcctatgcatacatacctgtgattaagtttatgaattaggcacct

SEQ ID NO: 12488 - DNA, 201 bp, Homo sapiens
tggcccagggcctctgctgcctccagcagtggggcaccagtgagccactgtgagcgtcagccaagcgcgggaagcctaggtggcaagtgccagcaggtggraaatcgggcagctgctgccactgctggccccacagcccacctgggcattgggcactgctggtgcagaggcgaaggctgggcaggacacccgtgtgcacac

SEQ ID NO: 12489 - DNA, 201 bp, Homo sapiens
tcactgcaacctctgcctcctgggttcaagcaattcttctgcctcagcctcccaagcagctgggactacaggcgtgcaccaccacgcccagctaatttttmtatttttactagagatggggtttcaccatattggccaggctggtctcaaactcctgacctcgtgatccacccgcctcggcctcccaacatgctgggatta

SEQ ID NO: 12490 - DNA, 201 bp, Homo sapiens; identical to SEQ ID NO: 1431

SEQ ID NO: 12491 - DNA, 201 bp, Homo sapiens
  misc_feature (1)...(201): n = A,T,C or G, or insertion/deletion polymorphism (see Tables 1-2)
gcagtacagtccagctttggctcggcatcagagggagaccgtggagaaagagggagagggaaagctatatcattcttatgtctttgcatcatcatagcttngcatctactcataagtgagaacatatgatatttggtatccattcctgaattactttacttaggataatggcctccagctccgtccaagttgctgcaaaag

SEQ ID NO: 12492 - DNA, 201 bp, Homo sapiens
acggggtggctgccgggcggagggtctcctcacttctcagacggggcggccgggcagagacgctcctcacctcccggatggggtcacggccaggcagaggygctcctcacatcccagacagggcggcggggcagaggcgctccccacatctcagacgatgggtggccgggcagagacgctcctcactttccagactgggca

SEQ ID NO: 12493 - DNA, 201 bp, Homo sapiens; identical to SEQ ID NO: 1432
  misc_feature (1)...(201): n = A,T,C or G, or insertion/deletion polymorphism (see Tables 1-2)

SEQ ID NO: 12494 - DNA, 201 bp, Homo sapiens; identical to SEQ ID NO: 1434
  misc_feature (1)...(201): n = A,T,C or G, or insertion/deletion polymorphism (see Tables 1-2)

SEQ ID NO: 12495 - DNA, 201 bp, Homo sapiens
aagcgcctgccacatgtggtattggctctccctgtacttagggcctggccccacctgccgtgtggcccgtgtcctgcatggttaggaaaaaggtctctttygactttctggctcagaagctgactttagatgctagctgaggttaatgttttactgaattggagaaagagaaaggtccagtatcatgggcccaccaagaat

SEQ ID NO: 12496 - DNA, 201 bp, Homo sapiens
cgaggggcgccctgaggcaagcctgtgcccctcccgccacctgggaccacggccagcctagtgatctgtggcctgcacctccgcctcatcctcagcacctstgcagccccacttacaaacccgagggagctgctgctgctgcagtgatgtctgtgccattaaagtcacgctgggaacctgctagaactttgtagttacttg

SEQ ID NO: 12497 - DNA, 201 bp, Homo sapiens; identical to SEQ ID NO: 1435
  misc_feature (1)...(201): n = A,T,C or G, or insertion/deletion polymorphism (see Tables 1-2)

SEQ ID NO: 12498 - DNA, 201 bp, Homo sapiens
tttgtcctattatgtgtaccctgagcaatagcgagtaagctctgctaatgcagttctgaaaatgtttttctttaagcaaactccagagccaggaatattarttgtaggagtttctaaaacttaacatgcagaccaggaattaaggcaggtgtgacacagagagggggcagcactgggtgtgtccctactactcacactcaa

SEQ ID NO: 12499 - DNA, 201 bp, Homo sapiens; identical to SEQ ID NO: 1437

SEQ ID NO: 12500 - DNA, 201 bp, Homo sapiens
gtaggtgtgggaggttaggagttggttttgtcctattatgtgtaccctgagcaatagcgagtaagctctgctaatgcagttctgaaaatgtttttctttargcaaactccagagccaggaatattaattgtaggagtttctaaaacttaacatgcagaccaggaattaaggcaggtgtgacacagagagggggcagcactg

SEQ ID NO: 12501 - DNA, 201 bp, Homo sapiens; identical to SEQ ID NO: 1438

SEQ ID NO: 12502 - DNA, 201 bp, Homo sapiens
agaggttttgtacatattcctacctttccctttagagcatcctgccctcctctgatttcagcgacacaaacagaaggatgagatgttctccactgcagggmtgtctgtaggtgtgggaggttaggagttggttttgtcctattatgtgtaccctgagcaatagcgagtaagctctgctaatgcagttctgaaaatgttttt

SEQ ID NO: 12503 - DNA, 201 bp, Homo sapiens
  misc_feature (1)...(201): n = A,T,C or G, or insertion/deletion polymorphism (see Tables 1-2)
cttggtctttgtgagtggccactgttccccctagacccctgcagccttaactgcacgtgtgcatgcatgctccccgactgtctgccaggagccagggccanggtcaggcttggcctgttgcgcgtgtctcctgtgtgctcatggtgagttttgttccaggaacagatggagtcggataactgttcaggaggagatgatgac

SEQ ID NO: 12504 - DNA, 201 bp, Homo sapiens
gtcctgggcttgaccttgcgtttccaggatgatgcccacacctgctgcccttcctctctggttccctgcccacctccttccttccctgcagattccacttmctgggtccttccctcaagttcctggacccccgctggctgcaaagtggaggccaggttccaatctggcctccgactggctacgtctggtttcaccaggggt

SEQ ID NO: 12505 - DNA, 201 bp, Homo sapiens
cgatgggcctttctaggcggtatcagggccgatgctcgtggatgcagagcagtgaccagcccagaaccgtaccggcttcccggggcaggggcggcccgagmgcgccgctaacgggagcaacgggccctgcccccggtggtgtaggggccacctcgccccgcccagcccagcccgatattgatgggggcccacgccttcatt

SEQ ID NO: 12506 - DNA, 201 bp, Homo sapiens
  misc_feature (1)...(201): n = A,T,C or G, or insertion/deletion polymorphism (see Tables 1-2)
gtcacgctgggaacctgctagaactttgtagttacttggtctttgtgagtggccactgttccccctagacccctgcagccttaactgcacgtgtgcatgcntgctccccgactgtctgccaggagccagggccacggtcaggcttggcctgttgcgcgtgtctcctgtgtgctcatggtgagttttgttccaggaacagat

SEQ ID NO: 12507 - DNA, 201 bp, Homo sapiens
acagcttgcaggacctagtacacagtgttgggaattgaatttgggttttgacctttgaagctgtgcataaagtctaaaacaagaagaggagtggaggctgrggttgtatttgtattttaaaatgagcatttgccacacaaagccaggagcttcagaccagcgtggttaacacagcgagaccctcctctctgtgagaaatta

SEQ ID NO: 12508 - DNA, 201 bp, Homo sapiens
gaggaattgacaatggccatgtcctacgtgaaggatgacatcttccgaatctacattaaaggtaaggggctgctctgggggctgcctgaagccagctcagyttgtactcagttccctgctgagtaaaaaacagggctcgatgttccaccaatgaaggggtcagcaatttgagggctgtttaagacagagacataggccagg

SEQ ID NO: 12509 - DNA, 201 bp, Homo sapiens
ccagcgtggttaacacagcgagaccctcctctctgtgagaaattaaaaaaaaaacaataataaaagccaggcatgttggcatgtacctgtagtcctagctsctcagggggtgaggcgggaggatcacttgactcctgggttacagtgagctctaattgccactgcacttcagcctgggccacagagtgagaccttttctca

SEQ ID NO: 12510 - DNA, 201 bp, Homo sapiens
gtggccctcccatgtgagtggaagggagtggctgcagcgcagaaggcctggaggcccccgcacagaccaggacctctgtagaggaactcatcccctgtgtyccctgtgattgtcaatctccctaaagatggcccagagcagtgcggcctgaatccctcagtggccttgtctctggctgccccagcacccacgcggacactt

SEQ ID NO: 12511 - DNA, 201 bp, Homo sapiens
gccccctgcatgtggctgtggtccagggcccaggtcggagcactcaccttccaggaggtgccagagcaagggggtagtcttgcctctcactcctgccctcygtggctcaagtaggtgtgtttgtttatagccctgtgagtgtccctttcatacttgcctcagcccattccagcagcttatgtccagctgagaacccctggg

SEQ ID NO: 12512 - DNA, 201 bp, Homo sapiens
taataaaagccaggcatgttggcatgtacctgtagtcctagctgctcagggggtgaggcgggaggatcacttgactcctgggttacagtgagctctaattrccactgcacttcagcctgggccacagagtgagaccttttctcaaaataaaataaaatataaccttttgggcaggcatggaaaggggctggagagaataag

SEQ ID NO: 12513 - DNA, 201 bp, Homo sapiens
  misc_feature (1)...(201): n = A,T,C or G, or insertion/deletion polymorphism (see Tables 1-2)
tggagggtgggaaggggccagtggacgcggggagcctgcggggtgggactgcatcgggaaaggggaaggagtcagaggcgagaagggggagagtgtctgtntggctccagccgctgcacgctcttcctgctcaggggactcacggtgaccccggagccactccccagcccagcctccaggtaagaggtcactgagatgggt

SEQ ID NO: 12514 - DNA, 201 bp, Homo sapiens
aagaggaaacagagataagccccctccctgggagcacaagggactcatccccagacatggcaccacaggcaaacagacactgtcacaaaactagcatattmtctttcctagaagtcctttgttttccccaagtgccctttcccccaaccttttgttggtttacgagctctcaattctaacctcctagtacacgaataaaaa

SEQ ID NO: 12515 - DNA, 201 bp, Homo sapiens
cttctatgcctgtggggataatcagtcaggataggctggattatgctgctctaacaaccccaaatttctctgatctaataaaagtatactcaaagctgtayacccttcaagggtcccctggggtctctgctcattgtagttcctgccctggctacaggcataaccatgtggaaatcaaaggctttcttggcaaagagaaag

SEQ ID NO: 12516 - DNA, 201 bp, Homo sapiens
ccacttctgacgcgggtgcgaggccttccgcgggcgtgcacggttgggccggagccgcgccgggggccgggacacgcctggggtcagcgctggcgtcgccrctcgggtggggtgggccgggttcgggtccagtctcctccccacgggcggcccgcgccccgtcttccagtgacccccacatcccttgcgccccgagctgga

SEQ ID NO: 12517 - DNA, 201 bp, Homo sapiens
agcggcgggggcggtgacgcaggccggacacggcctcctgccgcggggtggctgccccctcccttctcggcgacgcctggcgggccgtgagggggtctgcyctggctgctccctggatggcggtggcctgcatgggtccccagttcggccatgggagccggcctggtgactggagtggtgaccaaggccgggacccgctgc

SEQ ID NO: 12518 - DNA, 201 bp, Homo sapiens
atgtgatctgcgatggctgcaatgggcctgtggtaggaacccgctacaagtgcagcgtctgcccagactacgacttgtgtagcgtctgcgagggaaagggyttgcaccgggggcacaccaagctcgcattccccagccccttcgggcacctgtctgaggtgagcaggccctctgtgcaggcctggggtgggctcagggtgg

SEQ ID NO: 12519 - DNA, 201 bp, Homo sapiens
gtcgaatcagctggcatttggttgggataatcccagtgagggagggtgaccagactgtggttgcaggtcttgcctgtcacctctgactgccctcctttggrtgaacaatagtctgcaatttcccctaagccaggccttgggatttggacttttgaggacctgggtagtagttagttgacatgctatttatcttttccttct

SEQ ID NO: 12520 - DNA, 201 bp, Homo sapiens
tgtctgtgccattaaagtcacgctgggaacctgctagaactttgtagttacttggtctttgtgagtggccactgttccccctagacccctgcagccttaastgcacgtgtgcatgcatgctccccgactgtctgccaggagccagggccacggtcaggcttggcctgttgcgcgtgtctcctgtgtgctcatggtgagttt

SEQ ID NO: 12521 - DNA, 201 bp, Homo sapiens
gatctcctgacctcgtgatctacctgcctcggcctcccaaaatgctgggattacaggcgtgagtcaccaccccggcctttttttttttttttttttttaaracggagtctcggtctgtcgcccaggttggagtgcagtggcaccatctcggctcactgcaacctcagcctcccaggttcaagcgattctcctgcctcagcc

SEQ ID NO: 12522 - DNA, 201 bp, Homo sapiens
atgattggcattctaactggtgtgagatgctatctcaatgtggttttgatttgcatttctctgatggccagtgatgctgagcattttttcatgtgtctgcrggccaacaatttttttaaggaaaaaaaaaaagtgactcagttgggcactgtggcctacgcctgtaatccaagtgagacagccaagtctaaaggggtcccg

SEQ ID NO: 12523 - DNA, 201 bp, Homo sapiens
cactgtggcctacgcctgtaatccaagtgagacagccaagtctaaaggggtcccgctttgggaggccgagacgggcggatcacgaggtcaggagaccgagrccatcttagctaacacggtgaaaccccgtctctactaaaaattagccgggagtggtggcgggcacctgtagtcccagctactcgggaggctgaggcagga

SEQ ID NO: 12524 - DNA, 201 bp, Homo sapiens
gctcagggggtgaggcgggaggatcacttgactcctgggttacagtgagctctaattgccactgcacttcagcctgggccacagagtgagaccttttctcwaaataaaataaaatataaccttttgggcaggcatggaaaggggctggagagaataagaggaaacagagataagccccctccctgggagcacaagggactc

SEQ ID NO: 12525 - DNA, 201 bp, Homo sapiens
ccacaaaactacctgagcccacatagtcagggcagggacaggcacagaacaaagtgggtgcacagggactcgcagggaggtcgaagagctgagtctcgtcrggaggctgagggggaagagcgggcactgggctgcgagtgtgcagagctggaggtgggggactgcggtaagtacccgtcctggggtgcgggccctgctggg

SEQ ID NO: 12526 - DNA, 201 bp, Homo sapiens
  misc_feature (1)...(201): n = A,T,C or G, or insertion/deletion polymorphism (see Tables 1-2)
tttgggcttgtctgaaagggctaaaagggggtgatgcctggccgggcgggtggctcacgcctgcagtcccagcactttgggaggccgaggtgggcggatcncctgaagtcaggagttcaagaccatcctggccaacatagtgaaacccatctctactaaaaatacaaaaattagcaaggcttggtggcaggcacctgtagt

SEQ ID NO: 12527 - DNA, 201 bp, Homo sapiens
ttgagatggagtcttgctctgtcaccaggctggagtgcagtggcgccaacttggctcactgcaacctccgcctcccaggttcaagcgattcttctgcctcrgcctcccgagtaactgagactacaggcgattgccaccacgcccagctgattttttgtatttttagtagagacggggtttcaccatattagccagggtagt

SEQ ID NO: 12528 - DNA, 201 bp, Homo sapiens
ggcaggcacctgtagtcccagctacttgggaggctgaggcaggagcaggagaattgcttgaacctgggaggcagaggttgcagtgagctgagatcgtgccmctgcacttcagcctgggtgacagagagagactgtctcaaaaaaaaaaaaaaaaaaaaaaaaaaaagtgatgtccagtgcctggggatttttcctagggag

SEQ ID NO: 12529 - DNA, 201 bp, Homo sapiens
tgggaagttgccatgtagggcaggagtggaaagggttttggaccagagggagagccagggaaaagtcaccaggtagaatgagctggcatgattaggaagayggcaagggagggctgtggccctcccatgtgagtggaagggagtggctgcagcgcagaaggcctggaggcccccgcacagaccaggacctctgtagaggaa

SEQ ID NO: 12530 - DNA, 201 bp, Homo sapiens
  misc_feature (1)...(201): n = A,T,C or G, or insertion/deletion polymorphism (see Tables 1-2)
accccgtgctcctccctgtctgcgcccatacctccggtgcggccctggcccacgcgcaccgcgggctgcagactgctctccttggccagcaggtgtggcangtgatggaagacggtgggcaggtgcagcacgtgccggtgtgagccgttccacggcttcaatcgggggtcctctgggtgggtcgggaaggatcgggactga

SEQ ID NO: 12531 - DNA, 201 bp, Homo sapiens
gagctgtaactgaaataagggttcacccatttagtgtacaagtcagtggttttcactattttcataggtttgtggaccatattcagtgtgagagcttttcmtcaccttataaacgccatacataccatttatcaccctcttatccacatgcccccagcaacctcctttctgtatctattcatcttgcaatcctggacattt

SEQ ID NO: 12532 - DNA, 201 bp, Homo sapiens
tccccagccccttcgggcacctgtctgaggtgagcaggccctctgtgcaggcctggggtgggctcagggtggcaggaaccttgacccgctcactgcctgcygctctgctaattcctcccccagggcttctcgcacagccgctggctccggaaggtgaaacacggacacttcgggtggccaggatgggaaatgggtccacca

SEQ ID NO: 12533 - DNA, 201 bp, Homo sapiens; identical to SEQ ID NO: 1439

SEQ ID NO: 12534 - DNA, 201 bp, Homo sapiens
acctcaggtgatccacccgtcttggcctcccaaagtgctgggattacaggtgtgaaccactgcgcctggccttgctcattccactttgaggcggcagtgayatcttggcattgcttctgaactaaacagcccaaacacgcatggcttctgtactagagtttagaggtgaagtcagagaataggaaagaagaatcgctagtc

SEQ ID NO: 12535 - DNA, 201 bp, Homo sapiens
ctcagcctgcactttatgtaactttcacctggaatactgcaaaggaatgggtaattgacatgcccttgacactggtgaggatttgttgcctcaaatcaacytttagtagtgctggaccacgggcaactcaaggttgaattccctgacaaaattctcgagctttctacatggagtgaagtcgaatcagctggcatttggttg

SEQ ID NO: 12536 - DNA, 201 bp, Homo sapiens
tggccttgctcattccactttgaggcggcagtgacatcttggcattgcttctgaactaaacagcccaaacacgcatggcttctgtactagagtttagaggygaagtcagagaataggaaagaagaatcgctagtctgtttttttttttttttctttgagacagactttcacccttgtcgcctaggctggagtgcagtggtg

SEQ ID NO: 12537 - DNA, 201 bp, Homo sapiens
ttttttttttctttgagacagactttcacccttgtcgcctaggctggagtgcagtggtgtgatctcggctcactgcaacctctgccttccaggttcaagcrattctcctgcctcagcctcccaagtagctgggattataggtgcccaccacaacgcctagctattttttgtatttttagtagagacggggtttcactgtgt

SEQ ID NO: 12538 - DNA, 201 bp, Homo sapiens
gcagtggtgtgatctcggctcactgcaacctctgccttccaggttcaagcgattctcctgcctcagcctcccaagtagctgggattataggtgcccaccayaacgcctagctattttttgtatttttagtagagacggggtttcactgtgttggccaggctgatctcgacacctgcctcggcctcccaaagtgctgggatt

SEQ ID NO: 12539 - DNA, 201 bp, Homo sapiens
gatttgttgcctcaaatcaacctttagtagtgctggaccacgggcaactcaaggttgaattccctgacaaaattctcgagctttctacatggagtgaagtmgaatcagctggcatttggttgggataatcccagtgagggagggtgaccagactgtggttgcaggtcttgcctgtcacctctgactgccctcctttggatg

SEQ ID NO: 12540 - DNA, 201 bp, Homo sapiens
atttttagtagagacggggtttcactgtgttggccaggctgatctcgacacctgcctcggcctcccaaagtgctgggattacaggtgtgagccaccgagcycggccaagaatcagtattcttaatgctttccaaggagggtaaacagtggagcaccgaggtcatgattgagagatcggctgtgcctaaatcctgccactca

SEQ ID NO: 12541 - DNA, 201 bp, Homo sapiens
ctggctgtgtgattccggggtcgagctgggtagaacctagcacctgcatccacacgctgagtgccaccatccagacacttagctgcttgtggggactgaaygttgagatcttcgtgagtctgtagtctccacaggccaagctcctgcttgcaggtgcatccttgggggaacttcacggcttgctctttcctcctccgcctc

SEQ ID NO: 12542 - DNA, 201 bp, Homo sapiens
ttcacggcttgctctttcctcctccgcctctaggcattgaagttgatatcgatgtggagcacggagggaaaagaagccgcctgacccccgtctctccagasagttccagcacagaggagaagagcagctcacagccaagcagctgctgctctgatcccagcaagccgggtgggaatgttgagggcgccacgcagtctctgg

SEQ ID NO: 12543 - DNA, 201 bp, Homo sapiens
tgtggaagttagggctagtttctttctttatgaggaactataagctggatgactcacaggttaactgcctagaagggactgttcccagagcagggcccaarggggaacgaacgagtcaacagctgcctcccggtggcagtgtgtgtagggtaagcggcagctttcatgtgaagtgccaaggccttttggttggggggctga

SEQ ID NO: 12544 - DNA, 201 bp, Homo sapiens
caacttttctgtttgtttcaaccttttttttttcttatctttttttttttttttttttttgagacagacttttgctcttgttgtccaggctggagtgcaayggtgtgatcttggctcactacaacctctgcctcccgggttcaagcgattctcctgcctcagcctttcccagtagctgggattacaggcatgcaccatcac

SEQ ID NO: 12545 - DNA, 201 bp, Homo sapiens
  misc_feature (1)...(201): n = A,T,C or G, or insertion/deletion polymorphism (see Tables 1-2)
aggagaagagcagctcacagccaagcagctgctgctctgatcccagcaagccgggtgggaatgttgagggcgccacgcagtctctggcggagcagatgagnaagatcgccttggagtccgaggggcgccctgaggcaagcctgtgcccctcccgccacctgggaccacggccagcctagtgatctgtggcctgcacctccg

SEQ ID NO: 12546 - DNA, 201 bp, Homo sapiens
  misc_feature (1)...(201): n = A,T,C or G, or insertion/deletion polymorphism (see Tables 1-2)
tggagcacggagggaaaagaagccgcctgacccccgtctctccagagagttccagcacagaggagaagagcagctcacagccaagcagctgctgctctgancccagcaagccgggtgggaatgttgagggcgccacgcagtctctggcggagcagatgagaaagatcgccttggagtccgaggggcgccctgaggcaagcc

SEQ ID NO: 12547 - DNA, 201 bp, Homo sapiens
  misc_feature (1)...(201): n = A,T,C or G, or insertion/deletion polymorphism (see Tables 1-2)
gctgcttgtggggactgaacgttgagatcttcgtgagtctgtagtctccacaggccaagctcctgcttgcaggtgcatccttgggggaacttcacggcttnctctttcctcctccgcctctaggcattgaagttgatatcgatgtggagcacggagggaaaagaagccgcctgacccccgtctctccagagagttccagca

SEQ ID NO: 12548 - DNA, 201 bp, Homo sapiens
gagatgctctctgtgcagggccagggggtgcagagtgggaggaaggagagggggatgctgagtgggtcactggacaagatgtccgggttaaaggtcacccrggaacacagggaccttggcaagaaggtgacaggactgtgacaggtatccaaggcattaaagatatctttatcttatctttgtaaaaatcaaagcttctgg

SEQ ID NO: 12549 - DNA, 201 bp, Homo sapiens; identical to SEQ ID NO: 1433

SEQ ID NO: 12550 - DNA, 201 bp, Homo sapiens
gggggtgcagagtgggaggaaggagagggggatgctgagtgggtcactggacaagatgtccgggttaaaggtcacccgggaacacagggaccttggcaagraggtgacaggactgtgacaggtatccaaggcattaaagatatctttatcttatctttgtaaaaatcaaagcttctggtccatcggaggatccgagtgtga

SEQ ID NO: 12551 - DNA, 201 bp, Homo sapiens
cttggcattgcttctgaactaaacagcccaaacacgcatggcttctgtactagagtttagaggtgaagtcagagaataggaaagaagaatcgctagtctgtttttttttttttttctttgagacagactttcacccttgtcgcctaggctggagtgcagtggtgtgatctcggctcactgcaacctctgccttccaggttc

SEQ ID NO: 12552 - DNA, 201 bp, Homo sapiens
agaatgtttccagaagccacagagatttgtagctgggatatggggagaagcctctgactcatgggtttgtatcgtctggtcccatactggctgtgtgattscggggtcgagctgggtagaacctagcacctgcatccacacgctgagtgccaccatccagacacttagctgcttgtggggactgaacgttgagatcttcgt

SEQ ID NO: 12553 - DNA, 201 bp, Homo sapiens
aataatttaaatattacagatggaggtacttgtagttaagcctgcttttacctctgctccccccttaaactctattgaaataacaggaaagggcttacacaaaaaagaaaacaccatagacaaagaaagtaatagaggaaaagacaaagatgtgatcagattttggaagatggacatggagggagggtggcaacctgctga

SEQ ID NO: 12554 - DNA, 201 bp, Homo sapiens
gttgtcttcatctcgtgggctcaagtgatccttctgcttcagcctccccagtagctgggactacaggcatgtgccactgtgcctagatatttttttttttctttttctttccccacccccgagtcagagtctcgctgtcgcccaggctggagtgcagcggcgtgatctcagctcactgcagtttccacctcctgggttcaa

SEQ ID NO: 12555 - DNA, 201 bp, Homo sapiens
agaccaggaattaaggcaggtgtgacacagagagggggcagcactgggtgtgtccctactactcacactcaagtgccgcctcagggagtgctggtctgagrggggggggggggtcatagccaagatccctgtaggagccaggcagaagccaccgttgaagtggatggtgtggcaggcagcagtgggggggtggggggtggg

SEQ ID NO: 12556 - DNA, 201 bp, Homo sapiens
tcagtggtaggaaaacaaaaagcgatacaaagaaatagtctgctacttgacccagcaaagaacatttagatagaggtcctagctgaaacattgaatgttctttttttttttttgagatggagtcttgctctgtcaccaggctggagtgcagtggcgccaacttggctcactgcaacctccgcctcccaggttcaagcgatt

SEQ ID NO: 12557 - DNA, 201 bp, Homo sapiens
  misc_feature (1)...(201): n = A,T,C or G, or insertion/deletion polymorphism (see Tables 1-2)
attgccaccacgcccagctgattttttgtatttttagtagagacggggtttcaccatattagccagggtagtctcgatctcctgatctcgtgatccgcccncctcggcctcccaaagtgctgggattacaggcgtgagccactgcgctcggcctactgaatgttcttttaacaaaaaattgcgtcttggaaagggtagtgg

SEQ ID NO: 12558 - DNA, 201 bp, Homo sapiens
gtgtgcacaacctgctgtgggccgccgctgtgtgtcttctctgccttagggcaggggatggcgagctatggcctatgggccaagagtagttcttatttttrtttatttatttatttatttttattgatcattcttgggtgtttctcgcagagggggatttggcagggtcataggacaatagtggagggaaggtcagcagat

SEQ ID NO: 12559 - DNA, 201 bp, Homo sapiens
ttatttatttatttttattgatcattcttgggtgtttctcgcagagggggatttggcagggtcataggacaatagtggagggaaggtcagcagataaacawgtgaacaaaggtctctggttttcctaggcagaggaccctgcggccttccgcagcgtttgtgtccctgggtacttgagattagggagtggtgatgactctt

SEQ ID NO: 12560 - DNA, 201 bp, Homo sapiens
tatttttattgatcattcttgggtgtttctcgcagagggggatttggcagggtcataggacaatagtggagggaaggtcagcagataaacaagtgaacaarggtctctggttttcctaggcagaggaccctgcggccttccgcagcgtttgtgtccctgggtacttgagattagggagtggtgatgactcttaatgagaat

SEQ ID NO: 12561 - DNA, 201 bp, Homo sapiens
tggagggaaggtcagcagataaacaagtgaacaaaggtctctggttttcctaggcagaggaccctgcggccttccgcagcgtttgtgtccctgggtacttragattagggagtggtgatgactcttaatgagaatgctgccttcaagcatctgtttaacaaagcacatcttgcaccgcccttaatccattgaaccctgagt

SEQ ID NO: 12562 - DNA, 201 bp, Homo sapiens
tgtgatcagattttggaagatggacatggagggagggtggcaacctgctgagggaagcttcagaaatctctgtgccagaacagggcatcctggtgagaagsaagaccatctgttcaggtaccaggaaaggcaagaggtgggagtgatcgggggacaggaacaaggggggagggttgaaaacctctagggagtgtcagctag

SEQ ID NO: 12563 - DNA, 201 bp, Homo sapiens
cccccgtctctccagagagttccagcacagaggagaagagcagctcacagccaagcagctgctgctctgatcccagcaagccgggtgggaatgttgagggygccacgcagtctctggcggagcagatgagaaagatcgccttggagtccgaggggcgccctgaggcaagcctgtgcccctcccgccacctgggaccacggc

SEQ ID NO: 12564 - DNA, 201 bp, Homo sapiens
  misc_feature (1)...(201): n = A,T,C or G, or insertion/deletion polymorphism (see Tables 1-2)
gaagtggggggagggtgagatgacctccaggagcccagaatggatctccgtggggaacctgggggacgggaaggcctagtccgtatgcagcctccaggggntgagaggggccgagcccaccagactgtggccctttcttgaggctcacccagtgccagccccccaccaccccctacacccagccaactgaggtagcagagc

SEQ ID NO: 12565 - DNA, 201 bp, Homo sapiens
agccaagcagctgctgctctgatcccagcaagccgggtgggaatgttgagggcgccacgcagtctctggcggagcagatgagaaagatcgccttggagtcygaggggcgccctgaggcaagcctgtgcccctcccgccacctgggaccacggccagcctagtgatctgtggcctgcacctccgcctcatcctcagcacctc

SEQ ID NO: 12566 - DNA, 201 bp, Homo sapiens
gccaagcagctgctgctctgatcccagcaagccgggtgggaatgttgagggcgccacgcagtctctggcggagcagatgagaaagatcgccttggagtccraggggcgccctgaggcaagcctgtgcccctcccgccacctgggaccacggccagcctagtgatctgtggcctgcacctccgcctcatcctcagcacctct

SEQ ID NO: 12567 - DNA, 201 bp, Homo sapiens
  misc_feature (1)...(201): n = A,T,C or G, or insertion/deletion polymorphism (see Tables 1-2)
ggcgccacgcagtctctggcggagcagatgagaaagatcgccttggagtccgaggggcgccctgaggcaagcctgtgcccctcccgccacctgggaccacngccagcctagtgatctgtggcctgcacctccgcctcatcctcagcacctctgcagccccacttacaaacccgagggagctgctgctgctgcagtgatgtc

SEQ ID NO: 12568 - DNA, 201 bp, Homo sapiens
tgctagaactttgtagttacttggtctttgtgagtggccactgttccccctagacccctgcagccttaactgcacgtgtgcatgcatgctccccgactgtytgccaggagccagggccacggtcaggcttggcctgttgcgcgtgtctcctgtgtgctcatggtgagttttgttccaggaacagatggagtcggataactg

SEQ ID NO: 12569 - DNA, 201 bp, Homo sapiens
aagagcatcttcctctgcttataacaaagtgtgagtctggccaggtgcagtggttcatgcctgtaatcccagtactttgggagctgaggtgggaagatggyctgagcccaggagtttgagaccagcctagacaacacagggagaccctgcctctacaaaaaagaaaaaaaattagctgggcgtggtagggcacacttgtag

SEQ ID NO: 12570 - DNA, 201 bp, Homo sapiens
cccccctgcagtctctgtcctgccctgaccccccagcttacagccccaaaagcagctaaacaactcgcacacccacggggcatcgcctgggagggcagccsaaatccttccacttcagccccatttgaaagatgaggaaatgagaggctggtccatagtgggtctcgcggctcaggtgccgagccttccctgggcatgcac

SEQ ID NO: 12571 - DNA, 201 bp, Homo sapiens
  misc_feature (1)...(201): n = A,T,C or G, or insertion/deletion polymorphism (see Tables 1-2)
gagagaaactgtttgtcactgaccttctggggtccccaggcgacctcagagccacccgagtcctgcacgccacggctgcacggaggctggacggtgctccngctccacttcctgtcaggacaggaccgtcagtagtcccgtgctactctccagtggcaccccgagcctgactccacgatcacatggcccacaggctcgggt

SEQ ID NO: 12572 - DNA, 201 bp, Homo sapiens
ccaccacgcccggctgattttttgtatttttagtagagacggggtttcaccgtgttagccaggatggtctcgatctcctgacttcatgatccgcccgcctyggcctcccaaagtgctgggattacaggcgtgagccaccgcgcccacccctccatgaagaaagtttttctaaatgaaaaatgtttaggacgctcaggagag

SEQ ID NO: 12573 - DNA, 201 bp, Homo sapiens
gactacaggcgcccgccaccacgcccggctgattttttgtatttttagtagagacggggtttcaccgtgttagccaggatggtctcgatctcctgacttcrtgatccgcccgcctcggcctcccaaagtgctgggattacaggcgtgagccaccgcgcccacccctccatgaagaaagtttttctaaatgaaaaatgttta

SEQ ID NO: 12574 - DNA, 201 bp, Homo sapiens
tgggactacaggcgcccgccaccacgcccggctgattttttgtatttttagtagagacggggtttcaccgtgttagccaggatggtctcgatctcctgacytcatgatccgcccgcctcggcctcccaaagtgctgggattacaggcgtgagccaccgcgcccacccctccatgaagaaagtttttctaaatgaaaaatgt

SEQ ID NO: 12575 - DNA, 201 bp, Homo sapiens
cagcgtttgtgtccctgggtacttgagattagggagtggtgatgactcttaatgagaatgctgccttcaagcatctgtttaacaaagcacatcttgcaccrcccttaatccattgaaccctgagtggacacagcacatgtttcagagagcacggggttgggggtaaggtcacagatcaacaggataagaatttttcttagt

SEQ ID NO: 12576 - DNA, 201 bp, Homo sapiens; identical to SEQ ID NO: 1436

SEQ ID NO: 12577 - DNA, 201 bp, Homo sapiens
cccctcacatcccggacggggtggctgccgggcggagggtctcctcacttctcagacggggcggccgggcagagacgctcctcacctcccggatggggtcrcggccaggcagaggtgctcctcacatcccagacagggcggcggggcagaggcgctccccacatctcagacgatgggtggccgggcagagacgctcctcac

SEQ ID NO: 12578 - DNA, 201 bp, Homo sapiens
gcggggcagaggcgctccccacatctcagacgatgggtggccgggcagagacgctcctcactttccagactgggcagccaggcagaggggctcctcacatyccagacgatgggcggccaggcagagacgctcctcacttcccagacggggtggcggccgggcagaggctgcaatctcggcactttgggaggctaaggcagg

SEQ ID NO: 12579 - DNA, 201 bp, Homo sapiens
cactttccagactgggcagccaggcagaggggctcctcacatcccagacgatgggcggccaggcagagacgctcctcacttcccagacggggtggcggccrggcagaggctgcaatctcggcactttgggaggctaaggcaggcggctgggaggtggaggttgtagcgagccgagatcacgccactgcactccagcctggg

SEQ ID NO: 12580 - DNA, 201 bp, Homo sapiens
cagacgatgggcggccaggcagagacgctcctcacttcccagacggggtggcggccgggcagaggctgcaatctcggcactttgggaggctaaggcaggcrgctgggaggtggaggttgtagcgagccgagatcacgccactgcactccagcctgggcaccattgagcactgagtgaaccagactccgtctgcaatcccgg

SEQ ID NO: 12581 - DNA, 201 bp, Homo sapiens
accattgagcactgagtgaaccagactccgtctgcaatcccggcacctcgggaggccgaggctggcggatcactcgtggttaggagctggagaccagcccrgccaacacagcgaaaccccgtctccaccaaaaaaacacgaaaaccagtcagtcgtggcggcgcgcacctgcaatcgcaggcactcggcaggctgaggcaa

SEQ ID NO: 12582 - DNA, 201 bp, Homo sapiens
ctgagagcctcccgtcttcgatgggcttggggcgcctggacccttccggggtcactttgccgtcttcctccagcccccctccctactccttgtcgccgccyccccgtcttttcaggaccttgcgcactcaggctggccctatgctttggggtaccccagcagtgcccccgggtctccggccaccctgtgacggagggaggg

SEQ ID NO: 12583 - DNA, 201 bp, Homo sapiens
  misc_feature (1)...(201): n = A,T,C or G, or insertion/deletion polymorphism (see Tables 1-2)
ctccttgtcgccgcctccccgtcttttcaggaccttgcgcactcaggctggccctatgctttggggtaccccagcagtgcccccgggtctccggccacccngtgacggagggagggagaggctggcgagggggcggcgccttaggtcccagcgcgacccgcctctcagcccctcccgccggctacagccgcgcgggacggg

SEQ ID NO: 12584 - DNA, 201 bp, Homo sapiens; identical to SEQ ID NO: 1440

SEQ ID NO: 12585 - DNA, 201 bp, Homo sapiens
atgtgtgtggcaggtgtctgcctcctctccagaccctgcaacctcctaggagtaagggtgtccatcattgctgaagtccaggcctggggaggcggacagcytgaaggctgggagcgctgcatggctgagaccccgggctgcccccaagggtctgcctccctgggcagatcctcagcaggtgcttgaccgagggccacagtt

SEQ ID NO: 12586 - DNA, 201 bp, Homo sapiens
  misc_feature (1)...(201): n = A,T,C or G, or insertion/deletion polymorphism (see Tables 1-2)
gcttacagttcccaggcccacagcgtcagcagcagcggcagcagcggcaggcggccgcgcgggtgtttgtcgcttcgcggggccttgcggcagcatggcgnaccatctgatcagtggcggcaccggctacgtgccccaggactggctcaccgtgcagcagctcttcctcggcgccaactgccgcacccacaacaacttcct

SEQ ID NO: 12587 - DNA, 201 bp, Homo sapiens; identical to SEQ ID NO: 1483

SEQ ID NO: 12588 - DNA, 201 bp, Homo sapiens; identical to SEQ ID NO: 1484

SEQ ID NO: 12589 - DNA, 201 bp, Homo sapiens; identical to SEQ ID NO: 1485

SEQ ID NO: 12590 - DNA, 201 bp, Homo sapiens; identical to SEQ ID NO: 1486

SEQ ID NO: 12591 - DNA, 201 bp, Homo sapiens
gtgcagggtgtctcggcctccatccaggacaaagggtccattcagaagtttgtgccctacctcatagcgagtaaccagcatggctccatgatgtactcagragagctcaaatttgagaagtggaccatgtcagcccagatcgagggtggcgtccatggcctgcacgcttaccagaagcagctgtactgaggatagcagtgg

SEQ ID NO: 12592 - DNA, 201 bp, Homo sapiens; identical to SEQ ID NO: 1488

SEQ ID NO: 12593 - DNA, 201 bp, Homo sapiens; identical to SEQ ID NO: 1489

SEQ ID NO: 12594 - DNA, 201 bp, Homo sapiens; identical to SEQ ID NO: 1490

SEQ ID NO: 12595 - DNA, 201 bp, Homo sapiens; identical to SEQ ID NO: 1491

SEQ ID NO: 12596 - DNA, 201 bp, Homo sapiens
gagtcctgcagcctttgaataaatacctgccaggccaagctagcaaatagcacagtttcatgtctggaatttgcagaccagggctgaaggaagttagacaygcttctgtgaagaaaactgatattctgctggggtttgcaagatccctaaaggtcccgtcctccccctgggaatcccagcagtttagaagattcctgaaag

SEQ ID NO: 12597 - DNA, 201 bp, Homo sapiens
gccaagctagcaaatagcacagtttcatgtctggaatttgcagaccagggctgaaggaagttagacacgcttctgtgaagaaaactgatattctgctgggrtttgcaagatccctaaaggtcccgtcctccccctgggaatcccagcagtttagaagattcctgaaagggaaaggagcagctcacctgagacaagcaaggg

SEQ ID NO: 12598 - DNA, 201 bp, Homo sapiens
gaattcgagaccaacctgggcaatatattgagaccctgtctctatttaaaattgttttaatttaaaaaaatttacaataaataaataaaaataagaaaaamctcccaaatcccaccactctagtacaaccaaagtggccacaccatcacacgtgaggttgttcacagcatccttctctggggatgattctaagtcccttga

SEQ ID NO: 12599 - DNA, 201 bp, Homo sapiens; identical to SEQ ID NO: 1492

SEQ ID NO: 12600 - DNA, 201 bp, Homo sapiens; identical to SEQ ID NO: 1493

SEQ ID NO: 12601 - DNA, 201 bp, Homo sapiens; identical to SEQ ID NO: 1595

SEQ ID NO: 12602 - DNA, 201 bp, Homo sapiens; identical to SEQ ID NO: 1495

SEQ ID NO: 12603 - DNA, 201 bp, Homo sapiens; identical to SEQ ID NO: 1496

SEQ ID NO: 12604 - DNA, 201 bp, Homo sapiens; identical to SEQ ID NO: 1497

SEQ ID NO: 12605 - DNA, 201 bp, Homo sapiens; identical to SEQ ID NO: 1498

SEQ ID NO: 12606 - DNA, 201 bp, Homo sapiens; identical to SEQ ID NO: 1715

SEQ ID NO: 12607 - DNA, 201 bp, Homo sapiens; identical to SEQ ID NO: 1601

SEQ ID NO: 12608 - DNA, 201 bp, Homo sapiens; identical to SEQ ID NO: 1716

SEQ ID NO: 12609 - DNA, 201 bp, Homo sapiens; identical to SEQ ID NO: 1604

SEQ ID NO: 12610 - DNA, 201 bp, Homo sapiens; identical to SEQ ID NO: 1717

SEQ ID NO: 12611 - DNA, 201 bp, Homo sapiens
aggtgcctgcgtccaggctggtgtctgggttctgtgccccttccccaccccaggtgtcctgtccattctcaggctggtcacatgggtggtcctagggtgtsccatgagagatgcaaagcgcctgaattttctgactcttcccatcagaccccccaaagacacacgtgacccaccaccccatctctgaccatgaggccaccc

SEQ ID NO: 12612 - DNA, 201 bp, Homo sapiens; identical to SEQ ID NO: 1718

SEQ ID NO: 12613 - DNA, 201 bp, Homo sapiens; identical to SEQ ID NO: 1719

SEQ ID NO: 12614 - DNA, 201 bp, Homo sapiens
aggggcagtggggagccttccccatctcctataggtcgccggggatggcctcccacgagaagaggaggaaaatgggatcagcgctagaatgtcgccctccsttgaatggagaatggcatgagttttcctgagtttcctctgagggccccctcttctctctaggacaattaagggatgacgtctctgaggaaatggagggga

SEQ ID NO: 12615 - DNA, 201 bp, Homo sapiens; identical to SEQ ID NO: 1608

SEQ ID NO: 12616 - DNA, 201 bp, Homo sapiens; identical to SEQ ID NO: 1607

SEQ ID NO: 12617 - DNA, 201 bp, Homo sapiens; identical to SEQ ID NO: 1609

SEQ ID NO: 12618 - DNA, 201 bp, Homo sapiens; identical to SEQ ID NO: 1610

SEQ ID NO: 12619 - DNA, 201 bp, Homo sapiens; identical to SEQ ID NO: 1611

SEQ ID NO: 12620 - DNA, 201 bp, Homo sapiens
cattctcaggctggtcacatgggtggtcctagggtgtcccatgagagatgcaaagcgcctgaattttctgactcttcccatcagaccccccaaagacacaygtgacccaccaccccatctctgaccatgaggccaccctgaggtgctgggccctgggcttctaccctgcggagatcacactgacctggcagcgggatggcg

SEQ ID NO: 12621 - DNA, 201 bp, Homo sapiens; identical to SEQ ID NO: 1613

SEQ ID NO: 12622 - DNA, 201 bp, Homo sapiens; identical to SEQ ID NO: 1615

SEQ ID NO: 12623 - DNA, 201 bp, Homo sapiens
acatgggtggtcctagggtgtcccatgagagatgcaaagcgcctgaattttctgactcttcccatcagaccccccaaagacacacgtgacccaccaccccrtctctgaccatgaggccaccctgaggtgctgggccctgggcttctaccctgcggagatcacactgacctggcagcgggatggcgaggaccaaactcagga

SEQ ID NO: 12624 - DNA, 201 bp, Homo sapiens
gggcgcaggacccggggagccgcgccgggaggagggtcgggcgggtctcagcccctcctcgcccccaggctcccactccatgaggtatttctacaccgccrtgtcccggcccggccgcggggagccccgcttcatcaccgtgggctacgtggacgacacccagttcgtgaggttcgacagcgacgccacgagtccgaggat

SEQ ID NO: 12625 - DNA, 201 bp, Homo sapiens
ggggaccgcaggcgggggcgcaggacccggggagccgcgccgggaggagggtcgggcgggtctcagcccctcctcgcccccaggctcccactccatgaggyatttctacaccgccatgtcccggcccggccgcggggagccccgcttcatcaccgtgggctacgtggacgacacccagttcgtgaggttcgacagcgacgc

SEQ ID NO: 12626 - DNA, 201 bp, Homo sapiens; identical to SEQ ID NO: 1515

SEQ ID NO: 12627 - DNA, 201 bp, Homo sapiens; identical to SEQ ID NO: 1516

SEQ ID NO: 12628 - DNA, 201 bp, Homo sapiens
gaatttgttcatgactgttgttttctgtagcctgagacagctgtcttgtgagggactgagatgcaggatttcttcacgcctcccctttgtgacttcaagascctctggcatctctttctgcaaaggcacctgaatgtgtctgcgtccctgttagcataatgtgaggaggtggagagacagcccacccttgtgtccactgtg

SEQ ID NO: 12629 - DNA, 201 bp, Homo sapiens; identical to SEQ ID NO: 1621

SEQ ID NO: 12630 - DNA, 201 bp, Homo sapiens; identical to SEQ ID NO: 1622

SEQ ID NO: 12631 - DNA, 201 bp, Homo sapiens
tcatcacttaccatgactaaccagaatttgttcatgactgttgttttctgtagcctgagacagctgtcttgtgagggactgagatgcaggatttcttcackcctcccctttgtgacttcaagagcctctggcatctctttctgcaaaggcacctgaatgtgtctgcgtccctgttagcataatgtgaggaggtggagagac

SEQ ID NO: 12632 - DNA, 201 bp, Homo sapiens; identical to SEQ ID NO: 1624

SEQ ID NO: 12633 - DNA, 201 bp, Homo sapiens
tgtggtgggctgtttagagtgtcatcacttaccatgactaaccagaatttgttcatgactgttgttttctgtagcctgagacagctgtcttgtgagggacygagatgcaggatttcttcacgcctcccctttgtgacttcaagagcctctggcatctctttctgcaaaggcacctgaatgtgtctgcgtccctgttagcat

SEQ ID NO: 12634 - DNA, 201 bp, Homo sapiens
tgggtggggtggcgggtctgggggtgggtggggcagaggggaaaggcctgggtaatggagattctttgattgggatgtttcgcgtgtgtggtgggctgttyagagtgtcatcacttaccatgactaaccagaatttgttcatgactgttgttttctgtagcctgagacagctgtcttgtgagggactgagatgcaggattt

SEQ ID NO: 12635 - DNA, 201 bp, Homo sapiens
gggcgggtctcagcccctcctcgcccccaggctcccactccatgaggtatttctacaccgccatgtcccggcccggccgcggggagccccgcttcatcacmgtgggctacgtggacgacacccagttcgtgaggttcgacagcgacgccacgagtccgaggatggcgccccgggcgccatggatagagcaggaggggccgg

SEQ ID NO: 12636 - DNA, 201 bp, Homo sapiens; identical to SEQ ID NO: 1627

SEQ ID NO: 12637 - DNA, 201 bp, Homo sapiens
gtcgggcgggtctcagcccctcctcgcccccaggctcccactccatgaggtatttctacaccgccatgtcccggcccggccgcggggagccccgcttcatyaccgtgggctacgtggacgacacccagttcgtgaggttcgacagcgacgccacgagtccgaggatggcgccccgggcgccatggatagagcaggaggggc

SEQ ID NO: 12638 - DNA, 201 bp, Homo sapiens; identical to SEQ ID NO: 1629

SEQ ID NO: 12639 - DNA, 201 bp, Homo sapiens
ccggactcagaatctcctcagacgccgagatgcgggtcacggcgccccgaaccgtcctcctgctgctctggggggcagtggccctgaccgagacctgggcbggtgagtgcggggtcgggagggaaatggcctctgtggggaggagcgaggggaccgcaggcgggggcgcaggacccggggagccgcgccgggaggagggtc

SEQ ID NO: 12640 - DNA, 201 bp, Homo sapiens
ttctaaagtccccacgcacccacccggactcagaatctcctcagacgccgagatgcgggtcacggcgccccgaaccgtcctcctgctgctctggggggcastggccctgaccgagacctgggccggtgagtgcggggtcgggagggaaatggcctctgtggggaggagcgaggggaccgcaggcgggggcgcaggacccgg

SEQ ID NO: 12641 - DNA, 201 bp, Homo sapiens
ttgttctctgcctcacactcagtgtgtttggggctctgattccagcacttctgagtcactttacctccactcagatcaggagcagaagtccctgttccccrctcagagactcgaactttccaatgaataggagattatcccaggtgcctgcgtccaggctggtgtctgggttctgtgccccttccccaccccaggtgtcct

SEQ ID NO: 12642 - DNA, 201 bp, Homo sapiens; identical to SEQ ID NO: 1632

SEQ ID NO: 12643 - DNA, 201 bp, Homo sapiens; identical to SEQ ID NO: 1529

SEQ ID NO: 12644 - DNA, 201 bp, Homo sapiens
gttctaaagtccccacgcacccacccggactcagaatctcctcagacgccgagatgcgggtcacggcgccccgaaccgtcctcctgctgctctggggggcmgtggccctgaccgagacctgggccggtgagtgcggggtcgggagggaaatggcctctgtggggaggagcgaggggaccgcaggcgggggcgcaggacccg

SEQ ID NO: 12645 - DNA, 201 bp, Homo sapiens
ccagttctaaagtccccacgcacccacccggactcagaatctcctcagacgccgagatgcgggtcacggcgccccgaaccgtcctcctgctgctctggggrgcagtggccctgaccgagacctgggccggtgagtgcggggtcgggagggaaatggcctctgtggggaggagcgaggggaccgcaggcgggggcgcaggac

SEQ ID NO: 12646 - DNA, 201 bp, Homo sapiens
cccagttctaaagtccccacgcacccacccggactcagaatctcctcagacgccgagatgcgggtcacggcgccccgaaccgtcctcctgctgctctgggsggcagtggccctgaccgagacctgggccggtgagtgcggggtcgggagggaaatggcctctgtggggaggagcgaggggaccgcaggcgggggcgcagga

SEQ ID NO: 12647 - DNA, 201 bp, Homo sapiens; identical to SEQ ID NO: 1637

SEQ ID NO: 12648 - DNA, 201 bp, Homo sapiens
ggtgtcccatgagagatgcaaagcgcctgaattttctgactcttcccatcagaccccccaaagacacacgtgacccaccaccccatctctgaccatgaggycaccctgaggtgctgggccctgggcttctaccctgcggagatcacactgacctggcagcgggatggcgaggaccaaactcaggacactgagcttgtggag

SEQ ID NO: 12649 - DNA, 201 bp, Homo sapiens; identical to SEQ ID NO: 1534

SEQ ID NO: 12650 - DNA, 201 bp, Homo sapiens; identical to SEQ ID NO: 1640

SEQ ID NO: 12651 - DNA, 201 bp, Homo sapiens; identical to SEQ ID NO: 1642

SEQ ID NO: 12652 - DNA, 201 bp, Homo sapiens; identical to SEQ ID NO: 1536

SEQ ID NO: 12653 - DNA, 201 bp, Homo sapiens; identical to SEQ ID NO: 1643

SEQ ID NO: 12654 - DNA, 201 bp, Homo sapiens
ctagagaagccaatcagtgtcgccggggtcccagttctaaagtccccacgcacccacccggactcagaatctcctcagacgccgagatgcgggtcacggcrccccgaaccgtcctcctgctgctctggggggcagtggccctgaccgagacctgggccggtgagtgcggggtcgggagggaaatggcctctgtggggagga

SEQ ID NO: 12655 - DNA, 201 bp, Homo sapiens
tttttgttctactccaggcagcgacagtgcccagggctctgatgtgtctctcacagcttgaaaaggtgagattcttggggtctagagtgggtggggtggcrggtctgggggtgggtggggcagaggggaaaggcctgggtaatggagattctttgattgggatgtttcgcgtgtgtggtgggctgtttagagtgtcatcac

SEQ ID NO: 12656 - DNA, 201 bp, Homo sapiens
tctagagaagccaatcagtgtcgccggggtcccagttctaaagtccccacgcacccacccggactcagaatctcctcagacgccgagatgcgggtcacggmgccccgaaccgtcctcctgctgctctggggggcagtggccctgaccgagacctgggccggtgagtgcggggtcgggagggaaatggcctctgtggggagg

SEQ ID NO: 12657 - DNA, 201 bp, Homo sapiens
gacggcaaggattacatcgccctgaacgaggacctgagctcctggaccgcggcggacaccgcggctcagatcacccagcgcaagtgggaggcggcccgtgwggcggagcagcagagagcctacctggagggcacgtgcgtggagtggctccgcagatacctggagaacgggaaggagacgctgcagcgcgcgggtaccagg

SEQ ID NO: 12658 - DNA, 201 bp, Homo sapiens
tccctactgaaaataagaatctgaatataaatttgttttctcaaatatttgctatgagaggttgatggattaattaaataagtcaattcctggaatttgaragagcaaataaagacctgagaaccttccagaatctgcatgttcgctgtgctgagtctgttgcaggtggggtgtggagaaggctgtggggggccgagtgtg

SEQ ID NO: 12659 - DNA, 201 bp, Homo sapiens; identical to SEQ ID NO: 1648

SEQ ID NO: 12660 - DNA, 201 bp, Homo sapiens; identical to SEQ ID NO: 1647

SEQ ID NO: 12661 - DNA, 201 bp, Homo sapiens
tacttccctactgaaaataagaatctgaatataaatttgttttctcaaatatttgctatgagaggttgatggattaattaaataagtcaattcctggaatktgagagagcaaataaagacctgagaaccttccagaatctgcatgttcgctgtgctgagtctgttgcaggtggggtgtggagaaggctgtggggggccgag

SEQ ID NO: 12662 - DNA, 201 bp, Homo sapiens; identical to SEQ ID NO: 1651

SEQ ID NO: 12663 - DNA, 201 bp, Homo sapiens; identical to SEQ ID NO: 1652

SEQ ID NO: 12664 - DNA, 201 bp, Homo sapiens; identical to SEQ ID NO: 1653

SEQ ID NO: 12665 - DNA, 201 bp, Homo sapiens
ccctgttccccgctcagagactcgaactttccaatgaataggagattatcccaggtgcctgcgtccaggctggtgtctgggttctgtgccccttccccacmccaggtgtcctgtccattctcaggctggtcacatgggtggtcctagggtgtcccatgagagatgcaaagcgcctgaattttctgactcttcccatcagac

SEQ ID NO: 12666 - DNA, 201 bp, Homo sapiens
cggcccgtgtggcggagcagcagagagcctacctggagggcacgtgcgtggagtggctccgcagatacctggagaacgggaaggagacgctgcagcgcgckggtaccaggggcagtggggagccttccccatctcctataggtcgccggggatggcctcccacgagaagaggaggaaaatgggatcagcgctagaatgtcg

SEQ ID NO: 12667 - DNA, 201 bp, Homo sapiens; identical to SEQ ID NO: 1655

SEQ ID NO: 12668 - DNA, 201 bp, Homo sapiens; identical to SEQ ID NO: 1654

SEQ ID NO: 12669 - DNA, 201 bp, Homo sapiens
gtgggaggcggcccgtgtggcggagcagcagagagcctacctggagggcacgtgcgtggagtggctccgcagatacctggagaacgggaaggagacgctgsagcgcgcgggtaccaggggcagtggggagccttccccatctcctataggtcgccggggatggcctcccacgagaagaggaggaaaatgggatcagcgcta

SEQ ID NO: 12670 - DNA, 201 bp, Homo sapiens
tcgggcgggtctcagcccctcctcgcccccaggctcccactccatgaggtatttctacaccgccatgtcccggcccggccgcggggagccccgcttcatcdccgtgggctacgtggacgacacccagttcgtgaggttcgacagcgacgccacgagtccgaggatggcgccccgggcgccatggatagagcaggaggggcc

SEQ ID NO: 12671 - DNA, 201 bp, Homo sapiens
cgcaagtgggaggcggcccgtgtggcggagcagcagagagcctacctggagggcacgtgcgtggagtggctccgcagatacctggagaacgggaaggagamgctgcagcgcgcgggtaccaggggcagtggggagccttccccatctcctataggtcgccggggatggcctcccacgagaagaggaggaaaatgggatcag

SEQ ID NO: 12672 - DNA, 201 bp, Homo sapiens
cgggggcgcaggacccggggagccgcgccgggaggagggtcgggcgggtctcagcccctcctcgcccccaggctcccactccatgaggtatttctacacckccatgtcccggcccggccgcggggagccccgcttcatcaccgtgggctacgtggacgacacccagttcgtgaggttcgacagcgacgccacgagtccgag

SEQ ID NO: 12673 - DNA, 201 bp, Homo sapiens
agcgcaagtgggaggcggcccgtgtggcggagcagcagagagcctacctggagggcacgtgcgtggagtggctccgcagatacctggagaacgggaaggasacgctgcagcgcgcgggtaccaggggcagtggggagccttccccatctcctataggtcgccggggatggcctcccacgagaagaggaggaaaatgggatc

SEQ ID NO: 12674 - DNA, 201 bp, Homo sapiens; identical to SEQ ID NO: 1662

SEQ ID NO: 12675 - DNA, 201 bp, Homo sapiens; identical to SEQ ID NO: 1555

SEQ ID NO: 12676 - DNA, 201 bp, Homo sapiens
tgactcttcccatcagaccccccaaagacacacgtgacccaccaccccatctctgaccatgaggccaccctgaggtgctgggccctgggcttctaccctgsggagatcacactgacctggcagcgggatggcgaggaccaaactcaggacactgagcttgtggagaccagaccagcaggagatagaaccttccagaagtgg

SEQ ID NO: 12677 - DNA, 201 bp, Homo sapiens
tgtcctgtccattctcaggctggtcacatgggtggtcctagggtgtcccatgagagatgcaaagcgcctgaattttctgactcttcccatcagaccccccdaagacacacgtgacccaccaccccatctctgaccatgaggccaccctgaggtgctgggccctgggcttctaccctgcggagatcacactgacctggcagc

SEQ ID NO: 12678 - DNA, 201 bp, Homo sapiens; identical to SEQ ID NO: 1666

SEQ ID NO: 12679 - DNA, 201 bp, Homo sapiens
ggtcccagttctaaagtccccacgcacccacccggactcagaatctcctcagacgccgagatgcgggtcacggcgccccgaaccgtcctcctgctgctctsgggggcagtggccctgaccgagacctgggccggtgagtgcggggtcgggagggaaatggcctctgtggggaggagcgaggggaccgcaggcgggggcgca

SEQ ID NO: 12680 - DNA, 201 bp, Homo sapiens
gtgtctagagaagccaatcagtgtcgccggggtcccagttctaaagtccccacgcacccacccggactcagaatctcctcagacgccgagatgcgggtcayggcgccccgaaccgtcctcctgctgctctggggggcagtggccctgaccgagacctgggccggtgagtgcggggtcgggagggaaatggcctctgtgggg

SEQ ID NO: 12681 - DNA, 201 bp, Homo sapiens; identical to SEQ ID NO: 1669

SEQ ID NO: 12682 - DNA, 201 bp, Homo sapiens; identical to SEQ ID NO: 1670

SEQ ID NO: 12683 - DNA, 201 bp, Homo sapiens; identical to SEQ ID NO: 1562

SEQ ID NO: 12684 - DNA, 201 bp, Homo sapiens; identical to SEQ ID NO: 1563

SEQ ID NO: 12685 - DNA, 201 bp, Homo sapiens; identical to SEQ ID NO: 1564

SEQ ID NO: 12686 - DNA, 201 bp, Homo sapiens; identical to SEQ ID NO: 1674

SEQ ID NO: 12687 - DNA, 201 bp, Homo sapiens; identical to SEQ ID NO: 1566

SEQ ID NO: 12688 - DNA, 201 bp, Homo sapiens; identical to SEQ ID NO: 1675

SEQ ID NO: 12689 - DNA, 201 bp, Homo sapiens; identical to SEQ ID NO: 1567

SEQ ID NO: 12690 - DNA, 201 bp, Homo sapiens; identical to SEQ ID NO: 1677

SEQ ID NO: 12691 - DNA, 201 bp, Homo sapiens
tgtcgggtgtctagagaagccaatcagtgtcgccggggtcccagttctaaagtccccacgcacccacccggactcagaatctcctcagacgccgagatgckggtcacggcgccccgaaccgtcctcctgctgctctggggggcagtggccctgaccgagacctgggccggtgagtgcggggtcgggagggaaatggcctct

SEQ ID NO: 12692 - DNA, 201 bp, Homo sapiens; identical to SEQ ID NO: 1569

SEQ ID NO: 12693 - DNA, 201 bp, Homo sapiens
tgcgtccaggctggtgtctgggttctgtgccccttccccaccccaggtgtcctgtccattctcaggctggtcacatgggtggtcctagggtgtcccatgaragatgcaaagcgcctgaattttctgactcttcccatcagaccccccaaagacacacgtgacccaccaccccatctctgaccatgaggccaccctgaggtg

SEQ ID NO: 12694 - DNA, 201 bp, Homo sapiens; identical to SEQ ID NO: 1570

SEQ ID NO: 12695 - DNA, 201 bp, Homo sapiens
accgcggcggacaccgcggctcagatcacccagcgcaagtgggaggcggcccgtgtggcggagcagcagagagcctacctggagggcacgtgcgtggagtsgctccgcagatacctggagaacgggaaggagacgctgcagcgcgcgggtaccaggggcagtggggagccttccccatctcctataggtcgccggggatgg

SEQ ID NO: 12696 - DNA, 201 bp, Homo sapiens; identical to SEQ ID NO: 1683

SEQ ID NO: 12697 - DNA, 201 bp, Homo sapiens; identical to SEQ ID NO: 1684

SEQ ID NO: 12698 - DNA, 201 bp, Homo sapiens; identical to SEQ ID NO: 1574

SEQ ID NO: 12699 - DNA, 201 bp, Homo sapiens; identical to SEQ ID NO: 1687

SEQ ID NO: 12700 - DNA, 201 bp, Homo sapiens; identical to SEQ ID NO: 1686

SEQ ID NO: 12701 - DNA, 201 bp, Homo sapiens; identical to SEQ ID NO: 1689

SEQ ID NO: 12702 - DNA, 201 bp, Homo sapiens
ctgagctcctggaccgcggcggacaccgcggctcagatcacccagcgcaagtgggaggcggcccgtgtggcggagcagcagagagcctacctggagggcahgtgcgtggagtggctccgcagatacctggagaacgggaaggagacgctgcagcgcgcgggtaccaggggcagtggggagccttccccatctcctataggt

SEQ ID NO: 12703 - DNA, 201 bp, Homo sapiens
cctgagctcctggaccgcggcggacaccgcggctcagatcacccagcgcaagtgggaggcggcccgtgtggcggagcagcagagagcctacctggagggcvcgtgcgtggagtggctccgcagatacctggagaacgggaaggagacgctgcagcgcgcgggtaccaggggcagtggggagccttccccatctcctatagg

SEQ ID NO: 12704 - DNA, 201 bp, Homo sapiens
cgccctgaacgaggacctgagctcctggaccgcggcggacaccgcggctcagatcacccagcgcaagtgggaggcggcccgtgtggcggagcagcagagarcctacctggagggcacgtgcgtggagtggctccgcagatacctggagaacgggaaggagacgctgcagcgcgcgggtaccaggggcagtggggagccttc

SEQ ID NO: 12705 - DNA, 201 bp, Homo sapiens
cctgaattttctgactcttcccatcagaccccccaaagacacacgtgacccaccaccccatctctgaccatgaggccaccctgaggtgctgggccctgggyttctaccctgcggagatcacactgacctggcagcgggatggcgaggaccaaactcaggacactgagcttgtggagaccagaccagcaggagatagaacct

SEQ ID NO: 12706 - DNA, 201 bp, Homo sapiens
cgggtctgggggtgggtggggcagaggggaaaggcctgggtaatggagattctttgattgggatgtttcgcgtgtgtggtgggctgtttagagtgtcatcrcttaccatgactaaccagaatttgttcatgactgttgttttctgtagcctgagacagctgtcttgtgagggactgagatgcaggatttcttcacgcctcc

SEQ ID NO: 12707 - DNA, 201 bp, Homo sapiens; identical to SEQ ID NO: 1694

SEQ ID NO: 12708 - DNA, 201 bp, Homo sapiens
tacatcgccctgaacgaggacctgagctcctggaccgcggcggacaccgcggctcagatcacccagcgcaagtgggaggcggcccgtgtggcggagcagckgagagcctacctggagggcacgtgcgtggagtggctccgcagatacctggagaacgggaaggagacgctgcagcgcgcgggtaccaggggcagtggggag

SEQ ID NO: 12709 - DNA, 201 bp, Homo sapiens
ttacatcgccctgaacgaggacctgagctcctggaccgcggcggacaccgcggctcagatcacccagcgcaagtgggaggcggcccgtgtggcggagcagyagagagcctacctggagggcacgtgcgtggagtggctccgcagatacctggagaacgggaaggagacgctgcagcgcgcgggtaccaggggcagtgggga

SEQ ID NO: 12710 - DNA, 201 bp, Homo sapiens; identical to SEQ ID NO: 1696

SEQ ID NO: 12711 - DNA, 201 bp, Homo sapiens; identical to SEQ ID NO: 1697

SEQ ID NO: 12712 - DNA, 201 bp, Homo sapiens; identical to SEQ ID NO: 1698

SEQ ID NO: 12713 - DNA, 201 bp, Homo sapiens
caccgcggctcagatcacccagcgcaagtgggaggcggcccgtgtggcggagcagcagagagcctacctggagggcacgtgcgtggagtggctccgcagayacctggagaacgggaaggagacgctgcagcgcgcgggtaccaggggcagtggggagccttccccatctcctataggtcgccggggatggcctcccacgag

SEQ ID NO: 12714 - DNA, 201 bp, Homo sapiens
acaccgcggctcagatcacccagcgcaagtgggaggcggcccgtgtggcggagcagcagagagcctacctggagggcacgtgcgtggagtggctccgcagrtacctggagaacgggaaggagacgctgcagcgcgcgggtaccaggggcagtggggagccttccccatctcctataggtcgccggggatggcctcccacga

SEQ ID NO: 12715 - DNA, 201 bp, Homo sapiens
gaccgcggcggacaccgcggctcagatcacccagcgcaagtgggaggcggcccgtgtggcggagcagcagagagcctacctggagggcacgtgcgtggagkggctccgcagatacctggagaacgggaaggagacgctgcagcgcgcgggtaccaggggcagtggggagccttccccatctcctataggtcgccggggatg

SEQ ID NO: 12716 - DNA, 201 bp, Homo sapiens
cgcaggcgggggcgcaggacccggggagccgcgccgggaggagggtcgggcgggtctcagcccctcctcgcccccaggctcccactccatgaggtatttcbacaccgccatgtcccggcccggccgcggggagccccgcttcatcaccgtgggctacgtggacgacacccagttcgtgaggttcgacagcgacgccacgag

SEQ ID NO: 12717 - DNA, 201 bp, Homo sapiens; identical to SEQ ID NO: 1703

SEQ ID NO: 12718 - DNA, 201 bp, Homo sapiens; identical to SEQ ID NO: 1704

SEQ ID NO: 12719 - DNA, 201 bp, Homo sapiens
ggaccgcggcggacaccgcggctcagatcacccagcgcaagtgggaggcggcccgtgtggcggagcagcagagagcctacctggagggcacgtgcgtggabtggctccgcagatacctggagaacgggaaggagacgctgcagcgcgcgggtaccaggggcagtggggagccttccccatctcctataggtcgccggggat

SEQ ID NO: 12720 - DNA, 201 bp, Homo sapiens; identical to SEQ ID NO: 1591

SEQ ID NO: 12721 - DNA, 201 bp, Homo sapiens; identical to SEQ ID NO: 1592

SEQ ID NO: 12722 - DNA, 201 bp, Homo sapiens; identical to SEQ ID NO: 1593

SEQ ID NO: 12723 - DNA, 201 bp, Homo sapiens; identical to SEQ ID NO: 1709

SEQ ID NO: 12724 - DNA, 201 bp, Homo sapiens
gggatcagcgctagaatgtcgccctcccttgaatggagaatggcatgagttttcctgagtttcctctgagggccccctcttctctctaggacaattaaggratgacgtctctgaggaaatggaggggaagacagtccctagaatactgatcaggggtcccctttgacccctgcagcagccttgggaaccgtgacttttcct

SEQ ID NO: 12725 - DNA, 201 bp, Homo sapiens
cctcattgtgtgacagcagccatgcctcctcctgkggatcaggatctattacctgtgcctggagagraggggactcctcttctcacccgctggtctctggrcacatactgtccaattcccctgkggcagctgtaatgtgtagttcaatgggcactcatttgtccccttttaagggtaccctcctttagaatccaggacctt

SEQ ID NO: 12726 - DNA, 201 bp, Homo sapiens
tgcaatacagaattaaatgtgccaggatttattaggggaaatagccatgaaagaaattggggagcaagacagaaaagactgggaaagccataagactgtgrcgcaagtggcttttttatttttattttttgagcaatctcagctcactgcaacctccacctcccaggtgcaagtgattctcatgcctcagcctcccaagta

SEQ ID NO: 12727 - DNA, 201 bp, Homo sapiens; identical to SEQ ID NO: 1920

SEQ ID NO: 12728 - DNA, 201 bp, Homo sapiens; identical to SEQ ID NO: 1924

SEQ ID NO: 12729 - DNA, 201 bp, Homo sapiens; identical to SEQ ID NO: 1926

SEQ ID NO: 12730 - DNA, 201 bp, Homo sapiens
cctttgatcaaatgccctcaaattccaatcccagaagtgttccccaggatcctatgtggacatgccagctagttcctgcaaagctcctgagtggaattccygctgcattataagggtgaggcttctgcagcatcttccagcgtaggaagtgggaaccattactggaaaaggcgagccttctctgcatgcccagagggtact

SEQ ID NO: 12731 - DNA, 201 bp, Homo sapiens
tttgaactgcagtatcagtcacctgacccataaagagctggttggtttgtgtacagcatttgcaagatgaatggacaacaccctgtttggaagtctacccytttgatcaaagaagataaaaacagaacagctcttgtgggctgaattgcagggtgttttcttagcagtgatggaagaattgaacaatgataaaagctccta

SEQ ID NO: 12732 - DNA, 201 bp, Homo sapiens; identical to SEQ ID NO: 1923

SEQ ID NO: 12733 - DNA, 201 bp, Homo sapiens; identical to SEQ ID NO: 1925

SEQ ID NO: 12734 - DNA, 201 bp, Homo sapiens; identical to SEQ ID NO: 1914

SEQ ID NO: 12735 - DNA, 201 bp, Homo sapiens; identical to SEQ ID NO: 1917

SEQ ID NO: 12736 - DNA, 201 bp, Homo sapiens; identical to SEQ ID NO: 1916

SEQ ID NO: 12737 - DNA, 201 bp, Homo sapiens; identical to SEQ ID NO: 1915

SEQ ID NO: 12738 - DNA, 201 bp, Homo sapiens
ggcttcattcaattcattgaaggtgtaaattgaatgaaacactgaccttccccaagcaagatggaattctgtcctgggatttgaactgcagtatcagtcasctgacccataaagagctggttggtttgtgtacagcatttgcaagatgaatggacaacaccctgtttggaagtctacccctttgatcaaagaagataaaaa

SEQ ID NO: 12739 - DNA, 201 bp, Homo sapiens
ccagggatttgctccagattaatctgagtcatggaaaaactgcctttcttttgtttctaaacaaatacctgcaaagacaaaagaccacataaatccccagrtgcacaactttttcagatttaaagaaaaaacaacccccgtctttccctccattcccaggagaagctcactctgtggcatcaagctgcctgggtgagctct

SEQ ID NO: 12740 - DNA, 201 bp, Homo sapiens; identical to SEQ ID NO: 1919

SEQ ID NO: 12741 - DNA, 201 bp, Homo sapiens; identical to SEQ ID NO: 1918

SEQ ID NO: 12742 - DNA, 201 bp, Homo sapiens; identical to SEQ ID NO: 1922

SEQ ID NO: 12743 - DNA, 201 bp, Homo sapiens; identical to SEQ ID NO: 1921

SEQ ID NO: 12744 - DNA, 201 bp, Homo sapiens
tcggctgctcctctggggttgccatggtaaccgtgtcctctggcttttgcaggtcactgccaccacttgttctctatctcttcagggccacaccctctccrtggatattaatgagcccaactctgggacatcttttcctaccatcaccctcagccttcagagaacaatacaatgaaacttcttagtgatgcaggtccctgt

SEQ ID NO: 12745 - DNA, 201 bp, Homo sapiens
gcatgttctcactcatagatgggaattgaacaatgagaacacatggacacagggtggggaacatcacacactgggacctgtcgtgggttggagggggggggagggataacattaggagaaatcctaatgtaaatgacaagttaatgggtgcagcacaccaacatggcacatgtatacatatgtaacaaatctgcacgttgt

SEQ ID NO: 12746 - DNA, 201 bp, Homo sapiens
agctggacggagaatgactttgacaagttgacagaagtaggcctcagaagatcagtaataacaaacttctctgagctaaaggaggatgttcaaacccatcrcaaagaagctaaaaaccttgaaaaaaaagatatgacaaatggctaactagaataagcagcacagagaaaaccttaaatgacctgatggagctgaaaacca

SEQ ID NO: 12747 - DNA, 201 bp, Homo sapiens
ctccagaggaacgcagcttctcgtcagcaacggaacgaagctggacggagaatgactttgacaagttgacagaagtaggcctcagaagatcagtaataacraacttctctgagctaaaggaggatgttcaaacccatcgcaaagaagctaaaaaccttgaaaaaaaagatatgacaaatggctaactagaataagcagcac

SEQ ID NO: 12748 - DNA, 201 bp, Homo sapiens
atgataaccaacatgaagaataaacttactgtgaaaggtatgattctatatgaagaaaaactataaatctttacttttaggaagtaaaacagtagttaaawgggagtgtcagtcagctctaaattagtattacaaatttaaagtggtaaaatacacttggaagagtaattaaactggtctagagagcagccagttcaggat

SEQ ID NO: 12749 - DNA, 201 bp, Homo sapiens
tgggcataatatatacatttgtgatgaatgaagaccttttttcctgtacaagaggattatagttgcctgaacctaaataatcaggaatactgtgtcctttktcattgaaaaaggtatggacatttcagaataaattcttgaaagaaaaaaataatcagttctgtactttccccctcacattcattttctatccctttatat

SEQ ID NO: 12750 - DNA, 201 bp, Homo sapiens
tgcttatactattcttgtttcatatttctcatggattatattttattttaccttaaagaaagcctatactgtgtatttttttaatcaaggtagtatgttcwtgtagttaatagagattatcatttttttcatgtgaattacagaaataattccctgataattaagattctgactttctctagatgtataaaatcttttcgg

SEQ ID NO: 12751 - DNA, 201 bp, Homo sapiens
gaaatgtgttaagaaggttgaccaaaaaaagcacaatgctgacatatcacgtaagatggaagcagaagaactcaaaatgtaaattacctgggattgacaaytgtgttcactagcatcattctaccattgttattgcaagccagttagtattatttcccttttacagacaggttgatcagagtggaaggagtgttttggtgc

SEQ ID NO: 12752 - DNA, 201 bp, Homo sapiens
tcctcaggtatattcaaagtttgaaacgttaaaaggagatttaaaatgatcattaacgttgtttttgctttcttttttaaaactgtaacaaccagttatcractgctagatctaggcagccagaaaattacagttaaatgcacatttgaacaactgtccattttgagagatgccgaaatgataactaacataaggctcatg

SEQ ID NO: 12753 - DNA, 201 bp, Homo sapiens
  misc_feature (1)...(201): n = A,T,C or G, or insertion/deletion polymorphism (see Tables 1-2)
caccacgatcaagtcagcttcatccctgggatgcaagactggttcaacatacgcaaatcaataaacgtaatccatcatataaacagaaccgaagacaaaanccacatgattatctcaatagatgcagaaaaggcctttgatgaaattcagcagcccttcatgctaaaaactcttaataaagtaggtattgatggagtgcat

SEQ ID NO: 12754 - DNA, 201 bp, Homo sapiens
aaaacaattttcaacccagaatttcatatccagccaaactaagcttcataagtgaaggagaaataaaatcctttacagagaagcaaatgctgagagattttgtcaccaccaggcctgccttacaagagctcctgaaggaagcactaaacatggaaaggaacaactgagaccagccactgcaaaaacatgccaaattgtaaa

SEQ ID NO: 12755 - DNA, 201 bp, Homo sapiens
attcaggaaatacagagaacgccacaaagatacttcttgagaagagcaactccaagacacgtaattgtcagattcaccaaagttgaaatgaaggaaaaaaygttaagggcagccagagagaaaggtcgggttacccacaaagggaagcccatcagactgacagcggatctctcggcagaaactctacaagccagaagagag

SEQ ID NO: 12756 - DNA, 201 bp, Homo sapiens
ctagagtgtagtggcacaatctcggctcactgcaacctccacttcctgggttcaagtgattctcctacctcaccctcctgagtagctgggattccacgccyggcttagttttgtatttttagtagagacggggttttgccatgttggccaggctgggctcaaacttctgacctcaggtgatctgccagccttggcctccca

SEQ ID NO: 12757 - DNA, 201 bp, Homo sapiens
gtcttttgttgttgttgttgttgttgttgggggatgggggtctcagtacattaccaacccaggctgatcttgaactcctgagtgcaagcaatcctcctgtytcagcctctcaagtagctgggattacagatgtgccatgcaccctaaaaatttgccaatttgttaactgacacagtattttaaaatttgttgtttctgtct

SEQ ID NO: 12758 - DNA, 201 bp, Homo sapiens
agatgtgtgattctcaaatttgtgactttatcagaattccctttagagctttttttttttttttgagacagagtctcactctgttgtgcagactagagtgyagtggcacaatctcggctcactgcaacctccacttcctgggttcaagtgattctcctacctcaccctcctgagtagctgggattccacgcctggcttagt

SEQ ID NO: 12759 - DNA, 201 bp, Homo sapiens
cctagtacagggagtgaaagcactgcatactgctttaaaattatggatgaaaaaagaagtaagttgtttcaacagtgaaatcactgtgttttatgccacaagattaggaaaacagagtccttgtgctattttggcagcacgtgtgaatgccagtagtagagggaatagaaatcatgcctttatatacaacctgcattttat

SEQ ID NO: 12760 - DNA, 201 bp, Homo sapiens
acctagtacagggagtgaaagcactgcatactgctttaaaattatggatgaaaaaagaagtaagttgtttcaacagtgaaatcactgtgttttatgccacaagattaggaaaacagagtccttgtgctattttggcagcacgtgtgaatgccagtagtagagggaatagaaatcatgcctttatatacaacctgcatttta

SEQ ID NO: 12761 - DNA, 201 bp, Homo sapiens
gtcctttgtccctcaatatttaaggactttttacatattaggggtactagctgtttgtggtaaatgttctaagtattctcttccagctttcagttgtcttktggttttgtttatggtaatttttttgccatgcaaaattttttttaagaaatatgtagtcatatttattagtcttttattggttctggattttgagtcata

SEQ ID NO: 12762 - DNA, 201 bp, Homo sapiens
tacctagtacagggagtgaaagcactgcatactgctttaaaattatggatgaaaaaagaagtaagttgtttcaacagtgaaatcactgtgttttatgccacaagattaggaaaacagagtccttgtgctattttggcagcacgtgtgaatgccagtagtagagggaatagaaatcatgcctttatatacaacctgcatttt

SEQ ID NO: 12763 - DNA, 201 bp, Homo sapiens
tttgtttatggtaatttttttgccatgcaaaattttttttaagaaatatgtagtcatatttattagtcttttattggttctggattttgagtcataattarcaatcctttctctacctcaaggtaaagagaattttttcctgtgtttttttctaatacttgtgtggttttattttttaagcttctaaatggatcactaatc

SEQ ID NO: 12764 - DNA, 201 bp, Homo sapiens
cttacctagtacagggagtgaaagcactgcatactgctttaaaattatggatgaaaaaagaagtaagttgtttcaacagtgaaatcactgtgttttatgccacaagattaggaaaacagagtccttgtgctattttggcagcacgtgtgaatgccagtagtagagggaatagaaatcatgcctttatatacaacctgcatt

SEQ ID NO: 12765 - DNA, 201 bp, Homo sapiens
ttaacacagtctaagaggattttgtatgttaatgagaatctccttagaaggcattatactagctacacgaactctgaaacctggcttactagtatttggcratgtctgtaacagtttagagaatccaaaaattggtttagtaaatttgtttttacatattaaagtgtaaataactttggttttcttatttttgttaatcca

SEQ ID NO: 12766 - DNA, 201 bp, Homo sapiens
acttacctagtacagggagtgaaagcactgcatactgctttaaaattatggatgaaaaaagaagtaagttgtttcaacagtgaaatcactgtgttttatgccacaagattaggaaaacagagtccttgtgctattttggcagcacgtgtgaatgccagtagtagagggaatagaaatcatgcctttatatacaacctgcat

SEQ ID NO: 12767 - DNA, 201 bp, Homo sapiens
tgtggtggctcatgcctgtagtcgcagctactcaagaggctgaggcaggaggatcacttgagcccaggaagttgagggcgcagtgtgctgtgattgcaccrttgcactccagcctgggcaacagagcgagaccctatctcaaaaaaacaaaacaaaagaccagttatttgcaatttatattcaccttgctttatctagagc

SEQ ID NO: 12768 - DNA, 201 bp, Homo sapiens
gtggcttatgcctataatcccagcactttgggaggccaaggtgggtggatggcgtgagtccaggagtttgagactagcctgggcaacatgacgagcctccrtctacaaaaaatacaaaaattagctgggcattgtggggagtgcctgtattcccagctacttggaaggctgaggcgggaggattgcttgagcttgggaggt

SEQ ID NO: 12769 - DNA, 201 bp, Homo sapiens
gaggcacacagtaagagattaacaacagtaactgaataaaatagaacattacaacagtgtaccgtagtaaaaggtatacagtgtggctgtaacttttgcartttaaggtgcagcagcaaaactagcatgaatttcttttgcctccttcacaattttatagatagaattgttcttaccatagagcttaggaactcaacatac

SEQ ID NO: 12770 - DNA, 201 bp, Homo sapiens
tcttgtaaatgttacttgtaaagggggaagtttttttttttttttttactttttaaccaggaactgtcactttgcctttaaacgttacgattttttttttwaatctcaaataatggaagagccatgacttttaaatttatattagatttactttctgccctcatcttttaagttggtttcttttaggcttttgtctcttct

SEQ ID NO: 12771 - DNA, 201 bp, Homo sapiens
aggtaagagtggaaactgtcatgtaaatgcttgattattatctgctttgagaagcaaatggatctattccactctctacaaatatttaaaaactcttacayacttagaagaaatataatgagctgagtctttggaggtttctcaggttttcaggcctctgaagtccttaagagaaatttaaatattgtattctaatgaatt

SEQ ID NO: 12772 - DNA, 201 bp, Homo sapiens
ttgtgtgtatgtttatctttattcttggcgagcatttgggtatccttatggtaagtttctagcattatccattttgaaattgtttttatctgtagtcataktttaaaattcatgttctgttgatcaaagacaagtgtaaagaacactgataatgaaatagaagtttgagcttaaatatacaaatttaagattcttatttac

SEQ ID NO: 12773 - DNA, 201 bp, Homo sapiens
aaatggtcatggagatgtgacctggatatatttccattgtctggaaccctacagaatagttttaaaaaaagaacaaaggtcagaacatgaaacagttttgrtagcattttaactgagctggtcagtgatgtatgggaccactggtatccttgaaacaggggctttctggccagtttccatcaatggttttggaaactttct

SEQ ID NO: 12774 - DNA, 201 bp, Homo sapiens
tgtgatgaggtggaagggttttaaacagcggaagttcagaagtatgactttgtccatgcagaacacctaagggcttacttcccataaagaaagctctcccygtagtcttccaggtgctctcttaagtgtacttttcatcattacttacactcccttttggtgttttataggtaaacgtccaaaaaaaggaatggcaacagc

SEQ ID NO: 12775 - DNA, 201 bp, Homo sapiens
acagcggaagttcagaagtatgactttgtccatgcagaacacctaagggcttacttcccataaagaaagctctccccgtagtcttccaggtgctctcttamgtgtacttttcatcattacttacactcccttttggtgttttataggtaaacgtccaaaaaaaggaatggcaacagccaaacaacgtcttgggaagatcct

SEQ ID NO: 12776 - DNA, 201 bp, Homo sapiens
aacttacctagtacagggagtgaaagcactgcatactgctttaaaattatggatgaaaaaagaagtaagttgtttcaacagtgaaatcactgtgttttatgccacaagattaggaaaacagagtccttgtgctattttggcagcacgtgtgaatgccagtagtagagggaatagaaatcatgcctttatatacaacctgca

SEQ ID NO: 12777 - DNA, 201 bp, Homo sapiens
tattaatggttaaatgaagaaatgtcaatttagttttctgctcagaaaagtgaggctcagtatcatctatattgaaaactagtttttctcagcagacctayaactgtcagaaaaacagaatgacaatttacttgattttatttactcagcttcatcctgctgctttcttttgtgccattaagttctctgatacttgcttag

SEQ ID NO: 12778 - DNA, 201 bp, Homo sapiens
ctatattgaaaactagtttttctcagcagacctacaactgtcagaaaaacagaatgacaatttacttgattttatttactcagcttcatcctgctgctttsttttgtgccattaagttctctgatacttgcttagggaaaatcattactgagggatagatatagataccaggaagaagatattggaaagttggattggttg

SEQ ID NO: 12779 - DNA, 201 bp, Homo sapiens
aaacttacctagtacagggagtgaaagcactgcatactgctttaaaattatggatgaaaaaagaagtaagttgtttcaacagtgaaatcactgtgttttatgccacaagattaggaaaacagagtccttgtgctattttggcagcacgtgtgaatgccagtagtagagggaatagaaatcatgcctttatatacaacctgc

SEQ ID NO: 12780 - DNA, 201 bp, Homo sapiens
atggaaagaggtatacatttacaaaatactaaaatgcttgctttaatatcaatggatagaatgtgtaattctcaatgtgttcagatagaggagaaaaataygttctgtttttaaagtgttacagtaatcacatttaaattgatttagtatcaaaagtcatatatctaatcttaaatatatatgtaagtttatacatatata

SEQ ID NO: 12781 - DNA, 201 bp, Homo sapiens
ctgagtgaacgagactccgtctgcaatcccggcacctcgggaggccaaggctggcagatcactcgcggttaggagctggagaccagcccggccaacacagygaaaccccgtctccaccaaaaaaatacgaaaaccaatcaggcgtggtggcgcgcgcctgcaatcccaggcactcggcaggctgaggcaggagaatcaagc

SEQ ID NO: 12782 - DNA, 201 bp, Homo sapiens
gttgtagcgagccgagatcacgccactgcactccagcctgggcaacattgagcactgagtgaacgagactccgtctgcaatcccggcacctcgggaggccraggctggcagatcactcgcggttaggagctggagaccagcccggccaacacagcgaaaccccgtctccaccaaaaaaatacgaaaaccaatcaggcgtgg

SEQ ID NO: 12783 - DNA, 201 bp, Homo sapiens
ataatttgggaatcagttagtgattgaataagggaatgtaatgacaatatgttatgtggcgctgggttatcaataatttttaccaagtccaatttactgartattgaaggaaagggaggtatgtgcatgtttaagagaggtgtgtaaggattaagacttcatcttgcatgataggaattcagtaatatctgaagctgaaaa

SEQ ID NO: 12784 - DNA, 201 bp, Homo sapiens
ttgagtcagtttcttttttgtgctagcctgtccttattttctttatatcaaaggatcaaagttttctttggagcccatggtgactgggtgaacgcagtccyttctgtttggttcagggacatctttcctcttacctgcttttccaaccatccaaatgccaagtagtcagcgctggagtctactccctgaatttttctcttc

SEQ ID NO: 12785 - DNA, 201 bp, Homo sapiens
ttcatatgtgtataagccttttttttttatgataaaaatattgtatgacatttattttttttttttacttttcttgtactattaatgttttatttttttttatttatttattttttttaaatttatttttttattgataattcttgggtgtttctcacagagggggatttggcagggtcatgggacaatagtggagggaag

SEQ ID NO: 12786 - DNA, 201 bp, Homo sapiens
tcagtaatatctgaagctgaaaacagtataaacatatcattttgtaatttggaggcaaataactacagggaaaaccatttagaagagttggaagtcctggytatatacctaaaagaattgatagcagggactcaaacaggtatttgtacacctacgtttatagcagcattatccacaatagccaaaagatagaccaagcaa

SEQ ID NO: 12787 - DNA, 201 bp, Homo sapiens
  misc_feature (1)...(201): n = A,T,C or G, or insertion/deletion polymorphism (see Tables 1-2)
ttgaaaaatcctaaatggaaccattgtaaatcggagactgtctgtcctgtgcttatctcttgcaggtctgcagagtgttttgttttgcagccctacccctnaccccagggcagctgctgattcagtcaccacctcagacattctaagaggacagaacaaagaaagaccctgatacaagcttcttaggacttcaagtaacgt

SEQ ID NO: 12788 - DNA, 201 bp, Homo sapiens
atttccctgattattgatagaatcgggtagtttttttcatatgtgtataagccttttttttttatgataaaaatattgtatgacatttattttttttttttacttttcttgtactattaatgttttatttttttttatttatttattttttttaaatttatttttttattgataattcttgggtgtttctcacagaggggg

SEQ ID NO: 12789 - DNA, 201 bp, Homo sapiens
caatttcccataaagctgccctgttgccagtgatatgctgattgcatctggatcccatcaggtctagccattcttgtggttatatgggtcctgaggtcctyttgattcctccctattttactggtgacattgcctgttccagggatgtgagaaactgcccacagcctcaggacggtcctcagtatgaatggcaagattggg

SEQ ID NO: 12790 - DNA, 201 bp, Homo sapiens
catttccctgattattgatagaatcgggtagtttttttcatatgtgtataagccttttttttttatgataaaaatattgtatgacatttattttttttttttacttttcttgtactattaatgttttatttttttttatttatttattttttttaaatttatttttttattgataattcttgggtgtttctcacagagggg

SEQ ID NO: 12791 - DNA, 201 bp, Homo sapiens
tttaggtgtattagatcccatccactcatccattcaaggacctggcttcaacagttgtatccctacctcaccatttttttttgttagcatgccaattgtaygcatatatcctttattttaatttttaatttttatttttttctccaatatggagttttgctctgttgcccaggctggagtgcagcggcatgaactcggctc

SEQ ID NO: 12792 - DNA, 201 bp, Homo sapiens
gcatttccctgattattgatagaatcgggtagtttttttcatatgtgtataagccttttttttttatgataaaaatattgtatgacatttattttttttttttacttttcttgtactattaatgttttatttttttttatttatttattttttttaaatttatttttttattgataattcttgggtgtttctcacagaggg

SEQ ID NO: 12793 - DNA, 201 bp, Homo sapiens
attaaaagaaacaaacaaacaaacaaaaaacccttttcttgactgacatcccttttcagctgcagccctgtttctttgctacctttgtagcaaaattcacyaggttgttcctacttgctgtttccagttttttggtttttttcctttcctaggaaatgagaggtcccattttctcttgtactcaatccaatcaggctttca

SEQ ID NO: 12794 - DNA, 201 bp, Homo sapiens
cttttaatgtgcatttccctgattattgatagaatcgggtagtttttttcatatgtgtataagccttttttttttatgataaaaatattgtatgacatttattttttttttttacttttcttgtactattaatgttttatttttttttatttatttattttttttaaatttatttttttattgataattcttgggtgtttc

SEQ ID NO: 12795 - DNA, 201 bp, Homo sapiens
aagttatcagtgagcatcacttaacttggcatctggggaacccctgtgctgattttccttctgctttgctacccctccttctcagttcttaactgcaattscttctcgtctccctgatcttttatggctgggtaccccatggtaactcagtagtttttccagcgctcacctgttttctttcgtagctctctcccctgagct

SEQ ID NO: 12796 - DNA, 201 bp, Homo sapiens
atggatataaagtagtattctttgtgcttttaatgtgcatttccctgattattgatagaatcgggtagtttttttcatatgtgtataagccttttttttttatgataaaaatattgtatgacatttattttttttttttacttttcttgtactattaatgttttatttttttttatttatttattttttttaaatttattt

SEQ ID NO: 12797 - DNA, 201 bp, Homo sapiens
tggatgaatagtaggtaggccaaccttgagtgtatgcagaatgaaaccccacgactccctcccttcttgatcagaactgctcctcctgtagtcctcttcayttcatttaatggcagtccttcgtgttgttcagggcagaatctttagagtcatccttgatgcttctctcataatctgcactaaattatttggccaaatcct

SEQ ID NO: 12798 - DNA, 201 bp, Homo sapiens
acaatatattagttttcaagtaagtttgcagcacagttaatagtcaacaaaaatttactgtgatcatcttgtacttggtattgagagagaaatcttaaagwgctcagttcagggaataggatataaaaattgctcagtattaaacaatgttaggccataagtcagtggaaatgtgtttttttttttcctacccttttggta

SEQ ID NO: 12799 - DNA, 201 bp, Homo sapiens
gtgcagaagcgaaatcctttgtttcaacttagctgaattttggaccacatctaatatattttgtttgttttagattatcacaatttgattaaaaaactcargacatttttgttgatgtgtgtttatatttactttattatgttattaaaatagttgattatatagatcacacacgcactgcatacacacacacacattcat

SEQ ID NO: 12800 - DNA, 201 bp, Homo sapiens
actttgggaggccgaggcaggcagatcacctgaggtcaggagttcaagaccaacctggccaacatggtgaaatcctgtctctactaaaaaaaaaaaaaaaatacaaaaattagccgggcatcgtggtgcatgcctgtaatcccagctacttgggaggctgaggcaggaagaatcgcttgaacccggcgggaggcagaggtt

SEQ ID NO: 12801 - DNA, 201 bp, Homo sapiens
caggatactttctcccctcttttctctctgtcccaagactccaagttcctgtcttatggttagctaggagaaactatccacgaacacacacacacacacacgcctctacccttggggtgatgcacagtggtttttttttttctactaatgtctaagagaagctcattctttaacttcttaaaacaaattaagagctttacc

SEQ ID NO: 12802 - DNA, 201 bp, Homo sapiens
  misc_feature (1)...(201): n = A,T,C or G, or insertion/deletion polymorphism (see Tables 1-2)
ataccattcccgaagaaagatgaggaaacttcgagatcataatgtccgaactccttctaacctagacatcctagagctccacacaagggaggtcctcaaangattagagatgtgtccatgggaagaggcaagtattatgtttcatgacaacaaaaagaaacttggctgttccttaaagtctttatagggataataagagaa

SEQ ID NO: 12803 - DNA, 201 bp, Homo sapiens
tcaggatactttctcccctcttttctctctgtcccaagactccaagttcctgtcttatggttagctaggagaaactatccacgaacacacacacacacacacgcctctacccttggggtgatgcacagtggtttttttttttctactaatgtctaagagaagctcattctttaacttcttaaaacaaattaagagctttac

SEQ ID NO: 12804 - DNA, 201 bp, Homo sapiens
agctgggtggactttagataccatcttgtcaccttgttcatcgtagtcaaatgactttctctttttctcatcctttcattctttttcagggttttttacamgtgtgaaatcagaactcaggagtagatcatcaggatattctgatatttctgagtcagaagactccggacccgagtgcactgcactggtacgcctgagacc

SEQ ID NO: 12805 - DNA, 201 bp, Homo sapiens
ctctccaggatcccagcagctgccatggcagtaaccatgaggttaggcagttgtatcgctatgataaaccagtggaatgtggtaagaaacataaattatcrgtctctaaaaagtaacatatgttgcccaacttaatggctcaataatcctcatttaggttagagattatgaataagcatctttaattggaaatgtgttaag

SEQ ID NO: 12806 - DNA, 201 bp, Homo sapiens
ttaaatattacccaagtattatttactgaacctgtacctatttacctgtaactatttattatgccattttgtgtatattcctattcagtgtttatccctgrgaggatgctgagataagagaatggagcagagggtgagtatgaagatgagcatatctgtacaggaaatgtgcaagttaagggtgtgtgcattagaggtttg

SEQ ID NO: 12807 - DNA, 201 bp, Homo sapiens
aagaattagcataataggttatgaattggtgactttttgtttttgagggaaaggcatatagtgaaggtaaaggtatgcaaatgagtatctaaagagttaaygtgtttttaaatacaatgtcaacataaatttgcttgcttttttttttttcccccaagatggagtctcactctgttgcctaggctggaatgcagtggcatg

SEQ ID NO: 12808 - DNA, 201 bp, Homo sapiens
ttgagaaaaaattcacataccacaatattcacccttttaaagtgtacagctcagtggtttttagtagattaataaagttgggcaaatatcaccactatctaattccagaacattttcattgtctcaaaaagaaacctcatactctttagcagtcacttcccattcccgcctccactgagcccctggcaaccacgaatgtac

SEQ ID NO: 12809 - DNA, 201 bp, Homo sapiens
catggatcacttcccatctgaatgcctgcagtcctgtctcaggttctgcttatgggggactccaaccttaaaccagtaggtaaattgttaatgaaaagaargataataagcaagagataggggatttgaaaatagagtttggatttcattgataacagatttttcacatgataatcgtgtttgtgtattaacgcctgtgta

SEQ ID NO: 12810 - DNA, 201 bp, Homo sapiens
aaggcatatagtgaaggtaaaggtatgcaaatgagtatctaaagagttaatgtgtttttaaatacaatgtcaacataaatttgcttgcttttttttttttyccccaagatggagtctcactctgttgcctaggctggaatgcagtggcatgatctcaactcactgcaacctccacctctcgggttcaagtgattctcgtgc

SEQ ID NO: 12811 - DNA, 201 bp, Homo sapiens
attgagaaaaaattcacataccacaatattcacccttttaaagtgtacagctcagtggtttttagtagattaataaagttgggcaaatatcaccactatctaattccagaacattttcattgtctcaaaaagaaacctcatactctttagcagtcacttcccattcccgcctccactgagcccctggcaaccacgaatgta

SEQ ID NO: 12812 - DNA, 201 bp, Homo sapiens
atttttcacatgataatcgtgtttgtgtattaacgcctgtgtaattatgtgatttcatttacctatgtctgtgtgcaaaatgtattgtgaacatggctgtsaaagtagaatatgaaagctgctttcttactttattgaatagttctctggtcctgctaccttcaaaaaaaatacactgccttgaaggttatttgtgatatg

SEQ ID NO: 12813 - DNA, 201 bp, Homo sapiens
gagcaggcagaccagactgtgggaagccttgtgagtcttgtgagggcctagtgtgatgaggtggaagggttttaaacagcggaagttcagaagtatgactytgtccatgcagaacacctaagggcttacttcccataaagaaagctctccccgtagtcttccaggtgctctcttaagtgtacttttcatcattacttacac

SEQ ID NO: 12814 - DNA, 201 bp, Homo sapiens
tattgagaaaaaattcacataccacaatattcacccttttaaagtgtacagctcagtggtttttagtagattaataaagttgggcaaatatcaccactatctaattccagaacattttcattgtctcaaaaagaaacctcatactctttagcagtcacttcccattcccgcctccactgagcccctggcaaccacgaatgt

SEQ ID NO: 12815 - DNA, 201 bp, Homo sapiens
actattcatgatgtttattttatatcaaatatatgcccagggcatgctactttaaaaatccgaggaatctccaacaaggtgctggattaaaatcagatttygtgcttgaagtggaagaaaaatgaagttgtttatggataagagagtgagaatgtgtatcctcaagtacgttaagatgatttaactgaaagatggctttag

SEQ ID NO: 12816 - DNA, 201 bp, Homo sapiens
tattctttcaagaagagcatgtctgtcaaaatccttctaaaaatagttggcatataattttgttgactaagtatcacggaccttagttatcttctgtgccrtgtgggctgctggactgtttgtgcaccagattgccccacaccagtggccatttatcgatggtgttttatctccttccttgcgattcttttttcctgttgc

SEQ ID NO: 12817 - DNA, 201 bp, Homo sapiens
ttattgagaaaaaattcacataccacaatattcacccttttaaagtgtacagctcagtggtttttagtagattaataaagttgggcaaatatcaccactatctaattccagaacattttcattgtctcaaaaagaaacctcatactctttagcagtcacttcccattcccgcctccactgagcccctggcaaccacgaatg

SEQ ID NO: 12818 - DNA, 201 bp, Homo sapiens
tctaaaagtaaaaattaaaaaattagccaggtgtggtggctcatgcctgtagtcgcagctactcaagaggctgaggcaggaggatcacttgagcccaggargttgagggcgcagtgtgctgtgattgcaccattgcactccagcctgggcaacagagcgagaccctatctcaaaaaaacaaaacaaaagaccagttatttg

SEQ ID NO: 12819 - DNA, 201 bp, Homo sapiens
agttgaggctgcagtgtgccgtgatcactccactgcactccagcctgggcaacagagcaagaacctgtctctaaaagtaaaaattaaaaaattagccaggkgtggtggctcatgcctgtagtcgcagctactcaagaggctgaggcaggaggatcacttgagcccaggaagttgagggcgcagtgtgctgtgattgcacca

SEQ ID NO: 12820 - DNA, 201 bp, Homo sapiens
gcacgcgtctgttcttcagtttacacgcagacaggagagcatgttttgctgcctccttgcctctcagtaataaacttacatgacctattagcaaaatagayaatcgaaagtgggaagtggccagtaaaaatgaaagagcaacaaagaaacaaaaaatgataactctggaagtaaaatccaattgagcataaatggagtaat

SEQ ID NO: 12821 - DNA, 201 bp, Homo sapiens
tcccaccacggccagctaacttttgtatttttagtagagttgggttttgccttgtcgcccaggctggtcttgaactgctggcctcaagcaatccatcctcsttggcctcccagagtgctaggattccaggtgtgggccaccacttctggccatgtattaaaattctttgaggtctctgggtcatatataaatttccacgta

SEQ ID NO: 12822 - DNA, 201 bp, Homo sapiens
tcaagagttcgaaaccagcctggccaacatggtgaaaccccatctgtactaaaaatacaaaaaattagctgggtgtggtggctcatgcctgtaatccttakctactcaggaggctgaggcaggagaattgcttgaacctgggaggcggaggttgcattgagctgagattgtgccattgcactccagcctgggcaacaagag

SEQ ID NO: 12823 - DNA, 201 bp, Homo sapiens
ttcgaaaccagcctggccaacatggtgaaaccccatctgtactaaaaatacaaaaaattagctgggtgtggtggctcatgcctgtaatccttagctactcrggaggctgaggcaggagaattgcttgaacctgggaggcggaggttgcattgagctgagattgtgccattgcactccagcctgggcaacaagagtggaact

SEQ ID NO: 12824 - DNA, 201 bp, Homo sapiens
tactgctttccttttcctctgaaaaatgtcccttttttcctgaaaggtccagttgaacttgagaaattaagagtatagggaaaatatttgtctagactacrtagttttatagttggtttaattatcataccaagttaaaatattttttgattagagcatctgctgatgtaactcttaagtccaataataagactgtaattt

SEQ ID NO: 12825 - DNA, 201 bp, Homo sapiens
agaaattaagagtatagggaaaatatttgtctagactacatagttttatagttggtttaattatcataccaagttaaaatattttttgattagagcatctrctgatgtaactcttaagtccaataataagactgtaatttttctctgcaggtggtgacaaagtgatagatgtcattgatgtggcgaggcaggcagacagca

SEQ ID NO: 12826 - DNA, 201 bp, Homo sapiens
gcctccaagaaatatgggactatatgaaaagaccaaatgtacgtctgataggtgtacctgaaagtgacggggagaatggaaccaagttggaaaacactctkcaggatattatccaggagaacttccccaacctagcaaggcgggccaacattcaaattcaggaaatacagagaacgccacaaagatacttcttgagaagag

SEQ ID NO: 12827 - DNA, 201 bp, Homo sapiens
gaagtcttttgttgttgttgttgttgttgttgggggatgggggtctcagtacattaccaacccaggctgatcttgaactcctgagtgcaagcaatcctccygtctcagcctctcaagtagctgggattacagatgtgccatgcaccctaaaaatttgccaatttgttaactgacacagtattttaaaatttgttgtttctg

SEQ ID NO: 12828 - DNA, 201 bp, Homo sapiens
attaaatattacccaagtattatttactgaacctgtacctatttacctgtaactatttattatgccattttgtgtatattcctattcagtgtttatccctragaggatgctgagataagagaatggagcagagggtgagtatgaagatgagcatatctgtacaggaaatgtgcaagttaagggtgtgtgcattagaggttt

SEQ ID NO: 12829 - DNA, 201 bp, Homo sapiens
ttcttgtaaatgttacttgtaaagggggaagtttttttttttttttttactttttaaccaggaactgtcactttgcctttaaacgttacgatttttttttttaatctcaaataatggaagagccatgacttttaaatttatattagatttactttctgccctcatcttttaagttggtttcttttaggcttttgtctcttc

SEQ ID NO: 12830 - DNA, 201 bp, Homo sapiens
tgttctctcactgacaaaaacatatagccctagtttttcagtggtatattcatttcttgtaaatgttacttgtaaagggggaagtttttttttttttttttactttttaaccaggaactgtcactttgcctttaaacgttacgatttttttttttaatctcaaataatggaagagccatgacttttaaatttatattagat

SEQ ID NO: 12831 - DNA, 201 bp, Homo sapiens
atctgcccctatgacccaaacaattcacaccgggctccacctccaacattgtggattacgtttcagcatgagggtgtgtgtgtgtgtgtgtgtgtgtgtgkatggtggggacagacatctggaacctcaggtggatttggactctgaacactagctagcaatcttattgtgtttcttagtctttcgttctacagatcaccc

SEQ ID NO: 12832 - DNA, 201 bp, Homo sapiens
agagaaatcttaaagagctcagttcagggaataggatataaaaattgctcagtattaaacaatgttaggccataagtcagtggaaatgtgtttttttttttcctacccttttggtaggaaatgtgtatcagtaaaatgttgaaggactttctgtggtgtgatcaagtaaagtatcatcaaggaggaggaatttggggcttt

SEQ ID NO: 12833 - DNA, 201 bp, Homo sapiens
gaaaccctgtctctactaaaaatacaaaaattagctgggtgtggtggcgcgtgcctgtattcccagctactcgggaggctgaggcacaagaatcgcttgarcccaggaggcagaggttgcagtgagctgagatggtgccattgcactccagcctggtgacagagcgagaccccgtctcaaaaaaaaggaattacaaaatgg

SEQ ID NO: 12834 - DNA, 201 bp, Homo sapiens
agctccgtctcctgggttcacgccattctcctgcctcagcctcctgagtagctgggactacaggtgcctgccaccacgcccagctagttttttgtattttyagtagagacgggtttcactgtgttagccaggatggtctcaatctcctgacctcgtgatccgcccgcctcggcctcacgcatggttacttttatggtcctg

SEQ ID NO: 12835 - DNA, 201 bp, Homo sapiens
ctcggctcactgcaagctccgtctcctgggttcacgccattctcctgcctcagcctcctgagtagctgggactacaggtgcctgccaccacgcccagctarttttttgtattttcagtagagacgggtttcactgtgttagccaggatggtctcaatctcctgacctcgtgatccgcccgcctcggcctcacgcatggtta

SEQ ID NO: 12836 - DNA, 201 bp, Homo sapiens
cttttatattcagtgtaaattgtgcagctctgtcttactgctttccttttcctctgaaaaatgtcccttttttcctgaaaggtccagttgaacttgagaarttaagagtatagggaaaatatttgtctagactacatagttttatagttggtttaattatcataccaagttaaaatattttttgattagagcatctgctga

SEQ ID NO: 12837 - DNA, 201 bp, Homo sapiens
gattacttttttttttttttctttttgagacggagtctcgctctgtcgcccaggctggagtgcactggcgtgatctcggctcactgcaagctccgtctccygggttcacgccattctcctgcctcagcctcctgagtagctgggactacaggtgcctgccaccacgcccagctagttttttgtattttcagtagagacggg

SEQ ID NO: 12838 - DNA, 201 bp, Homo sapiens
gcatgatttcagcttgtgtgattacttttttttttttttctttttgagacggagtctcgctctgtcgcccaggctggagtgcactggcgtgatctcggctyactgcaagctccgtctcctgggttcacgccattctcctgcctcagcctcctgagtagctgggactacaggtgcctgccaccacgcccagctagttttttg

SEQ ID NO: 12839 - DNA, 201 bp, Homo sapiens
aaatttataataaactcttcatagctgatgagtctgaaaattagcttctaaggcaattttccaaggtggaaaataataacccatgaagtgttttgtggggraaaaaaaagggagagagagagagaaagacccgaggttgggtacagtatttatcacttatgcttgatccccatcatggaaattgaaagtgcttgttaactt

SEQ ID NO: 12840 - DNA, 201 bp, Homo sapiens
tgcctggtgtgtgctctgaagagaccttattgaagaaaaaaatactaagcccaatcataaaagcctagttcctatttgggctcaaacctcgtagctaatamgctgttgattagggcagtgttggctgactggaacctggtagagacatgataataatattaatagctgctgtttatgacttagtatgtttactgtgccatt

SEQ ID NO: 12841 - DNA, 201 bp, Homo sapiens
gattatgtcacatgtcacagtgaagaaaatgagtagttgggtgctttggatgagaaggtgaatttctgatacacaggtgaaaacttgaagcaaaatttccratatataaatctcattaccacagccttctactgtctaaggaaagatgaaagttgtactttacatgttgaaagagctttccgtttttaccagctgttaaga

SEQ ID NO: 12842 - DNA, 201 bp, Homo sapiens
tgtatcagtaaaatgttgaaggactttctgtggtgtgatcaagtaaagtatcatcaaggaggaggaatttggggctttgaagactaggtagtgtaagatcrttcagtgaagaatggggagagtatctgaagcaagaggaatatctaatgaagtccacggacagtaagatctgaaagaatttggccacccactcttctaaca

SEQ ID NO: 12843 - DNA, 201 bp, Homo sapiens
tgaagactaggtagtgtaagatcattcagtgaagaatggggagagtatctgaagcaagaggaatatctaatgaagtccacggacagtaagatctgaaagartttggccacccactcttctaacaccaagagtagagaatataaatgagagtgttatccgagaggaaaaaagagaacgtttggctgatcctagggaatttcg

SEQ ID NO: 12844 - DNA, 201 bp, Homo sapiens
ctgcaacctctgccgcctgggttcaagcaattctcctgcctcagcctcccaagtggctgggattacaggcaccggccatcgtgcccagctaatttttgtakttttagtagagacggggtttccccatgttggccagactgatcttgaactcctgatctcgtgatccacccgcctcggcctcccaaagtgctgggattacgg

SEQ ID NO: 12845 - DNA, 201 bp, Homo sapiens
gttttagaagtatccttttccagattatggaagtatcctctaagcttgctaagaggttttgttatttactttttaatcaaacataaatgttgaattttatyaaatacttgtcctgaatctttttaaatggtcatatgatatttttcttttaatctaataatgtggtaagtttcactgatttaagatttttagtgttaaaaa

SEQ ID NO: 12846 - DNA, 201 bp, Homo sapiens
ggtgctatcatagctcactgcagccttgacttcctgggcttaagtgatcctcctgcctcaacctctggagtagctgggaccacaggcatgcttcactacayccagttaattttttgatattttgtaaagacaaggtctcactttgttgcccaggctggtctcgaactctgcctcagactcccaaaagtgctgtgatttcag

SEQ ID NO: 12847 - DNA, 201 bp, Homo sapiens
taatttttctaatatctttgtaagatacttaaaaatttaagctacctgcatacattaaaatatttccttttaaaatagaggctattccttttgttaagtawacagcataaaaattgaggttagcaaattgggggaactgttacatgtgtaattgactagtttattgtcataaatgtttttaaatgatttttctctggctag

SEQ ID NO: 12848 - DNA, 201 bp, Homo sapiens
ttttttcttaaaggagaatattagaagacagtatcaggagggcagaaattatcctggtcaacttgcatgctaattccccaatgagtgatgtgtttttttttgaaatgatagccttagaatattttaggtgttacaaaagtgaaagggaaaagtcagtctcctcattttatgcctgagaaaactgaaatccagacagtgttg

SEQ ID NO: 12849 - DNA, 201 bp, Homo sapiens
taaatattacccaagtattatttactgaacctgtacctatttacctgtaactatttattatgccattttgtgtatattcctattcagtgtttatccctgagaggatgctgagataagagaatggagcagagggtgagtatgaagatgagcatatctgtacaggaaatgtgcaagttaagggtgtgtgcattagaggtttgc

SEQ ID NO: 12850 - DNA, 201 bp, Homo sapiens
taatcccttttgcaggaaagactattgcccttttcccacctgcttcaacatttcaattattattattattattattatttatttatttatttatttatttwttttttgagacggagtcttgctctgtggcccaggctggagtgcagtggtgtgatctcggctcactgcaacctctgcctcctgggttcaagcaattcttct

SEQ ID NO: 12851 - DNA, 201 bp, Homo sapiens
  misc_feature (1)...(201): n = A,T,C or G, or insertion/deletion polymorphism (see Tables 1-2)
attggttaagtattgccatattttgaattctaccttatcccatagtccattgtcaaactaattatgcttcctagtgtagcagtgcagtggtctgtaaacancacttcatgggtttatacgaaaactgtaaattaatcacaatttggaactcaggccttcggacactggtactaatgtgaactgatttttgcttcccaatca

SEQ ID NO: 12852 - DNA, 201 bp, Homo sapiens
cttaagattgctaagatattttaatcccttttgcaggaaagactattgcccttttcccacctgcttcaacatttcaattattattattattattattatttatttatttatttatttatttattttttgagacggagtcttgctctgtggcccaggctggagtgcagtggtgtgatctcggctcactgcaacctctgcctc

SEQ ID NO: 12853 - DNA, 201 bp, Homo sapiens
tcttaagattgctaagatattttaatcccttttgcaggaaagactattgcccttttcccacctgcttcaacatttcaattattattattattattattatwtatttatttatttatttatttattttttgagacggagtcttgctctgtggcccaggctggagtgcagtggtgtgatctcggctcactgcaacctctgcct

SEQ ID NO: 12854 - DNA, 201 bp, Homo sapiens
  misc_feature (1)...(201): n = A,T,C or G, or insertion/deletion polymorphism (see Tables 1-2)
atatctgcattgccagcatcacaccagcctcactgctcttgtgctttggggccattattaagtaaaataacggttagctgaacacaagcattgataccccnacagttgatctcataactcagagacttgtgggcaggtagtaaaacagtctggatacactaacagagggatgattcacatcctagatgggatggtgcaaga

SEQ ID NO: 12855 - DNA, 201 bp, Homo sapiens
tgaaataatttgaatttaacttctatgaaatactaagtaagttactatgaggcagaataatgtgatacacttcatttttttctatatgatttaattttttwaaaaacatgttatactcactaaattgattacacaatccataatggatcacgacttaactttgagtaattatgctttggagagaagcttgcctatgcttct

SEQ ID NO: 12856 - DNA, 201 bp, Homo sapiens
ataatgtgatacacttcatttttttctatatgatttaattttttaaaaaacatgttatactcactaaattgattacacaatccataatggatcacgacttmactttgagtaattatgctttggagagaagcttgcctatgcttctcatccctgaagaacataagaccaggcattgactatcttctggtcagacgtccaact

SEQ ID NO: 12857 - DNA, 201 bp, Homo sapiens
  misc_feature (1)...(201): n = A,T,C or G, or insertion/deletion polymorphism (see Tables 1-2)
cgcttatctgagggagatatgtgttccaagacccccagtggatgccggcaactacggatagtactgaactctgagtataccatgtttttgcctatatatanatacccatgacaaagtttaacttattaatgaggcacacagtaagagattaacaacagtaactgaataaaatagaacattacaacagtgtaccgtagtaaa

SEQ ID NO: 12858 - DNA, 201 bp, Homo sapiens
gagagaagcttgcctatgcttctcatccctgaagaacataagaccaggcattgactatcttctggtcagacgtccaactctgtgtacttacagggaaaacrcccaagatccagtcatctgttctatctggatttaaggctcaccttccctactcctcaccttctatccccaacttggttaatcccttttgatccctttccc

SEQ ID NO: 12859 - DNA, 201 bp, Homo sapiens
agtcagcacatttaaaaggaaatgatagtgattggcagcttattacatggtaggcactatagtaggtaagtaagtacttaacctatgttatcttctttgayatttataacaactccatgtgagaaatgagaaaaatgatctagctagcccttttatgtagctatttggcagagctggagtttgaacccctagcagtctaat

SEQ ID NO: 12860 - DNA, 201 bp, Homo sapiens
tataaatgagattttctttaccatttgtttgctgttggttattgtttgctgttggttattgtttgttttttaaatgttacttttatattctactactttgstgaaaaaaattatttgagttgtattatcacttagggaactgatatgtaatatacaaatagagagttttagtacttctttgcccattcttatgcctctatt

SEQ ID NO: 12861 - DNA, 201 bp, Homo sapiens
gaggaattaatcagggaaacattaatatatacaaacatgaatttcaactttgaagaaagattcagaatgaactaagtgcttaagaatcaaaaaatgattayaatatggtatatctacatcttaaaattgtagtctgttttaaatatttaataaaaagaaaatgctcattatataataagaaagataagcaggataaacatt

SEQ ID NO: 12862 - DNA, 201 bp, Homo sapiens
tcattatataataagaaagataagcaggataaacattgtgatcccaattgaagataaaatggagttatgggctgggcgcagtggctcacacgtgtaatccyagcactttgggaggccaaggtgggcggatcacaaggtcaggagatcgagaccatcctggccaacatggtgaaaccccatctctactaaaatacaaaaaat

SEQ ID NO: 12863 - DNA, 201 bp, Homo sapiens
tctataggtaccataatttgcttaaccgtccccatatatgtttagtttgtctccagattttcctcttgcaaaaaatgtacctatattttaaacacttgtcrttatgtatgtttgatcaaaaggggaaataaaacaccaaacatgtgagatcagggaatacaagtgatttaaaattctcccttagactgaagttgaaggaat

SEQ ID NO: 12864 - DNA, 201 bp, Homo sapiens
  misc_feature (1)...(201): n = A,T,C or G, or insertion/deletion polymorphism (see Tables 1-2)
ctcctgtcttcttgctacctaggcagcagatgacatcagatagttaagatctgattgtataagtggagactattgtgttttaacctttaaggcaagtgtcncacttaattttgaatgtgtagcagctgtagagcaattgggagattaaaaactggaatgccccattggaagagatctggtgggcaaagggacaaactccac

SEQ ID NO: 12865 - DNA, 201 bp, Homo sapiens
gaaccaccacacctggcctgtaataactatttgttttgacattttaggctgcagactagcatttttatattcacaaaattaaagggaaaattataggctttgtcattttaaaacctttgcctgaatgtaccttgatacacacttgggttggttttaggtaacttatatgacctctttattttacatgcagcttttttccta

SEQ ID NO: 12866 - DNA, 201 bp, Homo sapiens
ttcaccgtgttagccagggtggtctcgatctcctgacctcgtgatccgcccgccttgattaacttgtagatttcattcatttattgtatgattttttttttaatttgcattaccatatagatttctgttatgagaatatactgtatccattttactatttatagacttcacaaataatgattctataagcggttttgtata

SEQ ID NO: 12867 - DNA, 201 bp, Homo sapiens
ctaacacaggcagactgactcgagagagagagatttttctcaactccaccatctaaaattaattaaaaatagaaaacaaattctctcttttttttttttttcttgaagcatagccatttgagtgcctggtgtgtgctctgaagagaccttattgaagaaaaaaatactaagcccaatcataaaagcctagttcctatttgg

SEQ ID NO: 12868 - DNA, 201 bp, Homo sapiens
atttttcactggaaataattcatacaaattataaatttttaccttagctgatatctggtaataaagtgatctgtctcagggttaaaacattgtataaaackattaacaatttaaaagtgaaaatgcctattggcatcctagtatttttagtaagaatgtcaacttattaagccaattaataagccttatttttactggcta

SEQ ID NO: 12869 - DNA, 201 bp, Homo sapiens
ccccgcgtctcctccgcgccgcgggtccctgtcgcgcccccttccccgtctttatcaaacttcctgggccagtgggacgggggcagcggcgggccggagargcgaccgcgccagccagctcggcggggctccgcggagtaaacagagcaacagatgaggcactcgctctcggggacttgaaaggtgccggggaagttgggg

SEQ ID NO: 12870 - DNA, 201 bp, Homo sapiens
  misc_feature (1)...(201): n = A,T,C or G, or insertion/deletion polymorphism (see Tables 1-2)
agtaagtactagatgcttaaataaaaatggacatttcagaaaaactgacatttcaaacttacatgtacatggtaatactttaatgatactctgaggagttntattacacccttcaagaactgtagggaaagattttgctcaaggtatttaggatgtagtttttgtttcattaagtcagaagattaaggggggaaatgtact

SEQ ID NO: 12871 - DNA, 201 bp, Homo sapiens
ccgttcattacaactagttgtaagcatcctattattttatgatgtcttctagtgtagtttacatactaaaatacaggttgagtatcccttatccaaaatgmtaaggaacagaagtgtttcagaaatgatttcagattttttttttcttttggaatatttgcattatacttagcagctgagcatccctaatcggaaaatctg

SEQ ID NO: 12872 - DNA, 201 bp, Homo sapiens
tctcaaaaaaacaaaacaaaagaccagttatttgcaatttatattcaccttgctttatctagagctgcattgttcaaaacagttgccactagccatgtgtractaaatttaaataattaaaatggaatgtaattaaaaattcagttcctcgtttatactaggcacatttcaagtgctcagtagccacatgtggctaatggc

SEQ ID NO: 12873 - DNA, 201 bp, Homo sapiens
gtctctgtggatttgcctctttggatactttatgttgatggaatcatacaatatgtgggcttttgcgtctagcttctttcacttagcatattattttcttwcttttttttttttttttgagacagagtcttgctctgtcgctcaggctggagtgcagtggcctgatgtcggctcactgcaagctccccatcccgggttcgt

SEQ ID NO: 12874 - DNA, 201 bp, Homo sapiens
attgtttttatctgtagtcatagtttaaaattcatgttctgttgatcaaagacaagtgtaaagaacactgataatgaaatagaagtttgagcttaaatatwcaaatttaagattcttatttactggggctataagttgcattcatcttaacacaaaaatcaatgtcagagaaaatacagtgatcttatgtccagtttatat

SEQ ID NO: 12875 - DNA, 201 bp, Homo sapiens
cgtgttagccaggatggtctcaatctcctgacctcgtgatccgcccaccaaagtactgggattacaggcgtgagcctccacgcccggccggcatactattytctaggcttatccatgttgtagcatgtatcattacttcatcttttcatggcccagtaatgttccattgtgggatatacaggttgagcatccctaatgcaa

SEQ ID NO: 12876 - DNA, 201 bp, Homo sapiens
  misc_feature (1)...(201): n = A,T,C or G, or insertion/deletion polymorphism (see Tables 1-2)
ataataacaaatgtatgttgaataaatgaagacatgccttagaactaccagaatatttgcctagattagtaacagtattttcattgtgaatgggctcattnacattgtgaatgcccctcccttaaatcttcctacttcttgcttttatgttaggtatttctaatataatcataaattgacatttatgattcttcaaatcat

SEQ ID NO: 12877 - DNA, 201 bp, Homo sapiens
gattctgtatatacttgggtctgtttcagcactttctgttttattccactggttgatttgtccattgatgtttcagcaccacagtgttttaattacagagkcttttgtagtatggtgtaagtctggtaaggcctgtcccatcctcttagtttgttgtatttgttttcagtgtgtttctggttattcttgcagatttatttt

SEQ ID NO: 12878 - DNA, 201 bp, Homo sapiens
tgctatacatttttaaaccagatctcatgagaactcactgaccatccctaggacagcacaagacattcctgagggatctgcccctatgacccaaacaattsacaccgggctccacctccaacattgtggattacgtttcagcatgagggtgtgtgtgtgtgtgtgtgtgtgtgtgtatggtggggacagacatctggaacc

SEQ ID NO: 12879 - DNA, 201 bp, Homo sapiens
gactctacttaatgccactaaactgtacacttaaaaattgttaaaatggcagattttatgtttatgttaccacagtaaaaaaatgttgcaagtggttgcckctggagaatgagagggatggggaagaggaggctgctatttttcatgatatgcttatagaatatttaatttttaaaactacatagatgtataattttagtt

SEQ ID NO: 12880 - DNA, 201 bp, Homo sapiens
tttatttgaaacctttctatattttttaatatggtatgtgtgcatatttaacttattttaaaatctggccagatacagtggctcatgcctataatcccagmactttggaaggccagggctggaggactgcttgaagccaggagtttgagaccagcctgggcaacatactgagaccccatctctacacaaaaaaattaaatc

SEQ ID NO: 12881 - DNA, 201 bp, Homo sapiens
gccaaaacatatttatatataatagtcatatgtcaaagattctgtatatacttgggtctgtttcagcactttctgttttattccactggttgatttgtccmttgatgtttcagcaccacagtgttttaattacagaggcttttgtagtatggtgtaagtctggtaaggcctgtcccatcctcttagtttgttgtatttgtt

SEQ ID NO: 12882 - DNA, 201 bp, Homo sapiens
cagcacaccaacatggcacatgtatacatatgtaacaaatctgcacgttgtgcacatgtaccctagaacttaaagtataataattaaaataaaaaaaaaaaggaaatgctgacacatggtatagcgtggatgaaccttgaagatattttgctaagtgaaataagccagtcaccaaaggacaaattttataaaattccactt

SEQ ID NO: 12883 - DNA, 201 bp, Homo sapiens
  misc_feature (1)...(201): n = A,T,C or G, or insertion/deletion polymorphism (see Tables 1-2)
aaaggagggtagagcaagagagattgagagacatcacaagctgggtggactttagataccatcttgtcaccttgttcatcgtagtcaaatgactttctctntttctcatcctttcattctttttcagggttttttacacgtgtgaaatcagaactcaggagtagatcatcaggatattctgatatttctgagtcagaagac

SEQ ID NO: 12884 - DNA, 201 bp, Homo sapiens
atggggaccatatttggagaaccactgctgtaggcaatgtaattcttttcccaaggttgttagtgactgataagcttccaaactacagtacagtttttgtrtttcaggaaattgtgccaaaaccatgaaaatatactgtgtgtgggtgtctgtatatacagatatatataataatatataataatggagttctaatttcta

SEQ ID NO: 12885 - DNA, 201 bp, Homo sapiens
gagcacagcaatgggcacacttgaaagtgagtcctttgagggttttttgttttgtgttacagttcagtgaggggtcaaaagatgaaaaatacaaagaaaaygggatttgtgtattttaaaagctaatttgcatacaaatatgtgtttgtatttatttctggtgaagtcttgaagtctgccaacatttttttcaaaagttag

SEQ ID NO: 12886 - DNA, 201 bp, Homo sapiens
taaaatctttaatataaagttgggttgtgtttttaagctaaaaaacaaaaacaggctgggcacagtggctcacgccttaatttcagcactttgggaggccmatgtgagaggatgactttgaggccaggagtttgagatcagcctgggcaacaaagtgagaccccatctctatttttaaaaagaaaaaaacaaatacagtaa

SEQ ID NO: 12887 - DNA, 201 bp, Homo sapiens
actttgaggccaggagtttgagatcagcctgggcaacaaagtgagaccccatctctatttttaaaaagaaaaaaacaaatacagtaacaactacaaaaacygtcaccttatttctcaaactcagcatagagcctaccatataataggcatttaataaataattaaatctatagattgtaataaacattaacttctctagca

SEQ ID NO: 12888 - DNA, 201 bp, Homo sapiens
agctactttataaaaggtggaatttcagactttgatgttttaatcttttggtttaattatctttgagcactcaagttggagactgatgtcacttgcttctrttttctgcttttcatcctcttgtgctagtgagaatagtttgtctgctttttgtgttgtctaacttttctagtcagtttgtaaatagtgctactattataa

SEQ ID NO: 12889 - DNA, 201 bp, Homo sapiens
cgggaggcggagcttgcagtgagccgagatcatgccattgcactccagcctgggcgacagagcgagactccgtctccaaacaaacaaacaaacaaacaaacaaaaaaatatatatgtatatatatatatatatatatatataactttttaaaatattttaaattgtatgtaattataatgttttaagattatgctgttcta

SEQ ID NO: 12890 - DNA, 201 bp, Homo sapiens
  misc_feature (1)...(201): n = A,T,C or G, or insertion/deletion polymorphism (see Tables 1-2)
aaatctgcaatggggaaacgattccctatttaataaatggtgctgggaatggctagccatatgtagaaagctgaaactggatcccttccttacaccttatncaaaaattagttcaagatggattaaagacttaaatagtagacctaaaaccataaaaaccctagaagaaaacctaggcagtaccattcaggacataggcat

SEQ ID NO: 12891 - DNA, 201 bp, Homo sapiens
tgtatactttttcctgtatctttaatgttctttgaaaacatttttagtggctacattgtgtttaatttcacagaagtacaatatatttgaaaataattacsctattgttatttactttgtttactacttttttttttttgagacggagtttcgctctgtcgcccaggctggagtgcagtggcgcaatctcagctccctgca

SEQ ID NO: 12892 - DNA, 201 bp, Homo sapiens
cctctacccccaccccccaccccacccctgcggctcacagtcagccctctgcctcctcctcaccaagccctcagacagctccaaggccccggctgctccaktgccacacagccgctgccacctctccttagcctccatgttgactacatcccccttgcaggtgagccaccactaccatactattggagggtcttgactggg

SEQ ID NO: 12893 - DNA, 201 bp, Homo sapiens
gcaatctgaactgcctgaatgaccacttggaggccaaaacaccattgtccacccccagcgtggttactgggattggcctgtccagaagcatcatgacccaygtaaggtagaggagatgtgcaaagccaatgagccctgcacaagctttgcaaagtgtgtgtgtgatgagaattgtgagaaggaagctctgtgcaagtggct

SEQ ID NO: 12894 - DNA, 201 bp, Homo sapiens
  misc_feature (1)...(201): n = A,T,C or G, or insertion/deletion polymorphism (see Tables 1-2)
gtttatatactttggcccatgtttgtgaagactaaggaaggcctggcgttaatgggaagggcaaggccctgggtgagacagacagtacagatgaggatccncatcagagtgtcagggaggtccagaaccttcactccacattcagtcgaaagtcttaatgaagcctctggaccaaagctccagcttttctcctgccccata

SEQ ID NO: 12895 - DNA, 201 bp, Homo sapiens
gcaaccaaaagtgttctagagattcaatgcaatctccatcaaaattccaatggcattatttacagaaatataaaaggcaattttaaaatgtatatggaacyacaaaagaccccaaatagccacagaaatcctgagcaaaaagaacaaaactggaggcaacatacttgacttcaaaatatactgcaaagctatagtaaccaa

SEQ ID NO: 12896 - DNA, 201 bp, Homo sapiens
acagaagctgagtgttatgttttttaatgcaaatttggtttcctctctctctctctctccctctctccctccctctctccctccctacccttcttaaaacmcttcagtggttttatattgcttttagaatccaggtccaaatccttaacatggcttataagatccaacaaggtctggcccctgcagggcctccatttgtct

SEQ ID NO: 12897 - DNA, 201 bp, Homo sapiens
acacctctttccctcttaccctctacatccaattcaccaacaggtacactgttctgctttcgaaatatttaagttgatctgtttccctccatttcactgcyatccctctccaagccaccattttctttcacttggtcaacaaaactgacctcttaagaagtcttcctcacagagctttctgtcctgaatgaacagaagctg

SEQ ID NO: 12898 - DNA, 201 bp, Homo sapiens
gttcaagagggtttccatcatctaaccagctgccagaattcacctggagccacccacaacacctctttccctcttaccctctacatccaattcaccaacargtacactgttctgctttcgaaatatttaagttgatctgtttccctccatttcactgctatccctctccaagccaccattttctttcacttggtcaacaaa

SEQ ID NO: 12899 - DNA, 201 bp, Homo sapiens
ggttctccaagttcaagagggtttccatcatctaaccagctgccagaattcacctggagccacccacaacacctctttccctcttaccctctacatccaaytcaccaacaggtacactgttctgctttcgaaatatttaagttgatctgtttccctccatttcactgctatccctctccaagccaccattttctttcactt

SEQ ID NO: 12900 - DNA, 201 bp, Homo sapiens
ttctaaattaaggttaataacatagatcccatacggttgtcgtaaggattaaatgagataagtgggaattaaaaacacttgccttgcaaggtgttttaagmttaaataagatgatgtatgaaaatccaagcctggcactaacaggcccttaattgtgactggcttggtttgagggagggctataaatcaccccctctcctt

SEQ ID NO: 12901 - DNA, 201 bp, Homo sapiens
  misc_feature (1)...(201): n = A,T,C or G, or insertion/deletion polymorphism (see Tables 1-2)
aggccagagaattctggcaagatggtggggatgatggccacacaggttttggatcttcctaaatccccacctaaaaacagagatactaagtagcaacaccnaaaaacctggccatgaacaacatttatcacaaactagctgatggggtatccccatgaaccccaaatacaagcaggtcaggataaaccaccaactaagccc

SEQ ID NO: 12902 - DNA, 201 bp, Homo sapiens
gagatgatcctacactactggctttgaagacagagcaggaggacacaagccaaggaatgcaggaagcctctaggaactggaagaggtgaggaaacaaaatstcctctacagcttccagaaggaacacagccctgccaacaccttgattttagaccagtaagacatctgacctccagaactgtaagataataaatttgcatt

SEQ ID NO: 12903 - DNA, 201 bp, Homo sapiens
ttctctaaccatgtcttctcactttatttcattaattagatcttcaatcattgatatcctttcttccacttgattgaatcagctattgaagcttgtgcatscatcacgaagttctcatgccatagttttcagctccatcaggtcatttaaggtcctctccacactgtttattctagttagccactcatctaaccttttttc

SEQ ID NO: 12904 - DNA, 201 bp, Homo sapiens
accttgctgagaaaaccactgctctcttcagagctgtcagacagggatgtttaagtctacagaagctgtctgctgccttttgtcctactatgccctgcccrcagaggtggaatctatggaggcagtaggccttgctaagctgcggtgggctccacccagttcatgcttccaggcctctttgtttacactgtgagatactca

SEQ ID NO: 12905 - DNA, 201 bp, Homo sapiens
  misc_feature (1)...(201): n = A,T,C or G, or insertion/deletion polymorphism (see Tables 1-2)
tttcacccagcagtcagaaggattatagaactgcagagttcttctgaagatttgctagctctcctccaaaaggaaaattagactcctgaagatccacatcnccactaaaagtaagcaaggagatgagagacccgtctggggactgtggctagaaaaagcacttgaggcattttttgcagcagagtcttgaacaaaccaccg

SEQ ID NO: 12906 - DNA, 201 bp, Homo sapiens
  misc_feature (1)...(201): n = A,T,C or G, or insertion/deletion polymorphism (see Tables 1-2)
taaagtctgatcatttaacggtttctataaatggattaatatgttatataaatctgttttctgttaaataaaaagatgacagagaatctggttggttagtnttaatttgtttatcaatttgtctatttttagctcaaagacgttagtgcccatcgggaaggagagtagccctttgatatctgtaccagtgagtttttgtgt

SEQ ID NO: 12907 - DNA, 201 bp, Homo sapiens
taaatgttttattgtcactttaattaaataggtaaccaaatattgcttcttaggtatccatggcctctcgtaagcaagtgtccaaactgttctgataactkttaaaaatttaccttccccaaataggatcctaaatgtagaaaaaaaatgaaataaaagtttcaagattttttttacacctaaaactttcatctttgagat

SEQ ID NO: 12908 - DNA, 201 bp, Homo sapiens
  misc_feature (1)...(201): n = A,T,C or G, or insertion/deletion polymorphism (see Tables 1-2)
tccttctaattgataattatccttgatccctgtaatcatgatataatatctctaaggcagaagtgctcttattttccttttcttcttcctttttcctcctnaggttcatccttccggtggattcctgatatctcctaaactcattgtggatttccttacctctccaaacagatggctcagtgccattaactttgtaatttc

SEQ ID NO: 12909 - DNA, 201 bp, Homo sapiens
ttaaataattgatagtacaatcaaggccttatccgaagtgtcatatctgagaatggtgctcatttaatcagatatgaacaccagtttgttttaacaaacgsaagttggtcatacttagagaatcagtgcctacaaagccctcccaggaaaactggcctggttcctggctgacagagtccccaccttttgaggtgttggaaa

SEQ ID NO: 12910 - DNA, 201 bp, Homo sapiens
  misc_feature (1)...(201): n = A,T,C or G, or insertion/deletion polymorphism (see Tables 1-2)
taagaaaagaggatttcacccaaattcataggtactgcaggtgaaatttggtagagagagtttcttggaattgatttcctagcctcaagatagtaaatagnagaggcttttaaacccatctgatatttttatgaaaactcccagacataagttaatttggtagcattagttgttgctcagtactatatagctcaagatttg

SEQ ID NO: 12911 - DNA, 201 bp, Homo sapiens
catcgatgtgtacaaagattttatggaaaatacatcaaaagcacaggcaacaaaagtaaaaacagacaaatggaattatatcaaactaaaaagcttctgcmtagcaaagaaaacaacagagtgaaaagagaacctgcagaatgggagaaaatatttgcaaactattcacctgacaagggattaatattcagaatatacaag

SEQ ID NO: 12912 - DNA, 201 bp, Homo sapiens
actgaaagctcttaaggctgcactgtcggtttctctacttttttttttttttttttttttgagagggagtctctctctctctctctctctctctctctctcactaggctggagtgcagtggcacgacctcggctcactgcaacctccgcctcccaggttcaagcgattctcctgccccagcctcccgagtagctgggacta

SEQ ID NO: 12913 - DNA, 201 bp, Homo sapiens
tcctcagagaactgcagaggaaggggcgtgatgggaaggtgtggccacagcggcaggctcagtttccacaatctgcttaggtactcctgcaataaggaggytattttcacacagggcttatgagactcagtctcatctctccatagactctgtgcttttctcatttcccctacaggccagcactcaaaaatacataatgga

SEQ ID NO: 12914 - DNA, 201 bp, Homo sapiens
gactgaaagctcttaaggctgcactgtcggtttctctacttttttttttttttttttttttgagagggagtctctctctctctctctctctctctctctctcactaggctggagtgcagtggcacgacctcggctcactgcaacctccgcctcccaggttcaagcgattctcctgccccagcctcccgagtagctgggact

SEQ ID NO: 12915 - DNA, 201 bp, Homo sapiens
agaactctaattaatcttaattcaactaaacttaaaaccttacgagattttaagaataataaaaaatttttttaggatctcttaacttacatctcattctyaatattattgactaggtttttttttttaaactatgccttttcgatgtctctgagagtatctgattgttgtttttgtacaaaggggaaaggtaggaggcag

SEQ ID NO: 12916 - DNA, 201 bp, Homo sapiens
tttgtgacatctattgtgacatcatactatttctcttattaagttaaataaaattattgacatgttcattttatatttgtatgttatgtttaccttttttwaaaaaaattattttttagcagctttagacatcttccagcgatgtgcagagtggactcacctgacagaccaagagaaactgcactcccggagaagagaaat

SEQ ID NO: 12917 - DNA, 201 bp, Homo sapiens
actggaaaattgtgctcaagtgaccaattattaatagaactctaattaatcttaattcaactaaacttaaaaccttacgagattttaagaataataaaaaatttttttaggatctcttaacttacatctcattctcaatattattgactaggtttttttttttaaactatgccttttcgatgtctctgagagtatctgatt

SEQ ID NO: 12918 - DNA, 201 bp, Homo sapiens
tactggaaaattgtgctcaagtgaccaattattaatagaactctaattaatcttaattcaactaaacttaaaaccttacgagattttaagaataataaaaaatttttttaggatctcttaacttacatctcattctcaatattattgactaggtttttttttttaaactatgccttttcgatgtctctgagagtatctgat

SEQ ID NO: 12919 - DNA, 201 bp, Homo sapiens
tacagtactggaaaattgtgctcaagtgaccaattattaatagaactctaattaatcttaattcaactaaacttaaaaccttacgagattttaagaataataaaaaatttttttaggatctcttaacttacatctcattctcaatattattgactaggtttttttttttaaactatgccttttcgatgtctctgagagtat

SEQ ID NO: 12920 - DNA, 201 bp, Homo sapiens
  misc_feature (1)...(201): n = A,T,C or G, or insertion/deletion polymorphism (see Tables 1-2)
aggcctggcgttaatgggaagggcaaggccctgggtgagacagacagtacagatgaggatccccatcagagtgtcagggaggtccagaaccttcactccanattcagtcgaaagtcttaatgaagcctctggaccaaagctccagcttttctcctgccccatagacagaaatagtgagagggttccaactggacaatgggc

SEQ ID NO: 12921 - DNA, 201 bp, Homo sapiens
attaggtgttttcacatagtcccacatttcttggaggctttgtttgtttcttttcactcttttttctctaaccatgtcttctcactttatttcattaattwgatcttcaatcattgatatcctttcttccacttgattgaatcagctattgaagcttgtgcatgcatcacgaagttctcatgccatagttttcagctccat

SEQ ID NO: 12922 - DNA, 201 bp, Homo sapiens
ctggtgagggcctaaggaagcttacaatcatgttggaaggtgaggggaagccaatgtgtcacatggtgagagagagagtgagagaggaagaaggtgccagrctcttttaaacaaccatatcttacatgaactcatagagtgagaactaactcattactgtgaggactgcaccaagccattcatgagtgatccatctccatg

SEQ ID NO: 12923 - DNA, 201 bp, Homo sapiens
aactactatttatcaaattctggcataatatcaaagaagaatgcccacaattacctgcaaaacctattaaactactcctcccttttccaactgcataattgcgtgaaactagatttccttcagatacttcaaccaaaccaaagtattacaacacatcaatgcaaaatcccatgtaaattcaactgtcttctcttaaaccac

SEQ ID NO: 12924 - DNA, 201 bp, Homo sapiens
tccaagtactttcttcaccaatctcatgagaagaggaaacatgccgagacactgaagatgctgcagaaccagcaaggtggctgaatcttccttcaggataycaagaaaccatactgtaatgactgggagagcaggctgaatgcaatggagggtgtattacacttgataaaaaacatgaatcagtcactactggaactgcac

SEQ ID NO: 12925 - DNA, 201 bp, Homo sapiens
  misc_feature (1)...(201): n = A,T,C or G, or insertion/deletion polymorphism (see Tables 1-2)
agttgctgagtaatgctcctggagacatcatcccagcacagcaggctcccaatcacagctactgctgacagccagggaaacacagtcaaaatcctagaaanacacacttgacctggattgagggcagcagcttctggattcattcctttgctaatttcttttcttttcgtttggagacagggtcttgctctgtcgcccagg

SEQ ID NO: 12926 - DNA, 201 bp, Homo sapiens
gactggctttctgataatagacaatcagacaaaaatagagaaaaaagaatgaaaaggaacaaacaaaacctccaagaaacatgaaattatgtaaagagacmaaatctatcactcatttttgtcccttaaagaaatagggagagtgtaagcaacttgaaaaacatatttcaggatatcattcatgagaactttcccaaccta

SEQ ID NO: 12927 - DNA, 201 bp, Homo sapiens
actgcagaaagttcccgatttaccatcgtttgatttagggtttttcaactttacaatggtgcaaaagtgatattcattcagtacactcctcagtttcaacrgggttacatccagataaactcatctcaaattgaaaatactggctgggtgctgtggctcacacctctaattccagcactttgggaggccgaggtgggcaga

SEQ ID NO: 12928 - DNA, 201 bp, Homo sapiens
tcctcagagtggccctacctagtggcaatgggaataattattgtaagcacctaaacccctccctccaaaatcaggaaagtctctcgctacttctcaccccrcttcctcagcctgagagaagctcccagtggccaatcagaatcatcacccctagttttctataagcacacacatgagaaagatacacagtggctcatgcct

SEQ ID NO: 12929 - DNA, 201 bp, Homo sapiens
agctgactgggtcctgccaggacagaagatgggcaacctcagccagttatcctctgtcaaagacaagtggctgcttggaaagaaggcccaggaagtattakttaattcacctctacaggaggaatataatttcctcctagaccttttcggcctccctgcagtttgtgacctttttgcctgtatgcagcttaagttgataaa

SEQ ID NO: 12930 - DNA, 201 bp, Homo sapiens
gcctgtatgcagcttaagttgataaagagaagtggttacaccaaactcctctgcagatgtgaaggaatggacagcaagagttgagcagttttctgccgatmatcacacatcatgagctgagtgactacaggttgccaaatcattgtttctgagtctgaccagtgagcttagttcttctcctgcctaattttgtactagtga

SEQ ID NO: 12931 - DNA, 201 bp, Homo sapiens
ttactactttgactgcgatgatgtggctttgaagaacttttccaagtactttcttcaccaatctcatgagaagaggaaacatgccgagacactgaagatgstgcagaaccagcaaggtggctgaatcttccttcaggatatcaagaaaccatactgtaatgactgggagagcaggctgaatgcaatggagggtgtattaca

SEQ ID NO: 12932 - DNA, 201 bp, Homo sapiens
taatgttagtgaacatgttcacttttgccactttaagaacatgtaaaagagatgtgcatggctgtagaaaattgtttcaagcttttctagtttgctgtaaygctcatgtattgcaggaagttctcaattacccatcccacactgacttttctctgtaaatgagaagttagttactttgtttaaaagttataattaatgagt

SEQ ID NO: 12933 - DNA, 201 bp, Homo sapiens
ttttagctcaaagacgttagtgcccatcgggaaggagagtagccctttgatatctgtaccagtgagtttttgtgtttctgtgccttctatctcttaacctraggctaaaactgtagaattgaagctctaagctcctttgtggctagacatctatttctgtaattcaagcctttacctcttgtgtgagtacaaaatcttttc

SEQ ID NO: 12934 - DNA, 201 bp, Homo sapiens
tggtttaaagtctgttttatcagagactacgattgcaacccttgcttttttgctttccatttgcttgatagatcttcctccattcctttattttcagcctrtgtgtgtctttgcacgtgaaatgggtctcctgaacacagcacaccaatgggtcttgactctttatccaacttgccagtctgtgtcttttaattggggcat

SEQ ID NO: 12935 - DNA, 201 bp, Homo sapiens
atcttttattttttttgagatggagagtcactctgtcacccaggctggagtgtagtggcttgatcttggctcactgcaacctccacctcctgggttcaagygattctcctgcctcagcctcccgagtagctgggactacaggcacgtgccaccatgcccagctaatattttttgtatttttagtagagatggggttttacc

SEQ ID NO: 12936 - DNA, 201 bp, Homo sapiens
ttctaattgataattatccttgatccctgtaatcatgatataatatctctaaggcagaagtgctcttattttccttttcttcttcctttttcctcctcagrttcatccttccggtggattcctgatatctcctaaactcattgtggatttccttacctctccaaacagatggctcagtgccattaactttgtaatttcatc

SEQ ID NO: 12937 - DNA, 201 bp, Homo sapiens
aattcaagatagattaaagacttaaacgttagacctaaaaccataaaaaccctagaagaaaacctaggcattaccattcaggacataggcatgggcaaggwcttcatgtctcaaacaccaaaagcaatggcaacaaaagacaaaattgacaaatgggatctaattaaactaaagagcttctgcacagcaaaagaaactacc

SEQ ID NO: 12938 - DNA, 201 bp, Homo sapiens
cttaaggagattttgggctgagacaatggggttttctaaatatacaatcatgtcatatgaaaacagggacaatttgacttcctcttttcctaattgaataycctttatttttttctcttgcctgaatgaccaagccagaacttccaacactatgttgaataggagttgtgagagggcatccttgtcttgcaccagttttca

SEQ ID NO: 12939 - DNA, 201 bp, Homo sapiens
gtgagagggcatccttgtcttgcaccagttttcaaagggaatgcttccaatttttgcccagccagtataatattggctgtgggtttgtcataaatagctcwtattattttgaaatacatttcatcaatacctagtttattgagaatttttagcatgaagggctgtttaattttgttgaaggccctttctgcatctattgaa

SEQ ID NO: 12940 - DNA, 201 bp, Homo sapiens
tgcaaaaattttctcccattctgtaggttgcctgtccactctgatgatagtttcttttgctgtgcaggagctctttagtttaattagatcccatttgtcarttttggcttttgttgccattgcttttggtgttttagtcatgaagtctttgcccatgcctatgtcctgaatggtattgcctaggttttcttctagggtttt

SEQ ID NO: 12941 - DNA, 201 bp, Homo sapiens
ttgcaaaaattttctcccattctgtaggttgcctgtccactctgatgatagtttcttttgctgtgcaggagctctttagtttaattagatcccatttgtcwattttggcttttgttgccattgcttttggtgttttagtcatgaagtctttgcccatgcctatgtcctgaatggtattgcctaggttttcttctagggttt

SEQ ID NO: 12942 - DNA, 201 bp, Homo sapiens
tgcctagatgacgtctcctgcttcgtacagacaataggaaccaccatctggaaagtccttcagagtcacacattcagagctacaatccacccacatccacrtgcattctcttttcctttccctctcctgtaagaaagttcaatcaaagcaatctgaggcaagttctcttacctatttttggatgccatcaacccctccttc

SEQ ID NO: 12943 - DNA, 201 bp, Homo sapiens
tcaaatcttctaggcttcttttaaaactctggatgagcataggagctcagacacacatgtacgcagttgtgcatgcacacgtatgctcacatccactcackatcacccctcactctcagcaggtgatgcctagatgacgtctcctgcttcgtacagacaataggaaccaccatctggaaagtccttcagagtcacacattc

SEQ ID NO: 12944 - DNA, 201 bp, Homo sapiens
tcatgtgagaggtgccctccctacatccggaggaaagaagcatccttacctctgaagatggagggacacagagaggaatgtgagtgaacaggccttgctaygttcccccgatttactcattccctttgtcctaacacactcttctacaactttcccctcttcatcaaacctggcatcaaaacacaggtttaactgtttctt

SEQ ID NO: 12945 - DNA, 201 bp, Homo sapiens
  misc_feature (1)...(201): n = A,T,C or G, or insertion/deletion polymorphism (see Tables 1-2)
aagcaaagcaactaaaggatgaagcaaggaaaggacagatttactgaaacaaaagtacactccacagagagcaggagcaggctgagcaagcagttcaagancactggttacagaattttctggggtttaaatactctctagaggtttcccattggttacttggttacaccctttgtaaaagaagatttggcccacgaccag

SEQ ID NO: 12946 - DNA, 201 bp, Homo sapiens
attttacatttatttgtaaattcatgtaagtgtaacttacatgtaactccaagttcaggacacatcgccccaaaatatgccacccaccttggcatactgartatttgcagctgaaggaatttgagaaatacatagtgcagaaaggtctctctgactttcccctgcccttctcccatgaaggagatcataaacctctcatgt

SEQ ID NO: 12947 - DNA, 201 bp, Homo sapiens
ctgaatgagcaagtgaaatccatcaaagaattgggtgaccatgtgaccaagtcacacaaggtgggagcccctgaatctggcttggcagactatctctttgrcaagctcaccctgggacagagcaataatgagagctaagctttaggctaattttcccataaccatgggtgacttccctggtcaccaaggcagtgcatgcat

SEQ ID NO: 12948 - DNA, 201 bp, Homo sapiens
gactcgagaactacgtgaagaatgcagaagcctcaggagccaatgcaatccactggaagaaagggtatctgtgatggaagatgaaatgaatgaaatgaagygagaagggaagtttagagaaaaaagaataaaaagaaatgaacaaagcttccaagaaatatgggactatgtgaaaagaccaaatctgcatctgattggtgt

SEQ ID NO: 12949 - DNA, 201 bp, Homo sapiens
aggtagtaagatttgttggaaattattattgttattattattgttgccataatggcaataaggcaataataatgggctaaaacaggctgaatatcttgcckgcaattgcacagttctaagtgccagaagtaatatttgaacccagttttctgaccacagagttcataccttttcactacccaggatatggtcctgagtctt

SEQ ID NO: 12950 - DNA, 201 bp, Homo sapiens
ccctgagctggaccctgttgccacccctgggtctgaaggagcaagaggaggacaatgcagctgtaggagaggggcctcctgacagcagctgtgatccccaraagaggagcacaccaccactaaactgtagcccaagggggaggaggccaggctagaaacacttctacccctcccctttcactctcttatctctcgctggtg

SEQ ID NO: 12951 - DNA, 201 bp, Homo sapiens
aaaaactggaaactctaaaaagcagagcacctctcctcctccaaaggaacacagttcctcaccagcaatggaacaaagctggatggagaatgactttgacragttgagagaagaaggcttcagatgatcaaactacgagctacaggaggaaattcaaaccaaaggcaaagaagttaaaaactttgaaaaaaatttagacga

SEQ ID NO: 12952 - DNA, 201 bp, Homo sapiens
ctaacaaacagaaaggacatccacaccaaaaacccatctgtatatcaccatcatcaaagaccaaaagtagataaaaccacaaagatggggaaaaaacagarcagaaaaactggaaactctaaaaagcagagcacctctcctcctccaaaggaacacagttcctcaccagcaatggaacaaagctggatggagaatgacttt

SEQ ID NO: 12953 - DNA, 201 bp, Homo sapiens
ggcagtttttaattgaaaaaacaaactgacatcagcaatagttattcagacttaggaatctggcagatattttctcaaacattaacaaagtaagcctgggraaaaaaaagacagtatttgttgccaattatgaaatctgagctttcacatgaaaattagaatttttgaaaactggtcccaccactatgagttttccaaaac

SEQ ID NO: 12954 - DNA, 201 bp, Homo sapiens
gctcaccctccatgggctgcacccactgtcccagtcacagtgagatgaaccaggtacctcatttggaaatgcagaaatcacctgtcttctgcattgatctygctgggagatacagaacagagctgctcctattcagccaccctggaaatgactccttatcttttattttttttgagatggagagtcactctgtcacccagg

SEQ ID NO: 12955 - DNA, 201 bp, Homo sapiens
tcctttaccttttctataagttgtaccaaaacattcacttaagttctttgatttgtactattccttcaaataaagacatttggtacacctccaccccccccaaaaaaagtcactcctcttcatcactatcagcacagccccattcccattacttcctacccatccctaagataatctcatttatacttcctgaattttttt

SEQ ID NO: 12956 - DNA, 201 bp, Homo sapiens
cacggcttcccttggctaggaaagggaaatcccctgaccccttgcaccccgccctgcttcagctcaccctccatgggctgcacccactgtcccagtcacartgagatgaaccaggtacctcatttggaaatgcagaaatcacctgtcttctgcattgatctcgctgggagatacagaacagagctgctcctattcagccac

SEQ ID NO: 12957 - DNA, 201 bp, Homo sapiens
tgagccccaagagcgtgttggtaaatgtctaacaactagctctaccataaaagccctgatttgtagtgtttgccacttttagtagtgtaaatgttcccgcyacagctggtttcatggtatcaacataatgttactgaacacagtgttggaagagatgaacacagatagtagtatttccagacagattcaccaggcataaca

SEQ ID NO: 12958 - DNA, 201 bp, Homo sapiens
gctgtcagacagggatgtttaagtctacagaagctgtctgctgccttttgtcctactatgccctgcccgcagaggtggaatctatggaggcagtaggcctygctaagctgcggtgggctccacccagttcatgcttccaggcctctttgtttacactgtgagatactcaagcctcggcaatggcggatgcccctccccata

SEQ ID NO: 12959 - DNA, 201 bp, Homo sapiens
aggctgattgaagggaaacaaggtaccttcaggtcagtacatacatcatttgggaaagttgggatgcgggtgggagggaaagggcaagacgatgtgcacawtgcagattaattaagtgtctgcatagagtggactcccctgcttccctcagaccctgtctcctctgtgctcccacccagaggaatggctaattggcagaag

SEQ ID NO: 12960 - DNA, 201 bp, Homo sapiens
agaaataacaaaggataacttgagactatatgaacaactgtatgtcaacaaattggaaaacctagcagaaatggataaattctgggtcacaaatgacctayccaagattgaaccaagaagaaatagaaaacttgaacagatcaattaaaagtaatgagattgaatcagtaataaaaagtcttccatgaaagcaagcccagg

SEQ ID NO: 12961 - DNA, 201 bp, Homo sapiens
aagatgctgcagaaccagcaaggtggctgaatcttccttcaggatatcaagaaaccatactgtaatgactgggagagcaggctgaatgcaatggagggtgyattacacttgataaaaaacatgaatcagtcactactggaactgcacaaactggccactgacaaaaatgaccaccactgtgttgacttcattgagacacat

SEQ ID NO: 12962 - DNA, 201 bp, Homo sapiens
gtattattttttaatcccctccccagatatcatttagaactattataataaaggtggtgggtaataacaacctaaggagcctttctagttaccttaagttkcagctaactctgtggtttcttttttgaggcctaacaaacatactgtattttacattatcaaaatgtagtttacattactcactatgttaatgagtatata

SEQ ID NO: 12963 - DNA, 201 bp, Homo sapiens
ttcttatacttctttaacccatgacaatttagtaaactctgcttttgtaaactgaaatgacactgattttagaccactcctgcttacagagcacagagaaktcacacagacctgtgcccaccggcatcccaccccaagccaaaaccaccaccaatgtgactgctcacacatttgccagcagggtcctcaacagctgcattg

SEQ ID NO: 12964 - DNA, 201 bp, Homo sapiens
  misc_feature (1)...(201): n = A,T,C or G, or insertion/deletion polymorphism (see Tables 1-2)
gttagtgggtgcagcacaccagcatggcacaggtatacatatgtaactaacctgcatattgtgcacatgtaccctaaaacttaaagtataataataaaaanaaacattgtagtcatacacatctaaaattcattttcctcaatatcctttcattgatcttcaacccaaaaaccaatctaaaactttaagttattcccatct

SEQ ID NO: 12965 - DNA, 201 bp, Homo sapiens
aggaaggggaacatcacactccagggactgttgtggggtggggggagggatagcattgggagatatacctaatgctagatgacgagttagtgggtgcagcrcaccagcatggcacaggtatacatatgtaactaacctgcatattgtgcacatgtaccctaaaacttaaagtataataataaaaaaaaacattgtagtcat

SEQ ID NO: 12966 - DNA, 201 bp, Homo sapiens
caggaaggggaacatcacactccagggactgttgtggggtggggggagggatagcattgggagatatacctaatgctagatgacgagttagtgggtgcagyacaccagcatggcacaggtatacatatgtaactaacctgcatattgtgcacatgtaccctaaaacttaaagtataataataaaaaaaaacattgtagtca

SEQ ID NO: 12967 - DNA, 201 bp, Homo sapiens
tagaaacacacacttgacctggattgagggcagcagcttctggattcattcctttgctaatttcttttcttttcgtttggagacagggtcttgctctgtcscccaggctagagtgccatggcacaatcatggctcactgcagcctcgacctcctaggctcaagcaatcctcccacctcagcctcccaagtagctgggacta

SEQ ID NO: 12968 - DNA, 201 bp, Homo sapiens
gggtaggggaggtgctccatgtgaagacagagtccttggcacccccactgtgtctcctgggagatgacccaacatcctcatttgaaaccgtccagatcaaygttatccccacctctgatgattcctcaggtaataaaacagcctgcccccaatccttggctctactacgggagaatgtgttatgtgtgtgtgtgtatgtgt

SEQ ID NO: 12969 - DNA, 201 bp, Homo sapiens
agtctcgcgggctccagggttagttgtcagtatctttcccagttgttccgccccctacccccgcctcccgcaccgcgcccctctccggctgccctctccgygtggggcaaggctccgagggcagcattcagtagccatttagctttggaaggagaggtgattcgaatggcccggctcctcctgtcaccatgctaggcactt

SEQ ID NO: 12970 - DNA, 201 bp, Homo sapiens
caaggctccgagggcagcattcagtagccatttagctttggaaggagaggtgattcgaatggcccggctcctcctgtcaccatgctaggcactttggccgygcaggtacttattgacccgaccgggtgtccgtagttggcgcggctaccttaaccgcagggaattgtggaatttatagttctaaattatatgtgggtggaa

SEQ ID NO: 12971 - DNA, 201 bp, Homo sapiens
gaaagagtcaactgattagttggtgatggggagaggcgggccttgggaaccgtctcctggttggggggtgggggggaaagatggcggagctgatgctgctyagcgagattgctgacccgacgcgtttcttcaccgacaacctgcttagcccggaggactggggtctgcagagtgaggcaccggggaggggagagggctgtg

SEQ ID NO: 12972 - DNA, 201 bp, Homo sapiens; identical to SEQ ID NO: 1960

SEQ ID NO: 12973 - DNA, 201 bp, Homo sapiens
cctctggccccccacccccaaatctcacagcacagaccacaattcacaagttcctgtctcttttaaggtttaacttttaatcagccaaacatcttgcgcayaccctgagccagccctgcatcctggttcttcccctgaatgaccaccttccccagttcctcctgggctgcccggtttttgggatctatcgccagcaccttc

SEQ ID NO: 12974 - DNA, 201 bp, Homo sapiens; identical to SEQ ID NO: 1962

SEQ ID NO: 12975 - DNA, 201 bp, Homo sapiens; identical to SEQ ID NO: 1963

SEQ ID NO: 12976 - DNA, 201 bp, Homo sapiens
cctctccgtgtggggcaaggctccgagggcagcattcagtagccatttagctttggaaggagaggtgattcgaatggcccggctcctcctgtcaccatgcyaggcactttggccgcgcaggtacttattgacccgaccgggtgtccgtagttggcgcggctaccttaaccgcagggaattgtggaatttatagttctaaat

SEQ ID NO: 12977 - DNA, 201 bp, Homo sapiens; identical to SEQ ID NO: 1964

SEQ ID NO: 12978 - DNA, 201 bp, Homo sapiens
tgagaaaagtttcagtaaattaaaaaaatctcatattatctattaatatcttattcagataagatcaaatttctaacctagattttaggttaagacatagycatttgttgtaatgtgagaatgacagagagagagagagatattaactagcagaatccaactataaaaataaatttaagggcacaattctctactaatgac

SEQ ID NO: 12979 - DNA, 201 bp, Homo sapiens
actgcgctcggcctgcaattgttttttgttttaatgttatattcaattcttcctccatctttattaaagtataattgataaaaattgtgtatatttacagwgttcaatgtgatgttttgatatatgcatacattatgaaatgattaaatcaagttaattaacattttcatcacttcacatacttttattattattattatt

SEQ ID NO: 12980 - DNA, 201 bp, Homo sapiens
ggtttaaatgctccctccacgggcaggtgtcacgggagttccccctggttttgctttctgctgtgacagggcaacactgagttcaatgcaaagtcccacarttgctgcactctcccttccccaagtgcacagattctctctcagcaccacagtggccactgctgggggatgggagaggagtgaccttggtgtttcaagact

SEQ ID NO: 12981 - DNA, 201 bp, Homo sapiens
acagggcaacactgagttcaatgcaaagtcccacaattgctgcactctcccttccccaagtgcacagattctctctcagcaccacagtggccactgctggsggatgggagaggagtgaccttggtgtttcaagactgtctttcctaccctcctcagtgcctctttcagtgttatgaagttagggccaggtactgtgagtac

SEQ ID NO: 12982 - DNA, 201 bp, Homo sapiens
cactgcatgttctcactcataggtgggaattgaacaatgagaacacatggacacaggaaggggaacatcacacaccagggcctgttgtggggtggggggargggggagggatagcaataggagatatgcctaaggttaaatgacgggttaatgagtgcagcacaccaacatggcacatgtatacatatgtaactaacctgc

SEQ ID NO: 12983 - DNA, 201 bp, Homo sapiens
gctgtctgtgctacagattacacctttgccatgtacccaccatccagttgtgaaaacaacccaaatgcctgttaactgatgaacagataaccatatgtgakatatatcaatacaatggaatatggcctggcatgctggctcacgcctgtaatcctgcactttgggaggccaaagtgggaggatcacttgagccgaggagtt

SEQ ID NO: 12984 - DNA, 201 bp, Homo sapiens
cctgagtcagcaggtgatgaatcctgccaggactgggttcttttctttaaggcatcagattcccttctggcccagggtatatctagaaatgacattcaggrgctagatcctggaatgggggtctcttgactctgaccagtgctctatcctgctgtggctgagctggtatccaagatgtaagacaaagtcctctttactctt

SEQ ID NO: 12985 - DNA, 201 bp, Homo sapiens
ctctgcttccaagatggcactttaaatgctgagtcttccagagatgaggaatgctgtgtcccaacatggtggaaaggacagaaaagcaaaagaaggaaacsgagctaggcagctccctcaagccctttcataaggtcactatcccattcatgagggggctcttccctcacgacttaattatctcctaaagacgctacctgt

SEQ ID NO: 12986 - DNA, 201 bp, Homo sapiens; identical to SEQ ID NO: 1973

SEQ ID NO: 12987 - DNA, 201 bp, Homo sapiens
ctcctcaagcaaaaggaagaagccacgtttgttgctgcatgctgcactgcttgggttgggagaggggtggtgcaagcactcgcttggctgccctgcctggtgtcttactaggttgtgtgccccctgagtccactggctctaagcctagcatggcattaggacttacctgggaattgaagtctttatggtctagactgcctt

SEQ ID NO: 12988 - DNA, 201 bp, Homo sapiens
atgggcttttgccatgttggccaggctagtctcaaacacctgacctcagttgatccacccgcctcggcctcccaaagtgctgggattacaggcatgagccrccgcacccagccaaatattctgccttgtaagaatgtttttgtatgcctgaggctttgggctttgctgtatcaatatgacctctctagggactgaaacctg

SEQ ID NO: 12989 - DNA, 201 bp, Homo sapiens
atacgtaaattaaaagagataaaggacatgagcactcagaacaaaattacaggaataaatttagcaaaggggcaccaaagttgagagaagggtcactgttccacgtcagacatctttaattcttgcgtcatggagatggtaagccagcgaacagagtcttctgtctggaagctaaaaccagcctttgggatggcttcagag

SEQ ID NO: 12990 - DNA, 201 bp, Homo sapiens
tgccatgttggccaggctagtctcaaacacctgacctcagttgatccacccgcctcggcctcccaaagtgctgggattacaggcatgagccgccgcacccygccaaatattctgccttgtaagaatgtttttgtatgcctgaggctttgggctttgctgtatcaatatgacctctctagggactgaaacctgagtagctgg

SEQ ID NO: 12991 - DNA, 201 bp, Homo sapiens
aacagagtctcactctgttgcccagttagagtgcagtggcgcaaactcggcttactgcaaattctcctgcctcagcctccggagtagctaggattacagaygtgcgccaccacacccagataatttttgcatttttcatagagatggggtttcaccatgttggctaggctggtcttgaactcctgacctcaggtgatccgc

SEQ ID NO: 12992 - DNA, 201 bp, Homo sapiens
gggcttccctggtagacaacccttagcatgtgctgccacacatcattgctgggagaattaaccactgcctgtccaactccagattggaggccttcctttarcatttcttgtagcacaggtctggtgttgatgaaatccccgaacttttgttcgtctgggaaactctttatttctcctttaggtatgaagggtatttttgct

SEQ ID NO: 12993 - DNA, 201 bp, Homo sapiens
tctcccaaacagtctcagtctctttttttgtttctctctctctctgtgctgagccacttggagctgcaggtgggctgacacaacatccctatggctaccaycacttagactgcactgggtcagacctaaagccagcaaagcactgggtctcactcaaggccccctgtaaacactgcctggctatcaccgatgttcattcaa

SEQ ID NO: 12994 - DNA, 201 bp, Homo sapiens
catccagttgtgaaaacaacccaaatgcctgttaactgatgaacagataaccatatgtgatatatatcaatacaatggaatatggcctggcatgctggctyacgcctgtaatcctgcactttgggaggccaaagtgggaggatcacttgagccgaggagttcaaggccagcctgggccacaaagtgagactccttctaaaa

SEQ ID NO: 12995 - DNA, 201 bp, Homo sapiens
  misc_feature (1)...(201): n = A,T,C or G, or insertion/deletion polymorphism (see Tables 1-2)
acaactctgaatatactaaaaaccactgaatgtagtacacctggggaccctggttctctgccctttctctggccactccttccctgtgtgccatccctccngcagtctgcagcctctgctgctccttagtccactgttcttggccatctcttccacctgtgaccactctctcctcattccctctgggatgagctcactcct

SEQ ID NO: 12996 - DNA, 201 bp, Homo sapiens
aaagtcccacaattgctgcactctcccttccccaagtgcacagattctctctcagcaccacagtggccactgctgggggatgggagaggagtgaccttggmgtttcaagactgtctttcctaccctcctcagtgcctctttcagtgttatgaagttagggccaggtactgtgagtactcacctgatttttggttcttatga

SEQ ID NO: 12997 - DNA, 201 bp, Homo sapiens
acactgcctggctatcaccgatgttcattcaaggccctagggctctgcagtcagcaggtggcaaagccagccaggcttgtgtctttcccttcagggcaatragttccttcaggccctagcgggtctagagatgctgtgtgggagccagggactggagtaaaaaaccttagaaatttacctgatgctttattctaaggcggc

SEQ ID NO: 12998 - DNA, 201 bp, Homo sapiens
tttctttaaggcatcagattcccttctggcccagggtatatctagaaatgacattcaggggctagatcctggaatgggggtctcttgactctgaccagtgytctatcctgctgtggctgagctggtatccaagatgtaagacaaagtcctctttactctttcctctcctctcctcaagcaaaaggaagaagccacgtttgt

SEQ ID NO: 12999 - DNA, 201 bp, Homo sapiens
gatcatcaccagagtcctacaaatcagacagtcagcttgccccaaactctgttcctagaagctgtgacccagagggagcccttgtccagctatagcccagrgacactgcaccctggacaggactgcacctgttccctcccaggagcctcatctctgtctggcctggctttggcttcaaataccctcagctttggagctttg

SEQ ID NO: 13000 - DNA, 201 bp, Homo sapiens
agccctatttcaaaatgcaatcacataagggattagggctgcagcatatgaatttgggggagacacaattcagtctatagcatttggacttggggagaggraggaacagaacattcagaggaaggactcagtgcaagcaacagtttggaggtgggaaagttcagctcatggatagaaaaaattgatccagtttggcagggc

SEQ ID NO: 13001 - DNA, 201 bp, Homo sapiens
gtttaaacagagtctcactctgttgcccagttagagtgcagtggcgcaaactcggcttactgcaaattctcctgcctcagcctccggagtagctaggattrcagacgtgcgccaccacacccagataatttttgcatttttcatagagatggggtttcaccatgttggctaggctggtcttgaactcctgacctcaggtga

SEQ ID NO: 13002 - DNA, 201 bp, Homo sapiens
caaaaaatcagctgggcatggcacacctgtagtcccagctactcgggaggctgaggcaggggaattgcttgaacccgggaggcagaggttgcagtgagtcraaatcatgccactgcactccagcagcctgtaaacagagcaagactccatctcaaaaaaaaaaaaaagactccacttcttaatactatcacactggggtgt

SEQ ID NO: 13003 - DNA, 201 bp, Homo sapiens
tgctggaattacaggcgtgagccaccgcgcccggctagtgcaaggtttcttaagtggaatcttttttccttaagaaatactgtacttctttcggtgaaagrttaaaatatttctcatgagtagatgaaacatattgctgaagatggtatcgaaaggagaggggagagagaagatactgggtgacatggtacatttctgtag

SEQ ID NO: 13004 - DNA, 201 bp, Homo sapiens
ctgaatctcccaggaacctcaaattttgagtgacttgaattgggttaacaggttaaagaaattgaaaagaacaatgatgatagcgaggtgtttgcaatacsttgaaacctaagcaaaagaaaaaaacaagacagagggtcatgttttatcacatcctctgcatcattttcatttcaggatatttcagattatgactatttc

SEQ ID NO: 13005 - DNA, 201 bp, Homo sapiens
taacccaaatgaggaaacatctggcttatgaagcacatgtttaaggggacagtgaattagcacatgtgaattttagactgtcctgaaaaatccagtacagmacacagacttcctccatggaatccccacaaagaagcagctggggacagttcataccaagctttaagtatcttctctgtctggggccatgtgctcgggacc

SEQ ID NO: 13006 - DNA, 201 bp, Homo sapiens
caagcactttgggaggccgaggcaggcggatcatgaggtcaggagatcgagaccatcctggctaacacggtgaaatcccgtctctactaaaaatacaaaarattagccgagtgtggtggcaggcacctgtagtcccagctactcgggagcctgagacgggagaatggcgtaaatccgggaggcggagcttgcagtgagccg

SEQ ID NO: 13007 - DNA, 201 bp, Homo sapiens
atggcaccatgccatcatccctatatggcatttcaggggattaagtgaacttgtaatgctctgggatagtttattttaaagaaaccaggctgctgggtttwaaaaaaaaacaacagggaaaaaatttgatagtaaaagaattctgtgttgtatattttttgttaggtgggcttaaatagaatgtgcttcagaggaagctca

SEQ ID NO: 13008 - DNA, 201 bp, Homo sapiens
gtttcttaagtggaatcttttttccttaagaaatactgtacttctttcggtgaaagattaaaatatttctcatgagtagatgaaacatattgctgaagatkgtatcgaaaggagaggggagagagaagatactgggtgacatggtacatttctgtagccagcgtttcttcactgctggatggagtggcactcctcgtgaga

SEQ ID NO: 13009 - DNA, 201 bp, Homo sapiens
ttccacaaatacttattgctatttgccaggtccagccctagtcataatacactcaaaatgcatcttaatatgttacacttcacatcttcacagtctgtctscgaggcactaaagttcacaagaaatgctaccttgcttcagaaggtttgaagcatttccatgaggccaatgaagactgcatttccaaaggaggaatcctgg

SEQ ID NO: 13010 - DNA, 201 bp, Homo sapiens
aaggtgcagaccttctcagtgccttgtcccaaaggagacaggaaaatttctgggtcaatttctgggggacgtctttttaaaagaaacattgacaaatcaayaatgtggccaataagagggccccaatgctgggagatgattgttttaggaaatcagcttcatttacaatcccattctcctatatatgggtggtatagaaat

SEQ ID NO: 13011 - DNA, 201 bp, Homo sapiens
aaaagaattctgtgttgtatattttttgttaggtgggcttaaatagaatgtgcttcagaggaagctcaagtggatttctgaaaatctggtgttattaatayggggcaagaagaatgtattaactgagcacactgtttcactagtagatattgagtaactcaattcagttatattttaagataactataatcttattcaatg

SEQ ID NO: 13012 - DNA, 201 bp, Homo sapiens
tgttaggtgggcttaaatagaatgtgcttcagaggaagctcaagtggatttctgaaaatctggtgttattaatatggggcaagaagaatgtattaactgarcacactgtttcactagtagatattgagtaactcaattcagttatattttaagataactataatcttattcaatgtgtagcagaggatagagattttggta

SEQ ID NO: 13013 - DNA, 201 bp, Homo sapiens; identical to SEQ ID NO: 1977

SEQ ID NO: 13014 - DNA, 201 bp, Homo sapiens
cactgtttcactagtagatattgagtaactcaattcagttatattttaagataactataatcttattcaatgtgtagcagaggatagagattttggtaatkgtgacttcctgttttgtcattagttatcattagctgtatttccatatccttggcagcataaggacaacctataccatatatttaaactttttcatgtcag

SEQ ID NO: 13015 - DNA, 201 bp, Homo sapiens
gcaattttccaagatagcattctttaaattcagttttcagcttccaaagattggttgcccataatagacttaaacatataatgatggctaaaaaaaataartatacgaaaatgtaaaaaaggaaatgtaagtccactctcaatctcataaaaggtgagagtaaggatgctaaagcaaaataaatgtaggttctttttttct

SEQ ID NO: 13016 - DNA, 201 bp, Homo sapiens; identical to SEQ ID NO: 1975

SEQ ID NO: 13017 - DNA, 201 bp, Homo sapiens
ttggccaggctagtctcaaactcctgacctcaggtgatgggattgcaggcatgagccatcatacccagcctattcccagagtttttaaaatgcacaattawaatacatatttttaacaaaataagaattggctatgcagaatgtttggctaggcaaataaatttatttcatctattaaaccttggatagttaccagtgtaa

SEQ ID NO: 13018 - DNA, 201 bp, Homo sapiens
ccaaatgaggaaacatctggcttatgaagcacatgtttaaggggacagtgaattagcacatgtgaattttagactgtcctgaaaaatccagtacagaacayagacttcctccatggaatccccacaaagaagcagctggggacagttcataccaagctttaagtatcttctctgtctggggccatgtgctcgggaccaaga

SEQ ID NO: 13019 - DNA, 201 bp, Homo sapiens
gacagatgaaataaagtaaaatagagaaaagaaaatatacagaatactctataaaatatggaataaaataaaatgtgaactgagactagagaatgaagaaraataagtttcaaagacagattagcagaagggatactaaattatagtataaccaggaaagccttctcagaagaggagatatttaagcttgctaagaataca

SEQ ID NO: 13020 - DNA, 201 bp, Homo sapiens
tgaaatcccgtctctactaaaaatacaaaaaattagccgagtgtggtggcaggcacctgtagtcccagctactcgggagcctgagacgggagaatggcgtraatccgggaggcggagcttgcagtgagccgagatggcgccactgcactccagcctgggcgacagagcgagactccaactcaaaaaaaaaaaaaaaaaaaa

SEQ ID NO: 13021 - DNA, 201 bp, Homo sapiens
aattctgccatgtatcttttgagacactctcattggacttgtcctcattcttcagtgggaatccaatttttctcccttcatagctatgtttgaagagcaagtgaaaacaattttgtataccataaagtgtgtattcactagacaatattatgaacacctattatgtaccaagtatcatgttaagcatcagaagaaccaaga

SEQ ID NO: 13022 - DNA, 201 bp, Homo sapiens
ctatgttggccaggctggtctcgaactcctggcctcaagtggtccacccgccttggcctccccaagtgctgggattacaggcgtgagccacttcgccagcsccaagttattttcacgcattattttttgtatacactgggctcaggttcaccaaaaccactattgccttgggtcctacattccaaagcttgattttatttt

SEQ ID NO: 13023 - DNA, 201 bp, Homo sapiens
cacaccaccacatccagctaattttttgtatttttagtacagacggggtttcactatgttggccagactggtcttgaactcttgaccttgtgatccgcccrcttctgcctccctaagtgctgggattataagtgtgagccaccacgccaagcattttttttttaaataaatatttttaaaaataaatattaaataccatct

SEQ ID NO: 13024 - DNA, 201 bp, Homo sapiens
cctggtgatcaccttactcctggaccagaccaccagccacacatccagattaaaagccaggaagcacagcaaacgtcgagtgagaggtaatggggcttctmaatcaagcaaaattctaggcttagacagtgtggggaggtgctggacaatgttaattttcaaactcctccaggagactatcttcggtgatggcaccatgcc

SEQ ID NO: 13025 - DNA, 201 bp, Homo sapiens
ggcacacaccaccacatccagctaattttttgtatttttagtacagacggggtttcactatgttggccagactggtcttgaactcttgaccttgtgatccrcccacttctgcctccctaagtgctgggattataagtgtgagccaccacgccaagcattttttttttaaataaatatttttaaaaataaatattaaatacc

SEQ ID NO: 13026 - DNA, 201 bp, Homo sapiens
aagcactcgttccttgattctttctgtattgtctcaaagaaaaaacaaaggcaaaatgaacttggtccttcagaccttccaaatctgcaaccactgccctycatttgcacctggtcagccaaataagcatgtggaatgcaggaaggcctttccctgggtctaaattcctccctctcggctattcctgtaatgcaagtccat

SEQ ID NO: 13027 - DNA, 201 bp, Homo sapiens
ctaatggaaataattcactttttaaaattttcttttcactgtaaggtacattttcccaagaaagtaatttgcccgggctggagggcagtgatctcgaactsctggggctcaggtgattctcacacctcaacctcccaggtagctggcattacaaatgtgtgccaccatgcctgatgaatttttttatttttttgtagagat

SEQ ID NO: 13028 - DNA, 201 bp, Homo sapiens
cttgaaggaaattcaagccctgcagacaggtaaggtgcagaccttctcagtgccttgtcccaaaggagacaggaaaatttctgggtcaatttctgggggaygtctttttaaaagaaacattgacaaatcaacaatgtggccaataagagggccccaatgctgggagatgattgttttaggaaatcagcttcatttacaatc

SEQ ID NO: 13029 - DNA, 201 bp, Homo sapiens
cccctggatattccagaagacagcttcctaacccaaatgaggaaacatctggcttatgaagcacatgtttaaggggacagtgaattagcacatgtgaattwtagactgtcctgaaaaatccagtacagaacacagacttcctccatggaatccccacaaagaagcagctggggacagttcataccaagctttaagtatctt

SEQ ID NO: 13030 - DNA, 201 bp, Homo sapiens
ttattagaattcaagactctggaaaacagcttagagcaattttaaaatagcaaccagtggaataaacacaccaatggcacagggtggtcagtgaatgtgtkgcaaacagccatttattaaagaaaatgaaaccctggtgacagttttaaaatcatcatcaaaacgctttttgtctaaaagcaatatttttatagcgtctat

SEQ ID NO: 13031 - DNA, 201 bp, Homo sapiens
tatgtttgaagagcaagtgaaaacaattttgtataccataaagtgtgtattcactagacaatattatgaacacctattatgtaccaagtatcatgttaagyatcagaagaaccaagaataataagacagatgaaataaagtaaaatagagaaaagaaaatatacagaatactctataaaatatggaataaaataaaatgtg

SEQ ID NO: 13032 - DNA, 201 bp, Homo sapiens
gacttcctccatggaatccccacaaagaagcagctggggacagttcataccaagctttaagtatcttctctgtctggggccatgtgctcgggaccaagaasgtagaggcaatcactgtgcagaagcaggtaagagggatgaaatgagaacaggcctggagctgggcaaatttaaatcccaattcttcactttactagctgg

SEQ ID NO: 13033 - DNA, 201 bp, Homo sapiens
caaaggagacaggaaaatttctgggtcaatttctgggggacgtctttttaaaagaaacattgacaaatcaacaatgtggccaataagagggccccaatgcygggagatgattgttttaggaaatcagcttcatttacaatcccattctcctatatatgggtggtatagaaataaaaataagtagttcaggaataaatttga

SEQ ID NO: 13034 - DNA, 201 bp, Homo sapiens
aacacaaatccattaatcctccagcaacttaagctattatgatcctaattttacagatgaggaaaatgaggcacaaagaaggtaagtaatttgttcaagakatacacagctagttaaatgtcagagatgagacctaaacccaggcactatgggctctgaggcctgactctccagtgctatggcctaaaactatctttatgc

SEQ ID NO: 13035 - DNA, 201 bp, Homo sapiens
gcttatgcagaaggtgagtttggttcatcctttacccacagtcaggtactagaaattctttataaacacaaatccattaatcctccagcaacttaagctaytatgatcctaattttacagatgaggaaaatgaggcacaaagaaggtaagtaatttgttcaagagatacacagctagttaaatgtcagagatgagacctaa

SEQ ID NO: 13036 - DNA, 201 bp, Homo sapiens
ataaaaataagtagttcaggaataaatttgaaaagtcagtccatacttattctctaaagagtagtgaaacagaatgaagccagtatgaaatgactaaaatsattagcatttattggatgatagctaagtgcctatcaggccaccaggactctctcgggccacacccagcctaagatgctggaaggacatgggttagaaccg

SEQ ID NO: 13037 - DNA, 201 bp, Homo sapiens
tagcatgttgtccggcacatagaaaattgtaactgttgtctcatcattatcatacttcattccacaaatacttattgctatttgccaggtccagccctagkcataatacactcaaaatgcatcttaatatgttacacttcacatcttcacagtctgtctgcgaggcactaaagttcacaagaaatgctaccttgcttcaga

SEQ ID NO: 13038 - DNA, 201 bp, Homo sapiens
tgccatgaagctcttaagaatcttcctgtccaagttattttctttttctttttttccttccttctttccttcattcattgtttttttgtttgtttggtttkttttcagacagagtttcactccctcaccaaggctggagtgcagtggaatgatctttgctcactgcaacctctgcctcccaagttgaagcagttctcatgc

SEQ ID NO: 13039 - DNA, 201 bp, Homo sapiens
aggcagaggcagccatctttcttcctcctccagagctaaccctttccctcgtgcccttgatgccccctccacctcttcctattaccactacttggcaccasccacatattagggctcccttgcaaccactttcaaacaaggccaggctttattccatttcaaaaagcacacaagaaaaccaaaatgcttttgcctgacctt

SEQ ID NO: 13040 - DNA, 201 bp, Homo sapiens
cctctttatattcttaccccagcacaatgcattgtacaacaatgtttgttgatgatgagtgtctgtggcgcatgtgattttgttttgttttgtttttagtyccatggaccaaagacagaggagaatcctgggccagcccctttccatccctacttcccagcccaagcagaaaaggacatcaatgatatctttcttttccaa

SEQ ID NO: 13041 - DNA, 201 bp, Homo sapiens
caggatagaggttcttctataccaacaggcgtgtagcatcaccaggcaccacatacaaaaagtgcaatgctcaggcccgacactccctgagattcagatcmaataattctggggcaggcctggagtttattgttattattattatttatttttattttttagagacaggatcttgctctgtcaacccagctggagtgcagt

SEQ ID NO: 13042 - DNA, 201 bp, Homo sapiens
ctgtgcctggtgagttttcatcttaacagagaagtgggtatatttacactgatgatgatgtacactgattgactaacatgtagtcaatgctgtcttataartgtggcaatagcaatgattagtgtctagtgagccctcactgtgtgccaggcacagtgctaggcaatttacatgaatcatctcatataatcttcccaataa

SEQ ID NO: 13043 - DNA, 201 bp, Homo sapiens
gtcccgctactcggtaggctgaggcgtaagattcgcttgaacctgggaggcggaggttgcagtgagccaagttccccccactgcactccagcctggctgayagagtgagaccctgtctcaaaaataaaataaaataaactaaaaaagataaatttcctgattacacattgtaatacacatgtaattcacatacaaggtgaa

SEQ ID NO: 13044 - DNA, 201 bp, Homo sapiens
aagcagatgggagtcagtgtaaagcataaaacagtcttctaagttaccccaaatccatgtatcttcagtaagatcaggtagagcacaacctggcaatgaaracaagccccagccggggtcttggggttcgtgaaaaccaaggggtctgcacatagctcactcaggggtatgttccagaggaagaagaattcgttgaagaac

SEQ ID NO: 13045 - DNA, 201 bp, Homo sapiens
aaccccagtgcttcttcctgcagcatctattgcattcaaagattagcagccaaaagacctttgtttttagattaaaacacataggtagagaagtgggaggaagcaaatgtggcatgaagtttgggaagagcctcccaaggctgtctgccttggaggcgagtggactgtggaggagtcaggttaggtggctcatggggtggc

SEQ ID NO: 13046 - DNA, 201 bp, Homo sapiens
ccacgatgaggctgcttggcatggaacacagtgtcccatccttagattaaatgcgctctaacaggattatgtaaggaaggaggcagccacggcggcggctrtgtgcaggggtcgcctggaacccgtccattgagtcatgccgccatctcgcggccgcatggggaacgggccttggcagggaggttttgtttggtgcagagg

SEQ ID NO: 13047 - DNA, 201 bp, Homo sapiens
tctgaaactaaaggaggaatacagcttccagagtgaagaagatcaaaggaacactaagctctaccagcagctggtgagtgagccagggtaggagagaattmttttccggtccctgccctcctggtggttaacacggaaggtggccaagcacaagaaagagttacccccttaaaatgactcaggccaactatgtttattttt

SEQ ID NO: 13048 - DNA, 201 bp, Homo sapiens
  misc_feature (1)...(201): n = A,T,C or G, or insertion/deletion polymorphism (see Tables 1-2)
gtatgaagactctgaccgtcgttctgggcaagatccaggggaaaggtttgggttccttcttcatagatatcacccttcagaccaggactttattagatgangtaagtaaatcagaaaaattctgggttattgaaatcaaaatgggcttagaaatatgactgtggggccgggtgcggtggctcatgcctgtaatctcagcac

SEQ ID NO: 13049 - DNA, 201 bp, Homo sapiens
aaaccccagtgcttcttcctgcagcatctattgcattcaaagattagcagccaaaagacctttgtttttagattaaaacacataggtagagaagtgggaggaagcaaatgtggcatgaagtttgggaagagcctcccaaggctgtctgccttggaggcgagtggactgtggaggagtcaggttaggtggctcatggggtgg

SEQ ID NO: 13050 - DNA, 201 bp, Homo sapiens
taaaccccagtgcttcttcctgcagcatctattgcattcaaagattagcagccaaaagacctttgtttttagattaaaacacataggtagagaagtgggaggaagcaaatgtggcatgaagtttgggaagagcctcccaaggctgtctgccttggaggcgagtggactgtggaggagtcaggttaggtggctcatggggtg

SEQ ID NO: 13051 - DNA, 201 bp, Homo sapiens
ggttcattgaagcctttgggccctcttcaagccacccccacccacccagctaagtgctttagaccagatctcaccacccaccctgtaatgtacagtcaagrtcgatggctgtgatgtgttctgattgacggctgtgatgtgttctgaccgatggctgtgatgtgttcagatgcagttgccttttggtaatgatctggcttt

SEQ ID NO: 13052 - DNA, 201 bp, Homo sapiens
atgatctggctttcttattgttttgttgatggggaccgcaggagaacgacagtctgagatactcggcctttgttttgtttgggcaattggctgcctttgcygggaggaaatggaaaaaatttttcaccagtcaggttaagcagacacgagattccctcctgatccatttacaggacagaaatccccaggttgccaaggtaa

SEQ ID NO: 13053 - DNA, 201 bp, Homo sapiens
tccagagtgaagaagatcaaaggaacactaagctctaccagcagctggtgagtgagccagggtaggagagaattattttccggtccctgccctcctggtgkttaacacggaaggtggccaagcacaagaaagagttacccccttaaaatgactcaggccaactatgtttatttttttattttttctttttttctgagaaga

SEQ ID NO: 13054 - DNA, 201 bp, Homo sapiens
tctcccttcccctgcccaaaccattaaagaacacaatattgtttattacagtgctatggtggctatcctttgtgtatatctttgaacatatgatgtgttcmtatctataggattaaagaattgcctattacgtgtgctttaaagtggtaagagatagtgccaaatcctctctaaaaagaggtactgatttacattctcaga

SEQ ID NO: 13055 - DNA, 201 bp, Homo sapiens
tggcaaaacgcctagaggatcaagcacgagatatatcggcagttccaattcaggtcactagctggatacagatgatgcctccacctctcctgcttatccacatgccctgcactgatcactgcctactagttacattgtcaaggaagtttgttgaatcctgccctcacgcgtacctttgctaatttctttcagagccactat

SEQ ID NO: 13056 - DNA, 201 bp, Homo sapiens
tgaggcatgagggtcatttgagcacaggagttggaggccagcctgggcaatgtagcaagatgttgtctctaaaacaaaaacaaaaacaaaaacaaaaaaaracaaaaaccctaagacaatttctgtatgcatcatgtgctaaattttttaaagatacttcacaatatgattagtgttcctcagtcttgctgggtctctgtg

SEQ ID NO: 13057 - DNA, 201 bp, Homo sapiens
cactcactaatagagccatgaagataatacaaccctaagccaggcatggtggtgtgtgcctgtaatcccagctacttaggaggctgaggcatgagggtcayttgagcacaggagttggaggccagcctgggcaatgtagcaagatgttgtctctaaaacaaaaacaaaaacaaaaacaaaaaaagacaaaaaccctaagac

SEQ ID NO: 13058 - DNA, 201 bp, Homo sapiens
aagtaaatcagaaaaattctgggttattgaaatcaaaatgggcttagaaatatgactgtggggccgggtgcggtggctcatgcctgtaatctcagcacttygggaggccgaggcgggtgggatcacgaggtcaggagatcgagaccatcctggccaacatggtgaaaccctatctttactaaaatacaaagaactagctgg

SEQ ID NO: 13059 - DNA, 201 bp, Homo sapiens
gttgtcagactcctagcggggcgagcatctgtcttacgtgtctgtacatcttaaagcattagggtatggctttgaatggggtacattctccattaaaattwgttaaacacacacacacacacacacacacactacacacacacatacacaaacactcactaatagagccatgaagataatacaaccctaagccaggcatgg

SEQ ID NO: 13060 - DNA, 201 bp, Homo sapiens
tgttcatggggaggaggggatgtaaatttcagttctgattcacaaaggagattttgcagagaatctttacaatcatactttgggcttcctttctccagtckcctctgttcttcggataatcttattacctttttggtcattctaagcactacatggattagttcagtatatagattatggccgtataaacctcattctcgc

SEQ ID NO: 13061 - DNA, 201 bp, Homo sapiens
acaaactatgttaatcgatcaatagttgggttatagatcattctattgtcagcaatataatagaatggcagggactcagggaagatattgacactttaaamtgaaatgtctatgcggtctgtcttccctcgttcagctcacaggacattgcctgggagctgaacctaggcttatagcacagtgactgaaaggatatctttc

SEQ ID NO: 13062 - DNA, 201 bp, Homo sapiens
ttacaggtgtgagccactgcacccacctctggcttggagtttgtaacacgtaccccggggaattctgatatagaaggtgcaaccaacactgagaaatgctytacttttcctgcacccaagattgagatgatccctgacaacctgtaagattaaaccacatcacagtttttctcttgtgatggggaggtagggtttgctaga

SEQ ID NO: 13063 - DNA, 201 bp, Homo sapiens
actttaaactgaaatgtctatgcggtctgtcttccctcgttcagctcacaggacattgcctgggagctgaacctaggcttatagcacagtgactgaaaggwtatctttcagagtcctaaaatctgctctgccagtatttgactttgagttaattgttcaacattactttaagcccagtttcttcttttctaaaatgaagac

SEQ ID NO: 13064 - DNA, 201 bp, Homo sapiens
atatctttcagagtcctaaaatctgctctgccagtatttgactttgagttaattgttcaacattactttaagcccagtttcttcttttctaaaatgaagasgatttttttaatattaattttttttttcatttttttgagacagggtcttgttgtgttgcccaagctggggtgcggtggcccgatctcggctcactgcaac

SEQ ID NO: 13065 - DNA, 201 bp, Homo sapiens; identical to SEQ ID NO: 1986

SEQ ID NO: 13066 - DNA, 201 bp, Homo sapiens
ccaaaggtaatgttttgacatttcttaattttgaacattaattttgaaccttattgagcagttgaatgaaagaaagaaaaaaggaatgttcaagtgccccraccctcatgctaagtgcccagggtagagctttgcttggtccctgtgtctctggtgctcatgagataggtctttctttctttatttttatttttgagatgg

SEQ ID NO: 13067 - DNA, 201 bp, Homo sapiens
tacagatgatgcctccacctctcctgcttatccacatgccctgcactgatcactgcctactagttacattgtcaaggaagtttgttgaatcctgccctcasgcgtacctttgctaatttctttcagagccactatcatccagagatcctgcagttcttctacgcaaataaaattctgtaagcgcagagcagcagggaaatg

SEQ ID NO: 13068 - DNA, 201 bp, Homo sapiens
ggattatggaactctctaataaataaaatagtaatattatttttctcaggcttgcaaaacaacatttcaagcctgttctccatatctgaaactaaaggagraatacagcttccagagtgaagaagatcaaaggaacactaagctctaccagcagctggtgagtgagccagggtaggagagaattattttccggtccctgcc

SEQ ID NO: 13069 - DNA, 201 bp, Homo sapiens
tttataagttcagtgttggaaggatttttaagcaatctaacagtttcttctgctcattttacagatgagataaaatcaaagtgttttataattttggccttcataatataccttttggcttcaataaataaaaggattattgaccaaaaatctaatattttgagtcagaatcattcaagtttgcaaaagcagatgggagtc

SEQ ID NO: 13070 - DNA, 201 bp, Homo sapiens
gtcctctactggttgattctccttgagagcgcagtccgagtgttggtcccacctgccgagcactctgcctccatggaagcaggatctcagtaaacactggragaaagaaggaaagaatgagaagctgctaaacccaacctgtggctaaggaggtggctgattttacttctttttagaagtgaaaatcaagacagagtttag

SEQ ID NO: 13071 - DNA, 201 bp, Homo sapiens
ggaggtagaagctgcaatgagctgtgttcctgccactgcactccagcctgggagacagagcaaaaccctgtctcaaacccctgccccactctcccttcccytgcccaaaccattaaagaacacaatattgtttattacagtgctatggtggctatcctttgtgtatatctttgaacatatgatgtgttcatatctatagga

SEQ ID NO: 13072 - DNA, 201 bp, Homo sapiens
ttatcctggacagaccctgcgtcacctcctaatttcccttcttgtatgttaggaattcagggctgggaaaatttagccgagtcatcacatttggctactamccgggaaagcagccctcccgagtcaggaacgggctccggttcatcacgtggcagccgcctgcaggagccgcaggtaagggacactgttggccggggcagc

SEQ ID NO: 13073 - DNA, 201 bp, Homo sapiens
tatatttttctgtttatctcctgggttttctagaccagtccagtgcatagcatcatggctgagtccaagctcttacattagcctgcctgtagctgaatttyaactgccacaaattaactgcatgacctttgtcaaggtaatctccctgtgcctcagtttctccagccttaaaatggagactatagtaggagtattaacctt

SEQ ID NO: 13074 - DNA, 201 bp, Homo sapiens
tatagatttccacccatggcttcttttcttttctgttcttttctcttttctttccttccttccttctttccttccttcctttcttccttcgttctttcttyctttttttttttttgagacagttttgctcttgttgcccaggctggagtgcagtggtgtgatctcggctcactacaacttccgcctctggggttcaagcaa

SEQ ID NO: 13075 - DNA, 201 bp, Homo sapiens
tacatcttaaagcattagggtatggctttgaatggggtacattctccattaaaatttgttaaacacacacacacacacacacacacactacacacacacayacacaaacactcactaatagagccatgaagataatacaaccctaagccaggcatggtggtgtgtgcctgtaatcccagctacttaggaggctgaggcatg

SEQ ID NO: 13076 - DNA, 201 bp, Homo sapiens
aaaaaaaaaaaaaagataagataaaaaaggaatgaactgtaatgaaaatccaggaatactaatgaagctttgaaatcaccaaatctcatccatagcaccamtgagatagctgaatctcaagccagtctgcccctctaggcccctttctaaggatggtagggaggtggcttttgtcttctttgatcttgtctggatatttcg

SEQ ID NO: 13077 - DNA, 201 bp, Homo sapiens
ctctgtgggcagagcctgggaatctgcgttttacttctttggtgacagtgataaaagaaatctgcagaatggagtggggaactagagggcagatccccctygacccccaagctgctattcctcttgggctgccttgggttgctattcatctgtgtgactgttctatctcaccacagtggaaggttcctaaagacaggcctc

SEQ ID NO: 13078 - DNA, 201 bp, Homo sapiens
ccaccctgaagtgtaagcagatgtctccggggagatggctctaaatctcttggaggagccatctgaacttcgaggacttgtttgtcattcaaccacttttwtttttttttttgagacagggtctcgctgtattgcccaggctggagtacagtggcaggaacacagctcactgcagcctcaacctcccaggctcaactgatc

SEQ ID NO: 13079 - DNA, 201 bp, Homo sapiens
atcacacccatagctgctctagagcctctccccttaatctcctaaacctacctcaacaccagcctgcactatctttattgccctctttctccatcaatttyttcgttatgtagaccaaatgagtacatttccaacaaaacccagccgtctttagtaggagaaagaaggggtaaaattgagcaggcaatcacgggattttct

SEQ ID NO: 13080 - DNA, 201 bp, Homo sapiens
agatgagaatgatccttttgtttttgttggattgggtgtaaaggacttcatgttttagaaaggagggaggcactgcaggcaggaaggagggcatggggcgsggggtgggagttctttaagaagctgcaagtacaagaaacacaaggctccagcgaggggccttgtgaccttgatttaactcctaatttgttttatttttta

SEQ ID NO: 13081 - DNA, 201 bp, Homo sapiens
ggaaaacagtttggtggttcttcaaaaagttaaacatagaattaccatatgatggccaggctaggtggctaacgcctgtaatcctgacacttgggaggctraggtaggcagatcacttgaggtcaggaattcaagaccagcctggccaacatgctgaaaccccgtgtctactaaaaatacaaaaattatccaggcatggtg

SEQ ID NO: 13082 - DNA, 201 bp, Homo sapiens
  misc_feature (1)...(201): n = A,T,C or G, or insertion/deletion polymorphism (see Tables 1-2)
aacatatgatgtgttcatatctataggattaaagaattgcctattacgtgtgctttaaagtggtaagagatagtgccaaatcctctctaaaaagaggtacngatttacattctcagagaacttttaaaaacacaaaatttgaggctactctgtatttcaattcatgagaactctgtgggcagagcctgggaatctgcgttt

SEQ ID NO: 13083 - DNA, 201 bp, Homo sapiens
gatgtgttctgaccgatggctgtgatgtgttcagatgcagttgccttttggtaatgatctggctttcttattgttttgttgatggggaccgcaggagaacracagtctgagatactcggcctttgttttgtttgggcaattggctgcctttgccgggaggaaatggaaaaaatttttcaccagtcaggttaagcagacacg

SEQ ID NO: 13084 - DNA, 201 bp, Homo sapiens
tactaaaatacaaagaactagctgggcatggtggtgcacgcctgtagtcccagctagtcgggaggctgaggcaggagaatcgcttgaacttgggaggtggmggttgcagtgagccgagatcacgccactgcactccagcctggcaatagagcaagactccctctcaaataaaaaaagaaagaaagaaatgtgagctgcggg

SEQ ID NO: 13085 - DNA, 201 bp, Homo sapiens
gtggcatgaagtttgggaagagcctcccaaggctgtctgccttggaggcgagtggactgtggaggagtcaggttaggtggctcatggggtggctagctggmgggctttcatggcctcgtgttctcgctgggcctgcctcctgggaggcatttctcatatgcctctctgtctaacaggtttcactaagcgcaggagtagatg

SEQ ID NO: 13086 - DNA, 201 bp, Homo sapiens
tttctttagagggagagattggggttgggattggtatgactctgaacactcccaaattaatacatttttgacccatcacccaggtctcttggaaactgagsttccagaagcgggagcctctgaagaatgtgtttttcatcttggcagaaagagctcgggaccccagtgctaaaaagcgtcacatggcaatgagaaacttgg

SEQ ID NO: 13087 - DNA, 201 bp, Homo sapiens
gcagaaagagctcgggaccccagtgctaaaaagcgtcacatggcaatgagaaacttgggaaccatggcctatgaagcccctgacaaggtagggaaggagaktggggctcagccagctccccaagcctctccaaccaccttggtgtggagactcccagggctggagtatggtgtctgttgtattagttatctatcaccccgg

SEQ ID NO: 13088 - DNA, 201 bp, Homo sapiens
ttagaaacaatttgttccttttcagcgaggatcatctccatgtagcagggggatctctcatatgggttaatctgaccatgagctctgtaaatatggtgtayatcttggctttgctcaactgaatgtgctcaatgatccaagaatctacctctaaaccctgaagttcagcattgttctctgcatttttaagcacatgcagca

SEQ ID NO: 13089 - DNA, 201 bp, Homo sapiens
cttaatctcctaaacctacctcaacaccagcctgcactatctttattgccctctttctccatcaatttcttcgttatgtagaccaaatgagtacatttccracaaaacccagccgtctttagtaggagaaagaaggggtaaaattgagcaggcaatcacgggattttctttagagggagagattggggttgggattggtat

SEQ ID NO: 13090 - DNA, 201 bp, Homo sapiens
cctccaaccctcaagtaggccctggtgtctgtggccttctttgtgtccacaagtactcaacatttagctcccacttataagtgagaacatgagaacatgcygtacttggttttctgttcctgtgttagtttgcttaggataatgacctccagctccatccttaatgtgaattttaaaatccctttattctggagagaagct

SEQ ID NO: 13091 - DNA, 201 bp, Homo sapiens
ccctgtgaatttggaagtcatccatgagagtatgaagactctgaccgtcgttctgggcaagatccaggggaaaggtttgggttccttcttcatagatatcrcccttcagaccaggactttattagatgatgtaagtaaatcagaaaaattctgggttattgaaatcaaaatgggcttagaaatatgactgtggggccgggt

SEQ ID NO: 13092 - DNA, 201 bp, Homo sapiens
gccaccgtgactggttcataacttctgtggtttcaatcttgtcactcttttcaaaggagtctctcaaattatattcttctgtctcttccttattacttccygacaaacattttctttactgttggatgggcaccaggctttacagaaccctctctagagacagctgtctttggttccgctatatgcccatcaaccttatgt

SEQ ID NO: 13093 - DNA, 201 bp, Homo sapiens
tatcacccttcagaccaggactttattagatgatgtaagtaaatcagaaaaattctgggttattgaaatcaaaatgggcttagaaatatgactgtggggcygggtgcggtggctcatgcctgtaatctcagcactttgggaggccgaggcgggtgggatcacgaggtcaggagatcgagaccatcctggccaacatggtga

SEQ ID NO: 13094 - DNA, 201 bp, Homo sapiens
catgtagaaacacagaaattcttatgcagagctgtttgctgatagtttacatctccattacagatagcactcttcactatctgaggccatgaagctcaccygtgcgtgtgttcccagttagatggttgtcagactcctagcggggcgagcatctgtcttacgtgtctgtacatcttaaagcattagggtatggctttgaat

SEQ ID NO: 13095 - DNA, 201 bp, Homo sapiens
tggtctcgaactcctgagctcaagtcatctgcccacctcagcctcccaaagtgctgaaattacacgcgtgagccaccgtgactggttcataacttctgtgstttcaatcttgtcactcttttcaaaggagtctctcaaattatattcttctgtctcttccttattacttcccgacaaacattttctttactgttggatggg

SEQ ID NO: 13096 - DNA, 201 bp, Homo sapiens
ccttcagaccaggactttattagatgatgtaagtaaatcagaaaaattctgggttattgaaatcaaaatgggcttagaaatatgactgtggggccgggtgyggtggctcatgcctgtaatctcagcactttgggaggccgaggcgggtgggatcacgaggtcaggagatcgagaccatcctggccaacatggtgaaaccct

SEQ ID NO: 13097 - DNA, 201 bp, Homo sapiens
tcctgggttcaagcaattctcctgccttaacctcccaagtagctgggattacaggcacgtgccaccatgcccagctaatttttgtatttgtagtagagacsggggtttcaccatgttggtcaggctggtctcgaactcctgagctcaagtcatctgcccacctcagcctcccaaagtgctgaaattacacgcgtgagccac

SEQ ID NO: 13098 - DNA, 201 bp, Homo sapiens
accctcaaaactattctgttaaagtgtctgttcagaaatgtggaaaaactgaactatataaatattgaaaagttaaaaattccttaattttttattcttgraaccactaccacaatttacagggcaatatacctgatgtaatgaaaagaaaaagaaaaagaaaaagctatagcagataaaagaccatagggatgttcatct

SEQ ID NO: 13099 - DNA, 201 bp, Homo sapiens
tgtagcatcaccaggcaccacatacaaaaagtgcaatgctcaggcccgacactccctgagattcagatccaataattctggggcaggcctggagtttattrttattattattatttatttttattttttagagacaggatcttgctctgtcaacccagctggagtgcagtggcgcaatcatggcttacggcagcctcagac

SEQ ID NO: 13100 - DNA, 201 bp, Homo sapiens
gagaatgatccttttgtttttgttggattgggtgtaaaggacttcatgttttagaaaggagggaggcactgcaggcaggaaggagggcatggggcggggggtgggagttctttaagaagctgcaagtacaagaaacacaaggctccagcgaggggccttgtgaccttgatttaactcctaatttgttttattttttaatga

SEQ ID NO: 13101 - DNA, 201 bp, Homo sapiens
acagatgagaatgatccttttgtttttgttggattgggtgtaaaggacttcatgttttagaaaggagggaggcactgcaggcaggaaggagggcatggggvggggggtgggagttctttaagaagctgcaagtacaagaaacacaaggctccagcgaggggccttgtgaccttgatttaactcctaatttgttttattttt

SEQ ID NO: 13102 - DNA, 201 bp, Homo sapiens
aacagatgagaatgatccttttgtttttgttggattgggtgtaaaggacttcatgttttagaaaggagggaggcactgcaggcaggaaggagggcatggggcggggggtgggagttctttaagaagctgcaagtacaagaaacacaaggctccagcgaggggccttgtgaccttgatttaactcctaatttgttttatttt

SEQ ID NO: 13103 - DNA, 201 bp, Homo sapiens
tcaggtgtttaggttactatactggctctgttacctgacagtgtgattttgggcaagttccttaagtgccttgggccttggtctcctcacctggaaatgtratacttggaccaaacagctcaccttggaaagaaagagagggcggagtccactgaaatgcactcagggacaaaccaaccaatcagactggaagcagggaga

SEQ ID NO: 13104 - DNA, 201 bp, Homo sapiens; identical to SEQ ID NO: 1999

SEQ ID NO: 13105 - DNA, 201 bp, Homo sapiens; identical to SEQ ID NO: 2000

SEQ ID NO: 13106 - DNA, 201 bp, Homo sapiens
tccagcaagactgtcaattctgtttaccacccacaggcctgaagataaagccaaggggctggcggtcctgattgacgccaggagacagcccccacagcccrgtctggtcagcgccctgcaggccacccaggtgagtgggaggtggagagccttagcctagtaagtcctgggagccaccaggggcctcctgacattcataga

SEQ ID NO: 13107 - DNA, 201 bp, Homo sapiens
ggctcgtctcaccttcttccttttcagcctcacacccgctggctcctgcctgggaacagcctggctcctgcctggccgggctgcgggctgtgttcactggkaaggaatggaaacacatctattaagtttcatggaaatcatgctgaggggcccacgtctggtgtttgggttcctgtggtcccaggctgggctgccgggtgg

SEQ ID NO: 13108 - DNA, 201 bp, Homo sapiens
tgtctccatacaggggaactgttttcttcttccttctttctttcttgcctattaaactttctgctccttaaaaccacacacacacacacacacacacacasacacacacacacacacacacacaccataataataataataataataatatgaccacagaaattgtagtgatggctcttacttaatgagcacctactaaat

SEQ ID NO: 13109 - DNA, 201 bp, Homo sapiens
aaggtgacctttgttttagttctaactctatcattagctccctgtgtgtccttggagaagtcactgccctctctgggcctccttgagaggaggagaatagrcagataggacctggctcactgtcactcttccctcagttacttttgttgtaattcttgggggttgcaacatgcactgttagctcgcacatgcctgatgtgt

SEQ ID NO: 13110 - DNA, 201 bp, Homo sapiens; identical to SEQ ID NO: 2009

SEQ ID NO: 13111 - DNA, 201 bp, Homo sapiens
tccatattaattgtacacaaaggatctcatgatcctcttagggccatcatgggccaagggctcagattttgtccatggaaggctctgctatgggaggaagrtgacctttgttttagttctaactctatcattagctccctgtgtgtccttggagaagtcactgccctctctgggcctccttgagaggaggagaatagacag

SEQ ID NO: 13112 - DNA, 201 bp, Homo sapiens
attgtcctgaaatactattttacttcacagacttccatatctcttcaggaccttgagcactgccctgtctttttgcagctcccaggagaccttatctgtcmttttcctggtcatctttgctgaagctcctgctgtttgttccatattaattgtacacaaaggatctcatgatcctcttagggccatcatgggccaagggct

SEQ ID NO: 13113 - DNA, 201 bp, Homo sapiens; identical to SEQ ID NO: 2011

SEQ ID NO: 13114 - DNA, 201 bp, Homo sapiens
gtggaaggattgctggagcccaggaagtcaagactgcagtgagccgagatagcaccactgcactccagtctgggcaacagagcaagatcttgtctttaaaaacaaacaaacaaacaaacaaacaaaaaggccaagcacggtggctcatccctgtaattccagctactcgggctgaggcaggagaatcgcttcaacccagga

SEQ ID NO: 13115 - DNA, 201 bp, Homo sapiens
gaacagcatgtgcaaaggtccagagacaagagaaccacagtgctttctggagactgattgtcctgaaatactattttacttcacagacttccatatctctycaggaccttgagcactgccctgtctttttgcagctcccaggagaccttatctgtcattttcctggtcatctttgctgaagctcctgctgtttgttccata

SEQ ID NO: 13116 - DNA, 201 bp, Homo sapiens
ggcttagggtagtagaggtcaaggatgacttcccggaggaagtaacgtaaagcccagtcctatggtatgagtaggaattatccaggtgaagagttgggaayggcgttccagacaaagggaacagcatgtgcaaaggtccagagacaagagaaccacagtgctttctggagactgattgtcctgaaatactattttacttca

SEQ ID NO: 13117 - DNA, 201 bp, Homo sapiens
tggaaggattgctggagcccaggaagtcaagactgcagtgagccgagatagcaccactgcactccagtctgggcaacagagcaagatcttgtctttaaaaacaaacaaacaaacaaacaaacaaaaaggccaagcacggtggctcatccctgtaattccagctactcgggctgaggcaggagaatcgcttcaacccaggag

SEQ ID NO: 13118 - DNA, 201 bp, Homo sapiens
gcaacagggaatgaaagaaaagtctgttttcggaggatttcagcccagctccagacagatacaagagccccaggcagattcacaggggctgtaaggatttkgaaaaaagctgtgaagacaggccaaggctttaaccctgtgactgtgaccaaccatgttgaatttgtgtgggttttcactcacagcaaatgcatctccaca

SEQ ID NO: 13119 - DNA, 201 bp, Homo sapiens
ggaaggattgctggagcccaggaagtcaagactgcagtgagccgagatagcaccactgcactccagtctgggcaacagagcaagatcttgtctttaaaaacaaacaaacaaacaaacaaacaaaaaggccaagcacggtggctcatccctgtaattccagctactcgggctgaggcaggagaatcgcttcaacccaggagg

SEQ ID NO: 13120 - DNA, 201 bp, Homo sapiens
ggcaggagaatcgcttcaacccaggaggcggaggctgcagcaagcagagatcggaacactgcactccagcctgggcaacagagcaagactctgtctcaaaaataataataataataataataataataataaagagaagacaagaaaaggaaaagaaaaattgtgattcagagagggacattttgtttcttctgccataaa

SEQ ID NO: 13121 - DNA, 201 bp, Homo sapiens
agagaaagaggagacgttttccccttagaaagcccatcttctgcttaacgtccttttctttgttgttgctttttcccagctggaacaactcagaccaaaayatctggcccagccactgcccccagcccactgactgaggaaaaggctgccttgccagaagcttctgcaggctccccagaaagaggccccaccctggaggag

SEQ ID NO: 13122 - DNA, 201 bp, Homo sapiens
gcaggagaatcgcttcaacccaggaggcggaggctgcagcaagcagagatcggaacactgcactccagcctgggcaacagagcaagactctgtctcaaaaataataataataataataataataataataaagagaagacaagaaaaggaaaagaaaaattgtgattcagagagggacattttgtttcttctgccataaaa

SEQ ID NO: 13123 - DNA, 201 bp, Homo sapiens; identical to SEQ ID NO: 2042

SEQ ID NO: 13124 - DNA, 201 bp, Homo sapiens
caggagaatcgcttcaacccaggaggcggaggctgcagcaagcagagatcggaacactgcactccagcctgggcaacagagcaagactctgtctcaaaaataataataataataataataataataataaagagaagacaagaaaaggaaaagaaaaattgtgattcagagagggacattttgtttcttctgccataaaat

SEQ ID NO: 13125 - DNA, 201 bp, Homo sapiens
gaggggtaacactagaagtaaggggcttagcgcaatgcctggcacatgggagagatcaatagttgtaagctattattagtcagaaagagaaagaggagacrttttccccttagaaagcccatcttctgcttaacgtccttttctttgttgttgctttttcccagctggaacaactcagaccaaaacatctggcccagccac

SEQ ID NO: 13126 - DNA, 201 bp, Homo sapiens
cgccatcttggctcactgaaacctccatctcccaggttcaagcaattctcatgccttggcctcccgagtagctgggattacaggcatgcatcaccacacckggctacttttttgtatttttagtaaagatggggttttgctatgttggccaggctggccttgaactcctgacctcaagggatccacccacctcagcctccc

SEQ ID NO: 13127 - DNA, 201 bp, Homo sapiens; identical to SEQ ID NO: 2014

SEQ ID NO: 13128 - DNA, 201 bp, Homo sapiens
ggtttgagaccagcctggccaacatggtgaaaccccgtctctactaaaaatacaaaaattagccgggcgtggtggcacatgcctgtagtcccagctactcrggaggctgaggcaagagaatcgcttggaggcaggagaatcgcttgaacccaggaggcagaggttgcagtgagccaagatcacgccattgcactccagcct

SEQ ID NO: 13129 - DNA, 201 bp, Homo sapiens
agagatttggaggtaccttgcccagtgccacagtgaggggcagagctggacttgatctgggcctagtttattgactttgcccaaatatgcccacagtaggggcatggcatggcatggcctcccccagagattccctgcgagtgatgacatagctttgaatcagcaaagcctcagcccctgagagactgctctgaggaggca

SEQ ID NO: 13130 - DNA, 201 bp, Homo sapiens
gagatttggaggtaccttgcccagtgccacagtgaggggcagagctggacttgatctgggcctagtttattgactttgcccaaatatgcccacagtaggggcatggcatggcatggcctcccccagagattccctgcgagtgatgacatagctttgaatcagcaaagcctcagcccctgagagactgctctgaggaggcag

SEQ ID NO: 13131 - DNA, 201 bp, Homo sapiens
cgcctggaagctgccattcaccaggtgaaaggggtgtctggcttggggtgtgggggttctgcctggccacattccacaggaaagccccgactctgggcccrtccctagtcaggtgctttgttctggagaaaggacaccaagctggcgatccttcaaaggccaggcaggcatccttggggcgtagcacatgacctggtgctc

SEQ ID NO: 13132 - DNA, 201 bp, Homo sapiens
gttcatactctctctctctctctctcacacacacacacacacacacgcaggcactcacacacacgtacacatgcacacacacgtacacatgcacacacacatacacatgcacgcacagagcacacctgaatgctcccactgactcacacagctgaacacatgttcacaccctctcatacacccatgccttctgcacctgct

SEQ ID NO: 13133 - DNA, 201 bp, Homo sapiens
aatcatggtatccccactggcctgggagtcgctcaggcctgtctcctttcttctccctcactcatactcaacaccagtggttctcaaagtgtggttccccmggccagcagcatcagcaacacctgggaacttgttagaaatgcactttctaccatgcctcgccccagaggaactgaagcagaacctcaggagcagagccca

SEQ ID NO: 13134 - DNA, 201 bp, Homo sapiens
tcagctgctgttgggtggaggggaggcagggaatgccctggaggcctaggttctagaccaagcctccttgggcctcagtttcctcatctttcccatgggasaattggaatagatgaaagcaatttgttggcatccatccacccatctatctgtctgtccatctgtctacttgtccatccatcagtgaagcagccaaggtgg

SEQ ID NO: 13135 - DNA, 201 bp, Homo sapiens
tccatacaggggaactgttttcttcttccttctttctttcttgcctattaaactttctgctccttaaaaccacacacacacacacacacacacacagacasacacacacacacacacacaccataataataataataataataatatgaccacagaaattgtagtgatggctcttacttaatgagcacctactaaattcta

SEQ ID NO: 13136 - DNA, 201 bp, Homo sapiens
gaatgccctggaggcctaggttctagaccaagcctccttgggcctcagtttcctcatctttcccatgggacaattggaatagatgaaagcaatttgttggyatccatccacccatctatctgtctgtccatctgtctacttgtccatccatcagtgaagcagccaaggtggatactgggttccccagaagcagagcctgag

SEQ ID NO: 13137 - DNA, 201 bp, Homo sapiens
atttgtgtgggttttcactcacagcaaatgcatctccacaagcagaagaattccatatagaggtgttcatactctctctctctctctctcacacacacacrcacacacacgcaggcactcacacacacgtacacatgcacacacacgtacacatgcacacacacatacacatgcacgcacagagcacacctgaatgctccc

SEQ ID NO: 13138 - DNA, 201 bp, Homo sapiens; identical to SEQ ID NO: 2008

SEQ ID NO: 13139 - DNA, 201 bp, Homo sapiens; identical to SEQ ID NO: 2010

SEQ ID NO: 13140 - DNA, 201 bp, Homo sapiens
gaggaagggagcatgagccaagcaaggggaccacttgggaaagccgattgctaactagtgcatggtgctctgagctttctcacttgggtcagtaggctagratttccaaggtcagggccaggacgagggtggggcaggagagtcaacctttgcacaaccttgacagtgagtgcctcctaaatgctgcctcatcctagtccc

SEQ ID NO: 13141 - DNA, 201 bp, Homo sapiens
gtacattaaatgcatttttgacttatgatagtttcaatttatgatggatttaccaggatataaccccaccataaattgaggccatctgtataatctcactkaatcctcataccaacccagtaatactgacatgtattattatcctatttgcagatagggaaattggggctcaaagaagttaagcaatttgcacaaattagc

SEQ ID NO: 13142 - DNA, 201 bp, Homo sapiens
accagaccagtgagttgctaaggcaatagggagccacccgaggttgttgagcagtggagggtcacagttggatctctgtgttaggaagcccactatgatgrctaagaggagcctggcgtggtagcagggagcccggggaaagagacaggacagctggtggttatgtgcccagggtcataccccagtgctaccatttagtag

SEQ ID NO: 13143 - DNA, 201 bp, Homo sapiens
ggcgtcattggaggtcattctacccattacacctgcctttagatgggaaccgctgtaataggggtactataggatcccagaaaaggggacacctgatctcmctggggtagttgggggcacccaagaaaatctcctggaggagttgacagctgacctgagtcttgaatgaggagttggccaggtgaggaggggtggaagtga

SEQ ID NO: 13144 - DNA, 201 bp, Homo sapiens
aatttcccggtgataacaggtgctgggcctgggactacactttaagaaccactgttgtagagtaagaagaataggggatgttaatttcaattgggaaatcrgggaaggcttccctgaggaggtgataattgagctgtcatctgaattataaatatttgaataaacaaaggaaaggggtgaatgagtaaatgaatgaatgag

SEQ ID NO: 13145 - DNA, 201 bp, Homo sapiens
agatttggaggtaccttgcccagtgccacagtgaggggcagagctggacttgatctgggcctagtttattgactttgcccaaatatgcccacagtaggggcatggcatggcatggcctcccccagagattccctgcgagtgatgacatagctttgaatcagcaaagcctcagcccctgagagactgctctgaggaggcaga

SEQ ID NO: 13146 - DNA, 201 bp, Homo sapiens
caccataataataataataataataatatgaccacagaaattgtagtgatggctcttacttaatgagcacctactaaattctagtcctgtgcagagaattygcatgtattacctcaatacacccaatcttgatcaactccttaaggtgggtgtaattacagtctccattttacagatgaggaaactgaggcacaacgagtt

SEQ ID NO: 13147 - DNA, 201 bp, Homo sapiens
tgccatcggggggttgtcaggctggtgggagagatggacagagtgcaagaaacaaaccatggccaagaaactttcaggagtgtcagtgtgatgaagaaaasagtgatgtttgtagatcagtggttttcattttttttttttttttgaaatggagtttcactcttgttgcccagactggagtgcaacaatgcaatctcagct

SEQ ID NO: 13148 - DNA, 201 bp, Homo sapiens
gatttggaggtaccttgcccagtgccacagtgaggggcagagctggacttgatctgggcctagtttattgactttgcccaaatatgcccacagtaggggcatggcatggcatggcctcccccagagattccctgcgagtgatgacatagctttgaatcagcaaagcctcagcccctgagagactgctctgaggaggcagag

SEQ ID NO: 13149 - DNA, 201 bp, Homo sapiens
gacagtgatcattgtaacgaccaacgattgagcaactcaatcattcactgagctcttgctgtgtattaagtgcttctcaggagctgtctgatttcatcctygaaataacctaataagctcagcatattattctccctgtttaacagatgaggaaactgaagctcagaggtgcactgacttgcccacagacacatagtgagt

SEQ ID NO: 13150 - DNA, 201 bp, Homo sapiens
atttggaggtaccttgcccagtgccacagtgaggggcagagctggacttgatctgggcctagtttattgactttgcccaaatatgcccacagtaggggcatggcatggcatggcctcccccagagattccctgcgagtgatgacatagctttgaatcagcaaagcctcagcccctgagagactgctctgaggaggcagagg

SEQ ID NO: 13151 - DNA, 201 bp, Homo sapiens
ccccaaagaggaaaagaagccagtgcttactgtacctgcctcctgttgccaccgtagcaaatgatcatgcactttagtttcaagctacacaagtatagtaycttgcaggtaataaaagatcagaggcctgacatgcatttcactgggccaaaaacaaagtcttggcagggctatttctcttctggaggctctaggggagaa

SEQ ID NO: 13152 - DNA, 201 bp, Homo sapiens
aaatttatgaagcacctgtttgtgcctggtcctgtgcagacaccgaggccccaaagaggaaaagaagccagtgcttactgtacctgcctcctgttgccacygtagcaaatgatcatgcactttagtttcaagctacacaagtatagtaccttgcaggtaataaaagatcagaggcctgacatgcatttcactgggccaaaa

SEQ ID NO: 13153 - DNA, 201 bp, Homo sapiens
cgtcctgggtcaggtgttccgtctcctggactctggcttccagggggatgggctgagcttccttctggatttcctgatccctgccaagcgcctgtgtgagmaagtgcgagaagcagcctgtgtaagtcaagagggaaacagggacagggaacaagctgttccagaaagtcatggggctagaggcgggcagagaaggaggtg

SEQ ID NO: 13154 - DNA, 201 bp, Homo sapiens
gccaaaggtctgcaggccacaggagaggtccctagagggccccccacaagttctcactgctcacgtgtgccctctgtcctccaggtggccgggacagggcygggcggcccctgcttctggtgtcaactacagagggggcctgggaggcaccatggtgcacagtttcagaggtcaccaagctactgtcctacctgtgtacca

SEQ ID NO: 13155 - DNA, 201 bp, Homo sapiens
gccgctcagctgggagctacagccagaggggctggggaggcagaacgtgcagagttcccagagctggcagcctttgcctctacccagcgggccttccaggmtgagctgacccacttttacatggcggccgagcggcaacgcacggacctcgagacgctgctccacctgcaccgcttctgcaagagggtgagccccgcggcc

SEQ ID NO: 13156 - DNA, 201 bp, Homo sapiens
ctgcccctcagtgcctggtgggggttggcactgcctttctcagcctcttccacccttacctgccccaccagcccaggcccctcctgtccatccgaggcccygcagacccgcagctaccagcatctccagcaggggtcactgtggtcccacatgagctgctgtgggcgtttgttctgcagcgggtccctgcagcccctaggc

SEQ ID NO: 13157 - DNA, 201 bp, Homo sapiens
tccagggggatgggctgagcttccttctggatttcctgatccctgccaagcgcctgtgtgagcaagtgcgagaagcagcctgtgtaagtcaagagggaaamagggacagggaacaagctgttccagaaagtcatggggctagaggcgggcagagaaggaggtgggctggcctgtgtcttgtttcacggggagctgagggtg

SEQ ID NO: 13158 - DNA, 201 bp, Homo sapiens
gaggggctggggaggcagaacgtgcagagttcccagagctggcagcctttgcctctacccagcgggccttccaggctgagctgacccacttttacatggcrgccgagcggcaacgcacggacctcgagacgctgctccacctgcaccgcttctgcaagagggtgagccccgcggcccacctgcacagataccccccgatcc

SEQ ID NO: 13159 - DNA, 201 bp, Homo sapiens
cagttgctccatatagatctttgaaatcctttttgcctttaaaatttctatacattttaaatatccataaatagaatacattcacactcgttttgatatgaaaaaaatgcttttaattgcttgcaaattcaattacttaccattcctccctccccaaacttggagtgactcttcatgctgctggcagatgcaacacatttt

SEQ ID NO: 13160 - DNA, 201 bp, Homo sapiens; identical to SEQ ID NO: 2043

SEQ ID NO: 13161 - DNA, 201 bp, Homo sapiens
tcactgtccagcatgggcatcgccagagggaggcaaggacataaagtcagagacttgaaatcacctcccagagcctcctgtcactatctgccactgggcctttctgtgcctcagtttccccttctaggataatcatagcaaatatttacatcccatttactctgtgcagtcactgagtgctttacaagaatgaattcatca

SEQ ID NO: 13162 - DNA, 201 bp, Homo sapiens; identical to SEQ ID NO: 2003

SEQ ID NO: 13163 - DNA, 201 bp, Homo sapiens
atgaggatttaaggatcagtgtgtttggtgctgatccaggaacctctgctgggggagtaggaggcgaatctgcaaagggaataaagagtatgttgtcaagmaaattttcttttttttaatttttaaaacttcattgtattttatgtttagagatggggcctcactacattgcccaggctggtctcaaactcctgggctcaa

SEQ ID NO: 13164 - DNA, 201 bp, Homo sapiens; identical to SEQ ID NO: 2005

SEQ ID NO: 13165 - DNA, 201 bp, Homo sapiens; identical to SEQ ID NO: 2006

SEQ ID NO: 13166 - DNA, 201 bp, Homo sapiens
cctgcctgagacacacagaacctggcaaacggtcagtgctcaataagcattaggcagactcctccctcacagcactctcaagggttaatacaaccatggasaggaatttcacctctcaaaaggcttttcatgatcatctagtgcaacttccattttacagaagaagaaactgagccccagagagggctaagtccctgctgg

SEQ ID NO: 13167 - DNA, 201 bp, Homo sapiens
tgagcctcagttttcttctctgtgaaatgggctgctggtgcagttcagtgcaatcctgcctgagacacacagaacctggcaaacggtcagtgctcaataarcattaggcagactcctccctcacagcactctcaagggttaatacaaccatggagaggaatttcacctctcaaaaggcttttcatgatcatctagtgcaac

SEQ ID NO: 13168 - DNA, 201 bp, Homo sapiens
tcctccctgacttgctatgtgacctagggcaagtgagttcacttctctgagcctcagttttcttctctgtgaaatgggctgctggtgcagttcagtgcaaycctgcctgagacacacagaacctggcaaacggtcagtgctcaataagcattaggcagactcctccctcacagcactctcaagggttaatacaaccatgga

SEQ ID NO: 13169 - DNA, 201 bp, Homo sapiens
gtgctatgattgattaatgatgtctgccttgggcacaagctaggagagtggcagtatgagtgctgtttatttgccattccctaaccagggtctggttctgrattttgatttgtcagagtttccagagaagattggttgctggcaaagcaacttttaaagctggagtcaaccttacttgtgggaaatgaactggtgctgggg

SEQ ID NO: 13170 - DNA, 201 bp, Homo sapiens
ataataataacacaatggtgccactaacggagatttatggagctctttcccggccatgagctccgtgtgcttgcacgaatatgaagccatttatctaaagwcaagttcccttaatccgtggaaagatggtctcttcggagaaaatggttctccaatccctacagcctaacagctcgctatcgggttctaaattaatggaga

SEQ ID NO: 13171 - DNA, 201 bp, Homo sapiens
caaaggagcagcctgggagagtgtgatccagctgggacagggacccccatggctggcccagacccagtgcccttggctgccccttgcacttgtcaccaagkacaaagcatgagaaagacctgaccccagcctcccagctgtcaggccagccccacgtgcaggccacagcgatcacaggctgcttcagagggcagcaggagg

SEQ ID NO: 13172 - DNA, 201 bp, Homo sapiens
tgccacctgtcctaaattcatgtagccaaatctctctttaaaaaaaaattatgggaaaactgaggtctgtggggacaaaggagcagcctgggagagtgtgrtccagctgggacagggacccccatggctggcccagacccagtgcccttggctgccccttgcacttgtcaccaaggacaaagcatgagaaagacctgaccc

SEQ ID NO: 13173 - DNA, 201 bp, Homo sapiens
ttaacttgatgtgatctcatttgtccatttttgctttggttgcctgtgcttgttgggtattactcaagaaattttgcccagaccgaagtcctggagagttyccccaatgttttattgctgtggtttcatagtttaaagtcttagattcaagtctttaattcatttaaatttgatttttgtatatggcaaaagataggggtc

SEQ ID NO: 13174 - DNA, 201 bp, Homo sapiens
ggccccgcagacccgcagctaccagcatctccagcaggggtcactgtggtcccacatgagctgctgtgggcgtttgttctgcagcgggtccctgcagcccytaggctgtccccgtccctccgtccctccctctccaggcaggcagagattttctatcctattcacgcaccctgggccacacctcttccctgcaagggtggc

SEQ ID NO: 13175 - DNA, 201 bp, Homo sapiens
gagtggggatggggcctcagggcacctccctacgctggcaggaggctaccaggtgcctgagcaagtccaaggagctgatggaggctgtgctgagggacccsggcctactgggcctccagcgggaaggtggagccaccctggccaggctgcagcatgatgccagcaggctggacttcagccctgatgtcaggtacagacgtc

SEQ ID NO: 13176 - DNA, 201 bp, Homo sapiens
gagttcctattgtatttctctttcttcaggggcctcatttactaaaatgatttttccctccttaagtaagctccctttgagtggggtccttatttattctyatctccctttgcccccctgggcaacaggtggacctggagcttgcaaccaggctggggcaaccagaagggcccccgtgaggctcatgacctatgggtccta

SEQ ID NO: 13177 - DNA, 201 bp, Homo sapiens
ctacgggtgggagggagcctcagtcctctgtaaaagcctcctggcattggaatcttgctggcattgagaaatgccaccctcctcctcctcagagttcctaytgtatttctctttcttcaggggcctcatttactaaaatgatttttccctccttaagtaagctccctttgagtggggtccttatttattctcatctccctt

SEQ ID NO: 13178 - DNA, 201 bp, Homo sapiens
gattacaggtgtgagccaccacccctggcccatagtcacatttcctcttaccctttcctcttctgcatcctcttccacctggtgattacactgggcccatytgtctaatccaggatggtctccttgttttaaagtcagctgattagcaaacttaattccattggtagccttaactcccctttgtcttgtaacagcacgttc

SEQ ID NO: 13179 - DNA, 201 bp, Homo sapiens
ttaaatatattttaataaatgaaataatacaaaaaccatccaatgcatcatcagtttatttttggagttacattcgatttatgccagtttacagttatttytccatttatagtgatgatgtaataacagttataatattgccacagatccacccaaacatggtgattcctaccttcttcttcttgcccttgcccccacatg

SEQ ID NO: 13180 - DNA, 201 bp, Homo sapiens
caaaactctttcttgaaaagaaaagaaaagaaaagcttaatccacatctcagaaagtccagctaacaacatctggtgagaccatttacaaagggaaccagmcttaaaaacacatactctcacacttttattttttcccctcctaattataaaagctatacaagctggttacggaatgtttggaaaatccgggaaactatga

SEQ ID NO: 13181 - DNA, 201 bp, Homo sapiens
gagagtttccccaatgttttattgctgtggtttcatagtttaaagtcttagattcaagtctttaattcatttaaatttgatttttgtatatggcaaaagayaggggtctagtttcattcttctgcatatggatatccagttttcccatcaccatttattggactatcttttcccctgtgtatgttcttggcacctttgtca

SEQ ID NO: 13182 - DNA, 201 bp, Homo sapiens
cacggacctcgagacgctgctccacctgcaccgcttctgcaagagggtgagccccgcggcccacctgcacagataccccccgatcccctggctggggctayggtggggacagggatacctagacacagccccatggcctgactgcatagacaccgcccccatcccttggatacctagacacagcccccccccacccacttg

SEQ ID NO: 13183 - DNA, 201 bp, Homo sapiens
atctctctggcaatcctagcagctcctggtgggtgctgccacatgatcgagaattgcacatggcatagaacctatttgaaaagcttcatctggtccatccytcctccctttgttttcagagggggaaactgaagcctaaggccacacagcaagctagacgcagagctggagtcacctgactccagtgcctttttcacactg

SEQ ID NO: 13184 - DNA, 201 bp, Homo sapiens
ggcaacgcacggacctcgagacgctgctccacctgcaccgcttctgcaagagggtgagccccgcggcccacctgcacagataccccccgatcccctggctrgggctatggtggggacagggatacctagacacagccccatggcctgactgcatagacaccgcccccatcccttggatacctagacacagcccccccccac

SEQ ID NO: 13185 - DNA, 201 bp, Homo sapiens
tggggcctcactacattgcccaggctggtctcaaactcctgggctcaagtgatcctcttgccttggcctgccaaagtgctgggattgccttttccgcccaccccccccgaccccaccagagacagggtctcactctggtgtccaggctggagtgcagtggtgcaatcatagccttaaattcctgggttcaaccaatcctcc

SEQ ID NO: 13186 - DNA, 201 bp, Homo sapiens
ctcaccttccactaggtcctgccccctgtccgaggccatccagcaagactgtcaattctgtttaccacccacaggcctgaagataaagccaaggggctggyggtcctgattgacgccaggagacagcccccacagcccggtctggtcagcgccctgcaggccacccaggtgagtgggaggtggagagccttagcctagtaa

SEQ ID NO: 13187 - DNA, 201 bp, Homo sapiens
tcatcctcgaaataacctaataagctcagcatattattctccctgtttaacagatgaggaaactgaagctcagaggtgcactgacttgcccacagacacayagtgagtcactgcagagcagagacttgacccctttctgtgtgaccccagagctcatgccatgagctttgcctgcccacgtatcttatacagagggagtgc

SEQ ID NO: 13188 - DNA, 201 bp, Homo sapiens
ttcatactctctctctctctctctcacacacacacacacacacacgcaggcactcacacacacgtacacatgcacacacacgtacacatgcacacacacatacacatgcacgcacagagcacacctgaatgctcccactgactcacacagctgaacacatgttcacaccctctcatacacccatgccttctgcacctgctc

SEQ ID NO: 13189 - DNA, 201 bp, Homo sapiens
attacctctttaaacaccctatctccaaatacagtcacatgctgatgtactgggagttaagacttccacatataaatttggaggggcaggggacacagctwcgcccctaacacctagtgtatgaaatgaggatggaagagtgtgcagagcctgagacacttcaatgccaggtccagaagcttgcagtttctcttcaaggcc

SEQ ID NO: 13190 - DNA, 201 bp, Homo sapiens
aaccccgtctctactgaaaacagaaaaaactagccgggcatggtggcaggtgcctgtaatcccagctactcgggaggctgaggcaggagaatcacttgaaycccggaggcggaggttgcagtgagccgagatcgcaccattgcactccagcctggaggacaagagcgagactttgtctcaaaaaaaaaaaaaaaagtaact

SEQ ID NO: 13191 - DNA, 201 bp, Homo sapiens
ccagacatgtgaactaatcgtatgactactgtgtcccagtgtggaatgtcctgagtgtgtgaaccctttgctgctcaaagtgtggtctggggactacctayatcagcgtgaccttggagctagggggagaggcagaatctcaggcctgctgaactggcatctgcattctaacaagatccccaggcccatcaaagtttgaga

SEQ ID NO: 13192 - DNA, 201 bp, Homo sapiens
tgaccttgggctgcaggggagggggctgtggctcgtctcaccttcttccttttcagcctcacacccgctggctcctgcctgggaacagcctggctcctgcctggccgggctgcgggctgtgttcactgggaaggaatggaaacacatctattaagtttcatggaaatcatgctgaggggcccacgtctggtgtttgggttc

SEQ ID NO: 13193 - DNA, 201 bp, Homo sapiens
gaccttgggctgcaggggagggggctgtggctcgtctcaccttcttccttttcagcctcacacccgctggctcctgcctgggaacagcctggctcctgcctggccgggctgcgggctgtgttcactgggaaggaatggaaacacatctattaagtttcatggaaatcatgctgaggggcccacgtctggtgtttgggttcc

SEQ ID NO: 13194 - DNA, 201 bp, Homo sapiens
acaagttattacaaattagtgacgtaaaacaacacaaatgtattatctgatcgctctgtatgttagaagctcaacatggatctcgctaggctacatccagstgtctgcagagctgcattctttcctggaggctctaagggagactccatttccttgccttttccagcttctagagaccactactttccttggcttgtggcc

SEQ ID NO: 13195 - DNA, 201 bp, Homo sapiens
cctagcctcaggcgatcctcccacctcagcttcccagagtgctgggattacaggtgtgagccaccacccctggcccatagtcacatttcctcttacccttycctcttctgcatcctcttccacctggtgattacactgggcccatctgtctaatccaggatggtctccttgttttaaagtcagctgattagcaaacttaat

SEQ ID NO: 13196 - DNA, 201 bp, Homo sapiens
accttgggctgcaggggagggggctgtggctcgtctcaccttcttccttttcagcctcacacccgctggctcctgcctgggaacagcctggctcctgcctggccgggctgcgggctgtgttcactgggaaggaatggaaacacatctattaagtttcatggaaatcatgctgaggggcccacgtctggtgtttgggttcct

SEQ ID NO: 13197 - DNA, 201 bp, Homo sapiens
ctgacttcacatcccctcaccccacacttcccaaccttccagtctttcctcatggcagtaaaagatgaccacatcatccttgattgctctttctcttacaycccacattcaatttgttaactgtcaactctcccattaaattgtattcagaatctgttgacttcaccccacccaagtccaaaccagcgtggtctcttgcct

SEQ ID NO: 13198 - DNA, 201 bp, Homo sapiens
aaacaaacaaacaaacaaacaaacaaaaaggccaagcacggtggctcatccctgtaattccagctactcgggctgaggcaggagaatcgcttcaacccagraggcggaggctgcagcaagcagagatcggaacactgcactccagcctgggcaacagagcaagactctgtctcaaaaataataataataataataataata

SEQ ID NO: 13199 - DNA, 201 bp, Homo sapiens
ccttgggctgcaggggagggggctgtggctcgtctcaccttcttccttttcagcctcacacccgctggctcctgcctgggaacagcctggctcctgcctggccgggctgcgggctgtgttcactgggaaggaatggaaacacatctattaagtttcatggaaatcatgctgaggggcccacgtctggtgtttgggttcctg

SEQ ID NO: 13200 - DNA, 201 bp, Homo sapiens
actggtcacgttcaggttttttttttttttttttttttagatggagtctcgctctattgcccaggctgtagtgcagtgggactgtcttggctcactgcaayctctgcctcccaggtttaagcaattctcatgcctcagcctcctgcgtagctgggactataggtgtgtgacactaggcccagctaatttttgcatttttag

SEQ ID NO: 13201 - DNA, 201 bp, Homo sapiens
ctcttccactcactctaatcagaatcccttccccactgtgccactgagacacgtcttgtcaaggtcgtcattgcgttccatgtttctagatccaggggtcrattctcagtcctcatcaccctaggcccttccgcagcatttggcatggatggccacttcctcctgttgaaaggctttcttcacttgccattagatcttcag

SEQ ID NO: 13202 - DNA, 201 bp, Homo sapiens
cttgggctgcaggggagggggctgtggctcgtctcaccttcttccttttcagcctcacacccgctggctcctgcctgggaacagcctggctcctgcctggccgggctgcgggctgtgttcactgggaaggaatggaaacacatctattaagtttcatggaaatcatgctgaggggcccacgtctggtgtttgggttcctgt

SEQ ID NO: 13203 - DNA, 201 bp, Homo sapiens
gcactcggcggtcatggtcactccagggccacagcgtgcacctggtgtttgccaagcctctcctgctttcacacctaacctagtcattagaaacccctcaytgaaccccagatcctcagatcaagggtcaggcactggtctgccccctgtcaaagggtgagcaactctttccagattgggaacaatgtgcagatttccttc

SEQ ID NO: 13204 - DNA, 201 bp, Homo sapiens
cacaaagcagttgtctgtgttccctgtttccacaccttctctcttccactcactctaatcagaatcccttccccactgtgccactgagacacgtcttgtcraggtcgtcattgcgttccatgtttctagatccaggggtcgattctcagtcctcatcaccctaggcccttccgcagcatttggcatggatggccacttcct

SEQ ID NO: 13205 - DNA, 201 bp, Homo sapiens
ttgggctgcaggggagggggctgtggctcgtctcaccttcttccttttcagcctcacacccgctggctcctgcctgggaacagcctggctcctgcctggcvgggctgcgggctgtgttcactgggaaggaatggaaacacatctattaagtttcatggaaatcatgctgaggggcccacgtctggtgtttgggttcctgtg

SEQ ID NO: 13206 - DNA, 201 bp, Homo sapiens
tcagtaactcataccaactctaagattagacctgcggctatctccaacagatggggacctcaggctctgggaacttaagtagctgcccaaggtcaccccamccagaaagtgcaagttaggacagtctgaattctgagcctgcactcggcggtcatggtcactccagggccacagcgtgcacctggtgtttgccaagcctct

SEQ ID NO: 13207 - DNA, 201 bp, Homo sapiens
ccatacaggggaactgttttcttcttccttctttctttcttgcctattaaactttctgctccttaaaaccacacacacacacacacacacacacagacacrcacacacacacacacacaccataataataataataataataatatgaccacagaaattgtagtgatggctcttacttaatgagcacctactaaattctag

SEQ ID NO: 13208 - DNA, 201 bp, Homo sapiens
ggtggaaggattgctggagcccaggaagtcaagactgcagtgagccgagatagcaccactgcactccagtctgggcaacagagcaagatcttgtctttaaaaacaaacaaacaaacaaacaaacaaaaaggccaagcacggtggctcatccctgtaattccagctactcgggctgaggcaggagaatcgcttcaacccagg

SEQ ID NO: 13209 - DNA, 201 bp, Homo sapiens
tttcagcccagctccagacagatacaagagccccaggcagattcacaggggctgtaaggatttggaaaaaagctgtgaagacaggccaaggctttaacccygtgactgtgaccaaccatgttgaatttgtgtgggttttcactcacagcaaatgcatctccacaagcagaagaattccatatagaggtgttcatactctct

SEQ ID NO: 13210 - DNA, 201 bp, Homo sapiens
gcaaagcaacttttaaagctggagtcaaccttacttgtgggaaatgaactggtgctggggcagggatctgggcaggaccttctaaaatgactgtcctcacwttgagtccctggttctcctgattctttggtctgcaggtggaggtgctgacctcattgaaggccctcagccaccatgtggaccccagccagctgcccgcag

SEQ ID NO: 13211 - DNA, 201 bp, Homo sapiens
cgctcagctgggagctacagccagaggggctggggaggcagaacgtgcagagttcccagagctggcagcctttgcctctacccagcgggccttccaggctragctgacccacttttacatggcggccgagcggcaacgcacggacctcgagacgctgctccacctgcaccgcttctgcaagagggtgagccccgcggccca

SEQ ID NO: 13212 - DNA, 201 bp, Homo sapiens
tgcttaaggttttcttagagaacgttattcgagacgccgtcacctatacggagcacgccaagcgcaaaactgtcacagccatggatgtagtatatgccctraaacgtcaggggcgcactctgtatggcttcggcggctgaatctaagaatacgcggtctcctgagaacttcaaaaaacaaaaacaaaaaaacccaaaggcc

SEQ ID NO: 13213 - DNA, 201 bp, Homo sapiens; identical to SEQ ID NO: 2044

SEQ ID NO: 13214 - DNA, 201 bp, Homo sapiens; identical to SEQ ID NO: 2045
  misc_feature (1)...(201): n = A,T,C or G, or insertion/deletion polymorphism (see Tables 1-2)

SEQ ID NO: 13215 - DNA, 201 bp, Homo sapiens
gccgtttggctcggcgcggtggcgtcaagcgcatttccggtcttatctatgaggagactcgaggtgtgcttaaggttttcttagagaacgttattcgagaygccgtcacctatacggagcacgccaagcgcaaaactgtcacagccatggatgtagtatatgccctaaaacgtcaggggcgcactctgtatggcttcggcg

SEQ ID NO: 13216 - DNA, 201 bp, Homo sapiens; identical to SEQ ID NO: 2047

SEQ ID NO: 13217 - DNA, 201 bp, Homo sapiens
ctggtcgcggcaaaggcggaaaaggcttggggaagggtggtgctaagcgccatcgtaaggtgctccgggataacatccagggcattacaaaaccggctatycgccgtttggctcggcgcggtggcgtcaagcgcatttccggtcttatctatgaggagactcgaggtgtgcttaaggttttcttagagaacgttattcgag

SEQ ID NO: 13218 - DNA, 201 bp, Homo sapiens
ccaaggtgggtggatcacgaggtctggcgttcaagaccagcctggccaagatggtgaaaccccgtctactaaaaatacaaaaattagccgggcgtggtggygggcacctgtaatcccagctacgtgggaggctgagccagagaactgcttgaacccaggaggcagaggttgcagtgaaccgagattgtgccactgcactct

SEQ ID NO: 13219 - DNA, 201 bp, Homo sapiens
gtaaattggtcctagagagaaaaataaataaactggaaggagttatgctgtatgtttactttttttatggaaacatatgatatacctggaaattcgattgrccatgcatctatttcttcaatgggtatgcacagttgagctgttcccatgcaccaggcactgtaatgggacaactgcacatgacagtcaaaaatctcagtc

SEQ ID NO: 13220 - DNA, 201 bp, Homo sapiens
aatcactttattagcgcttacctctctatgcctactttatgctttgaaattttgtcacagtgtggccggtcatggcaaacacaattcattcttatgcaggmtgtcacggttatttctgtcatccaaactcattctcgcaacgcatttcagctctttaaacgactttgtgagcggccctgaaaagggcctttgggttttttt

SEQ ID NO: 13221 - DNA, 201 bp, Homo sapiens
tactaaatcaaaagtgaaaaacattttctaaggttcttaacatatacattgccaaattgctattcaggatcataccaatttataatcccaaaataatatgraaattcctgttttatagcactcatatttacaataaattttaaaaatcactgttaacctaatagtccttcaaaagaaaaaaaaattgaaattacattattt

SEQ ID NO: 13222 - DNA, 201 bp, Homo sapiens
tgtgcttaaggttttcttagagaacgttattcgagacgccgtcacctatacggagcacgccaagcgcaaaactgtcacagccatggatgtagtatatgccytaaaacgtcaggggcgcactctgtatggcttcggcggctgaatctaagaatacgcggtctcctgagaacttcaaaaaacaaaaacaaaaaaacccaaagg

SEQ ID NO: 13223 - DNA, 201 bp, Homo sapiens; identical to SEQ ID NO: 2046

SEQ ID NO: 13224 - DNA, 201 bp, Homo sapiens; identical to SEQ ID NO: 2048

SEQ ID NO: 13225 - DNA, 201 bp, Homo sapiens; identical to SEQ ID NO: 2049

SEQ ID NO: 13226 - DNA, 201 bp, Homo sapiens; identical to SEQ ID NO: 2050

SEQ ID NO: 13227 - DNA, 201 bp, Homo sapiens; identical to SEQ ID NO: 2051

SEQ ID NO: 13228 - DNA, 201 bp, Homo sapiens; identical to SEQ ID NO: 2052

SEQ ID NO: 13229 - DNA, 201 bp, Homo sapiens; identical to SEQ ID NO: 2053

SEQ ID NO: 13230 - DNA, 201 bp, Homo sapiens
cagtttggtaggccaaggtgggtggatcacgaggtctggcgttcaagaccagcctggccaagatggtgaaaccccgtctactaaaaatacaaaaattagcygggcgtggtggcgggcacctgtaatcccagctacgtgggaggctgagccagagaactgcttgaacccaggaggcagaggttgcagtgaaccgagattgtg

SEQ ID NO: 13231 - DNA, 201 bp, Homo sapiens
ggctaatccccttgaaaaataaatagaatagcagaattgggtctgaatgtggtttgaagaaagggacttctcaattcaaaattttattcttagcttcctgygggagctttccagaatgcccataagatccacttttgtttaaaaaacaaaaacaaccccacccaccactctctggttaataaatgaatttctattgggaat

SEQ ID NO: 13232 - DNA, 201 bp, Homo sapiens; identical to SEQ ID NO: 2054

SEQ ID NO: 13233 - DNA, 201 bp, Homo sapiens; identical to SEQ ID NO: 2055

SEQ ID NO: 13234 - DNA, 201 bp, Homo sapiens; identical to SEQ ID NO: 2056

SEQ ID NO: 13235 - DNA, 201 bp, Homo sapiens
tcactttattagcgcttacctctctatgcctactttatgctttgaaattttgtcacagtgtggccggtcatggcaaacacaattcattcttatgcaggctrtcacggttatttctgtcatccaaactcattctcgcaacgcatttcagctctttaaacgactttgtgagcggccctgaaaagggcctttgggtttttttgt

SEQ ID NO: 13236 - DNA, 201 bp, Homo sapiens
tcacagtggtatatgcccaactacaaatggaggttctgtcattatgagatgagagaaaggcagaaaacatgttgagagatgtgtagcaatctctggactcyacggggataaaaaagaattgagagtatcaaaattcaggatcaaaatcaaaattaaagataaaaaatatcaataactatcacctggaataagaacaacgta

SEQ ID NO: 13237 - DNA, 201 bp, Homo sapiens
cacacctggctagtttttgtatttttagtagagacggggttttgccatgttggccaggctgttctcgaactcctgacctcaggtgatccacctgcctcagscccccaaaatgctgggattataggcatgagtcaccgcgcctggctaatcaattacataatctcaagaggctaattctatattcttcatacagtgaaaatt

SEQ ID NO: 13238 - DNA, 201 bp, Homo sapiens
tgagttatttattctttttaataaataataaataactgagttatttattcttttttttttaataattccacttagagtggacaatcctatatgtcactgcrgaaattttgtgtgtttgattatggaatgctgccccaggcctcaatagttattacataatttagggtacatgtagcgtattaccttctaaaatttgaaaaa

SEQ ID NO: 13239 - DNA, 201 bp, Homo sapiens; identical to SEQ ID NO: 2071

SEQ ID NO: 13240 - DNA, 201 bp, Homo sapiens
gctgggatttcatgtgtgagccagtgtgcccagccaccattttttaatacttgtaaatttttcctataaaaacaaaccaatttctctatgccccaaaaccsctaagtagcacaaaatagaaacattagagtaccaagaatacttgaactgaaaaggaaattaatcaaaatgcagacacacattataccaagtgcatttgct

SEQ ID NO: 13241 - DNA, 201 bp, Homo sapiens
acattggaacacatatagataatttaagtaggtagatgtatgtgctgttataaggaagtggggaggagagaagagggaaccgaaatcatatgcacaaaaawtttttttagaatataaataaaaaatgtggtagtctaaaatgtcaattcttcaaagataaagttaggctttcagtaacgttagaaatggttttctggaata

SEQ ID NO: 13242 - DNA, 201 bp, Homo sapiens
tagccagataatagctatgcaaagaatatataatagactggcaggggcatgcctaccgattcaatacagaaaggtgagggtttcatttgctggggtgtagygggtgggagaattccttattgcaatcacactctacttctccatccagaaaactctccaaccctcctggaggactctccattttctcctctttctcctcct

SEQ ID NO: 13243 - DNA, 201 bp, Homo sapiens
cccagggggtgcccaggggcctttctgactggttggttagttgggtaaaagagtagagtcaggagagcaggaaatcctttcttaactcactataaaaatamaagcgttccccaggcctcaaatagtctcatctcaagataaatttccttttgccaagattgctgctgaaaataatccattgtagccagataatagctatgc

SEQ ID NO: 13244 - DNA, 201 bp, Homo sapiens
tccttttaaactcaggcaacttggcttttttctgctctgtgatcttgaaagtcgcttggaggaacagctgagtgcatggggctgttgtcctctcagggctracatgttgtagcccagggggtgcccaggggcctttctgactggttggttagttgggtaaaagagtagagtcaggagagcaggaaatcctttcttaactca

SEQ ID NO: 13245 - DNA, 201 bp, Homo sapiens
ccccgctgcaggctccccgccatcacagaaagcccctcgctcacacgtcttggctcaagcaactctttgtcttagaaatgcagatcccaacatttcctttkaaactcaggcaacttggcttttttctgctctgtgatcttgaaagtcgcttggaggaacagctgagtgcatggggctgttgtcctctcagggctgacatgt

SEQ ID NO: 13246 - DNA, 201 bp, Homo sapiens
aatgtcaatagtggttcagcaaatttaaaagtaaaaatattattctgctcttaacctataggaaatttctttatggctaaaaaaaggttattaagtaatcmatttattaaattaatacaatctgattatttaaaaatttggaacgctgtactaaaattaaaaatcatcattacagattaaccagccagtacctctgcaccc

SEQ ID NO: 13247 - DNA, 201 bp, Homo sapiens
aggtttccagcaatcgccccggccattgcttacttcttccatgccctttctaagttttcttcagccaggcagccatcccctctggtttctcccagaccccygctgcaggctccccgccatcacagaaagcccctcgctcacacgtcttggctcaagcaactctttgtcttagaaatgcagatcccaacatttccttttaaa

SEQ ID NO: 13248 - DNA, 201 bp, Homo sapiens; identical to SEQ ID NO: 2066

SEQ ID NO: 13249 - DNA, 201 bp, Homo sapiens; identical to SEQ ID NO: 2068

SEQ ID NO: 13250 - DNA, 201 bp, Homo sapiens; identical to SEQ ID NO: 2069

SEQ ID NO: 13251 - DNA, 201 bp, Homo sapiens
cagaacttaaaaaaacaagcaataaaataattttaaaaaaacaaaagaagtgatcgtggacatggaaaactatttaccaagatggtcagtgcagccaggcaaaaaaaaaaaaaaaaaaaaaatcatgtcccatgttgggaaggggtgaattaattgtagtagactcattaaatggaatattatgtaatcatcaaatcatgt

SEQ ID NO: 13252 - DNA, 201 bp, Homo sapiens
tcaggagagcaggaaatcctttcttaactcactataaaaatacaagcgttccccaggcctcaaatagtctcatctcaagataaatttccttttgccaagawtgctgctgaaaataatccattgtagccagataatagctatgcaaagaatatataatagactggcaggggcatgcctaccgattcaatacagaaaggtgag

SEQ ID NO: 13253 - DNA, 201 bp, Homo sapiens
ctgggagtggtggcggctgtctgtaatcccagatactcaggaggctgaggcaggagaatcacttgaaccgggtaggcagaggttgcggtgatccaagatcrggccagtgtactccagcctgggcgacagagtgagactctgtctcaaaataaataaataaataaataataaagacatataatgcttactttaaagaaaaac

SEQ ID NO: 13254 - DNA, 201 bp, Homo sapiens
gacccagtgggaggtaattgaatcatgggggcgggtttttcccatgctgttctcatgatagtggataagtctcacaagatctgatggtttcataaacggcmgttcccctgcacatgctctcttgcctgacgccatgtaagacgtaattttgctcctccttcaccttccaccatgattgtgaggcctcctcagtcatgtgga

SEQ ID NO: 13255 - DNA, 201 bp, Homo sapiens
gctgtgattcaataccaaagccaggcctatcatggtatactatgctattttacaagtcaaattactgaaagatgcatgtctttaggcaatcattacaaataaaaaaaaaaaaaccgaagcaaaacaaaataacatagattatttgtatcagatggacaaaacagacctggcttgatgccgaacccttaaatctcaaaataa

SEQ ID NO: 13256 - DNA, 201 bp, Homo sapiens
tataatgtgaatcttctatgggattttaagaaagttcaaagccttggtttactcagcaaatatttagcttgcactcactatgtggcgggcatcctaatgayggagtatatgtaaagacaaaaaaagtttccggacctcaaagtgttctccatctataggggcagatgactgagttgacatctcgagaagtagaatagcaga

SEQ ID NO: 13257 - DNA, 201 bp, Homo sapiens; identical to SEQ ID NO: 2070

SEQ ID NO: 13258 - DNA, 201 bp, Homo sapiens
taaacccaatgtgtagggaaaatgctcatcctaaaatctccttggaggggataatttgcaagattctttgcaaaaacaatccaagacaagagccagattayggaatgtcagtgccagaatggcaggaatgtatgttttctaatcaaatgccacttactactgggtaaccttgggctaatcagttaatattgctgagcgatg

SEQ ID NO: 13259 - DNA, 201 bp, Homo sapiens
gcaaatgggaatttttaattctgattcttggtatgttttagaacaatgatttgttctttcttatactttcaggtgtttccaatgtggacactgaagagacwaattcttatcctttttaacataatcctaatttccaaactccttggggctagatggtttcctaaaactctgccctgtgatgtcactctggatgttccaaag

SEQ ID NO: 13260 - DNA, 201 bp, Homo sapiens
gaagtaaatactgtaaatagatgtttcaaacgcattttaaagcaatgatcctagcatgtctttaagctacagtattgtgctgtctttgaaatgtaaacttkgatgtcttctctttctcttagttgatgctattgggcccatctcaagctgatcttggcacctctcatgctctgctctcttcaaccagacctctacattcca

SEQ ID NO: 13261 - DNA, 201 bp, Homo sapiens
cttctaccctctcgaaagctattttgctaaagagctaagatgctaaaagctaaatatgtaactaaatagttgcaaatctcagtaactgacaaatacagtcrtggggttggggatgctgtttagacagctgaaaataagacctgaattgtttatttttaaaatgttgcaaaagagaggcagcaaatgggaatttttaattct

SEQ ID NO: 13262 - DNA, 201 bp, Homo sapiens
gtttatgcctatagtcttggtgtaattattaccagccccacttcattcttgtaagtatactaatggatcagttatacggttcctctgattatgtatcaccyaggcagtgccctgactctactactatctcctctccaaatttatgtaatgtaaacccaatgtgtagggaaaatgctcatcctaaaatctccttggagggga

SEQ ID NO: 13263 - DNA, 201 bp, Homo sapiens
ttatgtcagctaaaacctcaaagcaaggaggatgttaagaacaatgaaggaggtcagctggactctcaatgtttttaacgatagggaggaaaagatagggkggtgacaagaagaagagacaattttgtacctctaactccaacaaactttagacctgaaaaatcccttctgagccatcttgcattggagaaaaaaaattgc

SEQ ID NO: 13264 - DNA, 201 bp, Homo sapiens
aaatggtagggaagaggacttctaacggagggacttgcaagtcagggaacttgggtttatcgactagtgaggctagtagaggaattcaatcaggtaagccrgacaagtagacagggtacaaattatggaagactttggatgccatgataaaaagcttcagctcatactgtaaaaaataaaataaaataagaaggttgggtg

SEQ ID NO: 13265 - DNA, 201 bp, Homo sapiens
cccactggcatattgccatatattctgaggtatctgagtgctccttttgagaaacatagccttaaaggataagtagaaatctggtgggtgaaaatggtagrgaagaggacttctaacggagggacttgcaagtcagggaacttgggtttatcgactagtgaggctagtagaggaattcaatcaggtaagccggacaagtag

SEQ ID NO: 13266 - DNA, 201 bp, Homo sapiens
cacatctctagttaccaaacaattcagtgtgatataaacatggcaaaaagtcaatgaatttgagggcaaggtttccagcaatcgccccggccattgcttayttcttccatgccctttctaagttttcttcagccaggcagccatcccctctggtttctcccagacccccgctgcaggctccccgccatcacagaaagcccc

SEQ ID NO: 13267 - DNA, 201 bp, Homo sapiens
tattatgtaatcatcaaatcatgttttttaaaataatactgaatgacctaagaaagcactcatggtataatgttaaatgaaaaaagcaagctagaaatggrtaagtaccgtgtattcctcatgtttttactgcacctgctaggcaaatactagatgctcactaaatgttggataatctgtgatgatggtttacataaacac

SEQ ID NO: 13268 - DNA, 201 bp, Homo sapiens
ggtgggtggttcacttggggtcaggcattccagaccagcctaaccaacatggtgaaaccccgtctctactaaaaatacaaaaattagccaggcctggtggygcatacctgtaatcccagctacttgggaggctgaagcaggagaatcgcttgaacccgggaggtggaggttgcagtgaaccgagattatgccattgcactc

SEQ ID NO: 13269 - DNA, 201 bp, Homo sapiens
ttatgtaagacaactttatatccttttattcttttagtttgaaaactaagtctgttgggctaaaatgataggaagtaaatgataactctctcctttttttwaaaaaaagcaagtggtttacaaccttgtacttaaacgttttggtgacataatgaaactgatattcatggtatttgtactttacagagattaaactaaaat

SEQ ID NO: 13270 - DNA, 201 bp, Homo sapiens
atcatatgcacaaaaattttttttagaatataaataaaaaatgtggtagtctaaaatgtcaattcttcaaagataaagttaggctttcagtaacgttagamatggttttctggaatatgtctccagtctacctaactttgaggaagtaaatactgtaaatagatgtttcaaacgcattttaaagcaatgatcctagcatgt

SEQ ID NO: 13271 - DNA, 201 bp, Homo sapiens
aacaacaacaatcatatactgctttctatcatgggtccaggagttgactggactcattaggcagctctcccacagggtctctcttggggtggcagtcaggyggtgactgcgactggaatcacctgaagactcactctccaggtctgatgcctgggctaggagactcaacagctaggtgccgaagcagctgcagctcctcaa

SEQ ID NO: 13272 - DNA, 201 bp, Homo sapiens; identical to SEQ ID NO: 2067

SEQ ID NO: 13273 - DNA, 201 bp, Homo sapiens
tcttgaatatgggcttcagtcctgccatcaaaatagtgcatccaggtggataggttttgccaccttgaagagttgtttattcaaacttttgtttgaagagkaggaaagcagtgttacctttaggcctgacttagcccttgccccacaatctattgttttttctcaccatagatttccctgacagcagagagagagttctgt

SEQ ID NO: 13274 - DNA, 201 bp, Homo sapiens
tttttgccctggactggctttcattgtctactagaaaatgcttaatgggaagtgcttagaaaatgtacatgggcatacacttaattaatctaagttgctgytttgtctgtatccattaaatctgctttattttggggtaaactacagtagaagttggctttttcaaccctgcaaagccttaaaattcaggatgtcttactc

SEQ ID NO: 13275 - DNA, 201 bp, Homo sapiens
atgcaggtttgttacataggtatacatgtgccatggtggtttgctgcacgcatcaacccgtcagctaggttttaagcttcacatgcattaggtatttgtcytaatgctctccctcccctttcccccaatcccctgacaggccctggtgtatgatgttcccctcctagagtccatgtgttctcactgttcaactcccactta

SEQ ID NO: 13276 - DNA, 201 bp, Homo sapiens
aaaaaaaatttaagtgacactgtgatgaattttttttttggtaaaaagtagcatcttttaataagaggattttttatgggctcttctcacattttcttttrattaaatatttgtacgacattttgcattatgtaaaatactatggaatatatgtctacatacatacatgaaacatatgtctataaagtcgcaacttggcca

SEQ ID NO: 13277 - DNA, 201 bp, Homo sapiens; identical to SEQ ID NO: 2076

SEQ ID NO: 13278 - DNA, 201 bp, Homo sapiens; identical to SEQ ID NO: 2077

SEQ ID NO: 13279 - DNA, 201 bp, Homo sapiens
ataggacacatgaaaaatgcattcatttcttcatcaagcatttattgacacattagtatgcatttgatatcatataaattccataaagtatcagtagaacmtgacccctcagtttaagaagtaggttatggtttagtagatacatacggtcataaaacattaggtcagtatggtattggagttttttattgtagaggtaag

SEQ ID NO: 13280 - DNA, 201 bp, Homo sapiens
  misc_feature (1)...(201): n = A,T,C or G, or insertion/deletion polymorphism (see Tables 1-2)
ctagtggagatggtagtttcaaaataggatacatgaatctagtcctcagtagagaaatctacacataattaacatagcaataagcatatagtttccgatangagaaaatttaatttgttagaagatcagtcccgctggactgggactgatgaatccaaccattaagggcttaagagagtaagaagagattgcaaaagagac

SEQ ID NO: 13281 - DNA, 201 bp, Homo sapiens
gagataatcatgtggtttttgtcattggttctgtttatgtgataaattatgtttattgatttgcatatgttgaaccagtcttggatcccagggatgaagcygacttggttgtggtggataagctttgtgatgtgctgctgtatttggtttgccagcattttattggggatttttgcatcaatgttcatcagggatattggc

SEQ ID NO: 13282 - DNA, 201 bp, Homo sapiens
aatctacgtgtacctgcaacctagtgacagctatgcccaggaccaagggaagtttatctccctcttctacaccatggtgacccccactttaaatcctatcrtctatactttaaggaacaaggatatgaaagaggctctgaggaaacttctctcgggaaaattgtgattcctatggacatgatttgcaaggaattcattata

SEQ ID NO: 13283 - DNA, 201 bp, Homo sapiens
cacaggaaggggaacatcacactctggggactgttgtggggtggggggaggggggagggatagcattgggagatatacttaatgctagatgacgagttagwgggtgcagcgcaccagcatggcacatgtatacatatgtaactaacctgcacattgtgcacatgtaccctaaaacttaaagtgtaataataataataaata

SEQ ID NO: 13284 - DNA, 201 bp, Homo sapiens
  misc_feature (1)...(201): n = A,T,C or G, or insertion/deletion polymorphism (see Tables 1-2)
attaagggcttaagagagtaagaagagattgcaaaagagacagttattctaggcatttgttatgatagctttaatataaagtatctcagttctaagagaangatgctcaaggttagaaatccaaagtacgggcaaagagattctctttaaaggggatgacgaagatcttctctatggtaactagagtgaaggaggagggac

SEQ ID NO: 13285 - DNA, 201 bp, Homo sapiens; identical to SEQ ID NO: 2080

SEQ ID NO: 13286 - DNA, 201 bp, Homo sapiens
gagttagagggtgcagcgcaccagcatggcacatgtatacatatgtaactaacctgcacattgtgcacatgtaccctaaaacttaaagtgtaataataataataaataaataaataaataaagttaggaacaatggatactggggaccaacagatgtggagggaggaagtgggctattggctgaagaaccacctgttgtat

SEQ ID NO: 13287 - DNA, 201 bp, Homo sapiens
atataaagtatctcagttctaagagaatgatgctcaaggttagaaatccaaagtacgggcaaagagattctctttaaaggggatgacgaagatcttctctrtggtaactagagtgaaggaggagggacacagaagacttaagtgggttttcttttcgctctttcacgttggacaagtttgatggcttctatttcctatgtg

SEQ ID NO: 13288 - DNA, 201 bp, Homo sapiens
accctcttatttataccttgaggatcaaggaggtgaaaggggcattaaagaaagttctagcaaaggctctgggagtaaatattttatgattattaaaaaamaatttaagtgacactgtgatgaattttttttttggtaaaaagtagcatcttttaataagaggattttttatgggctcttctcacattttcttttgattaa

SEQ ID NO: 13289 - DNA, 201 bp, Homo sapiens
ggcttctatttcctatgtgaagtacgaggtgccagaataatactgaagaaaggaatacttcacactggggaaatatgtgtattattgttccttgatgatcmaaagaagctagtcagttcctccactaattgcctactggggatgcaggtttttcccagaagacgtggtaaaaacaaatcatggcaattttgtaaatttgca

SEQ ID NO: 13290 - DNA, 201 bp, Homo sapiens
tggtgagttttttgttgtgtatattttatcactttatattttattttacatatatgcttatatacatataatttaataaatattttaccactacatatacttttttttttttgatatggagtctccctctgtcacccaggctggagtgcaatggcacaatcttggctcactgcaagctccgcctcccgggttcacgccatt

SEQ ID NO: 13291 - DNA, 201 bp, Homo sapiens; identical to SEQ ID NO: 2081

SEQ ID NO: 13292 - DNA, 201 bp, Homo sapiens
taggttaattttgtcattttcattccattaattttcttcccattgactttcattcagttaatgttgtcattttggtaattctcaggctattcacatgacaygaacctagttaatatcatgagaactattgaactatccctacctgaactccctcacatcaatatcttccctacccatcttcctatcaatgcaccaatattt

SEQ ID NO: 13293 - DNA, 201 bp, Homo sapiens
aagctaagaactttatttcacccagtgatttctacagtttgactccaagtattttattttctaagcataccttcagcactcacctttttgaatcttttttaaaaaaaaactatacttaaataaaacagtatttatcgtgttgtacatgataaatatatacaattttaatttgtcagttaaaaataaatgaataaagaaata

SEQ ID NO: 13294 - DNA, 201 bp, Homo sapiens
gcccaggaccaagggaagtttatctccctcttctacaccatggtgacccccactttaaatcctatcatctatactttaaggaacaaggatatgaaagaggmtctgaggaaacttctctcgggaaaattgtgattcctatggacatgatttgcaaggaattcattataagccaggtagcttattcagcttctatttagtcaa

SEQ ID NO: 13295 - DNA, 201 bp, Homo sapiens
ttttggggataaattttacttatagaaacaacttagttgatagatttagcacacactcaattccacaaaaacacaactataacacaagtggaacactcaaktcgaggtaatttcagccttctgtaaaaaaatcactcaagagaagtactgcagaggaagcttcctcaagtagtgcaccactgctaacctttgaaattgtaa

SEQ ID NO: 13296 - DNA, 201 bp, Homo sapiens
gattgatgttccaagtcagcagcacattagtgaaaaatgaatagtttagggtgaaaaatgaatagtttgggaaagttggtctccatgatcctctcagctcrtgtgttctgttattctaaatttaattgttttggatgtacccattccattcctgccttaggtgcggatccccctggagggatgggattgggcaatgagagt

SEQ ID NO: 13297 - DNA, 201 bp, Homo sapiens
taacacaagtggaacactcaattcgaggtaatttcagccttctgtaaaaaaatcactcaagagaagtactgcagaggaagcttcctcaagtagtgcaccaytgctaacctttgaaattgtaagctcttcgccagctgaaacagagggatagttgaattacaatttaaccaaaatgattgagggtttaaattattgggttgg

SEQ ID NO: 13298 - DNA, 201 bp, Homo sapiens; identical to SEQ ID NO: 2085

SEQ ID NO: 13299 - DNA, 201 bp, Homo sapiens; identical to SEQ ID NO: 2086

SEQ ID NO: 13300 - DNA, 201 bp, Homo sapiens
atgcctcagccttggggaacacactttacatatggggatggtgagacataccaatgagagcaacctagcaggtttcatccttttagggttttctgattatsctcagttacagaaggttctatttgtgctcatattgattctgtatttactaactattttggggaataccaccatcattctggtttctcgtctggaacccaa

SEQ ID NO: 13301 - DNA, 201 bp, Homo sapiens
  misc_feature (1)...(201): n = A,T,C or G, or insertion/deletion polymorphism (see Tables 1-2)
gcaaatttttaaattgcaccctatatgccatcctcttaacatgtggaagagatgtgtagacatgcaaatacaacacaaagacaaagggcacactttaaagntgatgtggaaagtagatgaaagcccagttctctggttgtgtagttgcatcaagaaatagtttgaactgcctaacactggagtctcagtctacagaaaaaa

SEQ ID NO: 13302 - DNA, 201 bp, Homo sapiens; identical to SEQ ID NO: 2089

SEQ ID NO: 13303 - DNA, 201 bp, Homo sapiens
acaaactgcaaggtaaccatgaaaatgaaactggaataaggtctatgaaaaaaatagtgtgttatgcaattgattatcaaggagctaactgaaggcttccwgggaaagtggcatttaatttgccacctcagtaaagctaagaagcaaccctggaggactaaaggggagaggatgggtaaggaaaggaaagagtttcctgta

SEQ ID NO: 13304 - DNA, 201 bp, Homo sapiens; identical to SEQ ID NO: 2090

SEQ ID NO: 13305 - DNA, 201 bp, Homo sapiens; identical to SEQ ID NO: 2091

SEQ ID NO: 13306 - DNA, 201 bp, Homo sapiens
atttatttttagtggtaggtcattgtggattttttgatatgcatgtaaatatgcactttgattggctttaataatcaatccccagacaactccaaagttgwaatcattcataatttttaaagatgagcctttgaactggaatgaagaaacatggattgatgttccaagtcagcagcacattagtgaaaaatgaatagttta

SEQ ID NO: 13307 - DNA, 201 bp, Homo sapiens
tcttcactagtaaggactattagccaacttggttaaataatgcctaaataaataaaaaattttaaaactaatttttattttttggcagttcaatcattgawtaaacttttatgagatgatttgaatttatatcatatattttggttccttaaatatgtcttttcattttccaccagttagtaccaatgtgacacatatcaa

SEQ ID NO: 13308 - DNA, 201 bp, Homo sapiens; identical to SEQ ID NO: 2073

SEQ ID NO: 13309 - DNA, 201 bp, Homo sapiens; identical to SEQ ID NO: 2074

SEQ ID NO: 13310 - DNA, 201 bp, Homo sapiens
ctatagaggttatactaatttacattcccaccagcagtggataagcattccctttttaccacatccacgccaacatctattgttttttgactttataatartggccattctggctggggtagggtagaatctcattgtggttttaatttgcatttccctgattattagtgatgttaaacatttaaaaaatttgtttgttgg

SEQ ID NO: 13311 - DNA, 201 bp, Homo sapiens
gatgttccaagtcagcagcacattagtgaaaaatgaatagtttagggtgaaaaatgaatagtttgggaaagttggtctccatgatcctctcagctcatgtrttctgttattctaaatttaattgttttggatgtacccattccattcctgccttaggtgcggatccccctggagggatgggattgggcaatgagagttccc

SEQ ID NO: 13312 - DNA, 201 bp, Homo sapiens
cagctggagctttatcttgaccttccaaatctggttaatatggttctgtatccaaccaattatagtgcctgctgttttccaaactctcccaaacttcccaraattttctgagggcttttatttttagagtaactatgatcttttgctctttataaaactctcatgagtttagaacactttaaataagattatgttttaagc

SEQ ID NO: 13313 - DNA, 201 bp, Homo sapiens
ctctcatgagtttagaacactttaaataagattatgttttaagcagagataacacagatgtgacagagcatgcactgaaagcatttgaatcttccttatcrttcttttttctttatgctggcccttcaatccctttccaggaacaccacattcttctccaatattagaagcaacaatctctcttcctgcaatattttgaca

SEQ ID NO: 13314 - DNA, 201 bp, Homo sapiens; identical to SEQ ID NO: 2078

SEQ ID NO: 13315 - DNA, 201 bp, Homo sapiens
tttatattggaacttcactttctaatcaatgatactttttcaaaagaagacttgcataaagtgggatttctatttatgtttattttgtcacctttcatggrgacatatacttcatacattaataagtttgcttatcaaatgtaaattaagcttgccctgggaactgggatcggaatattggaatcgtagattatagtgcaa

SEQ ID NO: 13316 - DNA, 201 bp, Homo sapiens
ggaccactgtttctcgactctattaacactgctgtaatttctgtgtttccttctcatgaagtaattgtattttagtaaaatttgatggttagcaagaataygtatgggtagaggacacttacttaaacagactgagtgctttactgatcaggtgggcaacttccaatctggtcttaaaacacgtgaacagacactaggaaa

SEQ ID NO: 13317 - DNA, 201 bp, Homo sapiens
ataaatattttaccactacatatacttttttttttttgatatggagtctccctctgtcacccaggctggagtgcaatggcacaatcttggctcactgcaarctccgcctcccgggttcacgccattctgctgcctcagcctccagagtagctggaactacaggcgcctgccaccacgccccgctaatttttttgtattttt

SEQ ID NO: 13318 - DNA, 201 bp, Homo sapiens
cttagtgtcatgcattttacacgtcatgccttttacccatgtaacaaacctgtacttgttccctttaatgtatgataaaagttgaaatgattagttattaraatggtgagttttttgttgtgtatattttatcactttatattttattttacatatatgcttatatacatataatttaataaatattttaccactacatat

SEQ ID NO: 13319 - DNA, 201 bp, Homo sapiens
tatatcatttgtgtagtacatttgaaactacttttaaataaatactttactggattaagataggcatgaacatattcaagaaatgtttatgtcagccagcttttttttttggttgctaataacgcattaatctctgagccttcctgtagatggacacatagcttattcccttccaagaatgtagctgagatgcatgcgtgt

SEQ ID NO: 13320 - DNA, 201 bp, Homo sapiens
tgggatggaatcactgggaccccaagccttagtgtcatgcattttacacgtcatgccttttacccatgtaacaaacctgtacttgttccctttaatgtatrataaaagttgaaatgattagttattagaatggtgagttttttgttgtgtatattttatcactttatattttattttacatatatgcttatatacatataa

SEQ ID NO: 13321 - DNA, 201 bp, Homo sapiens
ttgtttaaattatttgcactaaaatactgaacttcatttcccatggcttcactctaaatggcccataccattctttttctggaaataaggaatttttgcattttgagtctagaaaacgttgtgtgaactcatggtattatacttcctatttcactgcattatagcaggcattgggttgtatactctgtagtaggaaactat

SEQ ID NO: 13322 - DNA, 201 bp, Homo sapiens
aggcaggagaatcgcttgaactcgggaggcggagtttgcagtgagctgaaatcgcgccactgcactccagcctggcaacagagtaacactccgtctcaaamacaaaacaaacaaacaaacaaaccccccaaaacaaaacaaaacaaactgcaaggtaaccatgaaaatgaaactggaataaggtctatgaaaaaaatagtg

SEQ ID NO: 13323 - DNA, 201 bp, Homo sapiens; identical to SEQ ID NO: 2083

SEQ ID NO: 13324 - DNA, 201 bp, Homo sapiens
tgatccaaagaagctagtcagttcctccactaattgcctactggggatgcaggtttttcccagaagacgtggtaaaaacaaatcatggcaattttgtaaayttgcaaaattcactgtttctgcttccctttttctccaagttttcattgccactaacataatttcctcaggataaactcaggcgagaaatataaatcttga

SEQ ID NO: 13325 - DNA, 201 bp, Homo sapiens; identical to SEQ ID NO: 2088

SEQ ID NO: 13326 - DNA, 201 bp, Homo sapiens
ctatgaattcagaggggaaagagttcaggaaggaagtctaaaaaatacagtgattatacaagaggttgaacatatgaaaaactaacaatttcaatatgtcraataacctcccaagtgactgtagtacaaagatcaccagactcagaagaatagttttgaatttcagtcctaactcttttatacctagtagataaagttatt

SEQ ID NO: 13327 - DNA, 201 bp, Homo sapiens
taacaacatcttactgcctgcacagcaaagctaagaactttatttcacccagtgatttctacagtttgactccaagtattttattttctaagcataccttyagcactcacctttttgaatcttttttaaaaaaaaactatacttaaataaaacagtatttatcgtgttgtacatgataaatatatacaattttaatttgtc

SEQ ID NO: 13328 - DNA, 201 bp, Homo sapiens
acatgtaccctaaaacttaaagtgtaataataataataaataaataaataaataaagttaggaacaatggatactggggaccaacagatgtggagggaggragtgggctattggctgaagaaccacctgttgtatatcatgctcacttcctgggatggaatcactgggaccccaagccttagtgtcatgcattttacacgt

SEQ ID NO: 13329 - DNA, 201 bp, Homo sapiens
tgctagatgacgagttagagggtgcagcgcaccagcatggcacatgtatacatatgtaactaacctgcacattgtgcacatgtaccctaaaacttaaagtrtaataataataataaataaataaataaataaagttaggaacaatggatactggggaccaacagatgtggagggaggaagtgggctattggctgaagaacc

SEQ ID NO: 13330 - DNA, 201 bp, Homo sapiens
gcctaacactggagtctcagtctacagaaaaaacacagctgtaaaattttctatggctcacatggatacacaaataataacacattgttattatatctgcwtttctgtatatgaaacattttcataattttgagatatatcttccagataaaaccttaaccaaattgtttaaattatttgcactaaaatactgaacttcat

SEQ ID NO: 13331 - DNA, 201 bp, Homo sapiens
gttctctggttgtgtagttgcatcaagaaatagtttgaactgcctaacactggagtctcagtctacagaaaaaacacagctgtaaaattttctatggctcrcatggatacacaaataataacacattgttattatatctgcatttctgtatatgaaacattttcataattttgagatatatcttccagataaaaccttaac

SEQ ID NO: 13332 - DNA, 201 bp, Homo sapiens
gcttgttaagcaaaaggatttatattttcttccttgtattccccacacctatgaaagcagaataccaattaaatgcaaatttacttaaaggaaagtaggcygggtgtggtgactcatgcctgtaatcccagcactttgggaggctgacgcggatggatcacttgaggccaggagttggaggccagcctggtcaacatggaa

SEQ ID NO: 13333 - DNA, 201 bp, Homo sapiens; identical to SEQ ID NO: 2092

SEQ ID NO: 13334 - DNA, 201 bp, Homo sapiens; identical to SEQ ID NO: 2093

SEQ ID NO: 13335 - DNA, 201 bp, Homo sapiens
gttttactttaggggacacttctgctgattgggctagggagggaggtaataagaatccagatggtggatattataggcctttttttttttttttttttttttgacagttggcagagctagctgaggttttattttgggaaaaagaaaaaatttgaattgttttgtagctggatacatgggcaaggggactacccaggcagt

SEQ ID NO: 13336 - DNA, 201 bp, Homo sapiens; identical to SEQ ID NO: 2094

SEQ ID NO: 13337 - DNA, 201 bp, Homo sapiens
tacagccctcacacacatgagctcttagaaaaaatctgtttagaggacagtaagctgacttgaggtactgagagcatggcttctctgtgccctgaaaagtrattgaggacttcaagggagattaaccttagtagaatcaatacattttccttccttcgcttctgcctgctccctaatgattaagtattcactgccgctgca

SEQ ID NO: 13338 - DNA, 201 bp, Homo sapiens
aagtcttgctttccagtggtgtttattgtcacaaagtcagtcatttcactctgaattaaaattctttaatagttttcaatcccttcagggtttagccccarggtccttattattagacactaagccctttgctctgtcctcttacttcccctccgtggcacattcttcaccactcttactgtttttatctccttcgtaaga

SEQ ID NO: 13339 - DNA, 201 bp, Homo sapiens
ttttttaatttttatttcagcatatttaccattatcagttttattgatggtttctatagtgttgaccttctcttgaaattctttgtcatgcatgaaatcayagtttttctgtttcctccagcttctctcttagtcctttgctctgcagattctctggcttctttttctttttttttttttttttttttttttttcttgaga

SEQ ID NO: 13340 - DNA, 201 bp, Homo sapiens; identical to SEQ ID NO: 2095

SEQ ID NO: 13341 - DNA, 201 bp, Homo sapiens
tttaaacatcatttatgatgtcattctttggagtgttactatacggtcagtaagtcctgtgaagaatggaacaccgctctgagagaacaaagacgtgatgkaatgcgggttgtgtatgtgtcttacggagagcctctgaagtgacattaaactgggagctaagggatcaatagtttaaacaggtggctagggaggggaaga

SEQ ID NO: 13342 - DNA, 201 bp, Homo sapiens
actttacaattcaactacttgttctacccagcattttaacggcaagaactttatatttattctcaagcagggcatgtttccctttgttcacattctctgakaaattgaaactctggtttctcttcaaattttgtgccttgtgtttttcatacttctttccagtcctgattagccccctctaaactatgattgtacactgcg

SEQ ID NO: 13343 - DNA, 201 bp, Homo sapiens
ttgccctaaagtcattctgtttaacgcttaaaatagggtaaaaattagtcagattgttgccatcgtttttcaagctcaagttagatgttgcaggtacactwgtctcctttaaacatcatttatgatgtcattctttggagtgttactatacggtcagtaagtcctgtgaagaatggaacaccgctctgagagaacaaagac

SEQ ID NO: 13344 - DNA, 201 bp, Homo sapiens
agttccagacctatatatatctcacagcttactgaccagtactgcaagaatgttccaccaacaccacagattatacaaggcagttctgctgccttccctayttcagcctcttcctgttgcatttcctatctgattatatagcaccaccataccgtcactcaggcaggaatcccaaggaacaggcttggtgcctcctttctc

SEQ ID NO: 13345 - DNA, 201 bp, Homo sapiens
ttttgtttttgttttttaatataccagtaagtctaaactctgtattcctagcacagttctctcacaggagttccagacctatatatatctcacagcttackgaccagtactgcaagaatgttccaccaacaccacagattatacaaggcagttctgctgccttccctacttcagcctcttcctgttgcatttcctatctga

SEQ ID NO: 13346 - DNA, 201 bp, Homo sapiens
gccgatatgctttagcggtaaaggaggtgggtgataggtgagatgtgaggatgagaatgaaatgacatcggggattttggtttgagcaattgagtggttcrtgtggctgtttactaaaatggggatgactggggaagagcagatgctgatggatattgctggagcaggagttctgttggggcctgttaagtgttttgtttt

SEQ ID NO: 13347 - DNA, 201 bp, Homo sapiens
cactctcactctgaaatcttgaagtctaccctttgttcttaccactgaattgtctttgttccctaggagacttgaatgaaaattctgtggagaatcttcarcagaaaacacttcaggatctgttacatgagctttcctcctggctagttttggaaggcatggccagtacaattactggaagtcaggattgtattgtgaatc

SEQ ID NO: 13348 - DNA, 201 bp, Homo sapiens; identical to SEQ ID NO: 2099

SEQ ID NO: 13349 - DNA, 201 bp, Homo sapiens
  misc_feature (1)...(201): n = A,T,C or G, or insertion/deletion polymorphism (see Tables 1-2)
ggctgaggcaggagaatctcttgaacccgggaggtggaggttgtagtgagctgagatcatgccactgcactccagcctgggcaacagagtgagactctgtntcaaacaacaaagatgagttgagtgtagcccctatccttcagaatcttccagccaacttgggagagacttaatagctatagtagagggatgtgaaagatg

SEQ ID NO: 13350 - DNA, 201 bp, Homo sapiens
ttcagtcattttatttagaattattatttttcatagcaatatgtttatattttattattagattgtgtttaaatgtgatatcctctccagtttttctgggwttttaattatgtaccttttaaattctgttggtctccttatatattttttcaaaattcttgtgttctcagcatgatattggagtgtgtcctcaacccatgc

SEQ ID NO: 13351 - DNA, 201 bp, Homo sapiens
atcctctccagtttttctgggattttaattatgtaccttttaaattctgttggtctccttatatattttttcaaaattcttgtgttctcagcatgatattrgagtgtgtcctcaacccatgcttgacccactttggcatgcatatgtgttttactttaggggacacttctgctgattgggctagggagggaggtaataaga

SEQ ID NO: 13352 - DNA, 201 bp, Homo sapiens
gtggactagtcccgattatggttattacagtttgatgaaatgtggctgagatcattggcactgtggagattaagaaatgtgaggtcagagtgttgggtaarttgttcctgcgagtgttaaggttgtcaggataatggtgggaatggggtgaagatgacaactcagcaatgacacaagaagagagtgacacagaaagattca

SEQ ID NO: 13353 - DNA, 201 bp, Homo sapiens
tggattttactggatggccactgaaaagcctttggagggtttcatgcttggccttgtttttgttttaaaagatcaccttggctgtcatgtggaaaactcaygtttgggggagcaggagtagagtcagaccaaccaggaggttgatgtgggtgagagcaagtgctgcctaggcctagagaggtgacagtgcagggcagggga

SEQ ID NO: 13354 - DNA, 201 bp, Homo sapiens
gggttttcggtggacgttaggcgacggacgggggctcctgtaagagactgaggtttctgtccgcagcactgccttcgctgaaaagagcttgcatctgagcycccgcaccgcaggaacgagccaggctcctgagaatgaggtcggggaaggcgtcttgggcaaccgaaatccatcccgagaagcttctcctcttaactagaa

SEQ ID NO: 13355 - DNA, 201 bp, Homo sapiens
ggagaaaccctgtgaccataataactgtgggaaaatacttaacaccagcccagatggtcatccatatgagaaaatccacactgcagagaaacaatacgaakgtagtcagtgtggtaagaacttcagtcaaagctcagagctactacttcatcagagagaccacacagaagaaaaaccctacaaatgtgagcaatgtgggaa

SEQ ID NO: 13356 - DNA, 201 bp, Homo sapiens
ccgctggcagaggcgttcaggggtcaggaaatgggtgtgccgcgggtaaggcgctgggccgccgagctgcggaagccgggagggcggcgatggtagggcaygcgaccagcggaggcgcggcccgcggcggcacgtgtgtcccggcgccgcatttccgagctgctgcgcccccggggccgggctgcggccacaccgaagcct

SEQ ID NO: 13357 - DNA, 201 bp, Homo sapiens
gggcgacccctctgcaaaccctgctaccaggacacactggagaagtgcggcaagtgtggccaggtggtccgggagcacatcatcagggccctgggccaggycttccacccctcctgcttcatgtgtgtgacctgtgcccggtgcatccaggatgagagctctgccctgggcagccaaaacgagatgtactgcctagacgaa

SEQ ID NO: 13358 - DNA, 201 bp, Homo sapiens
tgcaaaccctgctaccaggacacactggagaagtgcggcaagtgtggccaggtggtccgggagcacatcatcagggccctgggccaggccttccacccctyctgcttcatgtgtgtgacctgtgcccggtgcatccaggatgagagctctgccctgggcagccaaaacgagatgtactgcctagacgaattctacaagaaa

SEQ ID NO: 13359 - DNA, 201 bp, Homo sapiens
gcttcatgtgtgtgacctgtgcccggtgcatccaggatgagagctctgccctgggcagccaaaacgagatgtactgcctagacgaattctacaagaaattygctcccgtatgcagcatctgtgagaatcccattattcctcgggatgggaaagatgccttcaaaatcaagtgcatgggaagaaacttccatgtaaattgct

SEQ ID NO: 13360 - DNA, 201 bp, Homo sapiens
atgcccagtgcttcacgtggcacacctgccaccgccagctagctgggcagagcttctaccaggatgggcgacccctctgcaaaccctgctaccaggacacrctggagaagtgcggcaagtgtggccaggtggtccgggagcacatcatcagggccctgggccaggccttccacccctcctgcttcatgtgtgtgacctgtg

SEQ ID NO: 13361 - DNA, 201 bp, Homo sapiens
gacctcgtcccaccccctccactgccccctccggtgctcctgtcttctgaagaagaggctcctgctccaatgggggcctcactcattgcagacttagagcrgttgcacctgccctcgcccccaccccgaccacaggccccagtggagggaccttcagtccagcctgggcccagtcccctcgggcctggggaggaagagctt

SEQ ID NO: 13362 - DNA, 201 bp, Homo sapiens
tgctacaggtgtgaggactgcaggatcctcctgtctgtggagcccaggaaccaaggctgctaccccctggacaaccatctcttctgcaagcagtgccacgygaagcagagtgctgctgggtgctgctgagagcaccgctgggtgttaggcagtgagcggaccactaggtcccttcctgacctgctcttgcacactttcctt

SEQ ID NO: 13363 - DNA, 201 bp, Homo sapiens
ggcctgaacttccgggccttcggaccttccaggagaattggatcccagccacaccaggagctgaagccatggcctcaaagcctgagaagagtgtggcatcrtctgtctttatcacccttgcacccctgtgccacgatttagctgtggttgaggaagggggcaggcggtttgtgaggcctgatgtggcctcccctgggaggc

SEQ ID NO: 13364 - DNA, 201 bp, Homo sapiens
gctacaggtgtgaggactgcaggatcctcctgtctgtggagcccaggaaccaaggctgctaccccctggacaaccatctcttctgcaagcagtgccacgtsaagcagagtgctgctgggtgctgctgagagcaccgctgggtgttaggcagtgagcggaccactaggtcccttcctgacctgctcttgcacactttccttc

SEQ ID NO: 13365 - DNA, 201 bp, Homo sapiens
cccctgggcaccccctggcagggctgcagccacagtgccagctgcacctctgcagctctccaatggaggatgctcaccccctcctcctgtcctggatggtraggacgcacttcctgacctggacctcgtcccaccccctccactgccccctccggtgctcctgtcttctgaagaagaggctcctgctccaatgggggcctc

SEQ ID NO: 13366 - DNA, 201 bp, Homo sapiens
tgtgtgacctgtgcccggtgcatccaggatgagagctctgccctgggcagccaaaacgagatgtactgcctagacgaattctacaagaaatttgctcccgyatgcagcatctgtgagaatcccattattcctcgggatgggaaagatgccttcaaaatcaagtgcatgggaagaaacttccatgtaaattgctacaggtgt

SEQ ID NO: 13367 - DNA, 201 bp, Homo sapiens
ggccataaagaggcagtaccatgcccagtgcttcacgtggcacacctgccaccgccagctagctgggcagagcttctaccaggatgggcgacccctctgcraaccctgctaccaggacacactggagaagtgcggcaagtgtggccaggtggtccgggagcacatcatcagggccctgggccaggccttccacccctcctg

SEQ ID NO: 13368 - DNA, 201 bp, Homo sapiens
  misc_feature (1)...(201): n = A,T,C or G, or insertion/deletion polymorphism (see Tables 1-2)
ccttcaaaatcaagtgcatgggaagaaacttccatgtaaattgctacaggtgtgaggactgcaggatcctcctgtctgtggagcccaggaaccaaggctgntaccccctggacaaccatctcttctgcaagcagtgccacgtgaagcagagtgctgctgggtgctgctgagagcaccgctgggtgttaggcagtgagcgga

SEQ ID NO: 13369 - DNA, 201 bp, Homo sapiens
gaaacttccatgtaaattgctacaggtgtgaggactgcaggatcctcctgtctgtggagcccaggaaccaaggctgctaccccctggacaaccatctcttytgcaagcagtgccacgtgaagcagagtgctgctgggtgctgctgagagcaccgctgggtgttaggcagtgagcggaccactaggtcccttcctgacctgc

SEQ ID NO: 13370 - DNA, 201 bp, Homo sapiens
cagtaccatgcccagtgcttcacgtggcacacctgccaccgccagctagctgggcagagcttctaccaggatgggcgacccctctgcaaaccctgctaccwggacacactggagaagtgcggcaagtgtggccaggtggtccgggagcacatcatcagggccctgggccaggccttccacccctcctgcttcatgtgtgtg

SEQ ID NO: 13371 - DNA, 201 bp, Homo sapiens
ccgatcataagccataactgataaaaagaaacactctgttgtacccagtgaaaaaaagaaatagaattgcaggaagcaaccagagaaggagatggttttartctcagagaggatattgactagcatgtttgggacagtggaggaaatgtaccagatctctagaaaggcaaagtttcccagaaggatgtacatgggtgtgtg

SEQ ID NO: 13372 - DNA, 201 bp, Homo sapiens
gatagcagagaaatccgcctacccagcatacacagaccagaattatacagaacttcccagtcatgatggaggggtagtgtaatggacgacagatggccagrtaccgatcataagccataactgataaaaagaaacactctgttgtacccagtgaaaaaaagaaatagaattgcaggaagcaaccagagaaggagatggttt

SEQ ID NO: 13373 - DNA, 201 bp, Homo sapiens
tgcttcatcagcaaagcaaattgtcattgaccatcggtgttctctccacagtctgggaagcatgaataactcacagatatctactgtgacgcagtttgtgktgttggggtttcctggtccctggaaaattcagatcatctttttctcaatgattttgttggtctacatcttcactctgactgggaatatggccatcatctg

SEQ ID NO: 13374 - DNA, 201 bp, Homo sapiens; identical to SEQ ID NO: 2132

SEQ ID NO: 13375 - DNA, 201 bp, Homo sapiens; identical to SEQ ID NO: 2133

SEQ ID NO: 13376 - DNA, 201 bp, Homo sapiens
aatactggcaaaacaaatccagcagcacatcaaaaagcttatccaccatgatcaagtgggcttcatctctgggatgcaaggctggttcaatatatgcaaaycaataaatgtaatccagcatataaacagaaccaaagacaaaaaccacatgattatctcaatagatgcagaaaaagcctttgacaaaattcaacaacactt

SEQ ID NO: 13377 - DNA, 201 bp, Homo sapiens; identical to SEQ ID NO: 2134

SEQ ID NO: 13378 - DNA, 201 bp, Homo sapiens
acctggcaactcagttgctatgcataagctcatcacactgatatattctgtggtaacacctgtcttaaaccccctcatctacagcctacgcaacaaggacrtgaaatatgccctccatcatgtcttctgtggaatgagaattatccagagatcatgaatagggttttttataacccaatgactcttaatgcgattggaaga

SEQ ID NO: 13379 - DNA, 201 bp, Homo sapiens
acacctgtcttaaaccccctcatctacagcctacgcaacaaggacatgaaatatgccctccatcatgtcttctgtggaatgagaattatccagagatcatraatagggttttttataacccaatgactcttaatgcgattggaagaataatcctcttcttttaacactaactgacttgattttattcatggtcatcgccat

SEQ ID NO: 13380 - DNA, 201 bp, Homo sapiens
  misc_feature (1)...(201): n = A,T,C or G, or insertion/deletion polymorphism (see Tables 1-2)
tggcctaccataacctagtgacccctgatccagggcaggaaatactgttcagaaaaatctatagactcttttactaccagaaactgaccatatgtggttcnagttgacctgagtgaggcaggtctcttacatacaggttggctatcactgttttaataatctgagtttgatctatccaatactgtaggcactggtcacgag

SEQ ID NO: 13381 - DNA, 201 bp, Homo sapiens
atgtggttcgagttgacctgagtgaggcaggtctcttacatacaggttggctatcactgttttaataatctgagtttgatctatccaatactgtaggcacyggtcacgagaggctatttaaatgttaattcatatgaattacaataaaataaaatattcaatcagttccttagccttattttccatttcaagtgtttaata

SEQ ID NO: 13382 - DNA, 201 bp, Homo sapiens
attgcttgaacccaggaggcagaggttgcagtgagccaagagtgcaccattgcactccagcctgggcgacagagtgagactccgtctcaaaaaaaaaaaaagagggagtgggaatcatctttattattttactgatgcttcaagaatggtgaacaaaatggagtcctgtggaattccaccaccaaaaaaatgatagtattc

SEQ ID NO: 13383 - DNA, 201 bp, Homo sapiens
gatgttaggaaaacttacaccatacacaaaaatcaattcaaaatggactaaagacttaaacataagacctgaaactgtaaaactcttagaagaaaacatarggacaaagttccattggtctggacaatgatttttttttatttgaaaccaaaagcacaagaaacaaaaacacaaataagggagaccacattttctgcacag

SEQ ID NO: 13384 - DNA, 201 bp, Homo sapiens
acccaggaggcagaggttgcagtgagccaagagtgcaccattgcactccagcctgggcgacagagtgagactccgtctcaaaaaaaaaaaaagagggagtkggaatcatctttattattttactgatgcttcaagaatggtgaacaaaatggagtcctgtggaattccaccaccaaaaaaatgatagtattcataagttgg

SEQ ID NO: 13385 - DNA, 201 bp, Homo sapiens
  misc_feature (1)...(201): n = A,T,C or G, or insertion/deletion polymorphism (see Tables 1-2)
acaaggtacaaaaattaggacctggaagggcttggggaaagggattaatggggcccatctttagagtccaggaatagaaaggagattgtgggttgtggacntagggaagactctcccagggcaggtaggtcttagctttgaactgaaatacttgggggtaggggaggaaataggaagtcaacataatgatgcttattcttc

SEQ ID NO: 13386 - DNA, 201 bp, Homo sapiens
  misc_feature (1)...(201): n = A,T,C or G, or insertion/deletion polymorphism (see Tables 1-2)
cttaagaagtttcagaaaaggcatgcaggtttgtaggactaagagggactaagcaagctacaagaaaataggagtgcccagggtagagttaattggagaancagaatttgaggaaaggcacaaagaggctttctaaaagactggtaaatgctgtgagtgaagttgggaccagatacccagaagaggggtcaagacttgaaa

SEQ ID NO: 13387 - DNA, 201 bp, Homo sapiens
  misc_feature (1)...(201): n = A,T,C or G, or insertion/deletion polymorphism (see Tables 1-2)
ccacatctttcaatgctctacattggaatgcagaagcataaatataactctttggtgtcattgagttttttgaggttctgccttccctatggcaagagaantgagcttcatggtctaatattaatggtggaagtaattgaaagaaaaatatatatctctaaaagtaaaacttcactagttaatatttgaaaatatttttct

SEQ ID NO: 13388 - DNA, 201 bp, Homo sapiens
tttttcttctacagaatcaaacacaagggctcagaagtcatcatgcctgccaactgaggcatatttcctagatcattttgtaagtacagggatttggtctsgccttcctcatgtgagattcccagggatgctcactttcttcctgtagcctcaccaggggcactacattcccacaagctcagaatggcctctcattacctg

SEQ ID NO: 13389 - DNA, 201 bp, Homo sapiens
acttacaccatacacaaaaatcaattcaaaatggactaaagacttaaacataagacctgaaactgtaaaactcttagaagaaaacatagggacaaagttcmattggtctggacaatgatttttttttatttgaaaccaaaagcacaagaaacaaaaacacaaataagggagaccacattttctgcacagcaaaggaaacaa

SEQ ID NO: 13390 - DNA, 201 bp, Homo sapiens
attgggtcccagctctctgatccagtaccttcagtttaatgcatggtcttcatcctttaccaaaacttacctttcactcattcttcctgtacacaaataayccatgttaggttaaccccagggtaaactatgttgttaatgagaagctctacaacttgctcaagaccacacaatgaatcagtgcagaacgaacatacaaac

SEQ ID NO: 13391 - DNA, 201 bp, Homo sapiens
aatgggccttctgatgtctccagatgttccaaattagaatggtggtctttcagcttagtccttttattaaccctgtacaaaggagcgtgataaatagtagmaggtggaggccagtggagcagtttagacgcatgagcacttgcccaggctccggtgagcccaccatgctgcggatgagctcccactcatgcttcaaggttt

SEQ ID NO: 13392 - DNA, 201 bp, Homo sapiens
tgccaccaccctggaaccatgcaaggcagatgagggtggcaggtttcctggcagttccctgggctttctgagttctgaacattactccagcctgttggtgrggcccttctcttacttgttctgtgttccagagtatatcttggaacctccaccctgcatatcagcacctgaaaactgtactcacctgtgtacaatgcagga

SEQ ID NO: 13393 - DNA, 201 bp, Homo sapiens; identical to SEQ ID NO: 2137
  misc_feature (1)...(201): n = A,T,C or G, or insertion/deletion polymorphism (see Tables 1-2)

SEQ ID NO: 13394 - DNA, 201 bp, Homo sapiens
gatttcagtgctgttcctccttctgtgggatagtctgttcatcagaaacatttcaaaagcgcaacaggtaagagatatctcatatccaggtctgatcctakagctgctggtgggagcccagcagaagagtcccttaccagcaactgtgctggatctctccttttttttttttttccttggtggccatgttgccaacatgcc

SEQ ID NO: 13395 - DNA, 201 bp, Homo sapiens
cacctgtgtacaatgcaggaagattgcgagaaaggatttcagtgctgttcctccttctgtgggatagtctgttcatcagaaacatttcaaaagcgcaacasgtaagagatatctcatatccaggtctgatcctagagctgctggtgggagcccagcagaagagtcccttaccagcaactgtgctggatctctccttttttt

SEQ ID NO: 13396 - DNA, 201 bp, Homo sapiens
tgaatagacttaatcaaaatgcaactatatttgtatttgaattctgatgcccagtgcattttatatccaaatgctataatctgtacctgaaaattttactrttcatcacaaagaataaaaaaatttattttaacagattttaagtgggagttatataattggagagaaacagatgagtactccgcagaaatgaaacaattt

SEQ ID NO: 13397 - DNA, 201 bp, Homo sapiens; identical to SEQ ID NO: 2142

SEQ ID NO: 13398 - DNA, 201 bp, Homo sapiens
tgtagaagagaaactactttctgaagaaacagagtgtctgctacgagctcaattttcaggtacttccccctagtaacctgtagtatttacaaaaatagctytttttctgaggtaccattaagtatttattttgttcttgcctatgaaaacatgctttcagttgggaagtgaaagtctcagtagcttaagaagaatgaaaat

SEQ ID NO: 13399 - DNA, 201 bp, Homo sapiens
aagggtccagcttcagtcttctgcatatggctagccagttaccccagcaccatttattgaatagggagtcttcccttttgcttggttttgtcagctttgtygaagatcagattgtcataggtgtgtggccttatttccggtttgccctattttaatatacaaacaacagatacttttgtcttctaaatagattataaccta

SEQ ID NO: 13400 - DNA, 201 bp, Homo sapiens; identical to SEQ ID NO: 2143

SEQ ID NO: 13401 - DNA, 201 bp, Homo sapiens
ctgcagaacctgtatgtatgaaaagttggctgtctgtatatgcaagttttgcatcctataaatactgtattttctctccatgcatttggttgaaaaaaaartcatgtataagtgtacccatgccatttagttcagaagtcaactctgtgtgtgtgtgtcatatatgtgtaagttcgtagtatgtactaagggtgaattttg

SEQ ID NO: 13402 - DNA, 201 bp, Homo sapiens; identical to SEQ ID NO: 2144

SEQ ID NO: 13403 - DNA, 201 bp, Homo sapiens; identical to SEQ ID NO: 2145

SEQ ID NO: 13404 - DNA, 201 bp, Homo sapiens; identical to SEQ ID NO: 2148
  misc_feature (1)...(201): n = A,T,C or G, or insertion/deletion polymorphism (see Tables 1-2)

SEQ ID NO: 13405 - DNA, 201 bp, Homo sapiens; identical to SEQ ID NO: 2146
  misc_feature (1)...(201): n = A,T,C or G, or insertion/deletion polymorphism (see Tables 1-2)

SEQ ID NO: 13406 - DNA, 201 bp, Homo sapiens; identical to SEQ ID NO: 2149

SEQ ID NO: 13407 - DNA, 201 bp, Homo sapiens
tttttagaaaagagtagctatctccaaaggagatgaatattttatgtttttccaagaggggactagaggtcataaataggaatccccaccaggaacagaattttttttttttctcttgatattaggcaagatggtctgttcagtctgaatagtaccctatccccagaaatgtttttcatatctaattttcaccctcagata

SEQ ID NO: 13408 - DNA, 201 bp, Homo sapiens
taagtaagttttcccatttctccgcaattttgccagcatctattatttgttgactttttaataatagtcattctgactggtgtgggatagtatctcattgyggttttgatttgcatttctcttaacgattggtgatgttgagctttttttcatatgcttgttggtggcatgtatgtcttttgaaaagtgtctgttcatgtc

SEQ ID NO: 13409 - DNA, 201 bp, Homo sapiens; identical to SEQ ID NO: 2141

SEQ ID NO: 13410 - DNA, 201 bp, Homo sapiens
ccctattttaatatacaaacaacagatacttttgtcttctaaatagattataacctacttatagtcaaggtatgtcttttgccatcctgtaagtatgttaktgttttgttttgttttgttttgagacagttttgcctcatcgcccaggctggagtgcagtggcacaatctcggctcactgcaacctctgcctcccacgttc

SEQ ID NO: 13411 - DNA, 201 bp, Homo sapiens
actgttaacatttagagtatttccttcctgtgtgtgtgtgtgtgtgtgcacttagatttattagtgtttacatagttatgatcttttgtaaataaatttcyaaccagccttttattactttattatgtatgccttttatctgtaacgttattttgaactctttatagacaagttttaatagctgcatgatatcaggtagtc

SEQ ID NO: 13412 - DNA, 201 bp, Homo sapiens
tatattggtttgttaatttaaaatatcgtgttgatgagagtataaatgaaaattgctttgaactttcgcaaggacagtttgggaatatgaattgtaaattktgtaaatatgaattgcacaattatgtgcagctgaaatcctaaatttgtctttaatttcttataaaatataagtaagtttaccttggcatgttattcctag

SEQ ID NO: 13413 - DNA, 201 bp, Homo sapiens
tgctgtaggttgatacttaagggcgtgtaaaaatatgtgaaacattaattaccattaagtgaaaaatagattcagtatacaattttgaaaattatatctasgtatgtatacataaagacattaacagtaacttttacttctttatactttttgtattgtttttttaaaaagaatgtgtctttttttatgatcataagaaaa

SEQ ID NO: 13414 - DNA, 201 bp, Homo sapiens
  misc_feature (1)...(201): n = A,T,C or G, or insertion/deletion polymorphism (see Tables 1-2)
gcctggcccataagtgtgttttttaaacctattaatgcatcatgaaattagtgggtcataattgccatttaagtatatataaatatatttatatttatttnaactattacagtcatcccttggtatatgtgggggattggttctaggacacccccaacttgtgccagtataccaaaatccatgtatatacaagtcctgtag

SEQ ID NO: 13415 - DNA, 201 bp, Homo sapiens
tagcactgctatactgttgagtcattgtcttactgttttttcctttttttaaaaatcttgtaattttaggttcaggggtacatgtgaaggtttgttacatrggtaaactcctgtcatgggggtttgttgtacagattatttcatcccaacctccaccctcgagtagaccccagtgtctgttgttttcttccttgtgtataa

SEQ ID NO: 13416 - DNA, 201 bp, Homo sapiens
gtctcaaactcctgacctcaggtgatttgcccacgtcagcctcccaaagtgctgggattataggcatgagccaccatgcctggcccataagtgtgtttttwaaacctattaatgcatcatgaaattagtgggtcataattgccatttaagtatatataaatatatttatatttatttaaactattacagtcatcccttggt

SEQ ID NO: 13417 - DNA, 201 bp, Homo sapiens
  misc_feature (1)...(201): n = A,T,C or G, or insertion/deletion polymorphism (see Tables 1-2)
taatcaccaaaattcttttgtatcttatggttttccagttataaaagtaacatttattataggaaaagcaaagaaatatttaagtaattaaaataatgttnatcccactacccagagatgaaaccatatggtttataccattttctgttctgcacttatcactttttgtagtagctcttacccatttgctactgcaaattc

SEQ ID NO: 13418 - DNA, 201 bp, Homo sapiens
catgcctggcccataagtgtgttttttaaacctattaatgcatcatgaaattagtgggtcataattgccatttaagtatatataaatatatttatatttayttaaactattacagtcatcccttggtatatgtgggggattggttctaggacacccccaacttgtgccagtataccaaaatccatgtatatacaagtcctg

SEQ ID NO: 13419 - DNA, 201 bp, Homo sapiens
  misc_feature (1)...(201): n = A,T,C or G, or insertion/deletion polymorphism (see Tables 1-2)
tagctcttacccatttgctactgcaaattcattataaacagttttaactgctacataattttaccaaagtctttttgcagtagagttgtactagtttgcanaatttctttgagcttggaaattgtgtatctccacatttttttctaaaatattctatagagtagactataaacccatggaaaggctacctagtcctcttta

SEQ ID NO: 13420 - DNA, 201 bp, Homo sapiens
aaagaataaaaaaatttattttaacagattttaagtgggagttatataattggagagaaacagatgagtactccgcagaaatgaaacaatttgcatgtacrctctacttgtgcagtagcaaagtctatgattatgtaagaaagattcttaagctgcctcattcttccatcctcagaacgtaagtgaattatttttttattt

SEQ ID NO: 13421 - DNA, 201 bp, Homo sapiens
ttttccaggttgacttcaaagatgcctcagttactgcaaaacattaatgggatcatcgaggccttcaggcgctatgcaaggacggagggcaactgcacagygctcacccgaggggagctgaaaagactcttggagcaagagtttgccgatgtgattgtggtacggtgtgctgagccgggtggagaggggacatagcaggag

SEQ ID NO: 13422 - DNA, 201 bp, Homo sapiens; identical to SEQ ID NO: 2162

SEQ ID NO: 13423 - DNA, 201 bp, Homo sapiens; identical to SEQ ID NO: 2163

SEQ ID NO: 13424 - DNA, 201 bp, Homo sapiens
  misc_feature (1)...(201): n = A,T,C or G, or insertion/deletion polymorphism (see Tables 1-2)
acaggagcagagccttggaatatttcaaaatgaaaataattgctgctttctgccgcctcttaaatttgatacagtaaatatttcccacgtctatctgaaangtaatcatccattcatagacattcattagaagcatagctctgggcttgcacgaagcagttactcaaaaatattagcagactgatcacatcagaaatgaaa

SEQ ID NO: 13425 - DNA, 201 bp, Homo sapiens
tcattagacagacggagtttagcctgctgagcagtctgcctcggcctctgtgtgtgtatgtgtgtgtgtgtgtgtgtgtgtgtgtgtgcgcgcgcgcgtgygcgcgagtgtgtgtatgcgcgcgcgagtgtgtgtatgtgtgtgtgtggtaagtacatagctgtttggggcagtcaggagataacgatcatgatgtaggac

SEQ ID NO: 13426 - DNA, 201 bp, Homo sapiens; identical to SEQ ID NO: 2164

SEQ ID NO: 13427 - DNA, 201 bp, Homo sapiens
aaatcttcacaataatcccacagagtactaatatcaccttcaattacaatgagtagtaaactgaggcatggagaggcaaagcaacttgtcccagctcacaycatacttaagtggtggggccagcatttaatcctgactcaggaacctgcctccatcctgtgtgctcctccttcccatacataagatgcattatgtaggaaa

SEQ ID NO: 13428 - DNA, 201 bp, Homo sapiens
aagatgcattatgtaggaaaggacaaaggaagactaaaaacagagctgaacgtgcaaggaaagacctagcagcagacgtgctataaaggaaatagctgagrttgattatggagcctccaagggaacttttcatcttttccaggttgacttcaaagatgcctcagttactgcaaaacattaatgggatcatcgaggccttca

SEQ ID NO: 13429 - DNA, 201 bp, Homo sapiens; identical to SEQ ID NO: 2165

SEQ ID NO: 13430 - DNA, 201 bp, Homo sapiens
gtgcaaggaaagacctagcagcagacgtgctataaaggaaatagctgaggttgattatggagcctccaagggaacttttcatcttttccaggttgacttcraagatgcctcagttactgcaaaacattaatgggatcatcgaggccttcaggcgctatgcaaggacggagggcaactgcacagcgctcacccgaggggagc

SEQ ID NO: 13431 - DNA, 201 bp, Homo sapiens; identical to SEQ ID NO: 2159

SEQ ID NO: 13432 - DNA, 201 bp, Homo sapiens; identical to SEQ ID NO: 2160

SEQ ID NO: 13433 - DNA, 201 bp, Homo sapiens
ggtggggccagcatttaatcctgactcaggaacctgcctccatcctgtgtgctcctccttcccatacataagatgcattatgtaggaaaggacaaaggaaractaaaaacagagctgaacgtgcaaggaaagacctagcagcagacgtgctataaaggaaatagctgaggttgattatggagcctccaagggaacttttca

SEQ ID NO: 13434 - DNA, 201 bp, Homo sapiens
gtaccaaatgtggtaggaggggcctgttaattagaccaaggcagtcacacatcagcaggtaaaacagagacaagaggaggtgtggctgggctgggctggakcttggatgaatcaagccttcccatagggcaggatatcctgtctaaaacaagagccttggttaaaacccctataaaaggttctcatcacactgacctggta

SEQ ID NO: 13435 - DNA, 201 bp, Homo sapiens
gcattatgtaggaaaggacaaaggaagactaaaaacagagctgaacgtgcaaggaaagacctagcagcagacgtgctataaaggaaatagctgaggttgaytatggagcctccaagggaacttttcatcttttccaggttgacttcaaagatgcctcagttactgcaaaacattaatgggatcatcgaggccttcaggcgc

SEQ ID NO: 13436 - DNA, 201 bp, Homo sapiens
tcttaggtttgaagactaattgaatctgctttcagcattttgttgcagagttttggaaccagctcctttagaatgctctaatagcttgatggccttgtcasagttttcaatatttctaagcagagtctctaatcttctcttaattttcttctgatcttcaagagcacagccaattactatggattgaaacttctgatcaac

SEQ ID NO: 13437 - DNA, 201 bp, Homo sapiens; identical to SEQ ID NO: 2172

SEQ ID NO: 13438 - DNA, 201 bp, Homo sapiens
attagtttattttgtacatttttgtgttatgaaaaaataatttcattttaaaccacagatttgagagggaagatctgatctcctagaattagagttggtayagaaaccatttcagctccaaaaatgttggaggaagatatggaagtcgccataaagatggtggttgtagggaatggagcagttggaaaatcaagtatgatt

SEQ ID NO: 13439 - DNA, 201 bp, Homo sapiens
gcttgaatccgggaggcagaggctgccgtgagccaagatcatgccactgcactccagcctgggcgacagagcaagactccatctcaaaaaaaaaaaaaaaragagagagaaaatccttcctgaattttaggatctgcttcagaggagaaggggctaggggagatcaaagtgactctcctgcttctgctgttttctcagatt

SEQ ID NO: 13440 - DNA, 201 bp, Homo sapiens
  misc_feature (1)...(201): n = A,T,C or G, or insertion/deletion polymorphism (see Tables 1-2)
tgtaagattttgtgtctcttttatgacacttaacatataatgtcatatggcattacttgtttactgtcttgtcttattacattgtaaacttcttgtgggcnagaactggtcttagtcacctttgtatccctgacagtatctctggcccagaattttgtgtgtcatggatgctatatcataaattggagattacattttgtg

SEQ ID NO: 13441 - DNA, 201 bp, Homo sapiens
agaatttggcaacagcctgtaattttagtttaccattctctctagcttttataatggaattaaatcagtattttatggtattccaaaaagaatgtgtatgsttttgaggtactttgacagttgaacacatttgagaaccactgtttttggtaaaaatgaaaatagaatttatatgttgaaaagtaaagaagagtagtgcaa

SEQ ID NO: 13442 - DNA, 201 bp, Homo sapiens; identical to SEQ ID NO: 2168

SEQ ID NO: 13443 - DNA, 201 bp, Homo sapiens
aaataccttcagaaactcaaacaacaaatagctgaggatccagaactaacgcattcaagtagtaacaagattggtaagtacataggaaattttagcccatrtttacttggtaaagttaaaaaacacatataatatgctcatttctttcagaaatgtgatttaaaagtgattattaaactattaagtcagtgatttaagtat

SEQ ID NO: 13444 - DNA, 201 bp, Homo sapiens
ttttacctgttttttaagtcttcttatgttagttatctgttgctatgtaacaaattagcccaaaacttagtgtcttaaaacaacaaacatctattatatcmcagtttctgtagatcaggagtttgagaatggcttagctggtggtttttcatgaagctgcagttgagatgttggctaggcctgttctcacggaaaggctac

SEQ ID NO: 13445 - DNA, 201 bp, Homo sapiens
ctttctacttctttttgttagtgcttaattatttactaatgcccttgaatacttttcatcctcgtaaggttttccatttttattattatctttgaaaaatktaagctatatatgtagagtatatgcatatgtggttttgatgcatacctgttaaaaataactcagttgttttagaactccatgatagtagatattccacta

SEQ ID NO: 13446 - DNA, 201 bp, Homo sapiens
gggactacaggtgcccaccaccacacccagctaatttttgtatttttagtagagacaaggtttcactatgttggccaggcttgttttgaactcctgacctygtgatccgcccacctcagcctcccaaagtgctgggattacaggcatgagccaccgcacccggccaagacattctttacagatccttttcctttccaaccc

SEQ ID NO: 13447 - DNA, 201 bp, Homo sapiens; identical to SEQ ID NO: 2169

SEQ ID NO: 13448 - DNA, 201 bp, Homo sapiens
cgtcactgatctgcctcatgtcctggctattttggatactgtggatcatttccagaaggatttctttctcttgctcaacagcagttgctgcttctctcaargcttcaaccctatagaaattgggaaaacaaaacggttattgtatgcaggatgttcttcctattaattttctttatctctcattcaacccaaatcaagttt

SEQ ID NO: 13449 - DNA, 201 bp, Homo sapiens
aattgatgtgcagtgaggaagctgaggcactggcaaaaaggttaaagttaagattctacagaacatcagtgaaagaagatctaaatgtgaatgaaggtaarttacctttaaaggatatagattgcaaaaagaaattttattcttgcgcttttaaaattgtgttgtttagaaattatatttataacgagaacaagatttttt

SEQ ID NO: 13450 - DNA, 201 bp, Homo sapiens
cttgaactcctgggctcaaacaatcctgccttagcttcccgagtagctgggactacaggctcacgccaccatgcctggccaatttttttttttttttttttggtagagacagggactcacatggtgcccaggctggtcttgaacccctggcctcaagcaatcctcctgcctcagcctcccaaagcactgggattataggtg

SEQ ID NO: 13451 - DNA, 201 bp, Homo sapiens
atgaacttttaggtacagtatcatataaacacataatttcttcttttagacaggatttaccactgattttattgaagtagcttgcttatttacaaacttayaccagttatataaaatcgatatacttgagaaattgggtgaattcatgtaacttttgaatatatagcttatttttttcgcttttgaaaatgtaggatttat

SEQ ID NO: 13452 - DNA, 201 bp, Homo sapiens
atccttatgagaatctaactaatgcctgatgatttgaggtagaacagttttatccccaaaccgtccctccactgccccccaccaacctcccatctgtggawgttgtcttccaccaaagcaagtccctggtgccaaaatggttgggaaccactgccctagaccatctgatcgtatactcagagggcaagatgcaggcatcag

SEQ ID NO: 13453 - DNA, 201 bp, Homo sapiens; identical to SEQ ID NO: 2171

SEQ ID NO: 13454 - DNA, 201 bp, Homo sapiens
caacaggtaactcaggcgtgtcagtggcaatcactcttttccctcaatttatacaggtgtctttaatacatctggtggaagtcactccggtcagaattcargtaccctcaatggtggagatgtcatcaatcttagacccaacaaacaaaggaccaagaaaaacagaaatccttttagcagctgtagcataccctaagatgt

SEQ ID NO: 13455 - DNA, 201 bp, Homo sapiens
tgtgagccactgcacccagccagattttttttttaccattaaaagggcacttaagagttgtgcattttattgtttgtaaattatacctcaattattattctttttttgagacagagtctctctctgtcacccaggttggagtgcagtggcgcaatctctgctcactgcagcctcctcctcctgggtccaagtgattctcgt

SEQ ID NO: 13456 - DNA, 201 bp, Homo sapiens
gaaatactatagagaaggatatctaaggatatataagatctctgtcagattctctgaatctgagccattgcctgcaatttgaagttgttatagtgatattrcatagcatcgtttaagttttagaaacaagttttaagtacacgaattgtgaactccctagacagtacccaaattttagtattcttacctacattatgggct

SEQ ID NO: 13457 - DNA, 201 bp, Homo sapiens
aaacaagagtcagggtttggcttcagggtgctaggaggagatggacctgaccagtctgtaagtgtcacttctttggaacatggctgtttcctgttcaaacrttttgagtggtgatttggtggattatggtgtgttttaagtttttttttctctgacagtttcattaatatgaagaataactgcatttccattattatcata

SEQ ID NO: 13458 - DNA, 201 bp, Homo sapiens
tgtgattttgctctcagccttttaaatgtacttctcagtattctctccacaccctctctaagctgggcctcactggcctctatgtacatggccttcccccscaaccgcaactcccatagcacctcctatctctgcacttcactggacatcattcttacataaccatatccctatttaaatggtctgctctttgtaaacaaa

SEQ ID NO: 13459 - DNA, 201 bp, Homo sapiens
gacatgtttatttcttctctctttacagtaaatacttcttacctataaataacattaatattttcccaaaggaaaaattttagtcatgaaatagatttttrtgacttaatattctttttttttttttttgagatggagtcttgctctgttgcccaggctggaatgcagtggcacgatctcagttcactgcaacctctgcct

SEQ ID NO: 13460 - DNA, 201 bp, Homo sapiens
cagttatcatatcctgcatttttatattttccccttagaaaaaggttaaattttctcgagttatataataattaccaagaattctcagtaagatgtgtttytagtagtactactaccttacttagaaaaagtggactttttatttctgtcatggtatatccagtttccttgatactctgattaatgggcataattcaggaa

SEQ ID NO: 13461 - DNA, 201 bp, Homo sapiens
tatgaagtcctaaaatcttttcagtgattatggatggcagttatcatatcctgcatttttatattttccccttagaaaaaggttaaattttctcgagttakataataattaccaagaattctcagtaagatgtgtttctagtagtactactaccttacttagaaaaagtggactttttatttctgtcatggtatatccagt

SEQ ID NO: 13462 - DNA, 201 bp, Homo sapiens
ttagtgcattctattgtaggtaaattatttctttcataccatcaatatttagaaaatgaaagtttatgaaaatattacttaccatagcatataagtttttwaaaaatacctagaaattaacctctaatgaaacgtaagtcctctatagtgtgaaattgagggatgctaaagaagatctaaatatgctgacagaaatttctt

SEQ ID NO: 13463 - DNA, 201 bp, Homo sapiens
ggccttccataaccataaactatagacaattatattaaatgaattagttctttctagcccaccaagtaggaatcctctgcaaatttgctgttttatagatkaaaaagaatccctcagcttctggcctttttttttttttttttttgagacagagtctcactccatcacccaggctggaatgcagtggtgtgattttggctc

SEQ ID NO: 13464 - DNA, 201 bp, Homo sapiens
aaagttacaaaaggatatgtacattatactatttatgaaaaaatatgtgaaatattgtgaaaatactctgtgaagcttttatgaaaacaatagtatttacrtgttatagatgcatatatacatatcctagatgtatattcaggaggaaagacacatatcaacttcaggacagctcagggagggagtggctatagggacagg

SEQ ID NO: 13465 - DNA, 201 bp, Homo sapiens
aagtcctctatagtgtgaaattgagggatgctaaagaagatctaaatatgctgacagaaatttcttattcatgaattaaaggcagtatggcaaagataccrgttctgctcaaattgacttgtagattcaatgtaattccataaaaatttcagcctttttagcctgtttatctgattctagaatgtatatggacaggctttg

SEQ ID NO: 13466 - DNA, 201 bp, Homo sapiens
agggcttcaacaagtataacaaagacaccaaagttcaatgtcacacaggtttgatgtcagtttcctgccttgccacttactggttctttggtataggaaasaatcttagtttaccttctctgtaagatggtcataacatttgtgccttcagattgttataaaaatgaaatgagataatatatgtataatgcctggtacata

SEQ ID NO: 13467 - DNA, 201 bp, Homo sapiens
ggactacaggctcatgccaccatggctggctaatttttgtattttttggtagagatggggtttcatcatgttggccaggctggtctgaaactcctgacctyaagtgatccacccacctcaggctcccaaagtgctgggattacaagtgtgagccaccatgcccagcccaagaaataatttttaaaataatttttataccgt

SEQ ID NO: 13468 - DNA, 201 bp, Homo sapiens
ctttccactttaaaattaaaaaaatacaactctgtagcacaagaatataagcctcatgaaggtatgaatttttatttgtgtagttatctgctgtaagctcrgcacctaaaagagtgcctgtctggtacaaagtggacattaataaatgttgttaattggatgaatatttacatcactcttaaaaatgaggcactgtatttt

SEQ ID NO: 13469 - DNA, 201 bp, Homo sapiens
atatgaaaaaaagctcaacatcgctgattattaaagaaatgcaaatcaaaatgacagtgagatatcatcttacgccagtcagaatggtgattattaaaaartcaagaaacaatagatgctggcaaggctgtggagaaacaggaacgcttttacactattggtgggagtataaattagttcaattaatgtggaagacagtgt

SEQ ID NO: 13470 - DNA, 201 bp, Homo sapiens
ttttttgtattttagtagagatggggtttcgccatgttagccaggctggtgtcgaattcctgacctcaggtgtactgggattacaggcatgagccgctgcrcctggcctgagccaccacgcccagccagtggcttcttaaactcaagaaataaggtggtatttaaagatagactgaccctgtcaaaaagtggacaaaggat

SEQ ID NO: 13471 - DNA, 201 bp, Homo sapiens
atcatgaatttaaagtaaacttgtcaatattgcctgtattcagctgtgtatggtgacatggagtaggtggagagtaggatttaagcagagttctgatttarccaggcagtattatgaagtaaggttagggcaaaggaatcaggaatatttacaagggaataattatagtggttcatcatggaatttaagttgggttagcag

SEQ ID NO: 13472 - DNA, 201 bp, Homo sapiens
cacgtaatatatagtgattagatcagggtgataagcattaaatgtcttgatgcacctagatgacaaagtcaaaatatatacttgctttcacaactaaaacttttttttttttttttttgagacggagttttactcttgcccaggctagagtgcagcagcacgatcttggctcactgcaacctccgccttctgcctcccagg

SEQ ID NO: 13473 - DNA, 201 bp, Homo sapiens
tagcaaatataaactctttcaaggtggtttggtgtaaagaggagagaaataggttggctgccaaggggtaaagagaattattttctttttactgaactggraacatgtttttatgtggttggatatgatctaatagatagagaagattggtgatgcaggaaggagagtgaaagaattgctgtaggcaagagaagatgggat

SEQ ID NO: 13474 - DNA, 201 bp, Homo sapiens
actgttattggctatattgggtacgtttatgaagaagctatagtaaatataatatcaaaagcttcacagcttggcatcttctgcaggactttatttagcarcagaaagcccctctgctatcatctatcagtctctccatgttccatagcctaaagatacatatttgtcccctaatctatgatgatggaatggtatgataga

SEQ ID NO: 13475 - DNA, 201 bp, Homo sapiens
ctcccaagcctccagcagaacccagcccttttcagccagatccagttgatcaagtcctctttgataatgagtttgatgcagaatctcaaagaaaacgaacracatctgtcagcaagatggaaagaatggatagctctcttcctgaagaggaagaagatgaggacaaggaagctattaatggcagtggaaacgcaggtttgt

SEQ ID NO: 13476 - DNA, 201 bp, Homo sapiens
accgccccaccaaccctaactacccttcccagcctctggtaatcatccttctactctctagctccattagttcagttgttttaatttttagcatccacaargaaatgagagcattcaaagtttgtgtttctttgcctgacttatttcacttaacataatgatcttcagttccatctgtgtcattgcaaatgacaagatctc

SEQ ID NO: 13477 - DNA, 201 bp, Homo sapiens
tgtttttatgccaataccatcttcctttagttactatagctctgtagtataatttgaagtcaggtaatgtgattcctccagttgtgttctttttcctcagkctagctttggctattctgggtcttttgtggttccatataaatttcagaattgttttttctatttctgtgaagaatgtcattggtattttgatagagattt

SEQ ID NO: 13478 - DNA, 201 bp, Homo sapiens
tttcaaagaacatctttatttctgccttcatttcgttatgtacccatgcccacaagagaaagcaggaaagagccaaaattgacatcctaacatcacaattraaagaactagaaaagcaagagcaaacacattcaaaagctagcagaaggcaagaaataactaaattcagagcagaactgaaggaaatagagacacaaaaaa

SEQ ID NO: 13479 - DNA, 201 bp, Homo sapiens
gagctttaattgtagatgtggccatatatgtatatatccttaaagagaaaaaaagggagatttgaaagcaatctagcaataatatctagatgatgtatatataaataaatacatgtacatatacttatataagtaaattttatatagatatttctaatactattctgatactacagtctgtaattttatatgtttgaaata

SEQ ID NO: 13480 - DNA, 201 bp, Homo sapiens
tctagatactgtaggtgtgctttattgttctttattcttgtttttttttgtctcctctgactgtgtattttcaaataggctgtcttcaagctcactaattmtttcttctacttgatcgattctgctgttaagagactctgatgcattgtttagcatgtcagttgtatttttcaactctagatttctgtttgattcttttta

SEQ ID NO: 13481 - DNA, 201 bp, Homo sapiens
agctttaattgtagatgtggccatatatgtatatatccttaaagagaaaaaaagggagatttgaaagcaatctagcaataatatctagatgatgtatatataaataaatacatgtacatatacttatataagtaaattttatatagatatttctaatactattctgatactacagtctgtaattttatatgtttgaaatat

SEQ ID NO: 13482 - DNA, 201 bp, Homo sapiens
tttttttgtctcctctgactgtgtattttcaaataggctgtcttcaagctcactaattctttcttctacttgatcgattctgctgttaagagactctgatkcattgtttagcatgtcagttgtatttttcaactctagatttctgtttgattctttttaattatttcagtctctgttaaatttatgtgacaggattctgca

SEQ ID NO: 13483 - DNA, 201 bp, Homo sapiens
gctttaattgtagatgtggccatatatgtatatatccttaaagagaaaaaaagggagatttgaaagcaatctagcaataatatctagatgatgtatatataaataaatacatgtacatatacttatataagtaaattttatatagatatttctaatactattctgatactacagtctgtaattttatatgtttgaaatatt

SEQ ID NO: 13484 - DNA, 201 bp, Homo sapiens
ctttaattgtagatgtggccatatatgtatatatccttaaagagaaaaaaagggagatttgaaagcaatctagcaataatatctagatgatgtatatataaataaatacatgtacatatacttatataagtaaattttatatagatatttctaatactattctgatactacagtctgtaattttatatgtttgaaatattg

SEQ ID NO: 13485 - DNA, 201 bp, Homo sapiens
tcgccatgttagccaggctggtgtcgaattcctgacctcaggtgtactgggattacaggcatgagccgctgcgcctggcctgagccaccacgcccagccartggcttcttaaactcaagaaataaggtggtatttaaagatagactgaccctgtcaaaaagtggacaaaggatatgaacagatacttctcaaaaaaagaca

SEQ ID NO: 13486 - DNA, 201 bp, Homo sapiens
ccaaatgctccctttgttggcatatgtcagctgagtacagcctggttctgctttcccttgtgacaggggagcactgagttcaatgcaaatcctgacaatckctgtgctcaccctctcccaagcatgcaaattctcaccaccactgcagggaggatgggggagtggtagcactggcaattccagactgcctttcctatcttc

SEQ ID NO: 13487 - DNA, 201 bp, Homo sapiens
actggggctgctgcctttctttcagagatgccctgcccagtgaggaggaatctagagaggcagtctggccacagccgtttttctgcgctgcagtgagttcyacacagtccgaacttcctggcggcttccttaacactgtgaggggaaaaccacctactcaagtctctgccatggtggatgcccctccccccaccaagctcg

SEQ ID NO: 13488 - DNA, 201 bp, Homo sapiens
aacccagaagataaatggctgcatttgtttgccctcctaaagaaaggactgttaatctcttagttgctaattaccttgagtgctaactaaaatgctaaatsaactttcaagttaagattaaaatatatttatgttgatcttttatccttactattagtacatcccttttagtgaatttttcagatatcaaatggactattt

SEQ ID NO: 13489 - DNA, 201 bp, Homo sapiens
aacagaaccaaagacaaaaaccacatggttatctcaatagatgcagaaaaggcctttgaaaaaattcaacagcccttcatgctaaaaactctcaataaatyaggtattgatgggacatatctcaaaataataagagctatctatgacaaacccacaaccaatatcatactgaatgggcaaaaactggaagcattccctttg

SEQ ID NO: 13490 - DNA, 201 bp, Homo sapiens
aaggtttttaaatgaaagaagtacacagtaatttttattagcatttttatggcttgtggttcatatgaacacctttttgtttaatgccatcttctgttctrggcttctgattgcttgctgaaattctcactggctggtgaagaagccactcagacttaaattgtgtttgttccttgaaagtgagccctcagctttctgaca

SEQ ID NO: 13491 - DNA, 201 bp, Homo sapiens
ttccttatggctgggagaaaatagaggaccctcagtatgggacatactatgttgagtaagtttgttacctcagttaatattctcccaaatattttcctttyagcatatagctttagagaatactggatacagcactttatgcttctgtgatccagctgttgagtttttcaactaggggaatgaaaaggtaggggcagtgag

SEQ ID NO: 13492 - DNA, 201 bp, Homo sapiens
agagaatactggatacagcactttatgcttctgtgatccagctgttgagtttttcaactaggggaatgaaaaggtaggggcagtgagcatttgcttcattsaccttgggcttcctggaagttggctttgaatttctaaatatagagaataagggggaagttgcctagacaattaatagctagagatggtattgttactact

SEQ ID NO: 13493 - DNA, 201 bp, Homo sapiens
gttttgaagcatacacctaaaggtgtgctctcttttaaggagttattcaaggaaaacttagtattctttttaggggtgaaagttgcttcttaggcagctgytatggttaaatttaaacataaatatatattggagaggagtgccagacacctgcctatgttagccagagaaattaagctaatatcaatgtctaattttgcc

SEQ ID NO: 13494 - DNA, 201 bp, Homo sapiens; identical to SEQ ID NO: 2195

SEQ ID NO: 13495 - DNA, 201 bp, Homo sapiens
taaatttgttttgtttttttttaaataacaaatacaaaattatttagtcataccaagatatcccactagctgaatatacaaagatttttggatcccagtgraatctgagctactaaaggaaagtaggatgtttctacttgagaagttttagtataatttaacatttattgagtgcttactatgtcctagatgcatggatta

SEQ ID NO: 13496 - DNA, 201 bp, Homo sapiens
cactaacagtgtaaaaacgttcctatttctccacatcctctccagcatctgtcatttcctgactttttaataatcgccattctaactgatgtgagatggtrtcttgttgtggttttgatttgcatctctgtaatgaccagtgatgatgagctttttttcatatgtttgttggccacataaatgtcttcttttgagaagtgt

SEQ ID NO: 13497 - DNA, 201 bp, Homo sapiens
tgatttgcatctctgtaatgaccagtgatgatgagctttttttcatatgtttgttggccacataaatgtcttcttttgagaagtgtctgttcatatccttygcccaatttttgatggggtagtttgtttttttcatgtaaatttgtttaagttccttgtagattctggatatcatacctttgtcagatggatagaatgcaa

SEQ ID NO: 13498 - DNA, 201 bp, Homo sapiens
acctcttatgtatagataccataggacacttacattgaattacatatttctttgtcatagaaaatatacaggacatttaagtgaaaaaatacaaagcaccygcctacaaacagaattcaccttctgaataagtatgaactgtagttgttagttaactaatcaaagttggggaaatatgctttgtgtgttgcttttgttgtt

SEQ ID NO: 13499 - DNA, 201 bp, Homo sapiens
gtctttcttcctccagttatttctctctctttaatacatcttttatgccagtggttttcaaaatgatcatactcaaactatctactggtacccagtagaawatattagaactaatttttcataatgttgttactgaaagaaaaagaaacaaactaagcttcactactattttacatacagattggtaatggcattcttact

SEQ ID NO: 13500 - DNA, 201 bp, Homo sapiens
gcccaggctggaatgcagtggcacgatctcagttcactgcaacctctgcctcccaggttcaagcaatcctcctgcttaatattctaaggaatacaacctaycctttgagggtaggacagtatgagttaggagattagaccctggaaatcaacctggatttaaatcttagcttcaccacttgctatgtgacaatggccaact

SEQ ID NO: 13501 - DNA, 201 bp, Homo sapiens
tatgtttgttggccacataaatgtcttcttttgagaagtgtctgttcatatccttcgcccaatttttgatggggtagtttgtttttttcatgtaaatttgtttaagttccttgtagattctggatatcatacctttgtcagatggatagaatgcaaaaattttctcccattctataggttgcctgttcactctgatgatag

SEQ ID NO: 13502 - DNA, 201 bp, Homo sapiens
tcacttactaatgataaatcttttccaaagtaaaattgcagatttgagtaggtataattttttaaaatttatttgttcttagaaagagatgtaaatctacsttggaaaagatatgtacaagtggaatatatgtatagttgacttaatgcttatttaactagttgcagaagtacatcttgataatcccaagccatattcaga

SEQ ID NO: 13503 - DNA, 201 bp, Homo sapiens
acctgaaacagtgtcttctttggcattcttctaaataatcacgtagcctgtttaaggacctgtgcagagaataagaactttaaaaaggagtgcatcaaatrctgctgttgtggaagaaactctacaaggtgcacatttgtagctatttaaatatccacaatgttttggatataaagacaattttatttaaaattctaattt

SEQ ID NO: 13504 - DNA, 201 bp, Homo sapiens
gtttggtattattggagacattttagctaatacattctaactatgcattttgaaaaaaaaaaagaaaaaaacatattcttaaaaccatgtgaattttcagmcagaaagagaccttataaatatggacatgactgcagtgtgttgtggttattattaacgatggtttgtaccaaattatggcaaaaaatatgccctttttaa

SEQ ID NO: 13505 - DNA, 201 bp, Homo sapiens
atggagttttactcttgttgcccaggctggagtgcagtgctgcgacctcggcttactgcaacctctgcctcctgggttcaagcaattctcctgcctcagcytcctgagtagctgggattatagcacataccaccacacccagctaattttttgtatttttagtggagacagggtttcatcatgttggccaggctggtcttg

SEQ ID NO: 13506 - DNA, 201 bp, Homo sapiens
ctaaaaccataaaaaccctagaagaaaacctaggcaataccattcaggacataggcatgggcaaggacttcatgtctaaaacaccaaaagcaatgagcaayaaaagccaaaattgacaaatgggatctaattaaactaaagagcttctgcacagcaaaagaaactaccatcagagtgaacaggcagcctacaaaacaggag

SEQ ID NO: 13507 - DNA, 201 bp, Homo sapiens
agagaagatgggatataatttataattggagggttagccctagctaggagtacaaacagttcttccatagtaacagatggtggagtcaatgggcacagttkctgtgtagatgtgatggtgggagtttgtggaagttttcttctgcttgcttctattttgttagtgaaataagacacaaggtcatcaaatgagatgagggat

SEQ ID NO: 13508 - DNA, 201 bp, Homo sapiens
ggtccagagagaactggaagagtggaagtggaggtagcaaatataaactctttcaaggtggtttggtgtaaagaggagagaaataggttggctgccaaggrgtaaagagaattattttctttttactgaactggaaacatgtttttatgtggttggatatgatctaatagatagagaagattggtgatgcaggaaggagag

SEQ ID NO: 13509 - DNA, 201 bp, Homo sapiens
acaaaccacctccaggaggtaagggctattgtatcttattgtctctccctgcaagtccagttttctgaggctcccactggagtttatgaaataattaggarctatgtataaaatgccttaggtacttatctttttaagaatggtgaatactttccttattttcaaaattaggtaatttgaaccgaaccttccaggcttcaa

SEQ ID NO: 13510 - DNA, 201 bp, Homo sapiens
aactgtaaatctgctgtgtctttgatcctgccacctatacaactataatcagttgacatatccatttcagatatcagttttatgaattaatcaaccatctkctttttaaaaaatactaagtaaggctcttttccatttcagaaaacagataaaaaggaaaatgcaggaagtttggaggccataaatgagcctattcctcag

SEQ ID NO: 13511 - DNA, 201 bp, Homo sapiens
catcttacgccagtcagaatggtgattattaaaaagtcaagaaacaatagatgctggcaaggctgtggagaaacaggaacgcttttacactattggtgggagtataaattagttcaattaatgtggaagacagtgtagcaattccttaaggatcttgaaccagaaataccatttgatccagcaatcccattactggatata

SEQ ID NO: 13512 - DNA, 201 bp, Homo sapiens
tatttatatgtacattttgtaatattcagtctacctaaaaacaatcatgttctgaaattctcatgatttggtatttaattgttggtgttcactcatatcamctctttatttttattttttattttttttgccgtggagtttcactcttgtcgcccaagctggagtgcaatggcatgatctcggctcactgcaacctccgcc

SEQ ID NO: 13513 - DNA, 201 bp, Homo sapiens
agtcggatggactgctgttgcctacatctgcactcagattatacccgaagctcacatgtggggctgcttttctattctttatgttattagaaactgaattkttctgtgagaggcttagcataaaaacactttagtcaccagaaattatgatgttccagacatatcaaaactgatcatgtttattacagaaaaacaacccga

SEQ ID NO: 13514 - DNA, 201 bp, Homo sapiens
tagtcaccagaaattatgatgttccagacatatcaaaactgatcatgtttattacagaaaaacaacccgaggacgacagctctcaggccttcatttcaacrcagaatggatctccccgcctgaaccgggcagaggtcccagccaggcctgcaccccaggagccctatgatgttgtcttgcaacgaaaagaaaatgaaggat

SEQ ID NO: 13515 - DNA, 201 bp, Homo sapiens
agtgagtttgaacttcttatttctatggctttgacactaaagagtgtctagttgttactgtaaagatatgaataatcttaataaaacatctgaacattatsagaatactgagatttttctcaggagtatacaaaaagcatgaagttgttgggagaagggatttcggcagcttttttatgaatttgagattttgttttgaag

SEQ ID NO: 13516 - DNA, 201 bp, Homo sapiens
gaggagcaggtttgaatcccagctgtgtaatcttgggtacgtttcctaaatctctaaatgctcctatttcttcatatataaagtaggaataataatggtasccaccttttaaggtggttatgagtatgtaaattaacagatgtaaagtgcctacaatggtattaagcacatgttgactaataaatgatagtttcattgtta

SEQ ID NO: 13517 - DNA, 201 bp, Homo sapiens
tcaagtgatccacccacctcaggctcccaaagtgctgggattacaagtgtgagccaccatgcccagcccaagaaataatttttaaaataatttttataccrtagttgtttataaagctttccatagtaagttccttcttatggtgaaatcagccattctaaaggcaaactagaatatataatactatagaatttgactttt

SEQ ID NO: 13518 - DNA, 201 bp, Homo sapiens
tactgacatatgctacaatacagatgaccctcaaaaacactgtcaagtgaaagaaaccattcaaaaaaccacatattgtctgattttgtttatatgaaatrcctatattgggcacatctatacatggatagtagattcgtggtttcctaaggctaggatatggatgtgggttggggagaaattggataatgactgctaatg

SEQ ID NO: 13519 - DNA, 201 bp, Homo sapiens
tccaaagatcagcaacctcaaagatcaaaggtacataagcccacaatgatgagaaagaatcaatgcaaaaaaagctgaaaactcaaaaagctagggtaccscctctcctccaaatgaccacaacacttctccagcaaggtctcagaaccaggctaaggctgagatggctgaaatgagagaagtaggctttagaagatggtt

SEQ ID NO: 13520 - DNA, 201 bp, Homo sapiens
cctgtagtcctagctactcgagaggctgaggcaggaggatcccttgagcccaggagtttgaggctatagtgagctataatcatgtcaggaatgagaccctrtctcttaaaaaaaatagagaaagaaagaaattactaacagaaagatattcagaaattaataattaatagcacacttctaaataaactgtgagttgaataa

SEQ ID NO: 13521 - DNA, 201 bp, Homo sapiens
aaaactgttattggctatattgggtacgtttatgaagaagctatagtaaatataatatcaaaagcttcacagcttggcatcttctgcaggactttatttakcaacagaaagcccctctgctatcatctatcagtctctccatgttccatagcctaaagatacatatttgtcccctaatctatgatgatggaatggtatgat

SEQ ID NO: 13522 - DNA, 201 bp, Homo sapiens
atgagaacacatggacacaggaaggggaacatcacactctggggactgctgtggggtggggggagtgggaagggatagcattagatatacctaatgctaartgacgagttaatgggtgcagcacaccagcatgtcacatgtatacatatgtaactaacctgcacattgtgcacatgtaccctaaaacttaaagtataataa

SEQ ID NO: 13523 - DNA, 201 bp, Homo sapiens
ctagctatatattttttatattccttaaccatctccacttccctctcaccgccccaccaaccctaactacccttcccagcctctggtaatcatccttctactctctagctccattagttcagttgttttaatttttagcatccacaaagaaatgagagcattcaaagtttgtgtttctttgcctgacttatttcacttaac

SEQ ID NO: 13524 - DNA, 201 bp, Homo sapiens
tctgctgtgacagggcagcactgagttcaatgaaaagtccatcagccactgtgctccccctctcacaatcacacagatttctccataccaggtggctgctrccgggagctaagggagaggtggcgtaagcactcccttagctgccctggctggtgtctcgtaggttgcagtcaggtgtctctgatcccagctcagcactag

SEQ ID NO: 13525 - DNA, 201 bp, Homo sapiens
tagctatatattttttatattccttaaccatctccacttccctctcaccgccccaccaaccctaactacccttcccagcctctggtaatcatccttctactctctagctccattagttcagttgttttaatttttagcatccacaaagaaatgagagcattcaaagtttgtgtttctttgcctgacttatttcacttaaca

SEQ ID NO: 13526 - DNA, 201 bp, Homo sapiens
tgaggcaggagaatcacttgaacctgggaggcagaggtcggagtgtgccgagatcacaccattgcactctagtctgggcaacaagagcaaaactccatttaaaaaaaaaaaaaaaaagacatttgctgtcttcaatttaaaaaaaaaaaaaacttaactcactggcattcagttaggtgatacattaaaaacttttaattt

SEQ ID NO: 13527 - DNA, 201 bp, Homo sapiens
atcttaaagcaatggctccccctccttcccctcattcagttttaaagttaaacagaaatgacacctggtggcaagtctgttcaattacaagtttttgttgttttttttttttgcagtttattgcaggaaaagaataaaaagtgttctgggttggagagcttaagctaaagaatgtgattgaaataaattataacctcaaac

SEQ ID NO: 13528 - DNA, 201 bp, Homo sapiens
agtgactttacacacccaggatattggaaaaatcttataagcctcatgacaagtattggtgtggacagaagagaatgcatgttatgtgattccattcataygaggttgcaaaagtggcaaaactaagctatgttgcttaaaaatgcattatttagttggtacaatcattaaaaaggaaaggaaatcatcacagatgtcaag

SEQ ID NO: 13529 - DNA, 201 bp, Homo sapiens
tggttctgctttcccttgtgacaggggagcactgagttcaatgcaaatcctgacaatcgctgtgctcaccctctcccaagcatgcaaattctcaccaccastgcagggaggatgggggagtggtagcactggcaattccagactgcctttcctatcttcttcagtgtctctttcagtgatatgaagtccaaaccaggcact

SEQ ID NO: 13530 - DNA, 201 bp, Homo sapiens
gttgcttaaaaatgcattatttagttggtacaatcattaaaaaggaaaggaaatcatcacagatgtcaagatggtagtcacttttgaggatggagggaggsagaggtttatcatcagagacacacaagaaggtttttgaggtcctggtaatgttctgctttttgcttgggttgatttgcttgtaactaaacagaaagggta

SEQ ID NO: 13531 - DNA, 201 bp, Homo sapiens
tgatttgcatttctctgatggccagtgatggtgagcattttttcatgtgttttttggctgcataaatgtcttcttttgagaagtgtctgttcatgtccttygcccactttttgatggggttgtttgtttttgtcttgtaaatttgtttgagttcattgtagattctggatattagcccttcgtcagatgagtagattgcaa

SEQ ID NO: 13532 - DNA, 201 bp, Homo sapiens
tggctagccagttttcccagcaccatttattacatagggaatcctttccccattgcttgtttttctcaggtttgtcgaagatcagatagttgtagatgtgyggcgttatttctgagggctctgttctgttccattgatctatatctctgttttggtaccagtaccatgctgttttggttactgtagccttgtagtaggttg

SEQ ID NO: 13533 - DNA, 201 bp, Homo sapiens
gaatataaaatttggggagaaaacaacaaaaacagaataattggttttcttttcatttctgtttcctctacccacttgattccattgatatttgatatttragatcaatttccatttttaaatgactctgttagatctatttttccccttatgtaacatacccttccctggcaagcttatccacttccatagcaccctacg

SEQ ID NO: 13534 - DNA, 201 bp, Homo sapiens
taagtttaacctaactaccttttctgggcttagcgcccatgactcattcatttgttcattcgttttatcctgttttattcattaaacaaccatttattaartacctactatgtgccaagtactaaaagagaatctcggaatactgtaatgaacaagattaaagtgcttttgaagtttttttttgtttgtttttgttttttt

SEQ ID NO: 13535 - DNA, 201 bp, Homo sapiens
ccaactggatcgtggtggatgagcttttctatgtgctgctggattcagtttgccagtattttattgaggtttttcgcatcgatgttcattagggatattgrcctgaaactttctttttttgttgtgttctgccaggttttggtatcaggatgatgctggactcataaaatgagttagggaggagtccctctttttctattg

SEQ ID NO: 13536 - DNA, 201 bp, Homo sapiens
tatgataggccacaaaacaagtctcaataaatttttaaaactcaaaatcttttgtgggcatttagtgctataaatttccctctgcacactgctttgaatgygtcccagagattctggtatgttgtctttgttctcgttggtttcaaagaacatctttatttctgccttcatttcgttatgtacccatgcccacaagagaaa

SEQ ID NO: 13537 - DNA, 201 bp, Homo sapiens
ataataaaattataaaaaaaactcaaaatcatatgaggtatcttctcagaccacagtggaataaaactagaaatcaactcctaaaggaaccctaaaaactrtacaaatgcatggaaattaaacagtctgctcctaagtgatttttgggttaagaacaaaatcaagatggaagtgttaaaattatttgaaatgaatgataat

SEQ ID NO: 13538 - DNA, 201 bp, Homo sapiens
gctaagggaattcattactgctagacctgccttgcaaaagcaccttaaggaaacactaaatatgaaaaggaaaaagcatcattaccaaccactacaaaaayacactgtggtgcacagaccagtgacgttatgaagcagccaccataaacaagtctgcaaaataaccagctagcatcatgatgacaggatcaaatccacaca

SEQ ID NO: 13539 - DNA, 201 bp, Homo sapiens
taagcttcactactattttacatacagattggtaatggcattcttactgattccgtatgtcggattatcacatactctaaccagagtgccttgagggaggratggatgagacacctttgctcttttttcaaggacactgtgaaattttacagttgatttgtgcccagttaagtggatttatagactagttatatagttttt

SEQ ID NO: 13540 - DNA, 201 bp, Homo sapiens
gtaaaatcatgataattgcttgtttaatcacctcctttaaaaacatctatttttgtatatgttttattatatacatattagaagaggggcagatgtcagattttttactaaaaaggctacatgatcaaaaaaccttggagatattatgtaagaccaaattaatctttctaaaactaattttctatctatctctcccttgct

SEQ ID NO: 13541 - DNA, 201 bp, Homo sapiens
tcattctgaattcaacattgttatattgattggacagcattagaagttaatggcagtgtaatactgagtatatggaagtgagagtaaatgtttctaaacartcttcatacagttttgtttagagctcaaaacgaggatttatagttgaattgtgtgtgtgtgttacactcttgtgcaaattttccatattaaaaagttctg

SEQ ID NO: 13542 - DNA, 201 bp, Homo sapiens
agctcccagtgccttgcataccaagaacaagtattttattagaactttattttaaaataattttaaaatctttcccttccccaacaagaaaaaaaaaaaagaagaagaagaaaaaggaaagggactctctcttacttggaataatttcttttttccctccctccgtggcttcttcccttcctcccttgactatgtagtggc

SEQ ID NO: 13543 - DNA, 201 bp, Homo sapiens
cttaaagcaatggctccccctccttcccctcattcagttttaaagttaaacagaaatgacacctggtggcaagtctgttcaattacaagtttttgttgttktttttttttgcagtttattgcaggaaaagaataaaaagtgttctgggttggagagcttaagctaaagaatgtgattgaaataaattataacctcaaacct

SEQ ID NO: 13544 - DNA, 201 bp, Homo sapiens
tgaatgtgtttgctcttgcttttctagttcttttaattgtgatgttagggtgtcaattttggatctttcctgctttcttttgtgggcatttcatgctatamatttccctctacacactgctttgaatgtgtcccagagattctggtatgttgtgtctttcttcttgttggtttcaaagaacatctttatttctgtcttcat

SEQ ID NO: 13545 - DNA, 201 bp, Homo sapiens
tataacttgtaagttctaattgggctttactaatagagaatttacagatcatatattatctcactaattatatgtaattggaaaaaatgaatattattttrtgtatataaacaacccatccttcatgtatgaacagatgtctgtacacatccgcctttatagagagatatgttgtaaacatatacaaactgtataaaatac

SEQ ID NO: 13546 - DNA, 201 bp, Homo sapiens
agtagagacagggtttcaccatgttggccaagctggtctcgaactcctggcctctggtgatccgcctgccttgacctcccagagtgctgggattacaggcrtgagccaccgtgcccagcctgtgtatcgctttggaatccctgccttgaaaaatcagaaaattgttcgggagtagaaatgaggagaggataggtagaggtt

SEQ ID NO: 13547 - DNA, 201 bp, Homo sapiens
ttcacctcgattcaatcagtttttaaagtgcacatttctcagcactataggaaagggaaaaaaatttaaaaataaagtggacatctgattcttgtccaaartctatagtttatccttcaaagatttctactgacaaagttcagactccttagcatcgcataaaatattttttgtttttttaatctgcctccttatctatga

SEQ ID NO: 13548 - DNA, 201 bp, Homo sapiens
cccctcccccagcctcactgccgccttgcagtttgatctcagactgctgtgctagcaatcagtgagactccgtgggcgtaggaccctccgagccaggtgcrgcatataatctcctggtgcgccgttttttaagcccatcagaaaagcgcagtattcgggtgggagtgacccaattttccaggtgccgtctgtcaccccttt

SEQ ID NO: 13549 - DNA, 201 bp, Homo sapiens
tgtataaaatactcaggctttttaagcagttacgacaattcaaatggctgtcaaagttcaaaacgtattgttcctatttgtaattctaaaatttaataatrttccattcaaatcacttttttaggtgattgggatattaataatccttcgtcttcaaatgtgatttatgatgaacagtcaccattacccccatcttcacat

SEQ ID NO: 13550 - DNA, 201 bp, Homo sapiens
acgtatgtttattgcagcactatttacaatagcaaagacaggaaccaacccaaatgcccatcaatgatagattgcataaggaaaatgtggtatatatacaytatggaatactatgcagccataaaaaggaatgagatcatgtcctttgcagggacatagatgaagctggaagccatcatcctcagtaaactaacacagaaa

SEQ ID NO: 13551 - DNA, 201 bp, Homo sapiens
ggcacacttatacctatgtaacaaatctacatattctgcacttgcatcctggaacttaaagtaaaatttaaatatatatatatttatatatatgatatatwaaatatatcatatataaatatatatcatattaaatatatatatgatatataatatatatacactatatatgatatatataatatatatgatatatgaata

SEQ ID NO: 13552 - DNA, 201 bp, Homo sapiens
gcacacttatacctatgtaacaaatctacatattctgcacttgcatcctggaacttaaagtaaaatttaaatatatatatatttatatatatgatatatawaatatatcatatataaatatatatcatattaaatatatatatgatatataatatatatacactatatatgatatatataatatatatgatatatgaatat

SEQ ID NO: 13553 - DNA, 201 bp, Homo sapiens
cacacttatacctatgtaacaaatctacatattctgcacttgcatcctggaacttaaagtaaaatttaaatatatatatatttatatatatgatatataawatatatcatatataaatatatatcatattaaatatatatatgatatataatatatatacactatatatgatatatataatatatatgatatatgaatata

SEQ ID NO: 13554 - DNA, 201 bp, Homo sapiens
atataaaatatatcatatataaatatatatcatattaaatatatatatgatatataatatatatacactatatatgatatatataatatatatgatatatgaatataatatatatgatatataatatatatgatatattatatatgatatatataatatatatgagatatatataatatatatgatatataaatatatatg

SEQ ID NO: 13555 - DNA, 201 bp, Homo sapiens
aatatatcatatataaatatatatcatattaaatatatatatgatatataatatatatacactatatatgatatatataatatatatgatatatgaatataatatatatgatatataatatatatgatatattatatatgatatatataatatatatgagatatatataatatatatgatatataaatatatatgatatat

SEQ ID NO: 13556 - DNA, 201 bp, Homo sapiens
atcatatataaatatatatcatattaaatatatatatgatatataatatatatacactatatatgatatatataatatatatgatatatgaatataatatrtatgatatataatatatatgatatattatatatgatatatataatatatatgagatatatataatatatatgatatataaatatatatgatatatatata

SEQ ID NO: 13557 - DNA, 201 bp, Homo sapiens
cagtttcaaaaaggatcaattgaccacaaactgcagcaagtgatcagagataatctctacttgagaaccattccatgtaagtatgtgatggaataaaagarctgaagcagaaatgtcctttcttaactaattaaacatctacagatagtttgatggagtatttcacatgaaattgtgaagactaagttgggaacaagaatg

SEQ ID NO: 13558 - DNA, 201 bp, Homo sapiens
gtttaccaaattatttgtaattatggaaaataccaagcattcttaatacctcaatgccctttaatctatctggaatcatctccctctccctaatcccaacttatttatttatttatttatttatttatttatttatttatttatttgactcggtctatcaccaggctggaatgcagtggcacgatcttggctcattgcaac

SEQ ID NO: 13559 - DNA, 201 bp, Homo sapiens
catggcatgttttgaaatatcatggtatttgaaagtcactgttttttgagtgcactattctagaaataaaggcagtaccacacccacgcagtacttgcctyatctagctccccacctcctgccctaccccaccccaccccaccgcttttgagggataagtgtagacataacctcctacagtacccttccagcttatgattc

SEQ ID NO: 13560 - DNA, 201 bp, Homo sapiens
ctacatattctgcacttgcatcctggaacttaaagtaaaatttaaatatatatatatttatatatatgatatataaaatatatcatatataaatatatatmatattaaatatatatatgatatataatatatatacactatatatgatatatataatatatatgatatatgaatataatatatatgatatataatatatat

SEQ ID NO: 13561 - DNA, 201 bp, Homo sapiens
gtcaggatccccaaaattggatccttctgaggtctacctgaaatctaagactttatatgaagataaacgtaagtagttgtggaatatttcaggagagcatwtaacaagataaatttggatttattttagactaggaccttcccatctttcagaagcatattgaaaagttattccttcattaccattttaatagaactctgg

SEQ ID NO: 13562 - DNA, 201 bp, Homo sapiens; identical to SEQ ID NO: 2190

SEQ ID NO: 13563 - DNA, 201 bp, Homo sapiens
taaaattacttagtcatctcttctttttccttccttctctcccatcatctgacttgaagtaatatctttttattcctacgaaatataaggtaatcagtaartgtatcccacactttgctgtgcttttctcattcttaccctactttttttgatagttgggctgttgttctacattggctaagcaaatagccattacattac

SEQ ID NO: 13564 - DNA, 201 bp, Homo sapiens
caattatattaaatgaattagttctttctagcccaccaagtaggaatcctctgcaaatttgctgttttatagattaaaaagaatccctcagcttctggcctttttttttttttttttttgagacagagtctcactccatcacccaggctggaatgcagtggtgtgattttggctcactgcagcctctgccgcctaggttca

SEQ ID NO: 13565 - DNA, 201 bp, Homo sapiens
ttggtcatattggttacagttacaacagtcattggagacacataaagcttaaggcaggttgccctatgtagaacaaatactagatactttaattgttcttkgtatttgtatttttgttttattgcttcctattttgttgatactcataatgttcacttagacattttaagaatttgtctcaaacaacttagaagaaacctt

SEQ ID NO: 13566 - DNA, 201 bp, Homo sapiens
tccggttttgttttgttttgttgagttgaggtagagtctcactctgtcacccaggctagagtgcagtggtatgagctcagctcactgcaacctccacctcytgggttcaagcgattctcctgcctcagcctcctgagtagctgggattacaggcacacaccaccacacggctaatttttgtatttttagtagagacggggt

SEQ ID NO: 13567 - DNA, 201 bp, Homo sapiens
ctgggattacaggcatgtgccaacacacctggctaattttttttgtatttttagcagagacggggttttgccatgttggccaggctggtctcaaactcccracctcaggcaatccacccaccttggcctcccaaagtgctgggattacagacatgagccaccgtgcccagccagatcattctttatggacctcatctcagg

SEQ ID NO: 13568 - DNA, 201 bp, Homo sapiens
tgccatgttggccaggctggtctcaaactcccaacctcaggcaatccacccaccttggcctcccaaagtgctgggattacagacatgagccaccgtgcccrgccagatcattctttatggacctcatctcaggtattttctgatgacgtatgtctcaagaagagttcctagtagcatctgtggtaccagttatggaattct

SEQ ID NO: 13569 - DNA, 201 bp, Homo sapiens
agaatcacttgaacccgggaggcagaggttgctgtgagctgagattgcgccattgcactccagcctgggcaacaagagtgaaactccatctcaaaaacagaaatatatatatatatatatatatatatgcatttcagtggtttttagtatattcacagggttttgcaatcattaccactagttccacattttattgctcca

SEQ ID NO: 13570 - DNA, 201 bp, Homo sapiens; identical to SEQ ID NO: 2193

SEQ ID NO: 13571 - DNA, 201 bp, Homo sapiens; identical to SEQ ID NO: 2192

SEQ ID NO: 13572 - DNA, 201 bp, Homo sapiens
ttcaccaaagatctctctgtagcatgtgatgctgtttgatagcattttacccacagtaaaacttctttcaaaattggactttgtcctctcaaactttgccwctactttatcaactaaggttatgtactattctaaatcctttgtggtcatttcaacagtgttcacagcatcttcaccaggagtagattccatctcaagaag

SEQ ID NO: 13573 - DNA, 201 bp, Homo sapiens
tcatatttcttggaagctttgtttgttccttttcattcttttttctctaattttgtctttatgctttatttcattaagttgatcttcagtctctgatatcmgttcttccacttgattgatttgcttattgatacttgtatatacttcatgaagttctcgtgctgtgtttttcagctccatcaggtcatttatgtttttctc

SEQ ID NO: 13574 - DNA, 201 bp, Homo sapiens
taactggtacaagaggtctagctttcagcctgtctcaggtctcaacaagccttcctcactaagcttaatcaagtctagcttttgacgtaaagtgagagatrtgcaactctttctttcacttgaatacatagaggtcattgtagggttattaattggcatgatcaatattgtgcatctcagggaatagaggggcctgaggag

SEQ ID NO: 13575 - DNA, 201 bp, Homo sapiens
aaattagtcaaacgctacttaaaggaagcactttccaaaattctgttctctgattgttgcattgcacattgaccaactagaaaagacatgtaaccttcagwttaatttaggctgcatttataaaaattaagtagccctttaaccaaaacctacattccttctttacaatatagaaatgcacattgagagtataaatcattt

SEQ ID NO: 13576 - DNA, 201 bp, Homo sapiens; identical to SEQ ID NO: 2191

SEQ ID NO: 13577 - DNA, 201 bp, Homo sapiens
cataagcaaaggagaattaatatcctttacagacaagcaaatgctaagggaattcattactgctagacctgccttgcaaaagcaccttaaggaaacactaratatgaaaaggaaaaagcatcattaccaaccactacaaaaatacactgtggtgcacagaccagtgacgttatgaagcagccaccataaacaagtctgcaa

SEQ ID NO: 13578 - DNA, 201 bp, Homo sapiens
tttaccaaattatttgtaattatggaaaataccaagcattcttaatacctcaatgccctttaatctatctggaatcatctccctctccctaatcccaacttatttatttatttatttatttatttatttatttatttatttatttgactcggtctatcaccaggctggaatgcagtggcacgatcttggctcattgcaacc

SEQ ID NO: 13579 - DNA, 201 bp, Homo sapiens
ttaccaaattatttgtaattatggaaaataccaagcattcttaatacctcaatgccctttaatctatctggaatcatctccctctccctaatcccaacttatttatttatttatttatttatttatttatttatttatttatttgactcggtctatcaccaggctggaatgcagtggcacgatcttggctcattgcaacct

SEQ ID NO: 13580 - DNA, 201 bp, Homo sapiens
taccaaattatttgtaattatggaaaataccaagcattcttaatacctcaatgccctttaatctatctggaatcatctccctctccctaatcccaacttatttatttatttatttatttatttatttatttatttatttatttgactcggtctatcaccaggctggaatgcagtggcacgatcttggctcattgcaacctc

SEQ ID NO: 13581 - DNA, 201 bp, Homo sapiens
aatttgcagaacacatttccttatcattttcccaaagcaccctaatctttttcatcaattattaaaatgtgatatgtatatttattgagttaatacattcwttgtttatgtcccactccagagtgtgagttctgttttatagtcctatctttcacataatacgtttaatgttaaatggattaccccaatgtatttaaatgt

SEQ ID NO: 13582 - DNA, 201 bp, Homo sapiens
caagaccagtctgggcaacacagcaaaacatcctcagttaaaaaacgacaacatgacatgctttatgaatgagcagaaactttagaatctaatgatgaaakcagcttttatttcaagaataaactctgaaaacaaaagcaaatgagcaattaactgttagaccccagtgtgctctaacctgtaagaaaatgtcagcttttc

SEQ ID NO: 13583 - DNA, 201 bp, Homo sapiens
ctagtagtggtagaagcccagattgcgacattactgagaagtgatgattgaaacctttgtggtagataagatcactaaggaagaatatttagagagtactyagccaagggcagagctctgagcaaggcatgtaattagtggactagataaaataaagaaaatgggaaggcgcagcatgcagagccacagagccaaagctgc

SEQ ID NO: 13584 - DNA, 201 bp, Homo sapiens
aagatgttttctccaaattattttttatcacatttttaaagtgacttaaaatgttaaaaggatgtttactgggtgaatttactcctctgaatttccctctyagaagagtctttttcatctgtagttttgtgtatgtaggtctctgcagaatttctcccactctgagggcctgtctaccataaatcttaaagcaatggctcc

SEQ ID NO: 13585 - DNA, 201 bp, Homo sapiens
cagggaacttcaaatggttgagtttacttagattttatttagaaaatgcgtagatgaatagaggaaatgagaatataaaagccgatgggtcgcaggcatamaggtcctaggcagtgggaagccatgggaggctttttagccaggagtttcccctcagagcaatctgctgataaaaatctgttagtggtgtgcaggaaggat

SEQ ID NO: 13586 - DNA, 201 bp, Homo sapiens
caatttgaagaagaaactaaagagttgactccttacaggagtccagctgagagataaaaagagagactgcataaggcagaaattcatgcatgttcctactmattcacttactaatgataaatcttttccaaagtaaaattgcagatttgagtaggtataattttttaaaatttatttgttcttagaaagagatgtaaatct

SEQ ID NO: 13587 - DNA, 201 bp, Homo sapiens
ttatttcatgttggaatgttccacaacagcattcactttctctctttgcattttttctgttaaatatttacaaagcactgaagcttgtaacaaataatcaktgaaaaatgccagaaaatattattggatagtattcaaataacctaacatttagatttctgagcatggttaacagcattacacagagttgtgtgttgaaac

SEQ ID NO: 13588 - DNA, 201 bp, Homo sapiens
gccaaagctgcagagtgtttatgacaaagagggaccgatggccttaatacagctcgtcaagaactgctgaatctactttcttatagagacaatttcatatsgtgacaagaacatgggtttggaaatcagacaggacattctcctgagtttcctcatctgcaaaatgcagaaccatatgtaatatacatggtccaagtaaac

SEQ ID NO: 13589 - DNA, 201 bp, Homo sapiens
agtcatgtacagggaacttcaaatggttgagtttacttagattttatttagaaaatgcgtagatgaatagaggaaatgagaatataaaagccgatgggtcrcaggcataaaggtcctaggcagtgggaagccatgggaggctttttagccaggagtttcccctcagagcaatctgctgataaaaatctgttagtggtgtgc

SEQ ID NO: 13590 - DNA, 201 bp, Homo sapiens
gggtgcttgatacttactccaaaaatctgaaacaatttgagcaacaacgttgaaaaaagagggcacttctattattgtcagatattgagctgtaggtggarcaggactatgatccttgagagaagaagaaaggagaccacacacagaggaatcctataatttcctcaactttctacttagaggcactttctggaccacagc

SEQ ID NO: 13591 - DNA, 201 bp, Homo sapiens
gtaacaaataatcagtgaaaaatgccagaaaatattattggatagtattcaaataacctaacatttagatttctgagcatggttaacagcattacacagarttgtgtgttgaaactgccaatttaaggacttacttagcctccaaacttgttatttcttggaactcaactcataggatttatatgaagtataatatacata

SEQ ID NO: 13592 - DNA, 201 bp, Homo sapiens
agatattatcctccctcaaaatgaccagacacatgcacaagttcaaagggatgaatagagaagatttcacagaataggtggcattgacaggtgcataggayttcaatagggagaaattaaggagagaaaacattccaggctgaataaatgagcaatggcgtaaaactaaggaagtataagtcatgtacagggaacttcaaa

SEQ ID NO: 13593 - DNA, 201 bp, Homo sapiens
attagatggtatattctagtaattattagaaaaggtgcttctgggtgattgcagttttgaatttttcatttcactcccattagtcatttcataaacacatwttgagtgtttgcattacccaaagctttatgcatgctactgaatgagttgggagagtgactcaaaacaaataagatattatcctccctcaaaatgaccaga

SEQ ID NO: 13594 - DNA, 201 bp, Homo sapiens
agcctccatcccaggcacagcataattatccaatcttgcctgacatgcgaggattagaaagaaatgacatagcatctggctctgctactcttggtcctcayagttttcatagggaagctgcagacccatatggattgctgtcttatcagaccacctgagcagagcaggttttgtgtgtatttctgtcttctttcattgaaa

SEQ ID NO: 13595 - DNA, 201 bp, Homo sapiens
cagtggctcacgcctgtaatcccagcactttgggaggctgaggcaggcggatcatgaggttaagagattgagactatcctggcctacatggtgaaaccccrtctctactaaaaatacaaaaattagctgggcgtggtggcgggtgcctgtagtcccagctacttgggaggctgaggcaggagaattgcttgaacctgggaa

SEQ ID NO: 13596 - DNA, 201 bp, Homo sapiens
ctcccaggttcaagtaattctcttgcctcagcctcccaagtagctgggattacaggcatgcgccaccacacctggccaattttgtatttttagtagagacmgggtttctccatgttggtcaggctggtctcgaactcccgacctcaggtgatccaccagcctcagcctcccagagtgctgggattacaggtgtgagccacc

SEQ ID NO: 13597 - DNA, 201 bp, Homo sapiens
tgtaatcccagcactttgggaggctgaggcaggcggatcatgaggttaagagattgagactatcctggcctacatggtgaaaccccgtctctactaaaaayacaaaaattagctgggcgtggtggcgggtgcctgtagtcccagctacttgggaggctgaggcaggagaattgcttgaacctgggaagtggaggttgcagt

SEQ ID NO: 13598 - DNA, 201 bp, Homo sapiens
cctgtaaacagttaacaattctgtatattaaactgtctctgttcagattgccatgtggtttctctctcttctctggatcttgatacagaattagtactagyagcgctcccaggagacagaacctctaagaagggatttcagaattggttttggttgtcttggctgatcttacgtggagtgccaagtttcttccaatgagag

SEQ ID NO: 13599 - DNA, 201 bp, Homo sapiens
ccaattttgtatttttagtagagacagggtttctccatgttggtcaggctggtctcgaactcccgacctcaggtgatccaccagcctcagcctcccagagwgctgggattacaggtgtgagccaccatccctggccctgagaaatgattttacactaacatcactaagtttatgccagttactggttttaaataagtgttc

SEQ ID NO: 13600 - DNA, 201 bp, Homo sapiens
tggcagcaacaggaagagacaatgtccaggtttactcacgcataaaaaccctacacagcaagtgcccaggtttacttatgaaaatcctacacagggccggscgcggtggctcacgcctgtaatcccagcactttaggaggctgaggcgggcggatcacgaggtcaggagatcgagaccatcctggctaacacggtgaaacc

SEQ ID NO: 13601 - DNA, 201 bp, Homo sapiens
ttggggagattatttctctaatagcatgagtaatatagactttctagagataatctcacttttttctacagaaataagctattattcagcatattaaaaastgttttggccaggcacggtggctcacgcctgtaatcccagcactttgggaggccgaggcaggcggattatgaggtcaggagatcgagaccatcctggcta

SEQ ID NO: 13602 - DNA, 201 bp, Homo sapiens
gggcggatcacgaggtcaggagatcgagaccatcctggctaacacggtgaaaccccatctctactaaaaatacaaaaaattagccgggcgtggtggcgggygcctgtagtcccaactactcgggaggctgaggtagtagaatggcgtgaacccaggaggcggagcttgcagtgagccgaggtctcgccactgcactccagc

SEQ ID NO: 13603 - DNA, 201 bp, Homo sapiens
ctgtggaaacagaaaataggttactggttgctttgggctaaggataagaatagagattaactgttaacagcatgaggaatcttcttggagttatgaagacrttttaaaactggattgtggtgatggttgtacaattcagtaaattattaaaaattattgaactgtatacttaaaacagatgaattgtatatatgtaaatta

SEQ ID NO: 13604 - DNA, 201 bp, Homo sapiens
ggtgaaaccccatctctactaaaaatacaaaaaattagccgggcgtggtggcgggcgcctgtagtcccaactactcgggaggctgaggtagtagaatggcrtgaacccaggaggcggagcttgcagtgagccgaggtctcgccactgcactccagcctgggcgacagagcaagactccgtctcaaaaagcaaaacaaaaca

SEQ ID NO: 13605 - DNA, 201 bp, Homo sapiens
tatctgggtacctcagttggaaatggagaaaccacccaccttctgtgttggtgttgctgggagctgcagaccagagcttttcctatttgggcatcttgccrgctcccacaaatcaattttaaagacacaaacccaacagagaaatggggaaagacttgaataaccacttcacaacagaggaaatctatatggcttctaaat

SEQ ID NO: 13606 - DNA, 201 bp, Homo sapiens
ctttggagaacagtttggcagtttcttaaaaggttaaatataaatttaccatatgacctagtaaattttctcctaggtatctacccaagaggaatgaaaayaaaagtcctcataaagacttgcatgcaaatattcatagcagcactattcataatagccaaaaagtggaaaccacccaactgtccattaaccaatgagcag

SEQ ID NO: 13607 - DNA, 201 bp, Homo sapiens
ctacagtacccttccagcttatgattctctgactgtattatcttccaccatctgcttgtaaatcatatgttcccagtgacatctttgctaactgcactgatttttttttttttttttcacatagtcctaggctttttctcttccctcttcaggtttggctccttccggtctgtgctcctacgtgaaacccgagcaacatta

SEQ ID NO: 13608 - DNA, 201 bp, Homo sapiens
gtcattatgttttatagtggagtttatttggatatctcaattagcctttgctgtataacagactaccctaaaacttagtggcttaaaatagtgatgtttatttctcatgatttcatgagttgggctcagtcgggaccattcatgtggctataatcattgacagctcaactggagctggaggggctaagatggcctcattca

SEQ ID NO: 13609 - DNA, 201 bp, Homo sapiens
aaattttaaaatgggcaaaatatgttaataaacatttcaccaaagaaaatatacaaacagcccataaaaacatgaaaagatatttaaaattattaatcatkaggtgttttgcaaattaaaaccactgtgatctactactttacacccactagaatgagtataacaaaaaaaaaaacagatggtaactaatcttggggagga

SEQ ID NO: 13610 - DNA, 201 bp, Homo sapiens
atacagtcaacttcctggccttaaacaaatagtattaagatattagataatatatgtgaagagcacttgagaaattagttctttcccctatttctgctctytcttctcgtaagatgagtgctttgagcgctttggcctccttttggccaatggtagatatttcaatttttttttttttttttttttttttgaggcagagtc

SEQ ID NO: 13611 - DNA, 201 bp, Homo sapiens
gagtttgtttcaggaatgccaagttggtataacatttgaaaattaatatagtaatattagaaaacaaaaaccaattaattttttcaatagatgcagaaaarttatttggcaaaattcaactcccatttatgacagaatctgtcagaaaactagtctgccatttattacccattgcctcttggctataaatctacttttttg

SEQ ID NO: 13612 - DNA, 201 bp, Homo sapiens
cccagcaagtttcagcagtaccctagcagtcagcttccctgtgacaagttcagtggcacacctgcaggagacttccttacagcaagttcagcaacaccctsataggtgatttcatgagtaccagcagtgcaccagctgacttatagtttcctggtgagttctgtgacatcccatttggtcccccagttttcagcaacatcc

SEQ ID NO: 13613 - DNA, 201 bp, Homo sapiens
ctgccacctatacaactataatcagttgacatatccatttcagatatcagttttatgaattaatcaaccatctgctttttaaaaaatactaagtaaggctyttttccatttcagaaaacagataaaaaggaaaatgcaggaagtttggaggccataaatgagcctattcctcagcctatgccttttccaccgagcattatc

SEQ ID NO: 13614 - DNA, 201 bp, Homo sapiens
catttcttattcacatagtcaacatctgagggtaaacgaattaataaatacacttttcatcttaataagagtcttgagaaagcgaggatcaaatagaatckttaactttttccaggaggcaataggcccaggattttttttccccactcttagctaccgggagaggtaactagaggctgaaaagcgtggctctcaacattt

SEQ ID NO: 13615 - DNA, 201 bp, Homo sapiens
aaggcagtggcatgtttcaacttatgtgttaaaactggagtctaaggtggcaaagagagcagttaggaggtcagtataagcagcttgttaaagttactcargaaaaataaaattcatgatagcaatataaaagagcaacaaatttccaggtctccaaaaaaaaaaaaaaaaaaaaaagttcatagcccactctactcccac

SEQ ID NO: 13616 - DNA, 201 bp, Homo sapiens
ttctgagcatggttaacagcattacacagagttgtgtgttgaaactgccaatttaaggacttacttagcctccaaacttgttatttcttggaactcaactyataggatttatatgaagtataatatacatatcatcttattagtattgttttatgtaagaaagacccaccactagcagatatggccatgagcacacacttg

SEQ ID NO: 13617 - DNA, 201 bp, Homo sapiens
aagacctgggaatttccagtgggtacaagaatataaatatcaaagatcactgaccacagatcaccataacagatataataataatgaaaaagttagaaatwttggaagaattaccaaaatgtgacacagagacatgaaagtgagcacatgctgttggaaaaatggcactaatagactcgcccaatgcagggttgccataaa

SEQ ID NO: 13618 - DNA, 201 bp, Homo sapiens
gcagctttatttattatagcccaaatgtggaaacaacccaaatttccatcattggtgaatggataattaattttggtatattcatacagtagaataccaaytgaataaaacaagacaaaagatcaatgaggaaacagaggacttgaacaatacaagaccaaatggacctaaccgacatacagaacatttcatccaataaca

SEQ ID NO: 13619 - DNA, 201 bp, Homo sapiens
aagaattctcagtaagatgtgtttctagtagtactactaccttacttagaaaaagtggactttttatttctgtcatggtatatccagtttccttgatactstgattaatgggcataattcaggaaaaatagagaccctcgaacctcctaatccccagccaaatctctgtttggtgtatttctgtgccggctgccccagaga

SEQ ID NO: 13620 - DNA, 201 bp, Homo sapiens
gaaattacttgatcagagggtatacatgtatttgatttaatattgtcagattgttgcatccatctactcccaccagcaaaacattgaggattctgatactktacttccccaccagtactttgtattatcagcttttgaatttgctagcctaaagcatgaaggtgttgtcttattatttaatttgcatttctctgattgccc

SEQ ID NO: 13621 - DNA, 201 bp, Homo sapiens
actgtgaataatgccactacaaatgctgttttataggtttttgtgttgttttatgatttcatttttcttggtcgtatacctaggagtggaattgttgggtygcatggtaactatgtttagctttttgaagaacttcaaaactgttttccacagcagctgcacccttttatattcccaccagcaatgtatgaggcttccatt

SEQ ID NO: 13622 - DNA, 201 bp, Homo sapiens
ttctagaatttgattcttgatttcaagatgtccagatcttagttagtagccatataaaactttcctgtgtaggatttttgtgagtaaacctgaacattgcyacttcctgttgtttgttgtcatctgtcctctcatcaactctcacatggcagtactgggtacacgttaggtattttacaaacgaaagaatcacttagcaag

SEQ ID NO: 13623 - DNA, 201 bp, Homo sapiens
ttcaaaattaggtaatttgaaccgaaccttccaggcttcaagtttatctattatctcacattctataaaatatttaataagtctcagtagctccatttgcmtcaaggttatactgaagacagtatgtcatagatatggatttaatgaaaggtataatgctgacttttaagaaaatggggacataggttttgaaaattagga

SEQ ID NO: 13624 - DNA, 201 bp, Homo sapiens
catgttagccaggctggtgtcgaattcctgacctcaggtgtactgggattacaggcatgagccgctgcgcctggcctgagccaccacgcccagccagtggsttcttaaactcaagaaataaggtggtatttaaagatagactgaccctgtcaaaaagtggacaaaggatatgaacagatacttctcaaaaaaagacaatta

SEQ ID NO: 13625 - DNA, 201 bp, Homo sapiens
cagggtgaaaccctgtctctactaaaagtacaaaaactcactgggtgtggtagcatgcgcctgtagtcccagctactcaggaggctgaggtgagaagatcrcttgagtccaggaggttgaggctgcggtgaaccatgatcacgccactgcactccagcctgggtgacagagtgagaccctgtctcaaaatactaatactaa

SEQ ID NO: 13626 - DNA, 201 bp, Homo sapiens
ctgcttaaatagtgtctgttattccatacttggcattttaggccttctttaaagtctcttgattctcaagttagtgcctctagcattaccattcctttatsgaaattttgaagtagactgagaacaatagggttaatgaatgaatctgaggaatacaaatggagcctgttggagattaatgttcaaacatcatatgtcttt

SEQ ID NO: 13627 - DNA, 201 bp, Homo sapiens
gagaatcacttgagccgaggagttcaagaccagtctaggcaacatagccaggcctctctctgcaaaaaaaattttttcagttgttaggcatggtggcacaygcctgtagtcacagccacttgggagcctgaagcaggaggatcacttgagcctaggaagtcaaggctgccgtgagctgtgatcatgccactgcactccaac

SEQ ID NO: 13628 - DNA, 201 bp, Homo sapiens
catttacaaattcagttccaaggaataatcacaaagttgaattttaatatgctttcttaaatccatacttataagtgactagtatcttaaagaataaaagmcacttactcttttatctctctggattttacttttcactattgaggcaaacgagcacttcagcttctttgggagttgtttcttattctcgtttctttgatt

SEQ ID NO: 13629 - DNA, 201 bp, Homo sapiens
tttttgaaagtgtttttttaatttttaaatttttattttagtccctgctgcccatttctctaccaccactcttaatgtttacaaatggcaaagctccagcrtggacaacatagtaagaccccatctctacaaaaaaaaaaattttttttaattagctgggcatggtggcacacacctgtggtcacagctactcaggaggct

SEQ ID NO: 13630 - DNA, 201 bp, Homo sapiens
tctgtgacagagtgagactctgtctcaaaaacaaacaaacaaacaaaaaagtgtttctatcacattctaccagctagtattatacctggcagtggctgcakagctctgcaagtagctcagcggttacaaaagatatagaagatgtgagtaattccctgaaaccttattggcttcatttcctaagagtggtcaaggtacaga

SEQ ID NO: 13631 - DNA, 201 bp, Homo sapiens
ctctttcaaccaatggtgtgtcatctggacctctgtaatgcaccaaagatgttttgaaagagctagcatctctgtggataagtaaaatgttggatggtgtrttaatctgttctgcagaggcaatcatgatagcatgtgctcataaagttttcatcttaagctctagtatctgactgtaaatgttaattaaaccacacagtg

SEQ ID NO: 13632 - DNA, 201 bp, Homo sapiens
ccaagaattctcagtaagatgtgtttctagtagtactactaccttacttagaaaaagtggactttttatttctgtcatggtatatccagtttccttgatastctgattaatgggcataattcaggaaaaatagagaccctcgaacctcctaatccccagccaaatctctgtttggtgtatttctgtgccggctgccccaga

SEQ ID NO: 13633 - DNA, 201 bp, Homo sapiens
tttagcaataaaattttggatcatgggaacctaagttaagcttttctcaagtggcagtttttagttgggtttagcaaggtattttcgtgttgttgttgttmttattgttgtttcctaacaatctatgtggctcctaggcccctgagttctcatcctttgcattttctaaaatttttttttaagcaaaaaacttttaagttt

SEQ ID NO: 13634 - DNA, 201 bp, Homo sapiens
gtatggttgatctgtattactgctgctgttgaaaaatgcaactgtaagaaaataatgttcatataggtctatagactttagttcttatgttttgggaatakcccctatggatatttcttttcattggaaaattttgggtaaaattttagcaaattgcctacatctgctgatttagcaataaaattttggatcatgggaacc

SEQ ID NO: 13635 - DNA, 201 bp, Homo sapiens
taaaaacatgaaaagatatttaaaattattaatcattaggtgttttgcaaattaaaaccactgtgatctactactttacacccactagaatgagtataacaaaaaaaaaaacagatggtaactaatcttggggaggatagggagaaacagtaacccttgtacattgctgtgccattggaaaatggtatagccactttggag

SEQ ID NO: 13636 - DNA, 201 bp, Homo sapiens
tctaccagacattcaaagaataattggtatcaatcctactgaaactattccaaaagattgagaaagagggaatcttctctaactctttctatgaagccagyatcaccctgataccaaaaccgggaaaggacctaacaaaaaaataaaactatagaccagtatccctgatgaaaatagaaagaccccaaaagcaaatgcaac

SEQ ID NO: 13637 - DNA, 201 bp, Homo sapiens
aagaatttttatattctcacgtagctgtaattctcatcgtaaagtaatttgcccaaaggtagaatattaatgtagtaaagttacagaatataacaattaartaacggttaaaatatttggatctaggcactacactcaaagaacatatactcagaaatgaatttggagtgggagtcttgaatctgtttcctcagatggtcc

SEQ ID NO: 13638 - DNA, 201 bp, Homo sapiens
aagaaattagacataataggccagatattgtatggttctatttgtatgaaatgtccagaataggcaaatctgtggaaacagaaaataggttactggttgcyttgggctaaggataagaatagagattaactgttaacagcatgaggaatcttcttggagttatgaagacattttaaaactggattgtggtgatggttgtac

SEQ ID NO: 13639 - DNA, 201 bp, Homo sapiens
acaaaaacaaaaataaatgcgacctaattaaacaaaaaagcttctacacagcaaaagaaataatcataagagtaaactgacaaccttcagaatgggagaamatatttgcaaattatgcatccgacaaaggaccaatatccagaatctacaaggaactcaaacaagtcagaaaaataaataaataaaacccaccaaataatg

SEQ ID NO: 13640 - DNA, 201 bp, Homo sapiens
cttagattcagttcatggctttgctgtttattggcagtgtaattttgactaagttaacttaacctctctgtgccttagttttctcagtctataaaacaagragattaataatagatactcacagggttgctgtgatgattatgagttaacatacagaaagcacttaaaatagagcctgacacataaaaggactacattagt

SEQ ID NO: 13641 - DNA, 201 bp, Homo sapiens
gagcagaaaatcagcaaacactggacttaaactacactctagaacaaataaacctgacagatatttacagaacaattctaaccaagaactgcagaatatayattcttctcatcagcacatggaaccttctgcaaagtagaccatatgataggccacaaaacaagtctcaataaatttttaaaactcaaaatcttttgtggg

SEQ ID NO: 13642 - DNA, 201 bp, Homo sapiens
actgcagcctccgcctcccgggttcaaggaattctcctgcctcagccttccaagtagctgggattacaggcatccaccaccacgcccagctaattttgtatttttttagtagagctggggtttcactgtgttagccaggctggtctcaaactcctgacctcaagtgatccacccgccttggcctcccaaagtgctgggatt

SEQ ID NO: 13643 - DNA, 201 bp, Homo sapiens
ctaccaaaaatacaaaaattagccacgcatggtggcacacacctgtggtcccagctactcgggaggctgaggtgggaggatcgctggagcctgggaagttraggctgcagtgagccgtgatcatgccactgcattccagcctgtgtgatggagagagaccctgtctcaaaaaaaataaagatgtttgttgggtgaatgcac

SEQ ID NO: 13644 - DNA, 201 bp, Homo sapiens
gatacaccatccgctgaccccgtctgctcctctaggctggccccttgtccacccctctccacaccccttccagcccagggttcccatttggcttctggcaktggcccaactagccaagtctggtgttccctcatcatccccctacctgaacccctcttgccactgccttctaccttgtttgaaacctgaatcctaataaag

SEQ ID NO: 13645 - DNA, 201 bp, Homo sapiens
  misc_feature (1)...(201): n = A,T,C or G, or insertion/deletion polymorphism (see Tables 1-2)
aagctggacaaactgggcgaggtgagaggcaaataggaggcccatggtggggatgaaggtcagtgggaactcctggaatctcatagcacctctcctgtcanacttcctcacattccagggtacctatgccaccgtctacaaaggcaaaagcaagctcacagacaaccttgtggcactcaaggagatcagactggaacatga

SEQ ID NO: 13646 - DNA, 201 bp, Homo sapiens
agacttaacaggtggtaattgcaataccataattcacttgacaaagttaataatgatttctttgtgtcatgtaatagtctatatttcatcttccctggttktagctggtttgtgtatggaattgtttgacagataaaggtcaagcctctcagagaaggggcagctttttctaattcttcccatggggtcatatggggctgg

SEQ ID NO: 13647 - DNA, 201 bp, Homo sapiens
  misc_feature (1)...(201): n = A,T,C or G, or insertion/deletion polymorphism (see Tables 1-2)
catcctggtgtttgagatgaactacagacaatcctgtggggtccaataagagctggtgggcatgggggagaggtactgtgtttgagctattcctgggagantgtgtccctggtatctgagctgagtggggaaaaagtctctggtgtttgaacagggcagatcagcggatctacttgtgtgtgagctgatttggatgggaag

SEQ ID NO: 13648 - DNA, 201 bp, Homo sapiens
tttgagaggtcacagcgctgtgtctgtgtgagtacacctgtgtctgcacccctctactcttacaggtcatagagctgcccaacatccagaaggtcgaagtrtacccagtagaactgctgcttgtccggcacaatgatttgggcaaatctcacactgttcagttcagccataccgattctattggtgagtctaagggtcacg

SEQ ID NO: 13649 - DNA, 201 bp, Homo sapiens
ttcagctgtgttaatgagagagtaacactcagaacagtgcctggcccacatttaacacagtcgaattgttaactgtaatcatgaaagaaaagcacagagcrttctgagagcccatagcaggtagctcaagcctgaaggccactctgaccaggccaagtcaaacctgaaactggaggctgtggttttgtagtcacctctgtc

SEQ ID NO: 13650 - DNA, 201 bp, Homo sapiens
cgggtttgagagcggggactttgtctccttttcagaagtacagggcatggttgaactcaacggaaatcagcccatggagatcaaagtcctgggtgagctgsgaccatgggggaagcagaggggaactagaagatatgttcctgggttctggccggggagttgaagggagaagacatggcccttggttcagagttgggaaga

SEQ ID NO: 13651 - DNA, 201 bp, Homo sapiens
tttgagatgaactacagacaatcctgtggggtccaataagagctggtgggcatgggggagaggtactgtgtttgagctattcctgggagaatgtgtccctrgtatctgagctgagtggggaaaaagtctctggtgtttgaacagggcagatcagcggatctacttgtgtgtgagctgatttggatgggaagcagagaaggt

SEQ ID NO: 13652 - DNA, 201 bp, Homo sapiens
ccgcctcgctgagctcaacagctatgtgcctgtcactgcctacactggacccctcgttgaggacttccttagtggtttccaggtatcttgggggtactacscagccttctgcccagttttctcagagcccatctctggtttattcagtagtgttcaatattgatttaatgggtcggcctgaatgtcaggttttgtgctggg

SEQ ID NO: 13653 - DNA, 201 bp, Homo sapiens
ggtacctcttcctagcacccttccccctttcccccttcccgaggcaccactgttcccggtgccacagccatttcatctttttccctactgcacacccttamagttctacctgcgggaggaggacatcggtaaaaaccgggccgaggtatcacagccccgcctcgctgagctcaacagctatgtgcctgtcactgcctacac

SEQ ID NO: 13654 - DNA, 201 bp, Homo sapiens
atttgaaaccaggtctgtcctgaatccacatccttcccctgacctcgacacaagtacattcttgtcattcctttcactccaggattggagtctctccctcrttatgctgggctgggaagaagcaaatggcttagtggtcagcagtgtggatttgcaaatcagaccacctgggttcagatcttaggtctgacagctgtgtta

SEQ ID NO: 13655 - DNA, 201 bp, Homo sapiens
tatggtttctatggttaccaaggtaaggagaccagccctagggttcctggcaggcaggtgggctgcagtagtccttcctgtctgctcttggtaccctgggsctgtttctgagactcactcttcctttaaccaggacaaccccggtgtggttacctgcctggatgaggcccgacacgggtttgagagcggggactttgtctc

SEQ ID NO: 13656 - DNA, 201 bp, Homo sapiens
tctagctctacttcccttgggcccagggccatcttaggccctgctgtgagtccagatggttcctgggtcaggtctttccccctccttgctggcccagagcycaagaggaagcagaagacggctggcctaagccttttggtggccccattcccttcagcaatccatctaggtcatcttcctgtcgatgccagcatccctggg

SEQ ID NO: 13657 - DNA, 201 bp, Homo sapiens
caggcggatcacttgagctcaggagttcaagaccagcctggataacatagccaggccctgtctctacaaaaataaataaataaataaaattaggctgggcrcagtgattcgcgcctgtaatcccagcattctgggaggccgaggcagatggatcactggagctcaggagtttgaaaccagcctgggcaacaaggtgaaacc

SEQ ID NO: 13658 - DNA, 201 bp, Homo sapiens
cagagagggtgagactgcagaaggaggctggatgggattccagggcaaggaggcagaagggcctgggaggccgtgcagactaacagtcccctctccatatyccattcctagatgatggtggctgatgtcttcagtcaccgcttctataagctctatcagctagaggagcctctgagcagcatcttggaccgtgatgatatc

SEQ ID NO: 13659 - DNA, 201 bp, Homo sapiens
ccctgaagaacttccctaatgccatcgagcacaccctgcaggtgataagctgtgggagaagggaaagaggccaggcatctggccaggctgctgcctctccrcccccaggcccttgccttgccttcagatgttgcatgcctaagtgtaagatgtgccttttctccaaacctccctccctcacttcccaccaggcagcctagg

SEQ ID NO: 13660 - DNA, 201 bp, Homo sapiens
ggtcacgggcaaagttgtgtgtgtttcggtgtgtatataccaagaggggtgtccgtctttctgtcctctcctgatgtttctttcctagctctcgctttgtsctccccacaggcatgtacatggaccgccgctgtgtctactaccggaagccactgctggagtcaggcacactgggcaccaaaggcaatgtgcaggtggtga

SEQ ID NO: 13661 - DNA, 201 bp, Homo sapiens
gtgctgtaacgacgagagcggcgaggatgtcgaggttccctatgtccgatacaccatccgctgaccccgtctgctcctctaggctggccccttgtccaccmctctccacaccccttccagcccagggttcccatttggcttctggcagtggcccaactagccaagtctggtgttccctcatcatccccctacctgaacccc

SEQ ID NO: 13662 - DNA, 201 bp, Homo sapiens
atgccctggacaacgtggatgcccgtgagtttggaggcgggtgaggtggtcacgggcaaagttgtgtgtgtttcggtgtgtatataccaagaggggtgtcygtctttctgtcctctcctgatgtttctttcctagctctcgctttgtgctccccacaggcatgtacatggaccgccgctgtgtctactaccggaagccact

SEQ ID NO: 13663 - DNA, 201 bp, Homo sapiens
tttaaatatatatgtatttgctcatttcttcctagcaaccccatgaaggtaggtatcactgttgtaacacctgttttagagacaaggcacagaggtaaagrtgttatcctgtgtgcctgaagtcacaaaactaggtaatacgtggcatagctggaatctgaacctgaatttctaacatctgtacactccaaaccacctcgc

SEQ ID NO: 13664 - DNA, 201 bp, Homo sapiens
cccttgtcttcctccctgccccacccacctacctgcttacccaccaacagccatctgctctgctttcccccacaggcaggccagctttccgcgtggtggamaccgagttctaagccacagaccgaggccccagcaggcagcggctggagggatgccacacccctcacagggcagcccccaactacatcttccctgcttact

SEQ ID NO: 13665 - DNA, 201 bp, Homo sapiens
ggcatagctggaatctgaacctgaatttctaacatctgtacactccaaaccacctcgctaatgactgcgaactgtcctaggaattctcagaggccagaagytctgtcttgtttgctattttattttttgagacaggtctcattctgccattcaggctgaagtgtattggcacaatcatagctcactgcaaccttccaactc

SEQ ID NO: 13666 - DNA, 201 bp, Homo sapiens
ttgatagcgacggggccgacctcctcaccaagctgttgcaggtgagaccaccttgggtcagccttgggggtatgggattccaagtgtggggaaacagggacccccccccctcaaaccaggggcagggtctgaggtgggcagagagacctacttgttgaagatatcaatactatccccctccccgcacccccactcagtttg

SEQ ID NO: 13667 - DNA, 201 bp, Homo sapiens
tcacttgaacccgagaggttcaagtgagccaagatcacgccactgcactccagtctgggcgacagggcaaaactccatctcaaaaataaataaagccgggygcggtggctcacgcctgtaatcccagcactttgggaggctgaagcaggcagatcacgaggtcaggagatggagaccatcctggctaacacggtgaaaccc

SEQ ID NO: 13668 - DNA, 201 bp, Homo sapiens
  misc_feature (1)...(201): n = A,T,C or G, or insertion/deletion polymorphism (see Tables 1-2)
ccgtcccctctttccgggctccacggtggaggaacagctacacttcatcttccgtatcttaggtgaggaggcatgggccctaggcgctgtggagacacacngggaggacctgtgaaatgtttgggataactcctcttccctactaggaaccccaactgaggagacgtggccaggcatcctgtccaacgaggagttcaagac

SEQ ID NO: 13669 - DNA, 201 bp, Homo sapiens
tttggggtgatgaaaaatgtacattcttgagtagaggagaaatgtgacttggcttgtaaaagtctagattggaccctaggggtcctaacctgatcaaacckttctggcagccctgagaagagctggtgtacactgagacccccccgccctccacacaatcccacccagtggttgggtctgggcaggacaccctgacacacg

SEQ ID NO: 13670 - DNA, 201 bp, Homo sapiens
tcggaactgagtactaaacagcctccacagttctccctggtgccgtctccggcttggcgccgcatcctcctctgggctcgcgatggccgcgtcccctcccrctgcggacgggtcctttggtacatgcagtccgaggtgagtcccctcctttccacttcacccttccgagcgcctgcgtgcgcatgcgcggagcgcggcgcg

SEQ ID NO: 13671 - DNA, 201 bp, Homo sapiens
ttgtggagaagcactggtataagcagtgggaggcatacgtgcagggaggggaccaggactccagcaccttccctggctgcatcaacaatgccacactcttycaaggtacaaggcctttgcctccttctcaccctagccctggagttcttgtcccttccgtccctacagatgatcataagcccattctgtgtgctaggtcac

SEQ ID NO: 13672 - DNA, 201 bp, Homo sapiens
gtgtgagattgaggagggtaggagatgagaagaaaacagaatttcattgcttagggtgagataggaaccacaagaggatttcgaacaaaagagggttgtgrtctgactaaacacgtctgcatgggggtaggggggatggagacagatgggggctggaccctctgggatggtctccatcttacactcccctctttgtcttgc

SEQ ID NO: 13673 - DNA, 201 bp, Homo sapiens
gccagtcatttggagactgattgaggacacaggtattggccaagcatgtgaggtccgtagggatgagtcaggtatgcccagatggattgatcattttgggyctcacaaagatcttgaatgtactccatcaccccgcacaggcctagtattgcgcacagctcgggagcggtttctggtggagccccaggaagacactcggct

SEQ ID NO: 13674 - DNA, 201 bp, Homo sapiens
ctctgccaagtgaggatatgttgctgtagaacagggtttcttagcttcagcactactgacatttggggctggttatttatttgtcatgggagaggggatgycctgtgcactgtaggatgtttctcagcattcctgacttctgcccactagatgccaatagcactctccctccatcatgacatctcaaaatgtctccagaca

SEQ ID NO: 13675 - DNA, 201 bp, Homo sapiens
ggctgtggggactgaggggtgttcatcgcttagagcaggtagcaggaggcctaacaccagccccaccgggactgcagagttaccgtgctctgtccttggtyttggctgagtgctccagacaattgaaagcaccagtctggccactgctacatctttgccttcttctattgtactggctcctggtgcctgaggagtccattc

SEQ ID NO: 13676 - DNA, 201 bp, Homo sapiens
atactccaatgaggtggtgacactgtggtaccggccccctgacatcctgcttgggtccacggactactccactcagattgacatgtggtaaggacaggtgsaagtgtggcaggggccatgtggtaaagggggtggcttggtcacaacagccacccagccagctgcctttctattcactgtgccctccctgcccaggggtgt

SEQ ID NO: 13677 - DNA, 201 bp, Homo sapiens
cagcctgggcaacaagagtgaaacttgtctcaaaagaaaaaaaaaaaaaaagaggctgggcgcggtggctcacacctgtaatcccagcactttgggaggcygaggcaggcggatcacctgaagtcagaagttcgagactggcctggccaacatggtgaaactccatctctactaaaaatacaaaaattagccaggcatggt

SEQ ID NO: 13678 - DNA, 201 bp, Homo sapiens
gtaaaataaaatttattttgaaacagtctatccaatgtagttttaattctcatctttctctctctcttttttttttttcttgagatggagtctcgctctgwcactcaggctggagcgcagtggtacaatcatagctcactgtaacctagaactcctaggctcaagcagtcctttcgcctcagcctcctgagtagctgggac

SEQ ID NO: 13679 - DNA, 201 bp, Homo sapiens
ggtaggctgcccccgcatttgcagtccaattaacatcaccaaggcctctgcctcggggattttctggcctccctggggtatctaacacgccaccattttcygttaagtttctctacctgacctcaactccagccttactcttaaccttagttgcaataccatatctgcccccacagtcaacccagagtaaaccccagcgca

SEQ ID NO: 13680 - DNA, 201 bp, Homo sapiens
ccaagaggaagcagaagacggctggcctaagccttttggtggccccattcccttcagcaatccatctaggtcatcttcctgtcgatgccagcatccctggrctaccttgtttagggttgttcaatgaatagcagggactcatcacctcagcagaggttggtcctaggccctcagccccctgattcacttatttctgccata

SEQ ID NO: 13681 - DNA, 201 bp, Homo sapiens
cactttccacggcctcttcaagtccacgctggtgtgccccgattgtggcaatgtatctgtgaccttcgaccccttctgctacctcagtgttccactgcctrtcagccacaagagggtcttggaggtcttctttatccccatggatccgcgccgcaagccagagcaggtgtggggcagtgggggcctggggagatgatgatg

SEQ ID NO: 13682 - DNA, 201 bp, Homo sapiens
cttggttcagagttgggaagacacatcctggtgtttgagatgaactacagacaatcctgtggggtccaataagagctggtgggcatgggggagaggtactrtgtttgagctattcctgggagaatgtgtccctggtatctgagctgagtggggaaaaagtctctggtgtttgaacagggcagatcagcggatctacttgtg

SEQ ID NO: 13683 - DNA, 201 bp, Homo sapiens
tatccggtcaggggccagggagaggatggctgggggaaggcagggaaaggagggggtgtaccagtattaaccctctccccacccacagggacctggacttytctgagtttgtcatccagccacagaatgagtcgaatccggagctgtacaaatatgacctcatcgcggtttccaaccattatgggggcatgcgtgatggac

SEQ ID NO: 13684 - DNA, 201 bp, Homo sapiens
gcccagtccgtgttgtccgaagtgccctcggtgccaaccaacgtgagtgtcctctccgtggagactggcagacgaggtggtgggtgggaaagtcttttgtrtcactgtctgtctatccatgctccactcctgtgtgtctccctaaacttgttcttttcctctattcctagggaatggccaagaacggcagtgaagcagaca

SEQ ID NO: 13685 - DNA, 201 bp, Homo sapiens
tgatccgagatcgcgccactgtactccagcctgggcaacagagcgattctctgtctcaaaaaaaaaaaaaagaaaaagtccgtttgctgactcgggctctstctgtaggtactgcccttcctgcaagcagcaccagctggcaaccaagaagctggacctgtggatgctgccggagattctcatcatccacctgaaacgctt

SEQ ID NO: 13686 - DNA, 201 bp, Homo sapiens
ttttaacaggaacagagcaaactagaatactagatgggctaatagtaagagcagtgtttctgtgagccagacatggcacgtgagaggcagtacaaagggcrcacagtaggtgctcagaaaaagtctgttttggctgggcattgtggctcatgcctgtcatccgagtaccttgggaggccgacacgggtggatcacctgagg

SEQ ID NO: 13687 - DNA, 201 bp, Homo sapiens
gtgaggtggtcacgggcaaagttgtgtgtgtttcggtgtgtatataccaagaggggtgtccgtctttctgtcctctcctgatgtttctttcctagctctcrctttgtgctccccacaggcatgtacatggaccgccgctgtgtctactaccggaagccactgctggagtcaggcacactgggcaccaaaggcaatgtgcag

SEQ ID NO: 13688 - DNA, 201 bp, Homo sapiens
gcaaccggtggcgcattctctttgccattctccttatcttgaagggaagcccagtgcatccctcgtttccccttctggtgcctccttcctcacatgactgygtgtcatttcttagagtcctgcaacctgaagatgtggtgttagcccctctccccgtctctcaggggagtgaggggtgatgggtagcttcacactaacctg

SEQ ID NO: 13689 - DNA, 201 bp, Homo sapiens
catgcccatcatgcagtggctatactttgatgcccttgagtgtctccctgaggacaaagaggtcctcacagaggacaagtgcctccaggtatgtgggtggsacctgtggggagggcatcattggggacatttctggggaggcctctctaaccctcctccctttgcattccttagcgccagaaccgttatgacgggcaagtg

SEQ ID NO: 13690 - DNA, 201 bp, Homo sapiens
tggtggaggaactggaaaagggggttggacctggggaggtggagctcatgatcctgtttctctcttgccttacctgctaggacatcaacaagcgcctatcrctaccagctgacatccggctgcctgagggctacctggagaagctgaccctcaatagccccatctttgacaagcccctcagccgccgcctccgtcgtgtca

SEQ ID NO: 13691 - DNA, 201 bp, Homo sapiens
cctagaagatgacgaggaggataaagatgacgtccctgggccctcaactgggggcagcctccgagaccctgagccagagcaggctgggcccagctctggartcacgaacaggtgcccgttcctcctggacaattgccttggcacatctcagtggcccccaaggcgacgacgcaagcagctgttcaccctgcagacggtgaa

SEQ ID NO: 13692 - DNA, 201 bp, Homo sapiens
gaggtagcggtggagggggcagttgggcggggataggccgtcctagctaaggtggtaaaggccaataactcttcaggctgcctctcctcgaaaagtcatcwtctcgcgaacctttaaaatgccttcctccccaagcacctcaagggactagaactgagtgcttcatttgtcttttttcctccttgcaaaagtcccgtttgc

SEQ ID NO: 13693 - DNA, 201 bp, Homo sapiens
agccgtagcccagaggccagatgaagccttctgcagtggttcggactagggatagtggctggcccgtgtttgaggatgcagggcagtgggtcagcagatasagttagtagccccagggtcatgagggttctgggaacctcacctccaccctcacccccagattgccaaggacatggaacgctgggcccgcagtctcaacaa

SEQ ID NO: 13694 - DNA, 201 bp, Homo sapiens
caagtgcctccaggtatgtgggtgggacctgtggggagggcatcattggggacatttctggggaggcctctctaaccctcctccctttgcattccttagcrccagaaccgttatgacgggcaagtggctgtgtttggctcagacctgcaagagaagctgggcaagcagaagtatttcctggtaagtggtccccttggatgt

SEQ ID NO: 13695 - DNA, 201 bp, Homo sapiens
ctggggactgggttctcagcaagttaccgctcctgccatcatgccaccctgatggatgtccaagcctcacttccctcctgcactccccgctcccgccgccytccctgggattaagggagaggagaatggctgcttgttactgcctacctactctgtgccaggttctatgctctgtgttatttatcatctcgataaccccgt

SEQ ID NO: 13696 - DNA, 201 bp, Homo sapiens
gtgacagtgaggaggagcaggagcgtgggggccctgagcgggaggagaagctcaccgactggcagaagctggcctgtctgctctgccgacgccagttcccyagcaaagaggcgctcatccggcaccagcagctctcagggctccacaaggtaacagcggatggttggcagggcatgctggggcctggcccactgaggctca

SEQ ID NO: 13697 - DNA, 201 bp, Homo sapiens
ggttctatgctctgtgttatttatcatctcgataaccccgtggggaaggtaagtggtattatcacccctgtttcacaggtgagaaaactgaggcctgtggsggttaattattactgttagtgcgtggcaggctcaagatttgaaaccaggtctgtcctgaatccacatccttcccctgacctcgacacaagtacattcttg

SEQ ID NO: 13698 - DNA, 201 bp, Homo sapiens
  misc_feature (1)...(201): n = A,T,C or G, or insertion/deletion polymorphism (see Tables 1-2)
ggatctggcacccataaacgccttcattgggggcctggctgcccaggaagtcatgaaggtcagcacgggtggggagaggcaggattggggtgggccaggtncctccatgactctgtcacttgctctctgtctgtgtcaggcccctgttaaccactgaccaccccctctctcccttcccctctccaggcctgctccgggaag

SEQ ID NO: 13699 - DNA, 201 bp, Homo sapiens
ctgattccacctccccacccccacaatccacactgactcctgtcctctccccacagtccaaggcagcctatgtcctcttctaccaacgccaggacgtggcrcgacgcctgctgtccccggccggctcatctggcgccccagcctcccctgcctgcagctccccacccagctctgagttcatggatgttaattgagagccct

SEQ ID NO: 13700 - DNA, 201 bp, Homo sapiens
cgggaccgcttcacctgggagggcctgtataacgtcctgatgtaccggctctcgtaagtgtcctcttccccgggggtggggggcggaggggtctgaactcygacttgggtgtttagctgcttatttgacacctcccctgtaacaaacaaaagacagtccaaacttaacatggccatagaagaacttgtagggttttttctt

SEQ ID NO: 13701 - DNA, 201 bp, Homo sapiens
ctcgactcagacaagatggtgacaatgccttgagtctgaggcatcctctgcctgctttcctgcctgccccacctgcctcatattgtgtgggcctttttttktttgtttcattcattgtttttttttttttaattattttaaatgagatttttgttttttttaaatgcaatatctctgtatacagactggctgggccccacc

SEQ ID NO: 13702 - DNA, 201 bp, Homo sapiens; identical to SEQ ID NO: 2238

SEQ ID NO: 13703 - DNA, 201 bp, Homo sapiens; identical to SEQ ID NO: 2239

SEQ ID NO: 13704 - DNA, 201 bp, Homo sapiens
gaagttactggcctttgaactaggctgatggatttgctccatcttgggctaggagacaatgattgaggtcagctatcaaagcctttctatgaaacctccaraaagtaaccacagctcagacctaagactgctcagtggcctgagagccaacaacatgggcctgtgaggggagagatgaccacaggccccaagccgttgtcc

SEQ ID NO: 13705 - DNA, 201 bp, Homo sapiens; identical to SEQ ID NO: 2240

SEQ ID NO: 13706 - DNA, 201 bp, Homo sapiens; identical to SEQ ID NO: 2241

SEQ ID NO: 13707 - DNA, 201 bp, Homo sapiens; identical to SEQ ID NO: 2242

SEQ ID NO: 13708 - DNA, 201 bp, Homo sapiens; identical to SEQ ID NO: 2243

SEQ ID NO: 13709 - DNA, 201 bp, Homo sapiens
attccagcacctatgtcagagctcacagagactgtggtctgtgccctggggttgtctgtgggcctcgtgggcattgtggtggggaccgtcttgatcatccraggcctgcgttcagttggtgcttccagacaccaagggcccttgtgaatcccatcctgaaaaagaaggtaagtttgagatttgttagagctgaagctgcag

SEQ ID NO: 13710 - DNA, 201 bp, Homo sapiens
agcctgagattccagcacctatgtcagagctcacagagactgtggtctgtgccctggggttgtctgtgggcctcgtgggcattgtggtggggaccgtcttsatcatccgaggcctgcgttcagttggtgcttccagacaccaagggcccttgtgaatcccatcctgaaaaagaaggtaagtttgagatttgttagagctga

SEQ ID NO: 13711 - DNA, 201 bp, Homo sapiens
ccacagagcctgagattccagcacctatgtcagagctcacagagactgtggtctgtgccctggggttgtctgtgggcctcgtgggcattgtggtggggacygtcttgatcatccgaggcctgcgttcagttggtgcttccagacaccaagggcccttgtgaatcccatcctgaaaaagaaggtaagtttgagatttgttag

SEQ ID NO: 13712 - DNA, 201 bp, Homo sapiens
cttccacagagcctgagattccagcacctatgtcagagctcacagagactgtggtctgtgccctggggttgtctgtgggcctcgtgggcattgtggtgggsaccgtcttgatcatccgaggcctgcgttcagttggtgcttccagacaccaagggcccttgtgaatcccatcctgaaaaagaaggtaagtttgagatttgt

SEQ ID NO: 13713 - DNA, 201 bp, Homo sapiens
tgacctcaacaacttcacttccacagagcctgagattccagcacctatgtcagagctcacagagactgtggtctgtgccctggggttgtctgtgggcctcrtgggcattgtggtggggaccgtcttgatcatccgaggcctgcgttcagttggtgcttccagacaccaagggcccttgtgaatcccatcctgaaaaagaag

SEQ ID NO: 13714 - DNA, 201 bp, Homo sapiens
agcacactctgcattctgacctcaacaacttcacttccacagagcctgagattccagcacctatgtcagagctcacagagactgtggtctgtgccctgggrttgtctgtgggcctcgtgggcattgtggtggggaccgtcttgatcatccgaggcctgcgttcagttggtgcttccagacaccaagggcccttgtgaatcc

SEQ ID NO: 13715 - DNA, 201 bp, Homo sapiens; identical to SEQ ID NO: 3706

SEQ ID NO: 13716 - DNA, 201 bp, Homo sapiens
atgcacatgagcacactctgcattctgacctcaacaacttcacttccacagagcctgagattccagcacctatgtcagagctcacagagactgtggtctgygccctggggttgtctgtgggcctcgtgggcattgtggtggggaccgtcttgatcatccgaggcctgcgttcagttggtgcttccagacaccaagggccct

SEQ ID NO: 13717 - DNA, 201 bp, Homo sapiens
aatgggcactcagtcacagaaggtgtttctgagaccagcttcctctccaagagtgatcattccttcttcaagatcagttacctcaccttcctcccttctgmtgatgagatttatgactgcaaggtggagcactggggcctggatgagcctcttctgaaacactggggtaaggatgagtttcaccattttttgatgctttct

SEQ ID NO: 13718 - DNA, 201 bp, Homo sapiens; identical to SEQ ID NO: 3707

SEQ ID NO: 13719 - DNA, 201 bp, Homo sapiens
agagccaaccctccaccccatcccatccctcacacatgcacatgagcacactctgcattctgacctcaacaacttcacttccacagagcctgagattccarcacctatgtcagagctcacagagactgtggtctgtgccctggggttgtctgtgggcctcgtgggcattgtggtggggaccgtcttgatcatccgaggcct

SEQ ID NO: 13720 - DNA, 201 bp, Homo sapiens
aattctttccctgacctcctgatttttttttcttttctcaggtgttacctactaagagatgcctggggtaagccgcccagctacctaattcctcagtaacmtcgatctaaaatctccatggaagcaataaattccctttaagagatctatgtcaaatttttctatctttcatccggggctgactgaacctatggctaagaa

SEQ ID NO: 13721 - DNA, 201 bp, Homo sapiens
cacaggagcccccttggacccatcgatctcatgtctgtcctgttgcaggtgcatcaccatctacagcagcggaagagtggacttgctacatgacctagcaytattctctggcccgatttatcataccctttttctcctgcaaatgtttctcctcttaccttttctctgctttttttttcttaagcttctgtatcccctcag

SEQ ID NO: 13722 - DNA, 201 bp, Homo sapiens
gtaatgcagaagaagctcagggcagagctattcacactttacaccagtgctgtttcctcaccatagaggttcctgaggtcacagtgttttccaagtctccygtgacactgggtcagcccaacaccctcatctgtcttgtggacaacatctttcctcctgtggtcaacatcacctggctgagcaatgggcactcagtcacag

SEQ ID NO: 13723 - DNA, 201 bp, Homo sapiens
cctgacctcctgatttttttttcttttctcaggtgttacctactaagagatgcctggggtaagccgcccagctacctaattcctcagtaacatcgatctawaatctccatggaagcaataaattccctttaagagatctatgtcaaatttttctatctttcatccggggctgactgaacctatggctaagaattgtgacac

SEQ ID NO: 13724 - DNA, 201 bp, Homo sapiens
ctccaagagtgatcattccttcttcaagatcagttacctcaccttcctcccttctgatgatgagatttatgactgcaaggtggagcactggggcctggatragcctcttctgaaacactggggtaaggatgagtttcaccattttttgatgctttcttgtctgtcaagttcagaacttcctgccttttactctatatccca

SEQ ID NO: 13725 - DNA, 201 bp, Homo sapiens
tgtaatgcagaagaagctcagggcagagctattcacactttacaccagtgctgtttcctcaccatagaggttcctgaggtcacagtgttttccaagtctcycgtgacactgggtcagcccaacaccctcatctgtcttgtggacaacatctttcctcctgtggtcaacatcacctggctgagcaatgggcactcagtcaca

SEQ ID NO: 13726 - DNA, 201 bp, Homo sapiens
ttttcttttctcaggtgttacctactaagagatgcctggggtaagccgcccagctacctaattcctcagtaacatcgatctaaaatctccatggaagcaayaaattccctttaagagatctatgtcaaatttttctatctttcatccggggctgactgaacctatggctaagaattgtgacactctcatgtttcaagccaa

SEQ ID NO: 13727 - DNA, 201 bp, Homo sapiens
gagcccccttggacccatcgatctcatgtctgtcctgttgcaggtgcatcaccatctacagcagcggaagagtggacttgctacatgacctagcactattytctggcccgatttatcataccctttttctcctgcaaatgtttctcctcttaccttttctctgctttttttttcttaagcttctgtatcccctcagagctc

SEQ ID NO: 13728 - DNA, 201 bp, Homo sapiens
tctccaagagtgatcattccttcttcaagatcagttacctcaccttcctcccttctgatgatgagatttatgactgcaaggtggagcactggggcctggaygagcctcttctgaaacactggggtaaggatgagtttcaccattttttgatgctttcttgtctgtcaagttcagaacttcctgccttttactctatatccc

SEQ ID NO: 13729 - DNA, 201 bp, Homo sapiens
cctcgtgggcattgtggtggggaccgtcttgatcatccgaggcctgcgttcagttggtgcttccagacaccaagggcccttgtgaatcccatcctgaaaargaaggtaagtttgagatttgttagagctgaagctgcaggaaggaaagtgggaggaggctgtggacatgaatgtggttgaaagttgtaggggaattgggaa

SEQ ID NO: 13730 - DNA, 201 bp, Homo sapiens
cctcacacatgcacatgagcacactctgcattctgacctcaacaacttcacttccacagagcctgagattccagcacctatgtcagagctcacagagactktggtctgtgccctggggttgtctgtgggcctcgtgggcattgtggtggggaccgtcttgatcatccgaggcctgcgttcagttggtgcttccagacacca

SEQ ID NO: 13731 - DNA, 201 bp, Homo sapiens; identical to SEQ ID NO: 2271

SEQ ID NO: 13732 - DNA, 201 bp, Homo sapiens; identical to SEQ ID NO: 2272

SEQ ID NO: 13733 - DNA, 201 bp, Homo sapiens
tcttcactcatcagctgaccacgttgcctcttgtggtgtaaacttgtaccagttttacggtccctctggccagtacacccatgaatttgatggagatgagsagttctacgtggacctggagaggaaggagactgcctggcggtggcctgagttcagcaaatttggaggttttgacccgcagggtgcactgagaaacatggc

SEQ ID NO: 13734 - DNA, 201 bp, Homo sapiens
gtcatcttcactcatcagctgaccacgttgcctcttgtggtgtaaacttgtaccagttttacggtccctctggccagtacacccatgaatttgatggagaygaggagttctacgtggacctggagaggaaggagactgcctggcggtggcctgagttcagcaaatttggaggttttgacccgcagggtgcactgagaaaca

SEQ ID NO: 13735 - DNA, 201 bp, Homo sapiens
tgtattaaggttctttcttcccctgttctccgcctacctgcttgtcatcttcactcatcagctgaccacgttgcctcttgtggtgtaaacttgtaccagtyttacggtccctctggccagtacacccatgaatttgatggagatgaggagttctacgtggacctggagaggaaggagactgcctggcggtggcctgagttc

SEQ ID NO: 13736 - DNA, 201 bp, Homo sapiens
atgcagaacttcagggcagagctattcacacttcacaccagtgctgtttcctcaccacagaggttcctgaggtcacagtgttttccaagtctcccgtgacrctgggtcagcccaacaccctcatttgtcttgtggacaacatctttcctcctgtggtcaacatcacatggctgagcaatgggcagtcagtcacagaaggtg

SEQ ID NO: 13737 - DNA, 201 bp, Homo sapiens
cggtggcctgagttcagcaaatttggaggttttgacccgcagggtgcactgagaaacatggctgtggcaaaacacaacttgaacatcatgattaaacgctmcaactctaccgctgctaccaatggtatgcgtccaccattctgcctctctttacttaagctatccctccataccagggttcattattttcttcccaagagg

SEQ ID NO: 13738 - DNA, 201 bp, Homo sapiens
ctacgtggacctggagaggaaggagactgcctggcggtggcctgagttcagcaaatttggaggttttgacccgcagggtgcactgagaaacatggctgtgrcaaaacacaacttgaacatcatgattaaacgctacaactctaccgctgctaccaatggtatgcgtccaccattctgcctctctttacttaagctatccct

SEQ ID NO: 13739 - DNA, 201 bp, Homo sapiens
aggagttctacgtggacctggagaggaaggagactgcctggcggtggcctgagttcagcaaatttggaggttttgacccgcagggtgcactgagaaacatsgctgtggcaaaacacaacttgaacatcatgattaaacgctacaactctaccgctgctaccaatggtatgcgtccaccattctgcctctctttacttaagc

SEQ ID NO: 13740 - DNA, 201 bp, Homo sapiens
ggagatgaggagttctacgtggacctggagaggaaggagactgcctggcggtggcctgagttcagcaaatttggaggttttgacccgcagggtgcactgasaaacatggctgtggcaaaacacaacttgaacatcatgattaaacgctacaactctaccgctgctaccaatggtatgcgtccaccattctgcctctcttta

SEQ ID NO: 13741 - DNA, 176 bp, Homo sapiens
ccaagtctcccgtgacactgggtcagcccaacaccctcatttgtcttgtggacaacatctttcctcctgtggtcaacatcacatggctgagcaatgggcastcagtcacagaaggtgtttctgagaccagcttcctctccaagagtgatcattccttcttcaagatcagttacctc

SEQ ID NO: 13742 - DNA, 201 bp, Homo sapiens
gaatttgatggagatgaggagttctacgtggacctggagaggaaggagactgcctggcggtggcctgagttcagcaaatttggaggttttgacccgcaggktgcactgagaaacatggctgtggcaaaacacaacttgaacatcatgattaaacgctacaactctaccgctgctaccaatggtatgcgtccaccattctgc

SEQ ID NO: 13743 - DNA, 201 bp, Homo sapiens
ttcacacttcacaccagtgctgtttcctcaccacagaggttcctgaggtcacagtgttttccaagtctcccgtgacactgggtcagcccaacaccctcatytgtcttgtggacaacatctttcctcctgtggtcaacatcacatggctgagcaatgggcagtcagtcacagaaggtgtttctgagaccagcttcctctcca

SEQ ID NO: 13744 - DNA, 201 bp, Homo sapiens
tgaatttgatggagatgaggagttctacgtggacctggagaggaaggagactgcctggcggtggcctgagttcagcaaatttggaggttttgacccgcagkgtgcactgagaaacatggctgtggcaaaacacaacttgaacatcatgattaaacgctacaactctaccgctgctaccaatggtatgcgtccaccattctg

SEQ ID NO: 13745 - DNA, 201 bp, Homo sapiens
agagctattcacacttcacaccagtgctgtttcctcaccacagaggttcctgaggtcacagtgttttccaagtctcccgtgacactgggtcagcccaacaycctcatttgtcttgtggacaacatctttcctcctgtggtcaacatcacatggctgagcaatgggcagtcagtcacagaaggtgtttctgagaccagcttc

SEQ ID NO: 13746 - DNA, 201 bp, Homo sapiens
ctctggccagtacacccatgaatttgatggagatgaggagttctacgtggacctggagaggaaggagactgcctggcggtggcctgagttcagcaaatttrgaggttttgacccgcagggtgcactgagaaacatggctgtggcaaaacacaacttgaacatcatgattaaacgctacaactctaccgctgctaccaatgg

SEQ ID NO: 13747 - DNA, 201 bp, Homo sapiens; identical to SEQ ID NO: 2287

SEQ ID NO: 13748 - DNA, 201 bp, Homo sapiens
agttcagcaaatttggaggttttgacccgcagggtgcactgagaaacatggctgtggcaaaacacaacttgaacatcatgattaaacgctacaactctacygctgctaccaatggtatgcgtccaccattctgcctctctttacttaagctatccctccataccagggttcattattttcttcccaagaggtccccagatc

SEQ ID NO: 13749 - DNA, 201 bp, Homo sapiens; identical to SEQ ID NO: 2307

SEQ ID NO: 13750 - DNA, 201 bp, Homo sapiens; identical to SEQ ID NO: 2309

SEQ ID NO: 13751 - DNA, 201 bp, Homo sapiens
taattttcttataaatttgggtctgtgatctgttttgagttcatttttgtgtatggtgtaaggtaggggtctgaatccattcttttgcctgttgataacargtcggtctagcaccatttgttgaaaggactgttctttccctgattatattggtagcctgtagtattggtttttatatactattacaattttgggaaaatt

SEQ ID NO: 13752 - DNA, 201 bp, Homo sapiens
atttccctgtaagctgaattactcatttaaaaattttaacttctatatgggacccgaattagacactgctgaatcctgtacagccttactcataaataaartacttactgaatttccaccattcaaattcatttttcaggtgtgttgactctcacattagaaactgctcaactgataaagactttcatgttatttcactgc

SEQ ID NO: 13753 - DNA, 201 bp, Homo sapiens
cgaggcaggagaatggcgtgaacccgggaggcagagcttgcagtgagctgagatggtgccactgcactccagcctgggcgacagagtgagcctccgtctcaaaaaaaaaaaaaaaaaaaaaagaaggactacatatttctcaatgaaaatacagtgtacaatgttttccatgcaggtgtaaatactaactcatgttctgtt

SEQ ID NO: 13754 - DNA, 201 bp, Homo sapiens
cttgaacccaggaggcagagggtgcagtgagctgagatctcaccattgcactccagcctgggcaacagagcgagactccgtctcaaaaaaaaaaaagaatraatcacaagaaatggttccttcactgttatactttaacatgatacagctttttaatgttttattttttgagagagagtctcactgtgttgcccaggctgg

SEQ ID NO: 13755 - DNA, 201 bp, Homo sapiens
ctttttgtttagaattcccacagctgctgctgctgctgcttttttttttttttaagagagaggagggaggcaggtctcatggtttcccttctcagtgtttrtgtcaaccattcatcagtcatctttgaaagaacctagtaacactcatttttcatcttgctgtattttttcccttctaggtgaggaaaatagcagctgaat

SEQ ID NO: 13756 - DNA, 201 bp, Homo sapiens
tacatgttcttaaagggtcatgaaacttactcatattatgggcctctgaatttacttaccttcaatgtgggttatcataatgaacatcatgatttccccarcattcctggaaaaagtcttccactggtaagtaaaggatttgatacatattctaattttgttttttcatttgtttgttttttgagacggtgtctcactcag

SEQ ID NO: 13757 - DNA, 201 bp, Homo sapiens
ttttatcaatgccttatctacatgttacataggaataatctagcgtcctacctgtgtaaaaaccaactctggaatactgaaactgagctacttaatattckgaaaatcaggacgggtgtggtggcttttttttgcctgtaatccgagcactttgagaagctgaggcaagaagatcgcttgaggccagttcagaacagcccc

SEQ ID NO: 13758 - DNA, 201 bp, Homo sapiens
tcactgtaacctccacctcccgggttcaaacgattctcatgcctcagtctcccaagtagttgggattacaggcgcatgctaccacgcccagctaatttttktatttttagtagagatggggttttgccatgttggccaggctagtattttgtcagtccaagcagttcattaaaaaaaaaaaaaacaaaaagagcaagaata

SEQ ID NO: 13759 - DNA, 201 bp, Homo sapiens
agatcttttcgctagaagattcctgtgccctcaggtgggcgccctttcctctcaccactccctctcctccggagcgggccgaggtgagcgggtgccggccytggggctgcctgagtgctaggcagggtgtggtcctgggcatccttgggcctaccagcgagccctgctcagggtgtcgggcgccggcgggcagtactggcg

SEQ ID NO: 13760 - DNA, 201 bp, Homo sapiens
ggcctcaggcagtctttgtgcctcagcctcccaaagtgctggattaatggtgtgagccacagcacctggccaatagctttattgagattataattcaactrtcatgatttattcatttaaagtgtacagttcagtattttttagtatattcacagagttgtgcagctgtcaccaccatataaccttagaacatttcatcat

SEQ ID NO: 13761 - DNA, 201 bp, Homo sapiens; identical to SEQ ID NO: 2308

SEQ ID NO: 13762 - DNA, 201 bp, Homo sapiens; identical to SEQ ID NO: 2310

SEQ ID NO: 13763 - DNA, 201 bp, Homo sapiens; identical to SEQ ID NO: 2312

SEQ ID NO: 13764 - DNA, 201 bp, Homo sapiens
atgaaaatatatttccctgtaagctgaattactcatttaaaaattttaacttctatatgggacccgaattagacactgctgaatcctgtacagccttactrataaataaagtacttactgaatttccaccattcaaattcatttttcaggtgtgttgactctcacattagaaactgctcaactgataaagactttcatgtt

SEQ ID NO: 13765 - DNA, 201 bp, Homo sapiens
gactaaatgctagggggattctaatgcgcattcggttgcctcttccagagcacgtgtttgttttttgtttgtttgttttttgagactgcacgtgtttgtttgtttgtttgtttgtttgttttttgagactgagtctcactctgttgctcatgctggagtgcagtggcgcgatctccactcgctgcaacctctgcctcctgg

SEQ ID NO: 13766 - DNA, 201 bp, Homo sapiens
actaaatgctagggggattctaatgcgcattcggttgcctcttccagagcacgtgtttgttttttgtttgtttgttttttgagactgcacgtgtttgtttgtttgtttgtttgtttgttttttgagactgagtctcactctgttgctcatgctggagtgcagtggcgcgatctccactcgctgcaacctctgcctcctggg

SEQ ID NO: 13767 - DNA, 201 bp, Homo sapiens
aggcctgtaatcctagcacttcgggaggctgaggcgggaggatcgcttcagcccagaagtttgagaccatcctgagtaacatagtgagagccccccgtttmcacacacacacacacacacacacacacacacacactttttttaaattgaggaaacggtgagttgaacatgagcaattattccttatatatagtatttcct

SEQ ID NO: 13768 - DNA, 201 bp, Homo sapiens; identical to SEQ ID NO: 13643

SEQ ID NO: 13769 - DNA, 201 bp, Homo sapiens; identical to SEQ ID NO: 13670

SEQ ID NO: 13770 - DNA, 201 bp, Homo sapiens; identical to SEQ ID NO: 13644

SEQ ID NO: 13771 - DNA, 201 bp, Homo sapiens; identical to SEQ ID NO: 13672

SEQ ID NO: 13772 - DNA, 201 bp, Homo sapiens; identical to SEQ ID NO: 13674

SEQ ID NO: 13773 - DNA, 201 bp, Homo sapiens; identical to SEQ ID NO: 13675

SEQ ID NO: 13774 - DNA, 201 bp, Homo sapiens; identical to SEQ ID NO: 13647
  misc_feature (1)...(201): n = A,T,C or G, or insertion/deletion polymorphism (see Tables 1-2)

SEQ ID NO: 13775 - DNA, 201 bp, Homo sapiens; identical to SEQ ID NO: 13650

SEQ ID NO: 13776 - DNA, 201 bp, Homo sapiens; identical to SEQ ID NO: 13651

SEQ ID NO: 13777 - DNA, 201 bp, Homo sapiens; identical to SEQ ID NO: 13652

SEQ ID NO: 13778 - DNA, 201 bp, Homo sapiens; identical to SEQ ID NO: 13682

SEQ ID NO: 13779 - DNA, 201 bp, Homo sapiens; identical to SEQ ID NO: 13655

SEQ ID NO: 13780 - DNA, 201 bp, Homo sapiens; identical to SEQ ID NO: 13654

SEQ ID NO: 13781 - DNA, 201 bp, Homo sapiens; identical to SEQ ID NO: 13684

SEQ ID NO: 13782 - DNA, 201 bp, Homo sapiens; identical to SEQ ID NO: 13653

SEQ ID NO: 13783 - DNA, 201 bp, Homo sapiens; identical to SEQ ID NO: 13687

SEQ ID NO: 13784 - DNA, 201 bp, Homo sapiens; identical to SEQ ID NO: 13688

SEQ ID NO: 13785 - DNA, 201 bp, Homo sapiens; identical to SEQ ID NO: 13689

SEQ ID NO: 13786 - DNA, 201 bp, Homo sapiens; identical to SEQ ID NO: 13659

SEQ ID NO: 13787 - DNA, 201 bp, Homo sapiens; identical to SEQ ID NO: 13661

SEQ ID NO: 13788 - DNA, 201 bp, Homo sapiens; identical to SEQ ID NO: 13660

SEQ ID NO: 13789 - DNA, 201 bp, Homo sapiens; identical to SEQ ID NO: 13694

SEQ ID NO: 13790 - DNA, 201 bp, Homo sapiens; identical to SEQ ID NO: 13662

SEQ ID NO: 13791 - DNA, 201 bp, Homo sapiens; identical to SEQ ID NO: 13663

SEQ ID NO: 13792 - DNA, 201 bp, Homo sapiens; identical to SEQ ID NO: 13665

SEQ ID NO: 13793 - DNA, 201 bp, Homo sapiens; identical to SEQ ID NO: 13695

SEQ ID NO: 13794 - DNA, 201 bp, Homo sapiens; identical to SEQ ID NO: 13696

SEQ ID NO: 13795 - DNA, 201 bp, Homo sapiens; identical to SEQ ID NO: 13697

SEQ ID NO: 13796 - DNA, 201 bp, Homo sapiens; identical to SEQ ID NO: 13698
  misc_feature (1)...(201): n = A,T,C or G, or insertion/deletion polymorphism (see Tables 1-2)

SEQ ID NO: 13797 - DNA, 201 bp, Homo sapiens
aaaaagctagagaaaattcacatagtacacccattgattggtaattttttttttgttttttgagacagagtcttgctctgtcacctaggctggagtgcagkggcatgatctcagctcactgcaacttctgcctcccgggttcaagcgattctcctgcctcagcctcccgagtagctgggattaaaggcatgtgctaccatg

SEQ ID NO: 13798 - DNA, 201 bp, Homo sapiens
gttaaagaagcaagtttcaggaaatctatattatatgcattcaaaaagacctggacaaataaagaccaatcttaacagcagttatctctctctctctctcttttttttttttttttaaaagaaactagctcttactctgtcacccaggctggagtgccatgtgatcatagctcactgtagttttgaacttgggcttgaaca

SEQ ID NO: 13799 - DNA, 201 bp, Homo sapiens
ctgtagttttgaacttgggcttgaacaaccttcccacttcagtctctggagtagctggggctacaggcacgtaccaccacactcagctaacagcagttatytttgatgaggatgtagtataggttgagcatccataactggaaaatctgaaatctgaagtgctccaaaatccaaaatttgtctgagcaccaacaggtacaa

SEQ ID NO: 13800 - DNA, 201 bp, Homo sapiens
gatcgagaccatcctggctaacaaggtgaaaccccgtctctactaaaaatacaaaaaattagccgggcgcggtggcgggcgcctgtagtcccagctactcrggaggctgaggcaggagaatggcgtgaacctgggaagcggagcttgcagtgagccgagattgcaccactgcagtccgcagtccggcctgggcgacagagc

SEQ ID NO: 13801 - DNA, 201 bp, Homo sapiens
gtggagaaatagaagacctttttgatgaggtgacatgaagggtggagtgagcagaggctaggcctggaggagggagcaggacaggcatgcaggaagaaccygctcaagggaggagtcgcacatcccctcagccctcagcttttacttgttggtttccatgagcactgttggaactgtcagaagctggctttgaccaccttg

SEQ ID NO: 13802 - DNA, 201 bp, Homo sapiens
aaaattgaattttaatgtgactactagaaaatttaaatttacatatgcggcctacatgtatggttcgcatgttgctatcagacaacacaactgaaggctcyatcacaaattgggtggttgatgctgttggctgggacctcagctagggcagttgcatatgaacacctacatgtgacctttttatgtggctgcataggcctc

SEQ ID NO: 13803 - DNA, 201 bp, Homo sapiens
tctcttccaaaccaaaactaattactcagttggagcaaggggcagagccctggactgaggtgcgagaggctccatcaggcacacatgcaggtgagtgggtrgggaacatcccagcagaagctgagcacacggagcagtacgggggttcctgagtggaagctcatctttgagtgccctgttggtgcagaaaggcactggttt

SEQ ID NO: 13804 - DNA, 201 bp, Homo sapiens
gccgcttttctccccagtctttctgcacttgggagggctgctgccttcctgagggcctcaggcccatctgtgccatctcccagccttctgaaatcctcaarctctttatgtgatttttctctctctctttccaggcattcaccaggtatcttttgtttctttctacttctgttccattttctttctttcttttttttatat

SEQ ID NO: 13805 - DNA, 201 bp, Homo sapiens
aagaacatttgaatttttaaaattttctttcagtcgaggattactggtttgaaacaaagatgtcagccctaaagcaaagcacttctgaagcatctgttctrggagagcgaacgaaaagtgtcatgatggaaaaaggcctggactgggagggcagaagctccacagagaagaactataagtgcaaggaatgtgggaaagtct

SEQ ID NO: 13806 - DNA, 201 bp, Homo sapiens
ctatagaataaattcctataagaattgttaaaggttaaaatttttaaatccaccaaatttggtgggtatttccgctattcataaagataatacatgtttayactcctaatgacaacatatgagtgccacttttatagcttgtcagcagtgtcttatatgctttgatccttgcaaatctgagaggtgaaaatattttattat

SEQ ID NO: 13807 - DNA, 201 bp, Homo sapiens
  misc_feature (1)...(201): n = A,T,C or G, or insertion/deletion polymorphism (see Tables 1-2)
ccctgcagagttctttattcagcaggttctcaggcatgctgatgctggtgctgtggggctggagcccatgcttggaaaatcactgttctagagtgactcantgtgtgactctactgcagtttctctcttacattcagatgcatatatggcattttccagcttttggctattgcaagtgctgtaaacattcttatactttat

SEQ ID NO: 13808 - DNA, 201 bp, Homo sapiens
aacataaagaacatttgaatttttaaaattttctttcagtcgaggattactggtttgaaacaaagatgtcagccctaaagcaaagcacttctgaagcatcygttctgggagagcgaacgaaaagtgtcatgatggaaaaaggcctggactgggagggcagaagctccacagagaagaactataagtgcaaggaatgtggga

SEQ ID NO: 13809 - DNA, 201 bp, Homo sapiens
ggtgacatgaagggtggagtgagcagaggctaggcctggaggagggagcaggacaggcatgcaggaagaacctgctcaagggaggagtcgcacatcccctsagccctcagcttttacttgttggtttccatgagcactgttggaactgtcagaagctggctttgaccaccttgcttccttctcttgggatgcctccctcag

SEQ ID NO: 13810 - DNA, 201 bp, Homo sapiens
atgtggaaaaactttcagaaagaactcaatccttttaagtcatcagagaattcatactggccagaaaccctacaaatgtaatgactgtgggaaagccttcrctcagaatgcagctcttactcgtcatgaaagaatacatagtggagagaagccttttaaatgtaacaagtgtgggagagctttcagggataattcaactgt

SEQ ID NO: 13811 - DNA, 201 bp, Homo sapiens
tttagtaatttataatttcctaaaaagcatccagtaattcaaggtcataagttacttgtgttgaacaaagtagctttttataactcttagtaatattctcyacatctttggttacttttccctgatttcttactttgtcttttttccatttcctatattttcctatttcccctttattagctctgttttatttttttgaac

SEQ ID NO: 13812 - DNA, 201 bp, Homo sapiens
ttctcttgggatgcctccctcaggggttcccggatgagcagaattgggtttggttttgcagggaccgctgacatttggggatgtggctgtggcctttaccyggattgagtggagacacctggatgctgctcagcgggccctgtacagggatgtgatgctggagaactatgggaatctggtgtctgtgggtgaggatggctt

SEQ ID NO: 13813 - DNA, 201 bp, Homo sapiens
tgcaggtgagtgggtggggaacatcccagcagaagctgagcacacggagcagtacgggggttcctgagtggaagctcatctttgagtgccctgttggtgcrgaaaggcactggtttcctcttttgatgtcatcctcctgtcaagtggctggccgcttttctccccagtctttctgcacttgggagggctgctgccttcctg

SEQ ID NO: 13814 - DNA, 201 bp, Homo sapiens
  misc_feature (1)...(201): n = A,T,C or G, or insertion/deletion polymorphism (see Tables 1-2)
attctagggagaaaccccacaaatgcattgaatgtggaaaaactttcagaaagaactcaatccttttaagtcatcagagaattcatactggccagaaaccntacaaatgtaatgactgtgggaaagccttcgctcagaatgcagctcttactcgtcatgaaagaatacatagtggagagaagccttttaaatgtaacaagt

SEQ ID NO: 13815 - DNA, 201 bp, Homo sapiens
cgctgcctaatgaagttctatgctgtggtggccacctcacctgcatcttgggagagccacaagattgcagagaggatagaacagaggatcctgaactccarccctgtcatggaagcttttggtgagcttgggctcctttgcacagtatctcagtcccatttcctctgggattttccaccttccagggagagggacagtgct

SEQ ID NO: 13816 - DNA, 201 bp, Homo sapiens
gggcgtagtggcaggcgcctgtagtcccagctgctcgggaggctgaggcatgagaattgcttgaatctgggagggagaggttgcagtgagccgagattgcrccgctgcactccagcctgggtgacaggacgagagtccatctaaaaaaaaaaaaaagtttggtttagggtaataataggtcaattacagaaaagaggaaaa

SEQ ID NO: 13817 - DNA, 201 bp, Homo sapiens
tcaggttgccacttgccttgattcggtgttccatttactcattaccgtctcctttctgcccacagtgttcacaccctttccagaaattcttggctggtaascgcgaaaccgactggagcaggagctgggagaactggagaaaactgctctaatctcacttgactccagctaggagctgatgctgcatcgtaataacatttg

SEQ ID NO: 13818 - DNA, 201 bp, Homo sapiens
tcacagatgaagtaattctctacttctgcctgctttggcctccagggtctctcaccgaaactttgtagaacgatacaagttactaagaaggcttcatcctygcacatcctctggccccgacagcccatatcctgccaaagggctccctggtgagtgggacccatgagttagtcatttgtgcaaccacagtttactgagcat

SEQ ID NO: 13819 - DNA, 201 bp, Homo sapiens; identical to SEQ ID NO: 2378

SEQ ID NO: 13820 - DNA, 201 bp, Homo sapiens
tttgccttatgtattgattttagaaccttatttgtagcaatttattgaaaaaaaaaaaacgtatttgaaactttgacagcaactgtggtgctgctgcagcsaggtcactgacagctctaatggcccctttattatctctttcctgtttctgggcaaacctcttagccattcgttcctggttaactcggaaacacatccaga

SEQ ID NO: 13821 - DNA, 201 bp, Homo sapiens
gtcagtggtccaagttctctgtgggttttttttttttttcatgttatttaattttttgagacggagtctcactctgtcgcccaggatggaatgcagtgggkttaagcgattctcctgcctcagcctcccgaatagctgggactacagggcatgtgccaccatgcctggctatatttttttttttgtatttttaatagagac

SEQ ID NO: 13822 - DNA, 201 bp, Homo sapiens
ctgggagtatgttttacctcctccatcagaccagaaggtccttgaggctgggactgtatctctagggtggaagccgtgtcactcttatcattttaagggcyctcctagaatggcatctgtcgctaacagaacaagggcttccctagagttgtgccttttccatcggactgggagtcccccaaggcatggataggatatctc

SEQ ID NO: 13823 - DNA, 201 bp, Homo sapiens; identical to SEQ ID NO: 2357
  misc_feature (1)...(201): n = A,T,C or G, or insertion/deletion polymorphism (see Tables 1-2)

SEQ ID NO: 13824 - DNA, 201 bp, Homo sapiens
gaacctctcatccaggacattctccacactctgccggtcctaactcaggcagcagccataactggtgactcggctgaggccatgccagcccccatgcactrtggcaggaccaaggtgttcatgactgactctatggtgagctggtttggggatgaggaggttacagaggcaagctgtgtgctctcctcagcaggagggggc

SEQ ID NO: 13825 - DNA, 201 bp, Homo sapiens
ctgcccgccttggcctcccagagtgctgggattataggcatgagccactgtgcctggcctcaccttcacgttatctcttccaggtcaatggccacaatccrgggtctgatggccaagccagggagtacctcagagaagacctgcaggagttcctgggtggggaggtcctgctgtacaaactggatgacctcaccagggtga

SEQ ID NO: 13826 - DNA, 201 bp, Homo sapiens; identical to SEQ ID NO: 2391
  misc_feature (1)...(201): n = A,T,C or G, or insertion/deletion polymorphism (see Tables 1-2)

SEQ ID NO: 13827 - DNA, 201 bp, Homo sapiens
ggagcttctggaatgtgggcgtgcccgggtgctggagcagtgtgcccgctgcatccagggtggctggaggcgacaccggcaccgagagcaggagcggcagyggcgggccgtcatgctcatccaggcaggtaggtgggcaggtcacctgtcagcactgctcacagaccccacaggatgttggtttcctttgaaacatagctc

SEQ ID NO: 13828 - DNA, 201 bp, Homo sapiens
attaaatagaataacttctgatgagccctgaaccgttaacctggctcacagatgaagtaattctctacttctgcctgctttggcctccagggtctctcacmgaaactttgtagaacgatacaagttactaagaaggcttcatccttgcacatcctctggccccgacagcccatatcctgccaaagggctccctggtgagtg

SEQ ID NO: 13829 - DNA, 201 bp, Homo sapiens
ctcactttgtgtcctgcccgccttggcctcccagagtgctgggattataggcatgagccactgtgcctggcctcaccttcacgttatctcttccaggtcartggccacaatccggggtctgatggccaagccagggagtacctcagagaagacctgcaggagttcctgggtggggaggtcctgctgtacaaactggatgac

SEQ ID NO: 13830 - DNA, 201 bp, Homo sapiens
  misc_feature (1)...(201): n = A,T,C or G, or insertion/deletion polymorphism (see Tables 1-2)
ccctgcgcccgagccgagtgtgacacccgtagagactgcctggccaaactgatctatgcgcggtgagcagttactctggccccttgttggggaggaccccnacaagtgctcttcctgtccggggttgggccagacaacatcaggcaataggcacaggcccagggtgggagataagacagactggttcctctccctgctcct

SEQ ID NO: 13831 - DNA, 201 bp, Homo sapiens
  misc_feature (1)...(201): n = A,T,C or G, or insertion/deletion polymorphism (see Tables 1-2)
tgttgaccgtggtgtccaagttcaaggtgggtctgatgtgctgatgggaggtgcttggttcaaactccacggtctcacaaatatttattgagcacctgccnggatcggtgctgtttgttggggagcagtggcaagtcaagtagatgtggtcccagtcccctggagtttatacttcagtgtggaagacagaaacagtagaca

SEQ ID NO: 13832 - DNA, 201 bp, Homo sapiens; identical to SEQ ID NO: 2361
  misc_feature (1)...(201): n = A,T,C or G, or insertion/deletion polymorphism (see Tables 1-2)

SEQ ID NO: 13833 - DNA, 201 bp, Homo sapiens
cctcctttttgccttttccttttgaccctcttgtgtctcacgagggggtagcccagctcttggctcttgcttgaaacaagtctttcttgatcaccctccayctttccacctggccggcagggggcggcctggggggagagggtccttgctccactcttcgcccagctgaggaccccgggagggggcggctggtcccgggag

SEQ ID NO: 13834 - DNA, 201 bp, Homo sapiens
cttgtcctgtgctcagtcttcccataaggacatgccaggtttgtgtgtacctggcaacatgcatgcccatagcctgcatctgtagtaggtcaagacgtgayaggccggaagcaagaggagaggatttggtctttgacctgtcaggctcagaatacaagggccccccagggtgtagcaccctgatggggggagcaattttac

SEQ ID NO: 13835 - DNA, 201 bp, Homo sapiens
tttgcagagcgctttcacaggtattagcccctttaacgcttcatttagccccgtgagatctggatattatcactccgttttgtaaacgaggaaacagagtraggcttagttcttgggttctgtgccaggggccttgggttttggattcaaaccccaaacctgttgtgctgcccctctggacctattgcttgagatgagttc

SEQ ID NO: 13836 - DNA, 201 bp, Homo sapiens
ctgtgggtggtgctagggaggtgtgaattggggaaggcttcctggaagaggtagtatctgagaataaattggattagccaggtgatgggtggtccacatgrtaaatgtaatctgaacaaaggcctagaggcttgaggcagcagtgtgggtatgaggaactccagccagttctgtgttgctggttcattgaggcagagaact

SEQ ID NO: 13837 - DNA, 201 bp, Homo sapiens
atcacctgaggtcaggagttcaagaccagcctggccaacatggcgaaaccccatctctactaaaaatacaaaaattggttgggcgtagtggcaggcgcctrtagtcccagctgctcgggaggctgaggcatgagaattgcttgaatctgggagggagaggttgcagtgagccgagattgcgccgctgcactccagcctggg

SEQ ID NO: 13838 - DNA, 201 bp, Homo sapiens
attgtgggcacagtcgggaaatatttgttggaagaaactggtcagtcttggtaggggcttgactagatgtagagggagaggaaaggagtaaattaacttakcctgggaagtgaggaaaagcaagaggaaaagaggttcagggaggctgaagagcccgggcatgggtgacttgtcctgcaggtccagtgaagaagtctgcaa

SEQ ID NO: 13839 - DNA, 201 bp, Homo sapiens
gggagcgcctcctcctagggtttcctcatctgtctcacactgagtggatgtaatgctattttaatcctgctgtggcccccaatactagtacttgtccataycttcttgcatttttagcgtctgctctgtggggttgttaggccctggcactcccaggaactagtgctaaagctgcatctctctctcccctctagggatcga

SEQ ID NO: 13840 - DNA, 201 bp, Homo sapiens
cctcctagggtttcctcatctgtctcacactgagtggatgtaatgctattttaatcctgctgtggcccccaatactagtacttgtccataccttcttgcayttttagcgtctgctctgtggggttgttaggccctggcactcccaggaactagtgctaaagctgcatctctctctcccctctagggatcgataaagtttca

SEQ ID NO: 13841 - DNA, 201 bp, Homo sapiens
tcacctcaacccaggaggcagaggttgcagtgagctgagattgcaccattacactccagcctgggtgacagagcaagactctgtctcaaaaaaaaaaaaaacaacaaaacataattaaccgtgcctggtggcacatgcctgtagtcccagttactccagaggctgaggcaagaggattgcttgagcctgggagattgaagc

SEQ ID NO: 13842 - DNA, 201 bp, Homo sapiens
taacacaagagatgctttgtgttggtagaccaaggcagcagggagagcagacccattttaaatagtctttatgggtttccaactaagtgatcctagaaatygcttcaaaaccacattcacattcagtggggatactcggggagggcagcaccgtgctgtgttgttgagcagattaaatagaataacttctgatgagccctg

SEQ ID NO: 13843 - DNA, 201 bp, Homo sapiens
gacccaggaggaaccccctggccagagcagggcccctgtgttgaccgtggtgtccaagttcaaggtgggtctgatgtgctgatgggaggtgcttggttcaaactccacggtctcacaaatatttattgagcacctgccgggatcggtgctgtttgttggggagcagtggcaagtcaagtagatgtggtcccagtcccctgg

SEQ ID NO: 13844 - DNA, 201 bp, Homo sapiens
ttgtctgaaatttcattaccaagtcggtattagaaaatattttgaactaataaattaaaatgaaagcacaacatcttcattacctctttttttttttttttgagatagtttcgctattgttgcccaggctggagtgcaacggtgcgagctcagctcactgcaacctgcgcctcccgggttcaagcgattctcctgcctcag

SEQ ID NO: 13845 - DNA, 201 bp, Homo sapiens
ttagtatttaattagttgatttatttaatgtaatttcaaacaattaaattatgaataatgcaatgtacagtagaatcacgttttgattttattaacactgmccaagtttaactccatatgaagtgtaagcttgatatcgtttatgatgtctatcaactgtaccaaaagtaaaacatttaaaaacaatcatctgaatgtcaa

SEQ ID NO: 13846 - DNA, 201 bp, Homo sapiens
cgtgggaccggtgagtgtcaacccgaacctatatctgaagcccttcagacgcggaaggggcttgggaggccagtttgccccgcagcggtgaggaagaagtrggcgtctccacctccccttccaaagcgccgtttccctcctttttgccttttccttttgaccctcttgtgtctcacgagggggtagcccagctcttggctc

SEQ ID NO: 13847 - DNA, 201 bp, Homo sapiens
ctgtgttgttgagcagattaaatagaataacttctgatgagccctgaaccgttaacctggctcacagatgaagtaattctctacttctgcctgctttggcytccagggtctctcaccgaaactttgtagaacgatacaagttactaagaaggcttcatccttgcacatcctctggccccgacagcccatatcctgccaaag

SEQ ID NO: 13848 - DNA, 201 bp, Homo sapiens
gcagggagagcagacccattttaaatagtctttatgggtttccaactaagtgatcctagaaatcgcttcaaaaccacattcacattcagtggggatactcrgggagggcagcaccgtgctgtgttgttgagcagattaaatagaataacttctgatgagccctgaaccgttaacctggctcacagatgaagtaattctcta

SEQ ID NO: 13849 - DNA, 201 bp, Homo sapiens
agctctggtgggcactgttctctcaggcaggctcagaagtgggcgggagcatagatacagctcccacagggctgtttctgccacagacatggacgtctcgytgcctaatgaagttctatgctgtggtggccacctcacctgcatcttgggagagccacaagattgcagagaggatagaacagaggatcctgaactccaacc

SEQ ID NO: 13850 - DNA, 201 bp, Homo sapiens
tctaatgtagaggatagggcacaaggcttctctgtctccccagtgtcttactcctcctccatggcacactgacccagagggtttgcagccccaccccaacscaaaccctaaccctgtaataaaactggcccagggagcctctgaggctctcataaaagtttccctgtctcctaattggcaagggaaaggacaggcccactc

SEQ ID NO: 13851 - DNA, 201 bp, Homo sapiens
ccgctttaccctcattttaccccagggtcgcaaaacatctcaccgtagttgaagccagcaagccggaccaggcgtcccggccaagccacgtgcgcgcccckcgccgcgagtgctcgccccgcccctagggaggagccggccgacccccggccacttagcagtgccgcagccgacggggtgcggttcggcgctcccaggttc

SEQ ID NO: 13852 - DNA, 201 bp, Homo sapiens
ggttggtgcttgccctcaaggagctcagagtctagtggagtcttgggtaggtaagtgcctgacatcagcaaggtagcagccaggtgtggggcctgccagcrtcaagggagccatagtagacactgcagcttgaccttccagccatatggctcctggaacaggtttgaaggtaagaagtgggcaaaacagttgactgctctg

SEQ ID NO: 13853 - DNA, 201 bp, Homo sapiens
tggagatggtgcagattagaaccatcagggcaggcagacagcagcaggtgttccggaagccctgcgcccgagccgagtgtgacacccgtagagactgcctrgccaaactgatctatgcgcggtgagcagttactctggccccttgttggggaggaccccgacaagtgctcttcctgtccggggttgggccagacaacatca

SEQ ID NO: 13854 - DNA, 201 bp, Homo sapiens
gggtcgcaaaacatctcaccgtagttgaagccagcaagccggaccaggcgtcccggccaagccacgtgcgcgccccgcgccgcgagtgctcgccccgcccmtagggaggagccggccgacccccggccacttagcagtgccgcagccgacggggtgcggttcggcgctcccaggttcctttcctcactgcacgctcttgcc

SEQ ID NO: 13855 - DNA, 201 bp, Homo sapiens
tcataaatgaggtggggaggtcagctaatgagccgagcaccagagttggcctttgggttttctggggccttgatgattatcctgtttcctctctgtgcctstctcctcccagtctgccaaatagatctgctaattgctatattttttctgttggggacactatgatgcctgtgtgatgtctgctgtcatggggtccacagg

SEQ ID NO: 13856 - DNA, 201 bp, Homo sapiens
tcctagaaatcgcttcaaaaccacattcacattcagtggggatactcggggagggcagcaccgtgctgtgttgttgagcagattaaatagaataacttctratgagccctgaaccgttaacctggctcacagatgaagtaattctctacttctgcctgctttggcctccagggtctctcaccgaaactttgtagaacgata

SEQ ID NO: 13857 - DNA, 201 bp, Homo sapiens
cttccaaagcgccgtttccctcctttttgccttttccttttgaccctcttgtgtctcacgagggggtagcccagctcttggctcttgcttgaaacaagtcwttcttgatcaccctccacctttccacctggccggcagggggcggcctggggggagagggtccttgctccactcttcgcccagctgaggaccccgggaggg

SEQ ID NO: 13858 - DNA, 201 bp, Homo sapiens
ctgcctcagccttccgagtagctgggactacaggtgcccgccaccatgcctggctaattttttgaattttttttagtagagacggggtttcaccgtgttarccaggatggtctcgatctcctcactttgtgtcctgcccgccttggcctcccagagtgctgggattataggcatgagccactgtgcctggcctcaccttca

SEQ ID NO: 13859 - DNA, 201 bp, Homo sapiens
ttattaacaggaaaggatttataaaggtattatatatttgtttatttaacaaactacctttttattttttattattatttatttatttatttatttatttwgagatggagtttcagtcttattgcccagactggagtgcaatggcatgatctgggctcagcgcaacctccacctcctgagttcaagcaattctcctgcttc

SEQ ID NO: 13860 - DNA, 201 bp, Homo sapiens
  misc_feature (1)...(201): n = A,T,C or G, or insertion/deletion polymorphism (see Tables 1-2)
accagagttggcctttgggttttctggggccttgatgattatcctgtttcctctctgtgcctctctcctcccagtctgccaaatagatctgctaattgctntattttttctgttggggacactatgatgcctgtgtgatgtctgctgtcatggggtccacagggtggggacagtgagggttgtggtgagacactctcatgt

SEQ ID NO: 13861 - DNA, 201 bp, Homo sapiens
agataatgagcttgttggtgtaaaagtgcatgatgcattcagggagaggtgagagaaaacttgctggcaggagggaggtcttgggggcaagagggagtagrtgagagcaggaagacgagaaagccagggttgtttgtgaagagtctgaagcaccatagcaggcagagagaatctgcagagcatcttcatccaggtagaggt

SEQ ID NO: 13862 - DNA, 201 bp, Homo sapiens
attttaaatagtctttatgggtttccaactaagtgatcctagaaatcgcttcaaaaccacattcacattcagtggggatactcggggagggcagcaccgtsctgtgttgttgagcagattaaatagaataacttctgatgagccctgaaccgttaacctggctcacagatgaagtaattctctacttctgcctgctttggc

SEQ ID NO: 13863 - DNA, 201 bp, Homo sapiens
gtaattggtgtcctaggagtagagagaggacatgggtcaaaagtaatatttttacaaaattaaccaaagatggcaagcacagatccaaaaagctcaaaaawtgccaagtagaatgaatacaaagaaaacacatttaggcacattatggtcaaagtgctgaaaactaaatataagaaaaaaatcttaaggaccaggtgcagt

SEQ ID NO: 13864 - DNA, 201 bp, Homo sapiens
tttccttttgaccctcttgtgtctcacgagggggtagcccagctcttggctcttgcttgaaacaagtctttcttgatcaccctccacctttccacctggcyggcagggggcggcctggggggagagggtccttgctccactcttcgcccagctgaggaccccgggagggggcggctggtcccgggaggtgtcagggcagct

SEQ ID NO: 13865 - DNA, 201 bp, Homo sapiens
ctttgcctctaaagaagacaaacaaacaaaaaaatgataactctccagtcagacttataaaaagagaaaaaagatgtaaatcaccagtatcaggaatgaargagtagacatcaatatagatcttacagattaagataatattttgaataactttatgccaagaaattatacaatttagatgaaatggagaaatattttgag

SEQ ID NO: 13866 - DNA, 201 bp, Homo sapiens
gggcatgctttgcttcagatttggagctcatcttaattagatcttgtatcttttcttcagggagctgctgggatttaatgattcttggctaattgcagaargagggctgttacttaagtagatgtgtgtctgtgtgtgtggtttgactatatttgagcccgagtttgctaaaggcatctctgcctcagtcctgaggtgcct

SEQ ID NO: 13867 - DNA, 201 bp, Homo sapiens
ggtgggcactgttctctcaggcaggctcagaagtgggcgggagcatagatacagctcccacagggctgtttctgccacagacatggacgtctcgctgcctratgaagttctatgctgtggtggccacctcacctgcatcttgggagagccacaagattgcagagaggatagaacagaggatcctgaactccaaccctgtca

SEQ ID NO: 13868 - DNA, 201 bp, Homo sapiens
agccctggatggagaggcaggagccctgggtccactgtgtgactctgggcagttcctttcccttttttgtctcctcttgcatctgcctgccagcatagagygagatctctgcatagggtgagatctctgctctcctgcacccacatctgagcagtccataactctccagacaggctcaacagtgccttgtctgaaagagcc

SEQ ID NO: 13869 - DNA, 201 bp, Homo sapiens
ccaataattctcatgcctcagcctcccgagtagctgggattacagatgcataccaccacactcagcaaagttttttttttttgttttttgtttttttttttgagacggagtcttgctctgttgcccaggctggagtgcagtggcacaatcttggctcactgcaacttctgcctcccgggttcacaccattctcctgcctca

SEQ ID NO: 13870 - DNA, 201 bp, Homo sapiens
atattctctaaaatattggttatttctgggtagtatgattatggatttttatgctccttttgcttatctctattttccaatttttttttttttttttttttgagatggagtctcaccctgtcatccaggctggagtgtagtggcttgatcttggctcactgcaatctctgcctcccaggttcatgctattctcctgcctca

SEQ ID NO: 13871 - DNA, 201 bp, Homo sapiens
gatattctctaaaatattggttatttctgggtagtatgattatggatttttatgctccttttgcttatctctattttccaatttttttttttttttttttttgagatggagtctcaccctgtcatccaggctggagtgtagtggcttgatcttggctcactgcaatctctgcctcccaggttcatgctattctcctgcctc

SEQ ID NO: 13872 - DNA, 201 bp, Homo sapiens
tagcaccctgagggacaacagagaggctgtttgtggcttcctccaaaagaagaacaaggagaaaatggctagagccaagaacagcaggaaagagacctgtrgagtgctagggaggccaaagccagtttcttcaggccacagaggcatgtagagatgaccatgcactgatggggccatctccctcccccagaatggtgtcca

SEQ ID NO: 13873 - DNA, 201 bp, Homo sapiens; identical to SEQ ID NO: 2428

SEQ ID NO: 13874 - DNA, 201 bp, Homo sapiens
gggcctctcccgggtcaagggtctccaggtcccgctgcctcggcgtggatctcggacccagagactcggggagacccgggcggtccgtgggggatgtggasgggtagtgacctgcgcccccggccggtgtcactcacaggcctcactctggttgtagtagccgctcagggtccgcaggttcactcggtaaaactgtgcttt

SEQ ID NO: 13875 - DNA, 201 bp, Homo sapiens; identical to SEQ ID NO: 2429

SEQ ID NO: 13876 - DNA, 201 bp, Homo sapiens
cgggtcaagggtctccaggtcccgctgcctcggcgtggatctcggacccagagactcggggagacccgggcggtccgtgggggatgtggaggggtagtgabctgcgcccccggccggtgtcactcacaggcctcactctggttgtagtagccgctcagggtccgcaggttcactcggtaaaactgtgctttggccttggcg

SEQ ID NO: 13877 - DNA, 201 bp, Homo sapiens; identical to SEQ ID NO: 2432

SEQ ID NO: 13878 - DNA, 201 bp, Homo sapiens
cctgggcctctcccgggtcaagggtctccaggtcccgctgcctcggcgtggatctcggacccagagactcggggagacccgggcggtccgtgggggatgtrgaggggtagtgacctgcgcccccggccggtgtcactcacaggcctcactctggttgtagtagccgctcagggtccgcaggttcactcggtaaaactgtgc

SEQ ID NO: 13879 - DNA, 201 bp, Homo sapiens
cagagactcggggagacccgggcggtccgtgggggatgtggaggggtagtgacctgcgcccccggccggtgtcactcacaggcctcactctggttgtagtrgccgctcagggtccgcaggttcactcggtaaaactgtgctttggccttggcggtccctgtctcctcttcccaatattccggcccctcctgctccatccac

SEQ ID NO: 13880 - DNA, 201 bp, Homo sapiens
gtcggggccggacggggctcgggggactgggctgaccgtggggtcggggccaggttctcacaccatccagatgatgtatggctgcgacgtggggtcggackggcgcttcctccgcgggtaccggcaggacgcctacgacggcaaggattacatcgccttgaacgaggacctgcgctcttggaccgcggcggacatggcggc

SEQ ID NO: 13881 - DNA, 201 bp, Homo sapiens
gccggacggggctcgggggactgggctgaccgtggggtcggggccaggttctcacaccatccagatgatgtatggctgcgacgtggggtcggacgggcgcytcctccgcgggtaccggcaggacgcctacgacggcaaggattacatcgccttgaacgaggacctgcgctcttggaccgcggcggacatggcggctcagat

SEQ ID NO: 13882 - DNA, 201 bp, Homo sapiens
gggactgggctgaccgtggggtcggggccaggttctcacaccatccagatgatgtatggctgcgacgtggggtcggacgggcgcttcctccgcgggtaccrgcaggacgcctacgacggcaaggattacatcgccttgaacgaggacctgcgctcttggaccgcggcggacatggcggctcagatcacccagcgcaagtgg

SEQ ID NO: 13883 - DNA, 201 bp, Homo sapiens; identical to SEQ ID NO: 2480

SEQ ID NO: 13884 - DNA, 201 bp, Homo sapiens; identical to SEQ ID NO: 2482

SEQ ID NO: 13885 - DNA, 201 bp, Homo sapiens; identical to SEQ ID NO: 2483

SEQ ID NO: 13886 - DNA, 201 bp, Homo sapiens; identical to SEQ ID NO: 2484

SEQ ID NO: 13887 - DNA, 201 bp, Homo sapiens; identical to SEQ ID NO: 2485

SEQ ID NO: 13888 - DNA, 201 bp, Homo sapiens; identical to SEQ ID NO: 2486

SEQ ID NO: 13889 - DNA, 201 bp, Homo sapiens
ggaggaccagacccaggacacggagctcgtggagaccaggcctgcaggggatggaaccttccagaagtgggcggctgtggtggtgccttctggacaggagmagagatacacctgccatgtgcagcatgagggtttgcccaagcccctcaccctgagatggggtaaggagggagacgggggtgtcatgtcttttagggaaag

SEQ ID NO: 13890 - DNA, 201 bp, Homo sapiens
gacgacacgcagttcgtgcggtttgacagcgacgccgcgagccagaggatggagccgcgggcaccgtggatagagcaggaggggccggagtattgggaccrgcagacacggaatgtgaaggcccagtcacagactgaccgagcgaacctggggaccctgcgcggctactacaaccagagcgaggccggtgagtgaccccgg

SEQ ID NO: 13891 - DNA, 201 bp, Homo sapiens
acacgcagttcgtgcggtttgacagcgacgccgcgagccagaggatggagccgcgggcaccgtggatagagcaggaggggccggagtattgggacctgcasacacggaatgtgaaggcccagtcacagactgaccgagcgaacctggggaccctgcgcggctactacaaccagagcgaggccggtgagtgaccccggcccg

SEQ ID NO: 13892 - DNA, 201 bp, Homo sapiens
agtgcggggtcgtggggaaaccgcctctgcggggagaagcaaggggcccgcccggcggggacgcaggacccgggtagccgcgccgggaggagggtcgggtrggtctcagccactcctcgcccccaggctcccactccatgaggtatttcaccacatccgtgtcccggcccggccgcggggagccccgcttcatcgccgtgg

SEQ ID NO: 13893 - DNA, 201 bp, Homo sapiens
cagacctgggcgggtgagtgcggggtcgtggggaaaccgcctctgcggggagaagcaaggggcccgcccggcggggacgcaggacccgggtagccgcgcckggaggagggtcgggtgggtctcagccactcctcgcccccaggctcccactccatgaggtatttcaccacatccgtgtcccggcccggccgcggggagccc

SEQ ID NO: 13894 - DNA, 201 bp, Homo sapiens
gcagttcgtgcggtttgacagcgacgccgcgagccagaggatggagccgcgggcaccgtggatagagcaggaggggccggagtattgggacctgcagacasggaatgtgaaggcccagtcacagactgaccgagcgaacctggggaccctgcgcggctactacaaccagagcgaggccggtgagtgaccccggcccggggc

SEQ ID NO: 13895 - DNA, 201 bp, Homo sapiens
ggccctgacccagacctgggcgggtgagtgcggggtcgtggggaaaccgcctctgcggggagaagcaaggggcccgcccggcggggacgcaggacccgggdagccgcgccgggaggagggtcgggtgggtctcagccactcctcgcccccaggctcccactccatgaggtatttcaccacatccgtgtcccggcccggccg

SEQ ID NO: 13896 - DNA, 201 bp, Homo sapiens
tcgtgcggtttgacagcgacgccgcgagccagaggatggagccgcgggcaccgtggatagagcaggaggggccggagtattgggacctgcagacacggaawgtgaaggcccagtcacagactgaccgagcgaacctggggaccctgcgcggctactacaaccagagcgaggccggtgagtgaccccggcccggggcgcagg

SEQ ID NO: 13897 - DNA, 201 bp, Homo sapiens
cagacgccgaggatggccgtcatggcgccccgaaccctcctcctgctactcttgggggccctggccctgacccagacctgggcgggtgagtgcggggtcgkggggaaaccgcctctgcggggagaagcaaggggcccgcccggcggggacgcaggacccgggtagccgcgccgggaggagggtcgggtgggtctcagccac

SEQ ID NO: 13898 - DNA, 201 bp, Homo sapiens
aacctggggaccctgcgcggctactacaaccagagcgaggccggtgagtgaccccggcccggggcgcaggtcacgacctctcatcccccacggacgggccrggtcgcccacagtctccgggtccgagatccaccccgaagccgcgggaccccgagacccttgccccgggagaggcccaggcgcctttacccggtttcattt

SEQ ID NO: 13899 - DNA, 201 bp, Homo sapiens; identical to SEQ ID NO: 2556

SEQ ID NO: 13900 - DNA, 201 bp, Homo sapiens; identical to SEQ ID NO: 2565

SEQ ID NO: 13901 - DNA, 201 bp, Homo sapiens; identical to SEQ ID NO: 2567

SEQ ID NO: 13902 - DNA, 201 bp, Homo sapiens
tacgacggcaaggattacatcgccttgaacgaggacctgcgctcttggaccgcggcggacatggcggctcagatcacccagcgcaagtgggaggcggcccrtgtggcggagcagttgagagcctacctggagggcacgtgcgtggagtggctccgcagatacctggagaacgggaaggagacgctgcagcgcacgggtacc

SEQ ID NO: 13903 - DNA, 201 bp, Homo sapiens
gaggtggggctgaggtgtctccatctctgtctcaacttcatggtgcactgagctgtaacttcttccttccctattaaaattagaacctgagtataaatttmctttctcaaattcttgccatgagaggttgatgagttaattaaaggagaagattcctaaaatttgagagacaaaataaatggaacacatgagaaccttcca

SEQ ID NO: 13904 - DNA, 201 bp, Homo sapiens
cgacggcaaggattacatcgccttgaacgaggacctgcgctcttggaccgcggcggacatggcggctcagatcacccagcgcaagtgggaggcggcccgtstggcggagcagttgagagcctacctggagggcacgtgcgtggagtggctccgcagatacctggagaacgggaaggagacgctgcagcgcacgggtaccag

SEQ ID NO: 13905 - DNA, 201 bp, Homo sapiens
aggacctgcgctcttggaccgcggcggacatggcggctcagatcacccagcgcaagtgggaggcggcccgtgtggcggagcagttgagagcctacctggakggcacgtgcgtggagtggctccgcagatacctggagaacgggaaggagacgctgcagcgcacgggtaccaggggccacggggcgcctccctgatcgcctg

SEQ ID NO: 13906 - DNA, 201 bp, Homo sapiens
aaaccagaagcaatattgtgccccagggtgggtcttgtggagggtactgcaggtattataggggtggcactgccattacagacctgaacgatgcggggtgktgttgggattgcctgttatctccatataactcagcaatctgtacctgcagaagcctgatatggctaaagaatgaatggaattactccagacttgaccaag

SEQ ID NO: 13907 - DNA, 201 bp, Homo sapiens; identical to SEQ ID NO: 2514

SEQ ID NO: 13908 - DNA, 201 bp, Homo sapiens
tgcggtttgacagcgacgccgcgagccagaggatggagccgcgggcaccgtggatagagcaggaggggccggagtattgggacctgcagacacggaatgtsaaggcccagtcacagactgaccgagcgaacctggggaccctgcgcggctactacaaccagagcgaggccggtgagtgaccccggcccggggcgcaggtca

SEQ ID NO: 13909 - DNA, 201 bp, Homo sapiens
acagcgacgccgcgagccagaggatggagccgcgggcaccgtggatagagcaggaggggccggagtattgggacctgcagacacggaatgtgaaggcccastcacagactgaccgagcgaacctggggaccctgcgcggctactacaaccagagcgaggccggtgagtgaccccggcccggggcgcaggtcacgacctctc

SEQ ID NO: 13910 - DNA, 201 bp, Homo sapiens
cagcgacgccgcgagccagaggatggagccgcgggcaccgtggatagagcaggaggggccggagtattgggacctgcagacacggaatgtgaaggcccagkcacagactgaccgagcgaacctggggaccctgcgcggctactacaaccagagcgaggccggtgagtgaccccggcccggggcgcaggtcacgacctctca

SEQ ID NO: 13911 - DNA, 201 bp, Homo sapiens
acagatatgaatttgttcatgaatatttttttctatagtgtgagacagctgccttgtgtgggactgagaggcaagagttgttcctgcccttccctttgtgrcttgaagaaccctgactttgtttctgcaaaggcacctgcatgtgtctgtgttcgtgtaggcataatgtgaggaggtggggagaccaccccacccccatgt

SEQ ID NO: 13912 - DNA, 201 bp, Homo sapiens
gccgcgagccagaggatggagccgcgggcaccgtggatagagcaggaggggccggagtattgggacctgcagacacggaatgtgaaggcccagtcacagaytgaccgagcgaacctggggaccctgcgcggctactacaaccagagcgaggccggtgagtgaccccggcccggggcgcaggtcacgacctctcatccccca

SEQ ID NO: 13913 - DNA, 201 bp, Homo sapiens
ccctggccctgacccagacctgggcgggtgagtgcggggtcgtggggaaaccgcctctgcggggagaagcaaggggcccgcccggcggggacgcaggaccsgggtagccgcgccgggaggagggtcgggtgggtctcagccactcctcgcccccaggctcccactccatgaggtatttcaccacatccgtgtcccggcccg

SEQ ID NO: 13914 - DNA, 201 bp, Homo sapiens
cagaggatggagccgcgggcaccgtggatagagcaggaggggccggagtattgggacctgcagacacggaatgtgaaggcccagtcacagactgaccgaghgaacctggggaccctgcgcggctactacaaccagagcgaggccggtgagtgaccccggcccggggcgcaggtcacgacctctcatcccccacggacgggc

SEQ ID NO: 13915 - DNA, 201 bp, Homo sapiens
tcctgctactcttgggggccctggccctgacccagacctgggcgggtgagtgcggggtcgtggggaaaccgcctctgcggggagaagcaaggggcccgccyggcggggacgcaggacccgggtagccgcgccgggaggagggtcgggtgggtctcagccactcctcgcccccaggctcccactccatgaggtatttcacca

SEQ ID NO: 13916 - DNA, 201 bp, Homo sapiens
tcctcctgctactcttgggggccctggccctgacccagacctgggcgggtgagtgcggggtcgtggggaaaccgcctctgcggggagaagcaaggggccckcccggcggggacgcaggacccgggtagccgcgccgggaggagggtcgggtgggtctcagccactcctcgcccccaggctcccactccatgaggtatttca

SEQ ID NO: 13917 - DNA, 201 bp, Homo sapiens
ccaagccaaaccagaagcaatattgtgccccagggtgggtcttgtggagggtactgcaggtattataggggtggcactgccattacagacctgaacgatgyggggtggtgttgggattgcctgttatctccatataactcagcaatctgtacctgcagaagcctgatatggctaaagaatgaatggaattactccagactt

SEQ ID NO: 13918 - DNA, 201 bp, Homo sapiens
ggacgcaggacccgggtagccgcgccgggaggagggtcgggtgggtctcagccactcctcgcccccaggctcccactccatgaggtatttcaccacatccrtgtcccggcccggccgcggggagccccgcttcatcgccgtgggctacgtggacgacacgcagttcgtgcggtttgacagcgacgccgcgagccagaggat

SEQ ID NO: 13919 - DNA, 201 bp, Homo sapiens
ggggagaagcaaggggcccgcccggcggggacgcaggacccgggtagccgcgccgggaggagggtcgggtgggtctcagccactcctcgcccccaggctcycactccatgaggtatttcaccacatccgtgtcccggcccggccgcggggagccccgcttcatcgccgtgggctacgtggacgacacgcagttcgtgcggt

SEQ ID NO: 13920 - DNA, 201 bp, Homo sapiens
ttctaaagtccgcacgcacccaccgggactcagattctccccagacgccgaggatggccgtcatggcgccccgaaccctcctcctgctactcttgggggcyctggccctgacccagacctgggcgggtgagtgcggggtcgtggggaaaccgcctctgcggggagaagcaaggggcccgcccggcggggacgcaggacccg

SEQ ID NO: 13921 - DNA, 201 bp, Homo sapiens
gcccggcggggacgcaggacccgggtagccgcgccgggaggagggtcgggtgggtctcagccactcctcgcccccaggctcccactccatgaggtatttcwccacatccgtgtcccggcccggccgcggggagccccgcttcatcgccgtgggctacgtggacgacacgcagttcgtgcggtttgacagcgacgccgcgag

SEQ ID NO: 13922 - DNA, 201 bp, Homo sapiens
cctgggcgggtgagtgcggggtcgtggggaaaccgcctctgcggggagaagcaaggggcccgcccggcggggacgcaggacccgggtagccgcgccgggasgagggtcgggtgggtctcagccactcctcgcccccaggctcccactccatgaggtatttcaccacatccgtgtcccggcccggccgcggggagccccgct

SEQ ID NO: 13923 - DNA, 201 bp, Homo sapiens
gtagccgcgccgggaggagggtcgggtgggtctcagccactcctcgcccccaggctcccactccatgaggtatttcaccacatccgtgtcccggcccggcmgcggggagccccgcttcatcgccgtgggctacgtggacgacacgcagttcgtgcggtttgacagcgacgccgcgagccagaggatggagccgcgggcacc

SEQ ID NO: 13924 - DNA, 201 bp, Homo sapiens
cagtttaggccaaaaatccccccgggttggtcggggccggacggggctcgggggactgggctgaccgtggggtcggggccaggttctcacaccatccagakgatgtatggctgcgacgtggggtcggacgggcgcttcctccgcgggtaccggcaggacgcctacgacggcaaggattacatcgccttgaacgaggacctg

SEQ ID NO: 13925 - DNA, 201 bp, Homo sapiens
ggagtgtcccatgacagatgcaaaatgcctgaatgatctgactcttcctgacagacgcccccaaaacgcatatgactcaccacgctgtctctgaccatgargccaccctgaggtgctgggccctgagcttctaccctgcggagatcacactgacctggcagcgggatggggaggaccagacccaggacacggagctcgtgg

SEQ ID NO: 13926 - DNA, 201 bp, Homo sapiens
tcccatgacagatgcaaaatgcctgaatgatctgactcttcctgacagacgcccccaaaacgcatatgactcaccacgctgtctctgaccatgaagccacyctgaggtgctgggccctgagcttctaccctgcggagatcacactgacctggcagcgggatggggaggaccagacccaggacacggagctcgtggagacca

SEQ ID NO: 13927 - DNA, 201 bp, Homo sapiens
gaggatggagccgcgggcaccgtggatagagcaggaggggccggagtattgggacctgcagacacggaatgtgaaggcccagtcacagactgaccgagcgracctggggaccctgcgcggctactacaaccagagcgaggccggtgagtgaccccggcccggggcgcaggtcacgacctctcatcccccacggacgggccg

SEQ ID NO: 13928 - DNA, 201 bp, Homo sapiens
ggagccgcgggcaccgtggatagagcaggaggggccggagtattgggacctgcagacacggaatgtgaaggcccagtcacagactgaccgagcgaacctgsggaccctgcgcggctactacaaccagagcgaggccggtgagtgaccccggcccggggcgcaggtcacgacctctcatcccccacggacgggccgggtcgc

SEQ ID NO: 13929 - DNA, 201 bp, Homo sapiens
cagtgtcgtcgcggtcgcggttctaaagtccgcacgcacccaccgggactcagattctccccagacgccgaggatggccgtcatggcgccccgaaccctcstcctgctactcttgggggccctggccctgacccagacctgggcgggtgagtgcggggtcgtggggaaaccgcctctgcggggagaagcaaggggcccgcc

SEQ ID NO: 13930 - DNA, 201 bp, Homo sapiens
ccggagtattgggacctgcagacacggaatgtgaaggcccagtcacagactgaccgagcgaacctggggaccctgcgcggctactacaaccagagcgaggmcggtgagtgaccccggcccggggcgcaggtcacgacctctcatcccccacggacgggccgggtcgcccacagtctccgggtccgagatccaccccgaagc

SEQ ID NO: 13931 - DNA, 201 bp, Homo sapiens
cgaaccctcctcctgctactcttgggggccctggccctgacccagacctgggcgggtgagtgcggggtcgtggggaaaccgcctctgcggggagaagcaasgggcccgcccggcggggacgcaggacccgggtagccgcgccgggaggagggtcgggtgggtctcagccactcctcgcccccaggctcccactccatgagg

SEQ ID NO: 13932 - DNA, 201 bp, Homo sapiens
cgtcatggcgccccgaaccctcctcctgctactcttgggggccctggccctgacccagacctgggcgggtgagtgcggggtcgtggggaaaccgcctctgyggggagaagcaaggggcccgcccggcggggacgcaggacccgggtagccgcgccgggaggagggtcgggtgggtctcagccactcctcgcccccaggctc

SEQ ID NO: 13933 - DNA, 201 bp, Homo sapiens
cccggcggggacgcaggacccgggtagccgcgccgggaggagggtcgggtgggtctcagccactcctcgcccccaggctcccactccatgaggtatttcahcacatccgtgtcccggcccggccgcggggagccccgcttcatcgccgtgggctacgtggacgacacgcagttcgtgcggtttgacagcgacgccgcgagc

SEQ ID NO: 13934 - DNA, 201 bp, Homo sapiens; identical to SEQ ID NO: 2500

SEQ ID NO: 13935 - DNA, 201 bp, Homo sapiens
tgaccgtggggtcggggccaggttctcacaccatccagatgatgtatggctgcgacgtggggtcggacgggcgcttcctccgcgggtaccggcaggacgcytacgacggcaaggattacatcgccttgaacgaggacctgcgctcttggaccgcggcggacatggcggctcagatcacccagcgcaagtgggaggcggccc

SEQ ID NO: 13936 - DNA, 201 bp, Homo sapiens
gcggggacgcaggacccgggtagccgcgccgggaggagggtcgggtgggtctcagccactcctcgcccccaggctcccactccatgaggtatttcaccacmtccgtgtcccggcccggccgcggggagccccgcttcatcgccgtgggctacgtggacgacacgcagttcgtgcggtttgacagcgacgccgcgagccaga

SEQ ID NO: 13937 - DNA, 201 bp, Homo sapiens; identical to SEQ ID NO: 2562

SEQ ID NO: 13938 - DNA, 201 bp, Homo sapiens
agtttaggccaaaaatccccccgggttggtcggggccggacggggctcgggggactgggctgaccgtggggtcggggccaggttctcacaccatccagatratgtatggctgcgacgtggggtcggacgggcgcttcctccgcgggtaccggcaggacgcctacgacggcaaggattacatcgccttgaacgaggacctgc

SEQ ID NO: 13939 - DNA, 201 bp, Homo sapiens; identical to SEQ ID NO: 2564

SEQ ID NO: 13940 - DNA, 201 bp, Homo sapiens
aggccaaaaatccccccgggttggtcggggccggacggggctcgggggactgggctgaccgtggggtcggggccaggttctcacaccatccagatgatgtwtggctgcgacgtggggtcggacgggcgcttcctccgcgggtaccggcaggacgcctacgacggcaaggattacatcgccttgaacgaggacctgcgctct

SEQ ID NO: 13941 - DNA, 201 bp, Homo sapiens
agccgcgccgggaggagggtcgggtgggtctcagccactcctcgcccccaggctcccactccatgaggtatttcaccacatccgtgtcccggcccggccgyggggagccccgcttcatcgccgtgggctacgtggacgacacgcagttcgtgcggtttgacagcgacgccgcgagccagaggatggagccgcgggcaccgt

SEQ ID NO: 13942 - DNA, 201 bp, Homo sapiens
ctcgcccccaggctcccactccatgaggtatttcaccacatccgtgtcccggcccggccgcggggagccccgcttcatcgccgtgggctacgtggacgacwcgcagttcgtgcggtttgacagcgacgccgcgagccagaggatggagccgcgggcaccgtggatagagcaggaggggccggagtattgggacctgcagac

SEQ ID NO: 13943 - DNA, 201 bp, Homo sapiens; identical to SEQ ID NO: 2508

SEQ ID NO: 13944 - DNA, 201 bp, Homo sapiens; identical to SEQ ID NO: 2511

SEQ ID NO: 13945 - DNA, 201 bp, Homo sapiens
tctgtggtgaacctgagtcctggagtgagtgcacccacctccctcagggtcaggagtgaatgctttaggaaccctccttttcagtgacctgcaaaagataragggcacatttactgtgataacccagagtatcagccaagggggcttgaccttcaaggagttgtggggaaggttaataaagggtggtgtcccagggtcaga

SEQ ID NO: 13946 - DNA, 201 bp, Homo sapiens
gggtgggtctcagccactcctcgcccccaggctcccactccatgaggtatttcaccacatccgtgtcccggcccggccgcggggagccccgcttcatcgcmgtgggctacgtggacgacacgcagttcgtgcggtttgacagcgacgccgcgagccagaggatggagccgcgggcaccgtggatagagcaggaggggccgg

SEQ ID NO: 13947 - DNA, 201 bp, Homo sapiens
accgcctctgcggggagaagcaaggggcccgcccggcggggacgcaggacccgggtagccgcgccgggaggagggtcgggtgggtctcagccactcctcgyccccaggctcccactccatgaggtatttcaccacatccgtgtcccggcccggccgcggggagccccgcttcatcgccgtgggctacgtggacgacacgca

SEQ ID NO: 13948 - DNA, 201 bp, Homo sapiens
gatcacactgacctggcagcgggatggggaggaccagacccaggacacggagctcgtggagaccaggcctgcaggggatggaaccttccagaagtgggcgkctgtggtggtgccttctggacaggagcagagatacacctgccatgtgcagcatgagggtttgcccaagcccctcaccctgagatggggtaaggagggaga

SEQ ID NO: 13949 - DNA, 201 bp, Homo sapiens
gggaaaccgcctctgcggggagaagcaaggggcccgcccggcggggacgcaggacccgggtagccgcgccgggaggagggtcgggtgggtctcagccactsctcgcccccaggctcccactccatgaggtatttcaccacatccgtgtcccggcccggccgcggggagccccgcttcatcgccgtgggctacgtggacgac

SEQ ID NO: 13950 - DNA, 201 bp, Homo sapiens; identical to SEQ ID NO: 2516

SEQ ID NO: 13951 - DNA, 201 bp, Homo sapiens
cctggcagcgggatggggaggaccagacccaggacacggagctcgtggagaccaggcctgcaggggatggaaccttccagaagtgggcggctgtggtggtrccttctggacaggagcagagatacacctgccatgtgcagcatgagggtttgcccaagcccctcaccctgagatggggtaaggagggagacgggggtgtca

SEQ ID NO: 13952 - DNA, 201 bp, Homo sapiens; identical to SEQ ID NO: 2519

SEQ ID NO: 13953 - DNA, 201 bp, Homo sapiens; identical to SEQ ID NO: 2521

SEQ ID NO: 13954 - DNA, 201 bp, Homo sapiens
ggacgacacgcagttcgtgcggtttgacagcgacgccgcgagccagaggatggagccgcgggcaccgtggatagagcaggaggggccggagtattgggacstgcagacacggaatgtgaaggcccagtcacagactgaccgagcgaacctggggaccctgcgcggctactacaaccagagcgaggccggtgagtgaccccg

SEQ ID NO: 13955 - DNA, 201 bp, Homo sapiens
gtcgcggttctaaagtccgcacgcacccaccgggactcagattctccccagacgccgaggatggccgtcatggcgccccgaaccctcctcctgctactctygggggccctggccctgacccagacctgggcgggtgagtgcggggtcgtggggaaaccgcctctgcggggagaagcaaggggcccgcccggcggggacgca

SEQ ID NO: 13956 - DNA, 201 bp, Homo sapiens
aggatggccgtcatggcgccccgaaccctcctcctgctactcttgggggccctggccctgacccagacctgggcgggtgagtgcggggtcgtggggaaacsgcctctgcggggagaagcaaggggcccgcccggcggggacgcaggacccgggtagccgcgccgggaggagggtcgggtgggtctcagccactcctcgccc

SEQ ID NO: 13957 - DNA, 201 bp, Homo sapiens
tgggctgaccgtggggtcggggccaggttctcacaccatccagatgatgtatggctgcgacgtggggtcggacgggcgcttcctccgcgggtaccggcagkacgcctacgacggcaaggattacatcgccttgaacgaggacctgcgctcttggaccgcggcggacatggcggctcagatcacccagcgcaagtgggaggc

SEQ ID NO: 13958 - DNA, 201 bp, Homo sapiens
cgcgccgggaggagggtcgggtgggtctcagccactcctcgcccccaggctcccactccatgaggtatttcaccacatccgtgtcccggcccggccgcggrgagccccgcttcatcgccgtgggctacgtggacgacacgcagttcgtgcggtttgacagcgacgccgcgagccagaggatggagccgcgggcaccgtgga

SEQ ID NO: 13959 - DNA, 201 bp, Homo sapiens; identical to SEQ ID NO: 2728

SEQ ID NO: 13960 - DNA, 201 bp, Homo sapiens
tggaattatgtaaacagtagctggcccaggcttataaaaggcccaatgtggcagccatcaccaaaactcagaaactcctccaagcaacccagacttcatascagctcccaacaccatgacctgctgccagaccagcttctgtggatatcccagctgctccaccagtgggacatgcggctccagctgctgccagccaagctg

SEQ ID NO: 13961 - DNA, 201 bp, Homo sapiens; identical to SEQ ID NO: 2730

SEQ ID NO: 13962 - DNA, 201 bp, Homo sapiens; identical to SEQ ID NO: 2731

SEQ ID NO: 13963 - DNA, 201 bp, Homo sapiens; identical to SEQ ID NO: 2732

SEQ ID NO: 13964 - DNA, 201 bp, Homo sapiens; identical to SEQ ID NO: 2733

SEQ ID NO: 13965 - DNA, 201 bp, Homo sapiens; identical to SEQ ID NO: 2734

SEQ ID NO: 13966 - DNA, 201 bp, Homo sapiens; identical to SEQ ID NO: 2735

SEQ ID NO: 13967 - DNA, 201 bp, Homo sapiens
acctgagttacctatttggaaattaaaggtgagaagagacagaggaaaaggagaaaagagaaagagacacagctatgccccttggatgctaaagaaatacraggaagaggaaaatgactcagaacgggttggggatcaaattcttaaagacagattgtggggagaagctagaaaagaagacccagagagtatggaggttaa

SEQ ID NO: 13968 - DNA, 201 bp, Homo sapiens
cttaccccagaagaaaaacagggaaatatagaaactcctaccctcccacatgcacagatttctgggtgatgcctccccaaggagtagagatagaagaagcrgcaaagacaagggcagagacccagcaccactatgccacacacttgatgtcagataccaccaggaaagggaaaaatcacattccaaattacaaaggaaaag

SEQ ID NO: 13969 - DNA, 201 bp, Homo sapiens
aaaaaaaaacctgagttttaacttggtgactgttgactccctcctgacagcgaggcggtggtgaaccgagtgtttgacaagctgtccccgctgcacgagcrcatctactgtgcactctctggttcagctgctgatgcccaagccgtggccgacatggccgcctaccagctggagctccatgggtatgaagctctggagttc

SEQ ID NO: 13970 - DNA, 201 bp, Homo sapiens
cactctagcgtgggtgacagagaaagaccctatcttaagaaaaaaaaaagaaaagaaaaagaaaaaacaaacaaaaaaaacacccaaccctatataggtaktattattacttctataggacacatagaggtttggaaagattaaatcacttgaccaaggtcacaaaataagttctgaggctgggatctgggattcagtctt

SEQ ID NO: 13971 - DNA, 201 bp, Homo sapiens
tggttctgttggaaaaactccgtctcctggcgcaggacagccccaaacacctctccctgcaagtggctgtgcacgtggcccatggtgttgttatagatccygtcacccacgaactccagcactgcactataaagaacccggaaaaaaaggggatcagggtgtgttcagggaacagactgaaggtcccaggtatccccatat

SEQ ID NO: 13972 - DNA, 201 bp, Homo sapiens
aagagtttcaggagaaacctgtctggttctgttggaaaaactccgtctcctggcgcaggacagccccaaacacctctccctgcaagtggctgtgcacgtgrcccatggtgttgttatagatcccgtcacccacgaactccagcactgcactataaagaacccggaaaaaaaggggatcagggtgtgttcagggaacagact

SEQ ID NO: 13973 - DNA, 201 bp, Homo sapiens
cctgggaggctgagtgggaggatcgcttaggcctgggagtttgaggctacagtgagctgtgattgcgccactgcactctagcgtgggtgacagagaaagamcctatcttaagaaaaaaaaaagaaaagaaaaagaaaaaacaaacaaaaaaaacacccaaccctatataggtattattattacttctataggacacataga

SEQ ID NO: 13974 - DNA, 201 bp, Homo sapiens
gagaaggaacaatgtgtgtatgtgtgtgtgagagagagagagcggggaggggggagatcaaagcagatgtatgaggatatgaacagtacatggcgtataaygaaagagtttcaggagaaacctgtctggttctgttggaaaaactccgtctcctggcgcaggacagccccaaacacctctccctgcaagtggctgtgcacg

SEQ ID NO: 13975 - DNA, 201 bp, Homo sapiens
atgcctgtagtcccagctgcctgggaggctgagtgggaggatcgcttaggcctgggagtttgaggctacagtgagctgtgattgcgccactgcactctagygtgggtgacagagaaagaccctatcttaagaaaaaaaaaagaaaagaaaaagaaaaaacaaacaaaaaaaacacccaaccctatataggtattattatta

SEQ ID NO: 13976 - DNA, 201 bp, Homo sapiens
tcggctgcgcgttgtgcgctgtcccaggttggaaaccagtgccccaggcggcgaggagagcggtgccttgcagggatgctgcgggcgggagcaccaaccgrggacttaccccgggcgggagaagtccacaccggggtaatgggtctgggcttgagggttggcagaggggtggaggagatgcagcggccaggggaccctgga

SEQ ID NO: 13977 - DNA, 201 bp, Homo sapiens
ctgacaacgaaggcggtagggtgacttccccagtgcagtagcctggtgctatccgcggacccgggggctccccatgagatcagctctcggaacaaggcaastcccggcagggccaagcccagtgccgcagctaatggcttcaaagcagccagccagccctgggcacctgcgttttcgctcttggagccaaccgttgccctg

SEQ ID NO: 13978 - DNA, 201 bp, Homo sapiens
gggttggcagaggggtggaggagatgcagcggccaggggaccctggaagcgcgcgcggagaagtgaatgcagagaccaacgggagcgcagggaggtcgcckgtagcagccagcgcttgcaacccgcaatgagcatagagtatttcttttctgaggggggtcgtctagagtgtccgtgaagggaacaggcacgcgaggctgg

SEQ ID NO: 13979 - DNA, 201 bp, Homo sapiens
ctgggagatgagggtctgtgtagagcgggccaactccatgaacatacctggtaccattttcccaccttcttgggcagaaggaaaagcagaggcagggtgaycagggtgaccatggtgagggacactgatccccagagcatgatccccaagagacataggcctcgcaccaggtaccacagaaataagctcagattctcactc

SEQ ID NO: 13980 - DNA, 201 bp, Homo sapiens
gatccccaagagacataggcctcgcaccaggtaccacagaaataagctcagattctcactcagagaatcactcagggtggacgtgtcctctgttacccgaracatgatgttacctgcagggttggggagaagagagtgaggtgaatcagacaggttccaagtgatgagacgaactaacaatgagccaggatgccagggtca

SEQ ID NO: 13981 - DNA, 201 bp, Homo sapiens
agaagtgaatgcagagaccaacgggagcgcagggaggtcgcctgtagcagccagcgcttgcaacccgcaatgagcatagagtatttcttttctgagggggktcgtctagagtgtccgtgaagggaacaggcacgcgaggctggtggaaaaagcgggtgctttgactcttagctggaagcgtcaacgggaagctactctaaa

SEQ ID NO: 13982 - DNA, 201 bp, Homo sapiens
ttgggcaatacggataaaccagggctgttctgagtaaatcaaatgaggatacacagtcactgtgagaaccagtggtgtgctaagcacagtggctcacacckgtaatgccaacaatttgggaggctgaggcaggaggattacttgagcccaggagtttgaggccagcctaggcaagatggtgaaaccctgtctccacaaaaa

SEQ ID NO: 13983 - DNA, 201 bp, Homo sapiens; identical to SEQ ID NO: 2743

SEQ ID NO: 13984 - DNA, 201 bp, Homo sapiens
cttctggttgagtgtctttatttcttgcagcttttccctaaacttctgggcttcgccctcctcgttggcaaagcttcgaactgtaggcatggccgacagarcctcaatggccacctggctggactttgccagagattcccgcacctgcacttccagcaactgtggatacatggacaagagatgtcacacgggttggcaaac

SEQ ID NO: 13985 - DNA, 201 bp, Homo sapiens
aacaggaagagaaatacaggggtggccatttaagttaatgccgggcctggtacacttttaagagtgaaaaggggcaggacaaatgcaaagctcaatggggytcttgggcaatacggataaaccagggctgttctgagtaaatcaaatgaggatacacagtcactgtgagaaccagtggtgtgctaagcacagtggctcaca

SEQ ID NO: 13986 - DNA, 201 bp, Homo sapiens
tttcccaggtatatggaaccctgggaggaatgctgactcgacagccttttgccattggtggctccggcagcacctttatctatggttatgtggatgcagcrtataagccaggcatgtctcccgaggagtgcaggcgcttcaccacagacggtaaccagccaagtggaagggtacctggggagggctttgaaacatgggaag

SEQ ID NO: 13987 - DNA, 201 bp, Homo sapiens
gaccaaaaaaaaaaaaatagactgaccttgtttcccaagatcatagtcaattactctgtgttgggtctacaccacatctgcacatactatgagcccttccrttggagataattttcacttgcggagctgcttcacttctacctgtaggagcctcatctccacctctctacagtggagaggattccactaggcaagttggaa

SEQ ID NO: 13988 - DNA, 201 bp, Homo sapiens
atgtagctttatcttccctcacttcttcttgattcttttcttgacctggaaaagtcagcttaaacttctcagtcaaattatctcttggtacaaatttaccyccctggctgctgagatatgtatttacctcttgatcggaaattccataactgaaacttttattttcaaccatctgtatgtgttccttgctgcttctctcct

SEQ ID NO: 13989 - DNA, 201 bp, Homo sapiens
tgggaggctgaggcaggaggattacttgagcccaggagtttgaggccagcctaggcaagatggtgaaaccctgtctccacaaaaaacaataaaaaaaagtaaaaaaaaaaatgaactgggcatagtggtgcacacctgtagtcccagctactcaggaggctgaggtggaaagatcatctgagccggggagatcaaggctgt

SEQ ID NO: 13990 - DNA, 201 bp, Homo sapiens
tcccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaagtgaggtgatgggactctttcctttaaggctaag

SEQ ID NO: 13991 - DNA, 201 bp, Homo sapiens
tgtccctcatccctggcttccactattcccatcactctcactaacaaatctacaaggtaccagcatgaagcagtcccaggtgcaagaatttatggcgccckgcacttcccctgagaggcaaaggaaggccctaggactggaagacacgcatctctccaatccacatggttgggtggattttatgtaccatactgaaaggaa

SEQ ID NO: 13992 - DNA, 201 bp, Homo sapiens
gccatgcgagagaagctccggggaggcagcggcacccgcggggagcgggacacctagagctagccattggcactcggacgccgtcccggtcccggccgggyctgggactctccgcgccccggtggggcctgaagctccgggtaccgccgagtcctcccctactggcggctgggggagggaacgagggcggggctctcggaa

SEQ ID NO: 13993 - DNA, 201 bp, Homo sapiens
cagatgtccctcatccctggcttccactattcccatcactctcactaacaaatctacaaggtaccagcatgaagcagtcccaggtgcaagaatttatggckccctgcacttcccctgagaggcaaaggaaggccctaggactggaagacacgcatctctccaatccacatggttgggtggattttatgtaccatactgaaa

SEQ ID NO: 13994 - DNA, 201 bp, Homo sapiens; identical to SEQ ID NO: 2736

SEQ ID NO: 13995 - DNA, 201 bp, Homo sapiens
ttcttctctaacatgagggcatcaaggctgttcttgccctgacattccatattctgtgtctctgcagaccaccatcatggcagtggagtttgacgggggcrttgtgatgggttctgattcccgagtgtctgcagggtgagtaaaagtgaagatgtatgcatttggaaagaagctaatggcctcaaatacacactttcctta

SEQ ID NO: 13996 - DNA, 201 bp, Homo sapiens
tgtaaatcactatcctgatataaataatcaggaagaaggtgatattgtgacccaccataatatcaggcagttaccatacgagaaatcaaggtcgttgggayggaagtaaccttatctgcttttccccataagagcagggtccttgcagccaaaagaaagttatgtgggtggggctgagcaaaagagtgagcaattgaaagc

SEQ ID NO: 13997 - DNA, 201 bp, Homo sapiens
aacccacgctactctaccttactgacaattacctttgattcctgtcccagtccccttgtgtcctcccctcttgccctgcgttccccttaccaagagaggasaggaccaccaggaccaggaacagcgagaggcggcgcgtctccgagcccaggcagcctagaagccgacgcacagggtttccagagccgccctgaccgccgg

SEQ ID NO: 13998 - DNA, 201 bp, Homo sapiens
gtcttgtttcggctcttgctggcacttgaatctgtcagtttctgcatctgtaaagtggagataatatagtacctcatgagacggttattttgagaaccacrttctatatgtgaacacagtttaaaagctgtaaatcactatcctgatataaataatcaggaagaaggtgatattgtgacccaccataatatcaggcagtta

SEQ ID NO: 13999 - DNA, 201 bp, Homo sapiens
ttccaggagctggacactgggaaatggaaaagtcttgtttcggctcttgctggcacttgaatctgtcagtttctgcatctgtaaagtggagataatatagyacctcatgagacggttattttgagaaccacattctatatgtgaacacagtttaaaagctgtaaatcactatcctgatataaataatcaggaagaaggtga

SEQ ID NO: 14000 - DNA, 201 bp, Homo sapiens
gacgcacagggtttccagagccgccctgaccgccgggcacccagaggctcccgagtttgtgccacagggctgctgcgggcagtgccgctgcataactgacracgaaggcggtagggtgacttccccagtgcagtagcctggtgctatccgcggacccgggggctccccatgagatcagctctcggaacaaggcaagtcccg

SEQ ID NO: 14001 - DNA, 201 bp, Homo sapiens
gaaagtggcttgtatgagtcgggattctccagagaagcagaaccaataggatgttggcagagagagatttattttaagtaattggctcatactactgtggragctggcacggtcgaaatctgcaggtaggctggagacccaggaagagctgatgttgcggcttgagtctgaaggtggtccagaggcagaattccctcttcc

SEQ ID NO: 14002 - DNA, 201 bp, Homo sapiens
acctctgaaagcatagtactttggggatatgagataccagggcttcattgcagggtgcagagaccacttaatgtctcagtgggaaggaagggcttgatgawtctttaacctgaggatccctttcccaggtatatggaaccctgggaggaatgctgactcgacagccttttgccattggtggctccggcagcacctttatct

SEQ ID NO: 14003 - DNA, 201 bp, Homo sapiens
acaaaaataatcattttattatctctcatgaatctgtgaattactggactttaagagccactgatgtagtccatgaaccaaaacacatattcacggcagcyactccacccagcacctcacacctgtgatgtttactggctgcccatgggatttgaacacctttagagtactgtgaaatttcccctaccttttgagtcctgc

SEQ ID NO: 14004 - DNA, 201 bp, Homo sapiens; identical to SEQ ID NO: 2739

SEQ ID NO: 14005 - DNA, 201 bp, Homo sapiens
cccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaagtgaggtgatgggactctttcctttaaggctaaga

SEQ ID NO: 14006 - DNA, 201 bp, Homo sapiens
tggaaaaactccgtctcctggcgcaggacagccccaaacacctctccctgcaagtggctgtgcacgtggcccatggtgttgttatagatcccgtcacccamgaactccagcactgcactataaagaacccggaaaaaaaggggatcagggtgtgttcagggaacagactgaaggtcccaggtatccccatataagtgcatt

SEQ ID NO: 14007 - DNA, 201 bp, Homo sapiens
aggccaaggcgggtggttcacctgaggtcaggagttcgtgaccagtctggccaacatggtgaaacctcatctctacttaaaatacaaaaattagctgggcrtggtgcctgtaatcccagctactcgggaggctgaggcagggagaatcgcttgaacccgggaggcaaaggtggcagtgagccaagattgcgccattgcact

SEQ ID NO: 14008 - DNA, 201 bp, Homo sapiens
ccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaagtgaggtgatgggactctttcctttaaggctaagac

SEQ ID NO: 14009 - DNA, 201 bp, Homo sapiens
aaagaataatgacaataaccaaaagaagctacatttgtggcattggctaaatgttttataaattttatctcttaaaattcaaaccaaaaaaccccctgtaytcacacctgtaatcccagcactttgggaggtcaaggcgggaggattgcttgagcccaggagttagtgaccagcctgggcaacatagtgagaaccccatct

SEQ ID NO: 14010 - DNA, 201 bp, Homo sapiens
catgcgtgtgacatgccttaagggcacagcaaagactttgagaactgaatgaagattagatcttttaaaattggaagacttcggccaggcgcggtggctcrtgcctgtaattccagcactttgggaggccaaggcgggtggttcacctgaggtcaggagttcgtgaccagtctggccaacatggtgaaacctcatctctac

SEQ ID NO: 14011 - DNA, 201 bp, Homo sapiens
aggagtaccaggttacccctgagctgcacatgcgtgtgacatgccttaagggcacagcaaagactttgagaactgaatgaagattagatcttttaaaattrgaagacttcggccaggcgcggtggctcgtgcctgtaattccagcactttgggaggccaaggcgggtggttcacctgaggtcaggagttcgtgaccagtct

SEQ ID NO: 14012 - DNA, 201 bp, Homo sapiens
gcctcaggtgcagagctgcactgcgtggtagcacaagccctgagttaacaagagaaataccggctttctggccagaggaatgaagaaaaagggcccctgcrggcaggaatgtgtaggggaatctccaaactgagagtacaggcggaaattccctaattctgagtctgaaccctcaggagtaccaggttacccctgagctgc

SEQ ID NO: 14013 - DNA, 201 bp, Homo sapiens
gaatggagttgaccttccccaaaagccactatgataagctatttggtgggtgcttgggtctctgaatttgtggaggaggatctggggtctgaatgtgtatrtgacctgtcccagtagtgtacagggatgagtaaaggaatagggtctgagagggggacaggagatagatttttgagggtcttctttccatctgtgcttagg

SEQ ID NO: 14014 - DNA, 201 bp, Homo sapiens
taaaggaatagggtctgagagggggacaggagatagatttttgagggtcttctttccatctgtgcttagggatcaaaaagatgattctgtcaagcagatayctggtttctcatttaccatatattgaactattttgtctcttctcccactcctaaccaatttcctcacatgcaaaatgagtatatggggttaggtcaatat

SEQ ID NO: 14015 - DNA, 201 bp, Homo sapiens
agcgcagggaggtcgcctgtagcagccagcgcttgcaacccgcaatgagcatagagtatttcttttctgaggggggtcgtctagagtgtccgtgaagggamcaggcacgcgaggctggtggaaaaagcgggtgctttgactcttagctggaagcgtcaacgggaagctactctaaagcgctttcgctttcactctggtccc

SEQ ID NO: 14016 - DNA, 201 bp, Homo sapiens
ggtagtttacagttccaacattcaatgccattttgctaacaagtgggcagtcaacaggcatattcaacagaaatactagtaggatctcaggctaaacataygaattcaaaactctaaaacaatcacatccccctggagtgtaaagaaaaaaatctaaaattacaaatgcctggagttgtttctagccatgatatttaactt

SEQ ID NO: 14017 - DNA, 201 bp, Homo sapiens
agcgcttgcaacccgcaatgagcatagagtatttcttttctgaggggggtcgtctagagtgtccgtgaagggaacaggcacgcgaggctggtggaaaaagsgggtgctttgactcttagctggaagcgtcaacgggaagctactctaaagcgctttcgctttcactctggtcccggacagtgggggctggttaaatcaaga

SEQ ID NO: 14018 - DNA, 201 bp, Homo sapiens
gaagcaagaagggtaaagaatggaaggacatcacacagatggtgctgggccagaggaaggaatcacactggggagtgaaggtggagggacctcacctccamagcctgggtgaactgcatctggtagagaacaaatgtgacaaggttcccactgcttacagccccactggtcaccagctgcccaccaatgtagaggattccc

SEQ ID NO: 14019 - DNA, 201 bp, Homo sapiens
cagtactgtccccagccatgcgagagaagctccggggaggcagcggcacccgcggggagcgggacacctagagctagccattggcactcggacgccgtccyggtcccggccgggcctgggactctccgcgccccggtggggcctgaagctccgggtaccgccgagtcctcccctactggcggctgggggagggaacgaggg

SEQ ID NO: 14020 - DNA, 201 bp, Homo sapiens
cttgaacctgggaggcagaggttgcagtgagctgagatcacaccattgcactccagcctgggtgacaaaaggaaaacttcgtctcaacaacaaaaaaaaaagaaaaagaaattacagtcttggccaggtgcgttggttcacgcctgtaatcctagcactttgggaggctgaggagggcggatcacctgaggtcaggagttc

SEQ ID NO: 14021 - DNA, 201 bp, Homo sapiens
accacgcctggccgtatttgggatttttttttttttttttgaaacggggtttccctcttattgcccaggctggagtgcaatggcacaatctcggctcaccrcaacctctgcttcccgggttcaagcaattctactgcctcggtctcccgagtagctgggattacaggcatgtgccaccacaccaggctaattttgtatttt

SEQ ID NO: 14022 - DNA, 201 bp, Homo sapiens
ccgctaattttttttttttttttttttgtatttttagtagagatggggtttcaccatgttggccaggctgctctcgaactcctgacctcaggtaatccacycgcctcagcctcccaaagtgctgggattacatgtgttagccaccatgcccggaaaaagcctgttattttacttgattcttttaaaagataggcaaaggtc

SEQ ID NO: 14023 - DNA, 201 bp, Homo sapiens
ccaggctggtcttggactcctgggctcaattgatctgcccaccttggcctccgaaactgctgggattacacgtgtgagctgcctggccccaaatatacttkttttttttttttttttttttgagacagagtctcaccctgttgcccaggctggagtgcaatggtgtgatctctgctcatttcaacttctgcctcctgagtt

SEQ ID NO: 14024 - DNA, 201 bp, Homo sapiens
atcggggttcagtttcctttttttgttaagagaggtggtttggctagaatgaatcaatctctaccgctccttctagccctcacccagttaaaaaaaaaaaacaaaaaaaaaactgcagcttggcagggggtagggggaaagcagggccgggcaggggggttactttctggtgtttcgaagggcggggctttgaagaggtgg

SEQ ID NO: 14025 - DNA, 201 bp, Homo sapiens
gcccgcgggccctggatggggcttggctgatggtcagcatatccagcccagtcctcagcctctccagcctcttgcgaccacagccagagcctcagcaggascctgttctcatcaccatggcaacaggtagctggggaggggaggtggagaagggtgggtagattctaagggtccagatcagccggtggtctcgctttatgg

SEQ ID NO: 14026 - DNA, 201 bp, Homo sapiens
aataacaagaggaggaggaagagggaagccaaggagggattgcaggggactttcggagagcaatactggggaactgagtctgctgggagagactggactgyccccctccagcctcagtcttcccgtacccctccacatatttatgtttctgtttctagctatgtggaaaggcaaaggtcagtgcatgagaagaatgggaaa

SEQ ID NO: 14027 - DNA, 201 bp, Homo sapiens
caggcatggtctcttctacttccttcaatggaggcgtctctcctcacaactggggagattctggtcccccctgcaaaaaatctcggaaggagaagaagcaracaggatcagggccattaggaaacaggtaataacaagaggaggaggaagagggaagccaaggagggattgcaggggactttcggagagcaatactgggga

SEQ ID NO: 14028 - DNA, 201 bp, Homo sapiens
ctaaggcccactggagggcgctcatcaagtagctgctggatgttgacgaaggaagcggcggcgcagctcagggatctccgagtcaggacggtcggccagasccacggggtaacgggtctaatcgtgtaggaataaagctgtattccagtgcttccaaacggttctctcattccaacccctttccaagctcaatgaatattc

SEQ ID NO: 14029 - DNA, 201 bp, Homo sapiens
ccatgcataaaatatacgaacactaacgatggctgataagctaaaaaaaaaaaatgtgaaaaaatctcataatgttttaagaaagtttatgaatttgtgtygggctgtattccaagccgtccttggctgcatgtggtccctgggctggaggttggacaagcttgatagatgtttgggagaaaatgggaaagacaatgtaaa

SEQ ID NO: 14030 - DNA, 201 bp, Homo sapiens; identical to SEQ ID NO: 2831

SEQ ID NO: 14031 - DNA, 201 bp, Homo sapiens
accacaccaggctaattttgtatttttagtagagacggggtttcaccatgttggtcaggctggtttcaaactcccgaactcaggtgatccacccgcctcgkcctcccaaagtgctgggattataggcatgaaccactgcgtctggcccatatttgggatttttaaacaggtaggtgatgggatcagacttgtagtcacttt

SEQ ID NO: 14032 - DNA, 201 bp, Homo sapiens
cccccttggcttccttggccccagttgctgattcctccacgagggtggactctcccagccatggcctggtgaccagctccctctgcatcccttctccagcycggctgtcccaaaccccccattcacagcctcctcggcctggtacttgcaaggtaagaaggggagggcgtgtttcctctgacaatttgttctctttcattg

SEQ ID NO: 14033 - DNA, 201 bp, Homo sapiens
tgtggacaagtgcactgaactactccgagaaggccgggcctcagctaccaccaccatcactactgctgcagccacctctgtcactgtccctggtgctgggstgccatccgggagtgggggcactgtggcccctgctaccatgggctctgcgcgctcccatgcctccagccgggccagtgagaatcaatctcccagcagcag

SEQ ID NO: 14034 - DNA, 201 bp, Homo sapiens; identical to SEQ ID NO: 2799

SEQ ID NO: 14035 - DNA, 201 bp, Homo sapiens; identical to SEQ ID NO: 2801

SEQ ID NO: 14036 - DNA, 201 bp, Homo sapiens; identical to SEQ ID NO: 2803

SEQ ID NO: 14037 - DNA, 201 bp, Homo sapiens
ttctcatcttcctcccaagaggcatttgcagcttctgcagtgggcagtggggagcgtcgaggaggtggccctgtattcccagcccctgtcgttggcagtgsaggggccacatctggaaagctgctgctggaggcagatgagctgtgcgatgatggtggggatgggaggggggcagtggttcctggggctgggctccggaga

SEQ ID NO: 14038 - DNA, 201 bp, Homo sapiens
cagtcctttctgagttgcgacggctccagaatgaatgtcgtggctataacctccaacctgaccatgatatccagaggtggctacaggggctccggccactkacagaggctcagaggtgactggcgggtgaggttgggactccagggttctggccaggtgtgggggattggtgtcatgtcctgagctctgcctattgccccc

SEQ ID NO: 14039 - DNA, 201 bp, Homo sapiens; identical to SEQ ID NO: 2820

SEQ ID NO: 14040 - DNA, 201 bp, Homo sapiens
tcagcatggctgctgctgacattgtcaacttccttacagtggggtctgtgctccaaatgtggcacattgtggacaagtgcactgaactactccgagaaggscgggcctcagctaccaccaccatcactactgctgcagccacctctgtcactgtccctggtgctggggtgccatccgggagtgggggcactgtggcccctg

SEQ ID NO: 14041 - DNA, 201 bp, Homo sapiens
ggaaaagtcaggggtccctgagttttggctcctgcagtttgagggctccttcccaggagtttgcagtcctttctgagttgcgacggctccagaatgaatgycgtggctataacctccaacctgaccatgatatccagaggtggctacaggggctccggccactgacagaggctcagaggtgactggcgggtgaggttggga

SEQ ID NO: 14042 - DNA, 201 bp, Homo sapiens
tgcggccgtttgactgccccgtgtgcaacaaaaagttcaagatgaagcaccatctgactgagcacatgaagacgcacacaggtctcaagccctacgagtgyggagtctgcgccaagaagttcatgtggcgagacagcttcatgcgccaccgaggacactgtgagcgccggcaccgcctgggcggggtcggggccgtacctg

SEQ ID NO: 14043 - DNA, 201 bp, Homo sapiens; identical to SEQ ID NO: 2759

SEQ ID NO: 14044 - DNA, 201 bp, Homo sapiens
cgccaccgaggacactgtgagcgccggcaccgcctgggcggggtcggggccgtacctgggcctgggactcccacggggccatccttgccgtccaagagagrgtctcccggagtgggcgggggcagcggcgacgaagcgagtgcggccacgcccccgtccagcagacgtgtctggtccccacccagagtccacaaggtggag

SEQ ID NO: 14045 - DNA, 201 bp, Homo sapiens
cttccctgcagacaagtgtggccacacaatgcgatccagaagagatcatcgtgctctcagactctgattagctgcctccccttctccctgcctccagaatkttctgggataacatttggaggaaggtgggaagcagatgactgaggaagggatggactaagctaatccccttttggtggtgtttctttaaaaaaaaaaaaa

SEQ ID NO: 14046 - DNA, 201 bp, Homo sapiens
cgagtgggcggatggacgcggctggagattggatagctcctattgcactgaaaggtgcattgcagtttgaggcccaggagtcagaagcttttctaggctgrgacgtgggagggactgtgcagataattcaagaatgaggagagtctgacctggatatctgggagctctccctcctggcagcggaggcggggtattccgggg

SEQ ID NO: 14047 - DNA, 201 bp, Homo sapiens; identical to SEQ ID NO: 2762

SEQ ID NO: 14048 - DNA, 201 bp, Homo sapiens
atttgggatttttttttttttttttgaaacggggtttccctcttattgcccaggctggagtgcaatggcacaatctcggctcaccgcaacctctgcttccygggttcaagcaattctactgcctcggtctcccgagtagctgggattacaggcatgtgccaccacaccaggctaattttgtatttttagtagagacggggt

SEQ ID NO: 14049 - DNA, 201 bp, Homo sapiens
ggcaatggggggtggtgtggaactgtctgacttccccttccttgctcctccaggcccctgtgtccgtctgggatgaggaggaggatggtgccgtgtttacygtcacaagccgccaatatcgacctcttgatcccttggtgagatcatgactttagcttctcacctctgactcttcattcccagttttccttcctctggctg

SEQ ID NO: 14050 - DNA, 201 bp, Homo sapiens; identical to SEQ ID NO: 2815

SEQ ID NO: 14051 - DNA, 201 bp, Homo sapiens; identical to SEQ ID NO: 2804

SEQ ID NO: 14052 - DNA, 201 bp, Homo sapiens
tcctggggctgggctccggagacccacctacacaccccctagcatcatgccacagaaacactgggtatacgtgaagcgaggtggtaattgcccagcgccarcacccctggttccccaagacccagatctggaggaggaagaggaggaggaagatctggtgttgacctgtgaggatgatgaagatgaagaactagggggtag

SEQ ID NO: 14053 - DNA, 201 bp, Homo sapiens; identical to SEQ ID NO: 2761

SEQ ID NO: 14054 - DNA, 201 bp, Homo sapiens
gtgggtggagacaaggagggagtaagtcgtaggagtacaaggtttttattttttttaacagtgattaaaatatttattggtcatttacttggcttcccgayaacccgtgtgtttgctggggacgcggcacagatagggggaagccggagtaatggttttcgggcaagtggatgttggagagcacacacaggagttgggggg

SEQ ID NO: 14055 - DNA, 201 bp, Homo sapiens; identical to SEQ ID NO: 2810

SEQ ID NO: 14056 - DNA, 201 bp, Homo sapiens
tgcccgcgggccctggatggggcttggctgatggtcagcatatccagcccagtcctcagcctctccagcctcttgcgaccacagccagagcctcagcaggagcctgttctcatcaccatggcaacaggtagctggggaggggaggtggagaagggtgggtagattctaagggtccagatcagccggtggtctcgctttatg

SEQ ID NO: 14057 - DNA, 201 bp, Homo sapiens; identical to SEQ ID NO: 2764

SEQ ID NO: 14058 - DNA, 201 bp, Homo sapiens
cggtcccccaggcaccttcacctaaccagagcggggatttccaccgcccctcatgccgccctttggaggaaagtgaaagtgaaaggaggaagaggaggctwcatggctgaggaggtcgcagcgccatgaagtccctgtctctgctcctcgctgtggctttgggtgagcgaaccccgcgactcatcgcccaagaactagagg

SEQ ID NO: 14059 - DNA, 201 bp, Homo sapiens
ggtcccccaggcaccttcacctaaccagagcggggatttccaccgcccctcatgccgccctttggaggaaagtgaaagtgaaaggaggaagaggaggcttmatggctgaggaggtcgcagcgccatgaagtccctgtctctgctcctcgctgtggctttgggtgagcgaaccccgcgactcatcgcccaagaactagaggg

SEQ ID NO: 14060 - DNA, 201 bp, Homo sapiens
tacatatttattttttgagacggagtttcactcttgtcacccatgctggagtgcaatggggtgatcttggctcactgcaacctctgcctcctgggttcaarcaattctcctgcctcagcctcccaagttgatgggatcacaggcacccacaaccacgccccgctaattttttttttttttttttttgtatttttagtagag

SEQ ID NO: 14061 - DNA, 201 bp, Homo sapiens
tggtgtttcgaagggcggggctttgaagaggtggggtttcccgacaccagaccttgagagacttgtcaggtgatgcgaggtgggaggggttcagaagcagsagcgttttttctctgctcttcccagatctgtgtcttgctctgcaccctcagctttgcgggtcactctttcaaaacccagcactctatccccacctgcgcc

SEQ ID NO: 14062 - DNA, 201 bp, Homo sapiens; identical to SEQ ID NO: 2768

SEQ ID NO: 14063 - DNA, 201 bp, Homo sapiens
tcaccatgttggccaggatggtcttgaactcctgacctaaggtgatccacccaccttggccttccaaagtgctgggattacaggcatgagccaccacgccyggcctgctgtgctctttcttttcaagcatttctgcttgatcagggatttaagaaaatgaaagctgttgtactgatgtaaaattagaaatgaaatctctcc

SEQ ID NO: 14064 - DNA, 201 bp, Homo sapiens; identical to SEQ ID NO: 2758

SEQ ID NO: 14065 - DNA, 201 bp, Homo sapiens
cctcaggcctcagcttcccctttgtaaagtgagtctcactacggggtagtctgtgcatttgaagttccccgaacgctgcccttccagcccctttcccggcrgtgactctacagctgcaacttccttctctacactcagaccccgcgggcgccctccaggctgccttcaggcggtatccccggggcgcccccgcaccacact

SEQ ID NO: 14066 - DNA, 201 bp, Homo sapiens; identical to SEQ ID NO: 2770

SEQ ID NO: 14067 - DNA, 201 bp, Homo sapiens; identical to SEQ ID NO: 2805

SEQ ID NO: 14068 - DNA, 201 bp, Homo sapiens; identical to SEQ ID NO: 2791

SEQ ID NO: 14069 - DNA, 201 bp, Homo sapiens
gcagccataaaaaagaatgagattatatcttttgtgggaacatgggtggagctggagcccattattcttagcaaactaatgcaggaacagaaaaccaaatwttgcatgttctcacttataagtgggaactaaacaatgagaacacatagagaggaacaacagacactggggcctactggaggagagagggtggggagaagg

SEQ ID NO: 14070 - DNA, 201 bp, Homo sapiens
tgagagccttctagaaaccaccctctgagcttcagggagcactattttaagtggctacagagtatttcaatatgagtgctctgtcttctacaccgttgtcrgaattaaatttctaaatgttttcagaaatttatttgacatttagttccatgtttttgttattataaacaatgtcttaatgactgtccttatggtttctta

SEQ ID NO: 14071 - DNA, 201 bp, Homo sapiens
gttaacattttttggaatgcataagtgtttatccagaggcagtaaaatatagttaaaagtacaagcttattagccacgtattagctgagcaacattaaacrgttatttaatcagagtttagttgcctcatggataaaatatgtgtaatgatattaggttgtgagacttaaatgagttaatacatgtaaaacagaatattgt

SEQ ID NO: 14072 - DNA, 201 bp, Homo sapiens
tacttctaccaggcttggtttgagtcaatctaaatgccatttggacagaccacttgatcagtaataaatgcctctgctgtgtaaactctctcacaagtttraaataacataggctagtgctagtttcattgatgatgaacatatctttaaagtagatatgtaatacacagggaagtgttatgggcttcagattttggtgca

SEQ ID NO: 14073 - DNA, 201 bp, Homo sapiens
gaaaccttaaccctaaacactaaacgctatttgaccttttgaagggaaggtaatctgtacttaatacttgtaaaacagcaagaaacagtcaatagatagtkgaacataatctgaagtggctttatagcctttctcattgagcatttgttactatttagtattataaaattaaccatatatatattatatgaagaaagtaat

SEQ ID NO: 14074 - DNA, 201 bp, Homo sapiens
tacttcaggcaaactcagtgggattaatgaaatagtatgtactcaggttttttaaaaattatttaactgttttgatttaagatgcaaatgctatttttctrtatgcccttttacagttaattgcttgaagttttctacccatgtcctcacagtatagaaaaattttcccagctagtgcttcctttactcttccttgttacc

SEQ ID NO: 14075 - DNA, 201 bp, Homo sapiens
aagtggattataagaaaccttaaccctaaacactaaacgctatttgaccttttgaagggaaggtaatctgtacttaatacttgtaaaacagcaagaaacaktcaatagatagttgaacataatctgaagtggctttatagcctttctcattgagcatttgttactatttagtattataaaattaaccatatatatattata

SEQ ID NO: 14076 - DNA, 201 bp, Homo sapiens
taagtggattataagaaaccttaaccctaaacactaaacgctatttgaccttttgaagggaaggtaatctgtacttaatacttgtaaaacagcaagaaacwgtcaatagatagttgaacataatctgaagtggctttatagcctttctcattgagcatttgttactatttagtattataaaattaaccatatatatattat

SEQ ID NO: 14077 - DNA, 201 bp, Homo sapiens
ttaacttgctttacttgaatgaaaagccattagaaagccttgtaggactgacagctttcttgatgtgtgagtatattcatggaaaagaattatttttcaawataggtttttgaatatttataagctctcaaagcataatgtaagctgttagaaaaaaaggaatacttgtaagctgtttgttttttattttgtcaggtggta

SEQ ID NO: 14078 - DNA, 201 bp, Homo sapiens
  misc_feature (1)...(201): n = A,T,C or G, or insertion/deletion polymorphism (see Tables 1-2)
ccaaagtgctaggattacaggcgtgagccaccacacccagtctctactgctcaattctcaaagagtaaacacctaagttttaagtgctgaattcttttttntgagacggggtcttgctctgtcacccaggctggagtgcactggcgtgatcttggctcactgcatcctccgccttctggttcggatgattctcctccctta

SEQ ID NO: 14079 - DNA, 201 bp, Homo sapiens
caagttctccaggtgattctcatacataatatagtttagaagcattgcgccaggagtctctcatgaggtttgaaactgctgaattgaggaaattgattcarcaagtccttttttaaaacacatactcctgaagtgaagtgtcattgatgtctgcaactttcaaatggtttagcaaaagaaaaaaattgtataaggctatgt

SEQ ID NO: 14080 - DNA, 201 bp, Homo sapiens
tgttctcttagatactctatgacttaaacaataaaaattggtaaaatactaagtggttttttaaattggcatgttatttctaggcatttcatatcattatscaaataataattcttagtgtttatagataattcaaatacaaaatatatatcaatgtaaccagttctttcttgttggaagtttaagttgcatctaattttc

SEQ ID NO: 14081 - DNA, 201 bp, Homo sapiens
agcccccagatttatcatgggacatcactgaaaccagtggtagggtcgtttgtgacagcctaacaatgtgaatctaactatcttgatatttaatttatgtmtttctgaaggatttaacaagttaattgtgtatattctaggtgtgtcacggggtcccagccctgtcagccttggaaatcaggataccttacctgtggcagt

SEQ ID NO: 14082 - DNA, 201 bp, Homo sapiens
aaaaagttcaccgaaggagaagtttcaaacccttatctttttgtttttttagagacaggttctcactttggccaggctggtcttgaacacctggcatcaarcaagcctccttgctcagcctctggagtagctgggattacaggcacaagcctctgacaataaatttttaaaaaaatcttaaacatgtaaagttgcagaagc

SEQ ID NO: 14083 - DNA, 201 bp, Homo sapiens
atgagagactaacacacattctttggggttatgtatccatatgaaattttaaaatatatatctttagcaaattagtttaggtgaccatatttgaaacccakaataaaggcttttcattacttgaaatttccaaatattgtagtttgggatacctgtttttaggatatgatcccatcagatgacataccaaaacaaaatcta

SEQ ID NO: 14084 - DNA, 201 bp, Homo sapiens
atgatcctcccacctcagccttccaagtaggtgcgaccacaggtacaggccaccatgaccagctggtttttaaattatttgtggagatgagatctcgctaygttgcccaggctggtctcgaactcctgggctcaagccatgtttccgcctcagcttcccaaagtgctgggattaaaaggctgagccactgtgcccagccaa

SEQ ID NO: 14085 - DNA, 201 bp, Homo sapiens
tgcctttttccatagaaaccacgctgtaaaagatgcagttcattttactagtcaaaccatagtaaccttaatcaaaaataaacaaaactagttttgctctmagtaccacccagacttcaatgattccatactaactttaccattaggcagagtgcttgacctctctaaacttcttttttttttttttttcatttaaaaaat

SEQ ID NO: 14086 - DNA, 201 bp, Homo sapiens
attaaaagataaaaacttgtcaaagtgaggtagtgagaacctttgatgttttaggtctgtcttgtcttgtcttctcttctctctcttctcttctttctttyttttttttttttctgaattgcagtctcaccgtgttgcctgggctggcacgcagtggcacgagcatggctcgctgcagcttcaaccacccaagctcaaatg

SEQ ID NO: 14087 - DNA, 201 bp, Homo sapiens
gtaagggttttatagttttacttcttctgtttagttctatgatccatttgaagttaatttttgtgtatggtgcaagggaaaggtataacttcattcttttkcaattgtgtatccagttgtcccagtaccatttgttgaaaaggttcatctttccccgttgaattgtggtaccattgtcaaatatcaatcgaccagaaatgt

SEQ ID NO: 14088 - DNA, 201 bp, Homo sapiens
tgatgctgctctttgaagtaactcataagtttttatttctcgtgaagtcttggtgaagtccatcttatctatttttttctattacttgtgcttttattgcrtctaacccaaaaattatttgcctaacccaaaaattacgccttttttcttgttttcttgtaagggttttatagttttacttcttctgtttagttctatgat

SEQ ID NO: 14089 - DNA, 201 bp, Homo sapiens
  misc_feature (1)...(201): n = A,T,C or G, or insertion/deletion polymorphism (see Tables 1-2)
ttttggaagattgactttcaaaatatttgtattaaatttttagattagcaagttttagtgttttgttgtagatgttgctttaatattttaaaaacattagntgttaaaactacatgtattattttttgctgtaaaacaaaaactactgttttttctctatatcttttatgtaaatacactttacaattgagcagatatact

SEQ ID NO: 14090 - DNA, 201 bp, Homo sapiens
tgttgcttatgacagaatacctgaaactgggtaattttttttttttttgagacagagtctcactctgttacccaggctagggtgcagtagccgcatctcasctcactgcaacctccgcctcccgagttcaagcaattctggtgactcagcctcccgagtagttgggattacagtcatgtgccacctcgcctggctaatttt

SEQ ID NO: 14091 - DNA, 201 bp, Homo sapiens
  misc_feature (1)...(201): n = A,T,C or G, or insertion/deletion polymorphism (see Tables 1-2)
ggtagatactataacattcatgcccaacagtgaattggtatgggtttcatatcattaatgcaaatgtctatgatctaaattagttaaaactatccagaggnttaaagtactgctgggttaaataccgttgtcttcttttttgtgaaccccagtgggctcaccatagtacctagtatgccgtgaccactcaaaaaatatatg

SEQ ID NO: 14092 - DNA, 201 bp, Homo sapiens
taaaacaccacttagtaggtactcatgtttgtggactattgactaagtactcattttatatgtatatgctggcttcatggattgtactataaaagtcatargcacttaaaatgtttttggtagtatattaatttataatgctaaggaaatgaataaaacttagatttgttttattatcataggtaatgtattaaagccact

SEQ ID NO: 14093 - DNA, 201 bp, Homo sapiens
tattttaaataaccaatgacaaaaaaaattcaaggtcagtctgtcaatcattttattcattattttaatttcatcttttgcctaaataaagttgccatatrtaccactattatttccactggttccttgttagaaccttaattttcttttttacttttaataagttattcccatattttttattttcttagaacatttgca

SEQ ID NO: 14094 - DNA, 201 bp, Homo sapiens
  misc_feature (1)...(201): n = A,T,C or G, or insertion/deletion polymorphism (see Tables 1-2)
ttaaaggcctataatgtttgatgcatagtgttataaaataatttctttgtttatactttagaaatacatgtcttttataagtagtaatgttcctccatgtngtcatcctttatttctattaggttataaatttcttgttagtgagaagctatcattgcattgtccataacacagcatatatatttacttggaaaataatca

SEQ ID NO: 14095 - DNA, 201 bp, Homo sapiens
ttttttgttttttgagtcagggtctctgttgtctgggctggagtgtggtggtattatcatagctcactgcagccttgaactctggggctcaagtgattccwcctcagcttcttgagtagctgggaccacaggtgtgtgtcactgtgcctggataatttattttattttattttatttttggagaatggggtcttgctatgt

SEQ ID NO: 14096 - DNA, 201 bp, Homo sapiens
attccacctcagcttcttgagtagctgggaccacaggtgtgtgtcactgtgcctggataatttattttattttattttatttttggagaatggggtcttgytatgttgcccaggcaggtctcgaactcctgggctcaaactattctctgcctctgcctccctaagagctggggttacaggcatgagccactgcacctggct

SEQ ID NO: 14097 - DNA, 201 bp, Homo sapiens
  misc_feature (1)...(201): n = A,T,C or G, or insertion/deletion polymorphism (see Tables 1-2)
tgtaatgccctgtttatgcatcaaaggcaggtttgtgttgacagaacatatttggggttgtcgtgcaacagcagtagtactttgggagaaggggaatgatnggttggaggtggggttggtagaaggaggactttcaagttccagttattaaatactagaccgcaaggaacagtttggtctctgtcctttagtgaagaaatt

SEQ ID NO: 14098 - DNA, 201 bp, Homo sapiens
ctccaccctagaccttctgaatagaacactgtgggagtggagcccagtagtctgtggtttaacaagttctccaggtgattctcatacataatatagtttaraagcattgcgccaggagtctctcatgaggtttgaaactgctgaattgaggaaattgattcagcaagtccttttttaaaacacatactcctgaagtgaagt

SEQ ID NO: 14099 - DNA, 201 bp, Homo sapiens
taagatcccaagatgctctgggctttgtatgcacagtataattggagaagcactgtctagactaattaaatatctaccagtggccacagagtctactaggrctgtatttctcaaaatgtgattccaggaccagtggcatcacctgggaatttgttaaaaatgcaaatatttgagctccaccctagaccttctgaatagaac

SEQ ID NO: 14100 - DNA, 201 bp, Homo sapiens
gagatcacaggtgtgagccaccacacccaaccacaagccttcatttttataaaacaccacttagtaggtactcatgtttgtggactattgactaagtactyattttatatgtatatgctggcttcatggattgtactataaaagtcataggcacttaaaatgtttttggtagtatattaatttataatgctaaggaaatga

SEQ ID NO: 14101 - DNA, 201 bp, Homo sapiens
ctgacctcaggtgatccacccacctcggcctcccaaagtgctgggattacagacatgagccaccacgcccgcctctattcagtattttggaaagaatactwcttaggtggtggtgtgtacttccaccagaggcatatattatccaaatataactgtttcatgatgttagtggccattggtgataatcacctagatctgtta

SEQ ID NO: 14102 - DNA, 201 bp, Homo sapiens
ttataagggagttattgttgatatgttaatttcacattaaatggttagtctttatcagctaagcatttgccgtttcattaatttttaaaattggaataaayagagtttgctatagtcagagttttttgtttgttgatgttactttataaaaaagagcgttcagcacatctttccatttccttttcatgttctgcttcctca

SEQ ID NO: 14103 - DNA, 201 bp, Homo sapiens
aacgaacatgcagtcccttccccctgcaatatggtaaattaaacatacgtttctgaattcccactaaatttttgttgcaatccccaacttctagaacccargttctgtaagttttcttagaagtttgaaaaatttttgtgcctttttccatagaaaccacgctgtaaaagatgcagttcattttactagtcaaaccatagt

SEQ ID NO: 14104 - DNA, 201 bp, Homo sapiens
taatttggattagggagtcaggaaaggccttttaagataagtgatgtttaaaactggaacttgaagagtgagtaagaaattaatagggcaagagcgttacwggctttggggatcatgagtatgaaggcccagagggtataaaagaacttacattctggaaagtaaaaaatgcttactaaacctgagtaagggaaaatggta

SEQ ID NO: 14105 - DNA, 201 bp, Homo sapiens
  misc_feature (1)...(201): n = A,T,C or G, or insertion/deletion polymorphism (see Tables 1-2)
ttactaatgtgtgtgtatttgttctttctcaagatcttagagatctctgtttctgtctcaccctctctttctgtcatactctacagctgcagaataggttnattattgtttcttcatagagaatagactttaatttgggttagtttagaagggaaagtaatccttttacttctccacttaactgtttttccaggccagctg

SEQ ID NO: 14106 - DNA, 201 bp, Homo sapiens
atgtagctgggactacaggcacatgtcaccatgcccagctgatttcttaaaccttttttttttggtagagttggggttgtgttgcccaggctggtcttgamctcctggcttcaagccattttcctgcttcagtctcccagagtgctgggattacaggtgtgaaccactgttcctggccaacaaaggttttgatatgctcat

SEQ ID NO: 14107 - DNA, 201 bp, Homo sapiens
tcagtctcccagagtgctgggattacaggtgtgaaccactgttcctggccaacaaaggttttgatatgctcatactgttggtaggaatgtaaattgatacygtctgtcttgtggatagtttggcagtattgccccaaaaaagaaatgtgagttcatttttgaccatgccatctccctgctaggaatttactgttacagtta

SEQ ID NO: 14108 - DNA, 201 bp, Homo sapiens
gtattctaaacaaatttaaagtagtccattgttaaatttgagatagaacctctgggagactaaatacctggtgtgtttttagggtacttggaatggggacyaagtattttgaaaaaaacctttcattctgatttctaaaagattcacaattagcaaagtttccttatttttaaagtattttaaagtgatatttgcatatta

SEQ ID NO: 14109 - DNA, 201 bp, Homo sapiens
ttgataaataactttttgtttttaagcccaggccattcagcccacctgtaacttccaacaccagcccacctcctgctgcaccattagcccgggcagaaagwtcttcttctatctcatcatctgcttcattgagtgctgccaatactccaacagtaggtaagtgattatcatcaattacatgtgaaatgtagtgtacaaagt

SEQ ID NO: 14110 - DNA, 201 bp, Homo sapiens
tctcttgcccgggcaggagtgcagtggcacaatctcagctcactgcagcctctgcctcccgggtttcagcgattcttctgcctcagtcccccaagtagctkggattacaggcatgcgcaccatgcctggctaatttttgtatttttagtagagacagggtttcattatgttggccagccaggctggtgaagaactcctgac

SEQ ID NO: 14111 - DNA, 201 bp, Homo sapiens
taaatttccctctaaacactgtttcagctgtgtcccagagatcctggtatgttgtgtctttgttctcattggtttcaaagaacttacttatttctgccttmatttcgttatgtacccagtagtcattcaggagcaggttgttcagtttccgtgtagttgtgcagttttcagtgagtttcttattcctgagttctaatttgg

SEQ ID NO: 14112 - DNA, 201 bp, Homo sapiens
ccatttctactcatctagtgattctgactccgaagatgaagaaccaaagaagtatcggatagaaattaagcctatgcatccaaataactcacatcacacartggcttctttggatgaattaaaagtatctatagggaatataacactctccccagcaatatctgtaagtacaaacacgtttgtactctttatataaaagtc

SEQ ID NO: 14113 - DNA, 201 bp, Homo sapiens
attttaaatatcgtcaaaatcctttttgtttttataagtgattaagaataagacttttgaatttggaaagaaaaaagtattttggaaataactcaaaagtrtatgtgtaaggtgtgaaaaacaagcctttctaaatattaataaatacatttgccaattcctctggttttagatcaaagtattattaattatttgaaaatg

SEQ ID NO: 14114 - DNA, 201 bp, Homo sapiens
tctacattatcattggcaggagcaaaggaaaggccgcagaactctgcatctcttggcatgttccttagccttccctcttcccctacacttcactactatcrctgtctactttgcaaccatcagggcagatattatgcctttgagccctgtttatgttagtcaccttaagaagtccaggactcctgggttatccttcctttg

SEQ ID NO: 14115 - DNA, 201 bp, Homo sapiens
aagactaggattgcaacccctgcttttttttgctttccatttgcttggtaaatattcctccatccctttattttgtgcttatgtgtgtctttgcatgtgaratgggtgtcctgaatacagcacaccagtgagtcttgactcttcatccaatttgcgagtctttgtcttttaattggggcatttagcctgtttacatttaag

SEQ ID NO: 14116 - DNA, 201 bp, Homo sapiens
ttcacatagtcccatatttcttggaggctttgtttgttccttttcattcttttttctctaattcttgtcttcatgctttatttcattaagttgatcttcartctatgatatcctttcttccacttgatcgatttggctattgatacttgtgtatgcttcacaaagttctcatgctgtgtttttcatctccatcaggtcatc

SEQ ID NO: 14117 - DNA, 201 bp, Homo sapiens
  misc_feature (1)...(201): n = A,T,C or G, or insertion/deletion polymorphism (see Tables 1-2)
aggtcatctatgttcttctctaaactggttattctagttagcaattcgtctaaccttttttcaaggtacttagcttccttgcatttggttagaacatgctnctttagcttaggggagtttgttattacccaccttctgaagcctacttctgtcagtttgtcaaactcattctccatccagttttgttctcttgctggtgag

SEQ ID NO: 14118 - DNA, 201 bp, Homo sapiens
ttatcttctaggggttttgtagttttatgttttacatttaggtctgtaatacattttgagttaatttttgtgaagggtgtaaggtctgtgtctggattcattttttttttttttttttgcatataggtgtccagttgttccagtaccatttattgaaaatactatctttgttccatcgtattgcatttgttcctttttttt

SEQ ID NO: 14119 - DNA, 201 bp, Homo sapiens
gctgggtgtggtggcgggtgcctgtagtcccagctactcgggaggctgaggcaggagaatcgcttgaatccgggaggcggaggttgcagtgagccaagatygcaccactgtactccagcctgggtgacagagccatattccgtctcaaaaaaagaaggccatacaaaatgtgtattctgtatttataggttacatgtctgt

SEQ ID NO: 14120 - DNA, 201 bp, Homo sapiens
ttatataaaacacagttttctagtgtgaaatatttgctaatattttagatctgatcacaaaataaattaagccatgaatgaagttcaggatttcagacttdatgatatatttagttttgtgcaaatgactgtcattaatctcttgttctattaaatgtgcatcacagtgttgaagaataataaaactaagtacaacaaaga

SEQ ID NO: 14121 - DNA, 201 bp, Homo sapiens
aaagtcatagatctttgaataatttttttgtgacttaaaaacataaatactataggtgttataacataatttggttatctcattcactcattcacaggccttttttttttttttttttttttaagatggagtctcgctctgttacccaggctggagtgcagtggcacgatcttggctcactgcaatctctgcctcctggat

SEQ ID NO: 14122 - DNA, 201 bp, Homo sapiens
cctgaagcagtccacctgcctcagcctcccaaagtgctgggattacaggtgtgaaccacggcacctggcctgtcattgttttttttttgtttgtttgtttktttttttttttttttagtgtagtaatggctggttcctctggaatttgagtcactgtaagaggatgctttgaatattaaggcacctgtggtctgaagggat

SEQ ID NO: 14123 - DNA, 201 bp, Homo sapiens
tatatatttatgaatgtcaagtaagcacatgaaaagataccccattcgtaattagggaaatacagattaaaaccacaagaaaaatagcagtagacacttawtagagtgataaaaatttaaaaggctgactataccagccaggcatgctggctcacacctgtaatcccagcactttaggaggccaagatgtgtggattcctt

SEQ ID NO: 14124 - DNA, 201 bp, Homo sapiens
caggtgtgcgccactacgcccggctaattttttgtgtgtttttagtagaaacggggtttcaccatgttggccaggctggtctcaaactcctgaccttaggwgatccgcccacgtcggccttccaaagtgctgggattataggcgagatccaccacaccaggccttaagtgctgaattctatcaaaagttaatagcatgact

SEQ ID NO: 14125 - DNA, 201 bp, Homo sapiens
accacaccaggccttaagtgctgaattctatcaaaagttaatagcatgactggcctttaaaaataatttgtcatgaaagaagaggatgccttattaggaawatcaaagataatttttactcctcggttatggtagaatccatttatagcattgtttgtattagggacaacattatggacacaagaatgccatattgtaaac

SEQ ID NO: 14126 - DNA, 201 bp, Homo sapiens
aatgaataataaataccaaaataaaagtaaggattttatctttaaagaaatgttgattgtagcttaatgatagggggtgtgaggaaaatgaggataaatgsagggtgctgagttgtggagatgagagcaaaatgcagaaatattgaagaatagcacaataaacactgaggcaaaacaaccaaccaaactgagccaagtgaa

SEQ ID NO: 14127 - DNA, 201 bp, Homo sapiens
agatagtagggagtgggtgtctgtgttttatttctgagcggaaaggaattctacataaatatccattgattgttataagaaggtaccctatacctgttacrtacctcaagtttataagctctctacattttcaaaacaaaattatctaaatatgtaacaaaccaaaattagaaaccacaatctacccttattaagagaata

SEQ ID NO: 14128 - DNA, 201 bp, Homo sapiens
atatttcctattcattttttgaagtatccatgtgcaatacgatcttgaaagaaaaacaaaaatagaaaatacgaaagggaatatgccaactgttaagtggsttttgagtttttcttcaactttccaatacttttctctgcttgccaatgtttcagtaatggcataatttacagggaagctaggcataataatttacagagt

SEQ ID NO: 14129 - DNA, 201 bp, Homo sapiens
aggtctccttaaaaaggagccattggacaaggagcttaagaatttgaaggaattataacatttactgtgagtcatgtgattaaacatttgaagttggaagyattctaattccaacttgtggtactacgtggtgaccttttttctcgtgttctaaatctgaattcttataatgtatgaagaatctttgaattctgtgttgaa

SEQ ID NO: 14130 - DNA, 201 bp, Homo sapiens
acttgagcccagaagtttgagaccagcctgggcaacatagggagacctcatctctacacaaaatttaaaaaatattttaaattgtttaaatattaaaaaakattttaaattgtttaaatattaaaaaagattttaaattgtttaaatattaaaaaagattttaaattgtttaaatattaaaaaagattttaaattgtttaa

SEQ ID NO: 14131 - DNA, 201 bp, Homo sapiens
catccagttgagtattcctaaaccgaaaatcccaaagccagaatgttccaatgaacattttgtttgagcatcctgttagtgttcaaaaactctcagatttwggagcactttggatttcagatttttggattagggatgctcagcctgctttgtgtgcattaactgtcacaagtcagaggtccaaaaaccttttaagtctgc

SEQ ID NO: 14132 - DNA, 201 bp, Homo sapiens
  misc_feature (1)...(201): n = A,T,C or G, or insertion/deletion polymorphism (see Tables 1-2)
atacaaggaaaggcacagataagagttcttagtggtaatagttaattcctcaattctaaaataccgtatttaataggatttgagggagaaataaaacattntcccagtaaattttttcctcattgatgtcaattttaaacttaaaaatgttacactatgtgaaaaaagcaattcttaggataagttaagtatatctatatg

SEQ ID NO: 14133 - DNA, 201 bp, Homo sapiens
acccatagtttctcttttctaaacagcaattttaatgaatatcatagtttaattgacttaagtcatttcttactaaagatattagaaggaaccagggtttwgtaatttcagttattttaatgtacacaatagaaaacttgttaaaatattgtttgtatttacattatcaattccaaaatttttaattgttatagtgttgag

SEQ ID NO: 14134 - DNA, 201 bp, Homo sapiens
gagtttaattccaggaaaagatgatgctagatgagtatactatttcatgtatataatttttaaaaattaaattgaaaaaataatctatagttatgataaasgatatagatatacacacatataggtgcgtgtgtgtgtgcgcacgtgcacgcgtgtgcctttttaaaccaaatactttaaatagagattagagcattttat

SEQ ID NO: 14135 - DNA, 201 bp, Homo sapiens
  misc_feature (1)...(201): n = A,T,C or G, or insertion/deletion polymorphism (see Tables 1-2)
tatagtatcatacagagtatttttgctgccctgaaaatcttctgtgctccaccttctcatcccttcttccacacacttacattttaagtatccttttgtcnttttttctagagttttattagctctatagttttaattccagtaaagttctgttaatcatcctgttttctgagctgtcaaatgcaatgttggagtttttag

SEQ ID NO: 14136 - DNA, 201 bp, Homo sapiens
cctatgaattaattgaactcttgtgctcacaaaaaaaaaaaaaaccgcttaaaatgattttttgaaaaatattgggctgtttttaaatattaactcgaacmctgatgtagtccgatgtacttcctgggggcagttttatcactggacaatgatgaactttgttgagtaccacacatacacagcattgttgctttgccacct

SEQ ID NO: 14137 - DNA, 201 bp, Homo sapiens
ggcatcatatgtaattggttttcagtaaattattgtgatcataatgggctagtcttgttatttttcactgttagaattatttgatttttaaaatttattgstgatattttaattattaggtaacaactagaaccatttcagaacaattaaaaagatgcgttgtcaattaaaagtagaataaaaaatttaaaatgtaaaaaa

SEQ ID NO: 14138 - DNA, 201 bp, Homo sapiens
agttgatcattttatgtgttagtggatcaatttgctgctattttatatgcaatttttacatctatacttgtgagtgagattggcctgaacattttctttctctaagtgtacttgttaggttttggtatcaaagtttgttggcttcataaaatgaattggggagtatatcctattgttgtattttctggaaaaatttttgaa

SEQ ID NO: 14139 - DNA, 201 bp, Homo sapiens
gcaaatatctttctatatcatgaattattctttgattataattttatttatagaattaggggatacaagtgcagatttcttacatgtatatattgcatacyggcagaatctgggcttttggtgtacccattaactgagtagtgaatattgtacccaacaggtaatttttctacccttacccttttcccatcctcccacctt

SEQ ID NO: 14140 - DNA, 201 bp, Homo sapiens
atctcatcatctgcttcattgagtgctgccaatactccaacagtaggtaagtgattatcatcaattacatgtgaaatgtagtgtacaaagtatatgtatgstaaatatgtatgtatttttaaatgggctaatgaagaatttaacattataaattttgtttttctggaaacacacctggaatttattaaactgtccatgctt

SEQ ID NO: 14141 - DNA, 201 bp, Homo sapiens
  misc_feature (1)...(201): n = A,T,C or G, or insertion/deletion polymorphism (see Tables 1-2)
gcttcattgagtgctgccaatactccaacagtaggtaagtgattatcatcaattacatgtgaaatgtagtgtacaaagtatatgtatgctaaatatgtatntatttttaaatgggctaatgaagaatttaacattataaattttgtttttctggaaacacacctggaatttattaaactgtccatgctttgcttttctgtt

SEQ ID NO: 14142 - DNA, 201 bp, Homo sapiens
aagtcatagatctttgaataatttttttgtgacttaaaaacataaatactataggtgttataacataatttggttatctcattcactcattcacaggccttttttttttttttttttttttaagatggagtctcgctctgttacccaggctggagtgcagtggcacgatcttggctcactgcaatctctgcctcctggatt

SEQ ID NO: 14143 - DNA, 201 bp, Homo sapiens
aaccataataaaagcaggcactatttatttttaaatttaactgtatgccagaccctattccaagcattttgtataactacattactactacagcttttttwaaaaaaaaggtgatattgttccctttttagtaatgagagaactgtataaatttctaagacaaggtcagatgggtagtgcagtgctgagatttcactttcc

SEQ ID NO: 14144 - DNA, 201 bp, Homo sapiens
aaaaaagattttaaattgtttaaatattaaaaaagattttaaattgtttaaatattaaaaaagattttaaattgtttaaatattaaaaaagattttaaatwgtttaaatattaaaaaagattttaaattgtttaaatattaaaaaagattttaaattgtttaaatattaaaaaagattttaaattgtttaaatattaaaaa

SEQ ID NO: 14145 - DNA, 201 bp, Homo sapiens
ttctttcttgttggaagtttaagttgcatctaattttctagtattatgaacatccatagaaataacaaattttgtgcatatgtctcataatatgcttgtartaatttatcaatttaaaatttatggcttacaagatgatgtccatgatacttattgccaaactgctttctagaaaggctttaacacttcccaagcagttta

SEQ ID NO: 14146 - DNA, 201 bp, Homo sapiens
agtggtttgtgacctgctctttactagcagtgagacttttttttttttatgttttattttttttggagtcggagtctcgctccgtcgcccaggctggagtrcagtggcatggtcttggctcactgaacctctgcctcctcggttcaagctattctcctgcctcagcctcccgagtagctgggattacaggtgcccaccacc

SEQ ID NO: 14147 - DNA, 201 bp, Homo sapiens
aagatgatgtccatgatacttattgccaaactgctttctagaaaggctttaacacttcccaagcagtttacaaaagaagttgataaatgttttttagttgktttggcaataatatatgaagtttctcttttcattagtcaaaaagcaggcaccaaaaatgtatgtttaataaaaccactgcttgttcaaaacaagaaaata

SEQ ID NO: 14148 - DNA, 201 bp, Homo sapiens
gtcgcccaggctggagtgcagtggcatggtcttggctcactgaacctctgcctcctcggttcaagctattctcctgcctcagcctcccgagtagctgggaytacaggtgcccaccaccacacctggctaatttttgtatttttagtagagacggggtttcaccatattagccaggttggtctcgaaatcctgacctcatga

SEQ ID NO: 14149 - DNA, 201 bp, Homo sapiens
agccaggtgtggtggtacacacctgtaatcccggctacttgagaggctgaggctggagaattgcttgaacctggaaggccgaagttgcagtgagccgagaygatgccactgaactccatctagcctgggtgacagagtaagactctgtgtcagagaaaaaaagaaaaaaaaaaaaagaagaagaaagaaagtcacctgggg

SEQ ID NO: 14150 - DNA, 201 bp, Homo sapiens
ttgccccaaaaaagaaatgtgagttcatttttgaccatgccatctccctgctaggaatttactgttacagttatagtaacaaaactttacacacacacatacacacacacacacacattgtattagtgtgtatatgtgtgtgtatacatatacacacatatataaagtatatatgtttgtacacatgcagacacacttgat

SEQ ID NO: 14151 - DNA, 201 bp, Homo sapiens
tgccccaaaaaagaaatgtgagttcatttttgaccatgccatctccctgctaggaatttactgttacagttatagtaacaaaactttacacacacacatacacacacacacacacattgtattagtgtgtatatgtgtgtgtatacatatacacacatatataaagtatatatgtttgtacacatgcagacacacttgatc

SEQ ID NO: 14152 - DNA, 201 bp, Homo sapiens
taaatatataaaacaaaagcctagaggaatatatgggtagtgagattgtgaatagttttaaattttctcttttgtactcttctcttttcagtttgtttttaaaaaacaatgaacatgtattaatttcatactatgaaaataataatcagaacaattttatagttaatattggataagaaaagattatatctgaatatattt

SEQ ID NO: 14153 - DNA, 201 bp, Homo sapiens
cgtggtgaccttttttctcgtgttctaaatctgaattcttataatgtatgaagaatctttgaattctgtgttgaatgttggaagattcgcaaactttacaygcataattaagaattccttcataaaatgctgatttctgggccctgtccctaagctgttgaatcagattttctgcagttggagctaagggaatgtgtgtta

SEQ ID NO: 14154 - DNA, 201 bp, Homo sapiens
aaaaatgaagtttttgtaggattaatttttaaattatttccagtgtctatgttgaaaaaaagggttatagtgtaatatcaggcctaaagtttcagaagagyaagcacaaagtaatttagctttccatacatttttagagtcagagataactttgaaatttcataagtttgatattcagtggatacaaatagaacatgaatt

SEQ ID NO: 14155 - DNA, 201 bp, Homo sapiens
agattaccttcagatacttgacattaacctcatcaaaagtgtgtgaattttaaaacaaattctaaaaaaactatagtgctaaattggtaactggtattttractctcaatttagcattttccttgatactttatcattgaaaatttatgcatttatttactgattgtgttgtgaacatgagttttatggtattttgtgagg

SEQ ID NO: 14156 - DNA, 201 bp, Homo sapiens
ctgaggcaggagagttgcttgaacccatgaggcagaggttgcagtgagccgagatcacgccactgcactccagcctggcgacagagcgagactccgtctcaaaaaaaaaaaaaaaaaaaaattaatgtaacaatacatgtgaacacagtgaatttgaagttgcagggagtaaagtgcctatctaatttgttcaggaaagtt

SEQ ID NO: 14157 - DNA, 201 bp, Homo sapiens
  misc_feature (1)...(201): n = A,T,C or G, or insertion/deletion polymorphism (see Tables 1-2)
aattataactgtacgtattgctgctggtttaagtagtgatgggtttattcttgataatgcaaatcactgattttcactaaccgagcactaattcagtagtngtcaaagtgtggtccttggacctgcagcatctgcataacctgggtacttcttagaaatgcagacttttaaaatcagaaaccctgggagtggaactagcag

SEQ ID NO: 14158 - DNA, 201 bp, Homo sapiens
ggattacaggggcacgccaccacacctggcaaatttgtaaaatatttttagtagggacggggtttcaccatgttggccaggctggtctcaaactcctgacytcaggtgatccacccaccttggcctcccaaagtgctgggattacaggtgtgagctaccgcgcctgagcattctatatattttagtcactattttctccat

SEQ ID NO: 14159 - DNA, 201 bp, Homo sapiens
aaatatataaaacaaaagcctagaggaatatatgggtagtgagattgtgaatagttttaaattttctcttttgtactcttctcttttcagtttgtttttaaaaaacaatgaacatgtattaatttcatactatgaaaataataatcagaacaattttatagttaatattggataagaaaagattatatctgaatatatttt

SEQ ID NO: 14160 - DNA, 201 bp, Homo sapiens
aggctggagtgcagtggcgtgatcatggctctctgcagcctcaacgtcccaggctcaaatgatcctcccgcccctgtctcccagctaatttttttcaaaattttttttttttggtagatactgggtcttgctatatttcccaggctggtctcgaactcctggactcagactcctgagcctctcaaagtactgtgattacag

SEQ ID NO: 14161 - DNA, 201 bp, Homo sapiens
agtgtgagccctgagctttttgtcttgcaactagtcagtcccatctgggggtgatgggagacaatggcagatcatcaggcattagattctcataagagtgygcaacctagatccctcacatgcacagttcacaatagggttctcgctcctatgagagtctaatgccgctgctgatctgactggaggcagagctcaggctgt

SEQ ID NO: 14162 - DNA, 201 bp, Homo sapiens
aaaaataaacaaaactagttttgctctaagtaccacccagacttcaatgattccatactaactttaccattaggcagagtgcttgacctctctaaacttcttttttttttttttttcatttaaaaaatacaaatattttatggattaaatatagcatctggcaagtctataggaacaggaacacctatctaattagtgttt

SEQ ID NO: 14163 - DNA, 201 bp, Homo sapiens
aaagccttttggaaattgtctagtatttcagaaaaatcagaaaatggaggtaagtgtgtgtgtccttttttatttataaaatgatgtcactgaaaattgattttttttttttttttaaaacagagtctagctttgttgccaggctggagtgcagtaacacaatctcagctcactgcaacctccgcctgctgggttcaagcg

SEQ ID NO: 14164 - DNA, 201 bp, Homo sapiens
tggagtgtgatttgaagctaattaactaaaaaggtgtaatttttcttcggtgttcatcatttcattaacctgttgatatctgagaagcggtttggttcctwagtaatacctgaggctactttgataatctctaataattttgtacattggagttgtcattataatttttttttctttttcccttagaacattcctgatgta

SEQ ID NO: 14165 - DNA, 201 bp, Homo sapiens
tctggagtgcagcggcatgatcttggctcactgcaacctctgcctcccaggttcaagcaattctcctgcctcagcctcccgagtagctgggattacaggcrcctaccaccacatccagctaatttttgtatttttagtagagacagggtttcgccatgttggccaggctggtcttgaactcctgacctcagttgatctgcc

SEQ ID NO: 14166 - DNA, 201 bp, Homo sapiens
tcatcatgttatccaggatggtctcgatctcttgacctcaggtgatcggccagcctcagcctcccaaagtgctgggattacaggtgtgagccaccatgccsggcctttttaaaatacttttaagttccgggatacatgtgcagaatgtgcaggtttgttccataggtatacatgtgccgtggtggtttgctacacccatca

SEQ ID NO: 14167 - DNA, 201 bp, Homo sapiens
ataattttgtacattggagttgtcattataatttttttttctttttcccttagaacattcctgatgtagatgaagaaggctacagtattaaaccagaaacraatcagaatgatatcctttcatcatctagtattcttaaggattatgttggcatataagtaggcagttataagaaaatcatgtattaaagcctcttccaat

SEQ ID NO: 14168 - DNA, 201 bp, Homo sapiens
aatagaattttctggtaaagccctctgggcttgaaactgtctttataggaaagttttaaattacatatttaatttctttaatcattataggaccattcacrttttttagttctgtgagtttgaaaagttatgtttttctatgaatgtcttaattttatccacactttaaggtttgttgcaaaaatttattattattattat

SEQ ID NO: 14169 - DNA, 201 bp, Homo sapiens
aagtatgttatctgtggtaaataggttagcgagcactaaaaaacaatgattgatttgagacggagttttgctcttgttgcctaggctggagtgcagtggcrcgatcttggctcactgcagcctctgcctcctgggttgaagtgattctcctgcctcagcctcccaaatagctgggattacaggcgcatgacaccacatccg

SEQ ID NO: 14170 - DNA, 201 bp, Homo sapiens
taggtaacaactagaaccatttcagaacaattaaaaagatgcgttgtcaattaaaagtagaataaaaaatttaaaatgtaaaaaaaaagttttaaaatttmcctaatagtttttttctactagaagtttttcaatttctttttttccaggcctcattgaatttgaagaatgtgacactgctagtgcagttgaaggtaagtt

SEQ ID NO: 14171 - DNA, 201 bp, Homo sapiens
  misc_feature (1)...(201): n = A,T,C or G, or insertion/deletion polymorphism (see Tables 1-2)
ggaagtaatggctttgattattttctgaaaatcttttagtgataccttttggtaagatcaagtgcttggaagaaaacctgaagataataatggagcacttnaaagaaatggtctgtcaactgacaaaaacaagcaatggggaaaggattccctattcaataaatggttctgggataactggctagccatatgcagaaaatt

SEQ ID NO: 14172 - DNA, 201 bp, Homo sapiens
aaggcaggctggaagagtgaggcaggggcatttagctattcccatcctcatctagctccccactctggcttctcccgccagcggatgtgaccctggacccygagacagctcatcctaacctagtcctgtcagaggatcgtaagagcgtcaagttcgtggagacaagactccgggatctccctgacacaccaaggcgtttca

SEQ ID NO: 14173 - DNA, 201 bp, Homo sapiens
ccactacaacccttgccaaacacagcccactccatttcagaccgccttcctgaggagaaaatgcagactcagggttccagtaaccagtgatggattcaccycatctcccaaataaagtttacttgttttacattccatgattctgttctgtgggtatttcaactcttaattccattttcttctgtttctgtctgtgtttct

SEQ ID NO: 14174 - DNA, 201 bp, Homo sapiens
tttactgctacactgagaggaccattgcgaagcggctcgtcttgcggcggtgagacagccacggggcgggcggcgggcgggacgcgggaggaacgcgagarggagcgcgggcgccagaccactatcctcctccgcccccagggatccctcggtgaagaggactctctgtcgaggctgctcttccctcctcgtcccgggcct

SEQ ID NO: 14175 - DNA, 201 bp, Homo sapiens
ctcatgtgggagatcatgggaatcaggtcccagtcaggatgagcggcagacaaaacagtatctggaatctggttcacttgtgagtctttgtggtttctttmtttgttgtgggtttctatcaatatataactctaaagatcacagccctcttcctctttccacagccctcttcctctttcctttttcatgtttaattataaa

SEQ ID NO: 14176 - DNA, 201 bp, Homo sapiens
tctgattctgctcatttactcagattccaaaccactacaacccttgccaaacacagcccactccatttcagaccgccttcctgaggagaaaatgcagactmagggttccagtaaccagtgatggattcaccccatctcccaaataaagtttacttgttttacattccatgattctgttctgtgggtatttcaactcttaat

SEQ ID NO: 14177 - DNA, 201 bp, Homo sapiens
agcgctggaccgtacagacctgcctaacatgccagcgcagccaacgcttcctcaatgatcccgggcatttactctggggagacaggcctgaggcccagctygggagccaagcaggtgagaggtgagggagaaaatggaggacaccccagaggatagggacaatggagaacgtagagtgaagaggacacatggacaggttct

SEQ ID NO: 14178 - DNA, 201 bp, Homo sapiens
tccctcaccctttgccatttcccttttcagagaatgtaaatgattttcatgttaggccaaaataaacaacttatagggtacatatgttgtcataaaaggtraaagtgatgcatgccaaaccaaactaaaccaatttggattatctgctattcgggtaatcttcacagaaatgactgagagaagaatctgcagtttactgag

SEQ ID NO: 14179 - DNA, 201 bp, Homo sapiens
ttgcggcggtgagacagccacggggcgggcggcgggcgggacgcgggaggaacgcgagagggagcgcgggcgccagaccactatcctcctccgcccccagrgatccctcggtgaagaggactctctgtcgaggctgctcttccctcctcgtcccgggcctcacctgcacccagcgccagagacgtgagtgctccaacggag

SEQ ID NO: 14180 - DNA, 201 bp, Homo sapiens
tttgaactttatcttaaagagttccaggaaatcgatggagcttatgccgaggcctgacaccatcaaatgtgcattcaaattgggggtgtggtgggggagcrgggatacctactgaaaaacactggaggcaaaactggcagcaagagaccgttacttctaaacgtggacagtctttttcccatgttcaccctaggctgcagg

SEQ ID NO: 14181 - DNA, 201 bp, Homo sapiens
accctgggcatggattgctggggttgtgtttagaaaccgatgagtttgtgaggcctccgggaggctcccgagggcgcggggactacgtttcccaggaggcytcgcgcggacgcccgggcggggctgtgcgaggggtggggctgcgggaggccctggagcgcggcggtgatggcggggccggtgaaggaccgcgaggccttc

SEQ ID NO: 14182 - DNA, 201 bp, Homo sapiens
cccctgcacatctttttagggggttctttgacccaggatagtcttgcttcttgaggtagatcacaggggtctgtgtacctctgaattcatgagagatgaaygacagatgctctcatgggtctagatattgaggagtttttctgagggcagagattggacatcaacaaggctagaagggtcagggaagtgggctaaaggaac

SEQ ID NO: 14183 - DNA, 201 bp, Homo sapiens
ctctgattctgctcatttactcagattccaaaccactacaacccttgccaaacacagcccactccatttcagaccgccttcctgaggagaaaatgcagackcagggttccagtaaccagtgatggattcaccccatctcccaaataaagtttacttgttttacattccatgattctgttctgtgggtatttcaactcttaa

SEQ ID NO: 14184 - DNA, 201 bp, Homo sapiens
cattcaaattgggggtgtggtgggggagcggggatacctactgaaaaacactggaggcaaaactggcagcaagagaccgttacttctaaacgtggacagtytttttcccatgttcaccctaggctgcaggggacagcgctggaccgtacagacctgcctaacatgccagcgcagccaacgcttcctcaatgatcccgggca

SEQ ID NO: 14185 - DNA, 201 bp, Homo sapiens
ccagaccactatcctcctccgcccccagggatccctcggtgaagaggactctctgtcgaggctgctcttccctcctcgtcccgggcctcacctgcacccascgccagagacgtgagtgctccaacggaggtggaagactgcggagcattgggggcgcggaggggggcggggtggggggcgggcactggaggccaacagcgc

SEQ ID NO: 14186 - DNA, 201 bp, Homo sapiens
ggccctggagcgcggcggtgatggcggggccggtgaaggaccgcgaggccttccagaggctcaacttcctgtaccaggtgagtctgcgacaagggccccayggggacggtgctcggcgtcccagagtgactgctcccctcccgcaggccgcccattgtgtccttgcccaggaccccgagaaccaggcgctggcgaggtttt

SEQ ID NO: 14187 - DNA, 201 bp, Homo sapiens
gaggtaggagggcaaaacatgagactggagggggaaacaggccagttcttgaagtcttgttagggagtttgaactttatcttaaagagttccaggaaatcratggagcttatgccgaggcctgacaccatcaaatgtgcattcaaattgggggtgtggtgggggagcggggatacctactgaaaaacactggaggcaaaac

SEQ ID NO: 14188 - DNA, 201 bp, Homo sapiens
tcccgggcatttactctggggagacaggcctgaggcccagctcgggagccaagcaggtgagaggtgagggagaaaatggaggacaccccagaggatagggrcaatggagaacgtagagtgaagaggacacatggacaggttctgggttggtgtgagaagtaccacagtcagaaaactaattctgtttctctgattctgctc

SEQ ID NO: 14189 - DNA, 201 bp, Homo sapiens
accgtacagacctgcctaacatgccagcgcagccaacgcttcctcaatgatcccgggcatttactctggggagacaggcctgaggcccagctcgggagccmagcaggtgagaggtgagggagaaaatggaggacaccccagaggatagggacaatggagaacgtagagtgaagaggacacatggacaggttctgggttggt

SEQ ID NO: 14190 - DNA, 201 bp, Homo sapiens
cccttgccaaacacagcccactccatttcagaccgccttcctgaggagaaaatgcagactcagggttccagtaaccagtgatggattcaccccatctcccraataaagtttacttgttttacattccatgattctgttctgtgggtatttcaactcttaattccattttcttctgtttctgtctgtgtttcttggtcacct

SEQ ID NO: 14191 - DNA, 201 bp, Homo sapiens
ccatgcctgtcctcaccctcccagcagccctgccagcctccgacgggcccagggcactgcagccggcacttgggagtgaagactggggccagagccaggckcacctttggccactgaatcctgaaagaggaggaatttggcaagtggggttctgcccaccaagctttcttccccccgctcccctgagtcttttcccttcac

SEQ ID NO: 14192 - DNA, 201 bp, Homo sapiens
ccagtgggcaaagcacaggtgcgttcactgagttcccagcacatagctgtggcaggcacttggtgatattttgaaataaaagaatggaagaatgtgtccargctgtgcttcccctttctaccttactcagggacatggtgccctcctctctggtttcctgccctgtgcccaccccccaccccctgcaagcacagctcttat

SEQ ID NO: 14193 - DNA, 201 bp, Homo sapiens
ccctgacttcttgccttcgtctcaaatagactctgcagccagccatctatgcagcgccccagtggctttgaaatgcaacagaaaccatcacccccggaccrtgggctccatgccagtgggcaaagcacaggtgcgttcactgagttcccagcacatagctgtggcaggcacttggtgatattttgaaataaaagaatggaa

SEQ ID NO: 14194 - DNA, 201 bp, Homo sapiens
cagttttaatctctccttctctgccttcctgttgggaataccccctcacttctgtggcttctttcctgtagtagacgatcaagggtggaatctacagtccrtgggccctgacttcttgccttcgtctcaaatagactctgcagccagccatctatgcagcgccccagtggctttgaaatgcaacagaaaccatcacccccg

SEQ ID NO: 14195 - DNA, 201 bp, Homo sapiens
tgacttgcatagtgacatttccaaccctcctcctgctaagccccagagccttacatgctggacatgggcaagataggaactcaagttacttccaggtctcygtaagtttaggactgtgaagagggcatcctaatagtcaaaaacataagtgttggccgggcacggtggctcacgcctgtaatcccagccctttgggaggcc

SEQ ID NO: 14196 - DNA, 201 bp, Homo sapiens
gtttaggactgtgaagagggcatcctaatagtcaaaaacataagtgttggccgggcacggtggctcacgcctgtaatcccagccctttgggaggccgaggyggggagatcacgatgtcaggagttcgagaccagcctggccaacatggtgaaaccccatctctactaaaatacaaaaattagccgggcatggtggtgcgca

SEQ ID NO: 14197 - DNA, 201 bp, Homo sapiens
caatgctggatccgctggagctaccactggagccaccaccagagcttctggcactggaaatggagctgccagaactgctggagccactgtagctactgaarccgctggagtcacccttcccagtgaggcaggggtcgttaggggaggtgatacgcgtggggtccttacaggggtctgagaaggtgccaatgctcttagcca

SEQ ID NO: 14198 - DNA, 201 bp, Homo sapiens
cagagcagagccattccctacttggaagctgctgctgctgaactgaaagctgctgctgctgctcgaatgagagctgctgcttcccgagtgagagccgctgyttcccgagtgagagctgctgctccccagctgggaggaaccggatgcaccttgtagactagagccagatccggaggagtagctgacctgggaataccccgt

SEQ ID NO: 14199 - DNA, 201 bp, Homo sapiens
gtgcgagacgatgggccctccactgcagggagagtcggggatgtccgaactacagggacgctggttggagctgacgctttggccactgctggataccccaraggtttgggaagaggaagagctttgtccaggctgggaagggtttagtattccgcggtaagagttgtcattggttggcagagcagagccattccctacttg

SEQ ID NO: 14200 - DNA, 201 bp, Homo sapiens
tcccttgcaactattggaagccaaagaatgggagcaaaccacacgatgggcgttgggaagcaccgtaattacagggttgggaggcaggatgcctgcgctgrgggaggaggtgcctttcaaacctgggatgcagctgggacagtgtcagctactaccccagcctccccactcacccccgcactgaaagctccccctggggct

SEQ ID NO: 14201 - DNA, 201 bp, Homo sapiens
ggcacggtggctcacgcctgtaatcccagccctttgggaggccgaggcggggagatcacgatgtcaggagttcgagaccagcctggccaacatggtgaaaccccatctctactaaaatacaaaaattagccgggcatggtggtgcgcacctgtaatcccagctactcagaaggctgaggcaggagaatggcttgaacccgg

SEQ ID NO: 14202 - DNA, 201 bp, Homo sapiens
aactgctggggactcgagaactggagggagagcagggtcccttggagcccgtggagccgcctccacagagctggaccccaccagtccccactggctggaaygcaatggccgaggaagctgccgactggctggggatgatggggttgctggagaagtatttgccctcagagatggggggcccagctgcaaaggaagggaccc

SEQ ID NO: 14203 - DNA, 201 bp, Homo sapiens
ctgtctggatggacgcagcctgaactgacccacaaacagaccaaaaaagtcactctcaaagagctctcggtaggtttgtaaatacttaactgatggtaaartgtcatgaacccctacccccgatggatctgaaccgttcacttgacccactttaaactgaccagacttctccaaataagctccatccacccctggttgggg

SEQ ID NO: 14204 - DNA, 201 bp, Homo sapiens
tcccagcactatgggaggccgatgcgggcggatcacttgaggccaggagttcgagatcagcctggccaacatggcgaaaccccgtctctaccaaaaatacaaaaaaattagccaggcgtggtggtgggcgcctgtaatccctgctactcgggaggctgaggcaggagaatcacttgaaccctggaggcagaggttgcagtg

SEQ ID NO: 14205 - DNA, 201 bp, Homo sapiens
gaagcacccatttccctctcgacaccttgcccgtagagttcctgctgctgggtcagctcctgccgcagactggcagcctcctctgtgctctcctgctggcmctggcgtgctacctccagctgcagccccaagctagccagggactcctgggtctgctgcagctcctgctccagctgctgggccaccttgctcagctgctgc

SEQ ID NO: 14206 - DNA, 201 bp, Homo sapiens
ctcctgtctcctaccagcatgaggttcttatccctctctagctcctgcaagcgccgggccagtcgctgcccctcctccttccgggcctcctcctgcagacrcctgagttcctggctccgctccttttcctgggcggctctgcgctgaatctggcgcaaggagaccactacagagaggccaaggcacagaggaggcaggtgt

SEQ ID NO: 14207 - DNA, 201 bp, Homo sapiens
caaccaggtgtaccttgctcccgagcccggcccacctcctgctggatgaggcgggcactcagctgcagttctgcatccaggcggttccgttcttcccgcarctgctgcaactcaaggctcacatctgtgaccggtggtggtaggggacagctgagacggggaagagaaagagtcaggagaaatcacccagctgcctgatcc

SEQ ID NO: 14208 - DNA, 201 bp, Homo sapiens
acactgtatcactcagacttcctcttctgcctcccatgtccacattaagggacctggtgactacactggacccacctgaataatccatgataatctctgtraagtcagccgaatagcaaccttaatcccatctggaaccttaatttccctttgccatgtaacctaattcctacgttccagggattaggatgtggacatctt

SEQ ID NO: 14209 - DNA, 201 bp, Homo sapiens
atgacacccacgcttccctgtggactcacctctgcagccacagcaacaccctcctctccttggcgtggaagccagcgctcctggcccactcccagtagggratgtcctctgagttgtttttcctgtgcggggaggggtggactgagtcatccacactcttcacctggttcctctggtgaccaagaacatagaaggagaggg

SEQ ID NO: 14210 - DNA, 201 bp, Homo sapiens
agaaacccaggaaatcgagactcatgactcccagagaggatggcatctagaaggtgaggaatgctaatggtggaagaaaaggagtttgggtggggaggggwggggaggggagggagagaaaacactgagggccctaaataaggggaagggggaccccacggtgaatgaggaatgggaagagaatggatttcctggagcaat

SEQ ID NO: 14211 - DNA, 201 bp, Homo sapiens
tttgttcctctctgcttggctccagcgagaggccatttcctctcctctctctttctccatgacacccacgcttccctgtggactcacctctgcagccacarcaacaccctcctctccttggcgtggaagccagcgctcctggcccactcccagtaggggatgtcctctgagttgtttttcctgtgcggggaggggtggact

SEQ ID NO: 14212 - DNA, 201 bp, Homo sapiens
ggagagaaggaaaggggccacccagagctgctctggggctccagggcctgtgggctcctcccctcctttgttcctctctgcttggctccagcgagaggccrtttcctctcctctctctttctccatgacacccacgcttccctgtggactcacctctgcagccacagcaacaccctcctctccttggcgtggaagccagcg

SEQ ID NO: 14213 - DNA, 201 bp, Homo sapiens
gagcaatgagagaggagggaaatggcggaaggatctgggaggccaggcaatctctgctttcagttcaacaaatatttattgtcttcctcctctgtgggagsagctggaaggtagaagagaaacacagcccgcttttgaaggaaaatgagggacacagagacctctagaggcgtaggaagagcaccacccagactctcagag

SEQ ID NO: 14214 - DNA, 201 bp, Homo sapiens
gacaggctgcttggatcgggattgtagatgacctacaacaccaggttaaaagaatttggattctataggaattgcagtaaatgtgagagggtgcagggaamcaaacggctttgaatgatcacaaagggggctgaagcatggcgtgctgtagtcccagctacccaggaggtggaggtgggaggaatccgaggccagctgggg

SEQ ID NO: 14215 - DNA, 201 bp, Homo sapiens
tctctgctttcagttcaacaaatatttattgtcttcctcctctgtgggaggagctggaaggtagaagagaaacacagcccgcttttgaaggaaaatgaggracacagagacctctagaggcgtaggaagagcaccacccagactctcagaggagacccaggactccaagaaggcaaaaagtctgcacctagtccccacagt

SEQ ID NO: 14216 - DNA, 201 bp, Homo sapiens
ctctctcctgtccactcctgtccaccccatcctgccaccctgggctgcccagttcctctactgtcctgcccacctgtgggcccttgagctctaatctgccrtgcttttggttttttactgaaaccctgccttctgtgctagattttactctggtgctcaccattaatctttctctcagtgcaggtggtgaagacctaaagc

SEQ ID NO: 14217 - DNA, 201 bp, Homo sapiens
gctctcctgctggcactggcgtgctacctccagctgcagccccaagctagccagggactcctgggtctgctgcagctcctgctccagctgctgggccaccytgctcagctgctgccgctctgcctcccctaaaaggagggggtgctgggtcaggcctctcccagcaccctagacactgggtttttcctcatcctctccacc

SEQ ID NO: 14218 - DNA, 201 bp, Homo sapiens
gaactggctattgtctctaaaggatattgaggtggccgaataaaggcatttctttgtttgggaagggtgggcaaacaccaaccagaaaaatagaaaattasgtgccaaagtgagtgacctcaaaggaatacattgaatataagagggggctgggcacagtggctcacgccggtaatcccagcactttgggaggctgaggtg

SEQ ID NO: 14219 - DNA, 201 bp, Homo sapiens
gctactctctcctgtccactcctgtccaccccatcctgccaccctgggctgcccagttcctctactgtcctgcccacctgtgggcccttgagctctaatcygccatgcttttggttttttactgaaaccctgccttctgtgctagattttactctggtgctcaccattaatctttctctcagtgcaggtggtgaagaccta

SEQ ID NO: 14220 - DNA, 201 bp, Homo sapiens
ctggccacatggagcaagtttaaccaccaaagatttggagctttaattttaattaattgtaatgatgtggttggccacgtgcagctagtggctgccatctrgtcttgctcttgacttgctagtgacactcagaatgggagtgggaggaaagaggggctgagggagctgtggagagaggaagggataggacagggtcccctg

SEQ ID NO: 14221 - DNA, 201 bp, Homo sapiens
aaggcagcggaacagtggaatctgtggcttcttcttttccaacacaaacttcccctgaccagccagaggtagcaaagtttgtcttgttttctttctcacaktcctcctggctgccatcagaacttggccaagacagccaggctggaggaggcacagtctctcctggcctcctgccaggtctccagccgcccacgtggactg

SEQ ID NO: 14222 - DNA, 201 bp, Homo sapiens
agaggtgcaggcacaaatgtgagacagagataccatttaaagtgatgctgctcggctgggcacggtggctcacgcttgtaatcccagcactatgggaggcygatgcgggcggatcacttgaggccaggagttcgagatcagcctggccaacatggcgaaaccccgtctctaccaaaaatacaaaaaaattagccaggcgtg

SEQ ID NO: 14223 - DNA, 201 bp, Homo sapiens
ggggagaaggcagcggaacagtggaatctgtggcttcttcttttccaacacaaacttcccctgaccagccagaggtagcaaagtttgtcttgttttctttstcacagtcctcctggctgccatcagaacttggccaagacagccaggctggaggaggcacagtctctcctggcctcctgccaggtctccagccgcccacgt

SEQ ID NO: 14224 - DNA, 201 bp, Homo sapiens
ccactcgattgggaactggagctgctgctgaaggagccggtgcctggtggggagcaggggctctgggaagcactgccgcagggatggtagggtgaaccggmgctgctggaaatgctagaactgctggggactcgagaactggagggagagcagggtcccttggagcccgtggagccgcctccacagagctggaccccacca

SEQ ID NO: 14225 - DNA, 201 bp, Homo sapiens
gctgctctttccgaacatcatttcctcttgtgggcctccctagactctcaggcttggctccctggaggacctgggcaaggagggagggggcactggggtartgaggggagtggcagagggcagggaggagtggactagaaggtgctgggccgtcccagggtgtgaggggagaaggcagcggaacagtggaatctgtggctt

SEQ ID NO: 14226 - DNA, 201 bp, Homo sapiens
tgtcttctgctcccttcctgccttgtatagaggtgcaggcacaaatgtgagacagagataccatttaaagtgatgctgctcggctgggcacggtggctcaygcttgtaatcccagcactatgggaggccgatgcgggcggatcacttgaggccaggagttcgagatcagcctggccaacatggcgaaaccccgtctctacc

SEQ ID NO: 14227 - DNA, 201 bp, Homo sapiens
tttgactttgctttatttggtaaaggggaagaggaaggtataacttcttcaggcgtcagaggtgctctgagagcatttcaggggtttcccagttgagaagstgatgggggtgttactcaatggaccatttcaacacagtagagggaattgtaaggggtggtgatctggctgaggggcactgtggtggaatgggaatttaaa

SEQ ID NO: 14228 - DNA, 201 bp, Homo sapiens
tccctgcctggtccgctaccccacagtaaggaacaccttattatgcaatggcgtgatctcatctgttccctccagggctcacgcagaaaccttcgttacaytcctccaccatccacctgcaagcccctccacaccctgtccaaacccagcccatcatcctgagccaccatctcccctgagcctccccaacacccttctaat

SEQ ID NO: 14229 - DNA, 201 bp, Homo sapiens; identical to SEQ ID NO: 2845

SEQ ID NO: 14230 - DNA, 201 bp, Homo sapiens
  misc_feature (1)...(201): n = A,T,C or G, or insertion/deletion polymorphism (see Tables 1-2)
gcactgaaagctccccctggggcttcgtgctttcctgggcacttcccttcccccatgggatccaggcatcctgctctccaccatgtccttcttcaggcatncaggggacctccaagcaatgatatccaaggaattccatctggcagccacccaggatgactgcagaaaaggaaggacacaggaggatatcctggttccctc

SEQ ID NO: 14231 - DNA, 201 bp, Homo sapiens
agggttgggaggcaggatgcctgcgctgggggaggaggtgcctttcaaacctgggatgcagctgggacagtgtcagctactaccccagcctccccactcayccccgcactgaaagctccccctggggcttcgtgctttcctgggcacttcccttcccccatgggatccaggcatcctgctctccaccatgtccttcttcag

SEQ ID NO: 14232 - DNA, 201 bp, Homo sapiens
ccctggagcagtcaatacccacttggcatctccgtaatcacagagatgtccaccttcatcccttgcaactattggaagccaaagaatgggagcaaaccacrcgatgggcgttgggaagcaccgtaattacagggttgggaggcaggatgcctgcgctgggggaggaggtgcctttcaaacctgggatgcagctgggacagt

SEQ ID NO: 14233 - DNA, 201 bp, Homo sapiens
gcaaaccatttctggtgagagccaaatgcaccttctgcaccatgtcccccacccaatgtgtccagaaagccatttctggtgagccagatgcaccttctgcrtcccctgaattcctgtccccaaccccatgcgtccagttcacctccgccatcttgagtatccctcatcaccccaaactgcagtccctgcctctgttcccac

SEQ ID NO: 14234 - DNA, 201 bp, Homo sapiens
ccacgttaatcctgaccgactttgccacatggagccagcaaaccatttctggtgagagccaaatgcaccttctgcaccatgtcccccacccaatgtgtccwgaaagccatttctggtgagccagatgcaccttctgcatcccctgaattcctgtccccaaccccatgcgtccagttcacctccgccatcttgagtatccct

SEQ ID NO: 14235 - DNA, 201 bp, Homo sapiens
ttgacccactttaaactgaccagacttctccaaataagctccatccacccctggttggggtaccccactagctttgtcctcaggccaacctgcaacccaargtgggttacaccttggcccccaggcacacagaccccagctttacaaggaccccagctccttaacacagatcccagctccgaggaaactcgtcccccccac

SEQ ID NO: 14236 - DNA, 201 bp, Homo sapiens
ctcaggggcaggaggccaggggttttctgggggctggggtcctgccggccaagggtcgtcaggccggggaggttgaggaggatccgttctaggcggttcakggggccagactccagtttcaggcaggtctctccagggacgactggggcgggtaggcggaggatcttcaaagagagggggtgcccctggccaagggtcacc

SEQ ID NO: 14237 - DNA, 201 bp, Homo sapiens
cacgtccctcctcctggctactctctcctgtccactcctgtccaccccatcctgccaccctgggctgcccagttcctctactgtcctgcccacctgtgggyccttgagctctaatctgccatgcttttggttttttactgaaaccctgccttctgtgctagattttactctggtgctcaccattaatctttctctcagtgc

SEQ ID NO: 14238 - DNA, 201 bp, Homo sapiens
acggctttgaatgatcacaaagggggctgaagcatggcgtgctgtagtcccagctacccaggaggtggaggtgggaggaatccgaggccagctggggcaasttgagggactccataaagaggaggcttggggcacgagatccaccatgtactgactgcctgctgcaggcggacacggtgcctgggtatttaacatgagttg

SEQ ID NO: 14239 - DNA, 201 bp, Homo sapiens
ggacacggtgcctgggtatttaacatgagttgtcttgttcaatcttcacaacagccctacagggtaagtgctttttccccctgtttcacagatgagaaaamtaagttgaaattatttgtccaaaccagctgctaacaagcaaaaatgtttgaaaaagattcaaacccaggcctgttggacttccaggcccacatagatcct

SEQ ID NO: 14240 - DNA, 201 bp, Homo sapiens
gccatcatcccgtgcccacccacacgccccatccagggtgcccgagacgagcccatctcgggctgcacggcctcctgactgatggcagctcgaggacaccygggtcctttatgccagagctggacattccctgggcaggagtcactgtggggagaggaggagaggtggagggggtgggtgccccgggggaagttggtgtgg

SEQ ID NO: 14241 - DNA, 201 bp, Homo sapiens
aaaagaatggaagaatgtgtccaggctgtgcttcccctttctaccttactcagggacatggtgccctcctctctggtttcctgccctgtgcccaccccccrccccctgcaagcacagctcttatgtgcaaagcccctgtaggtgctggagggattcactgatggccttggcggaggtggcagtgggcatgtgcacttggct

SEQ ID NO: 14242 - DNA, 201 bp, Homo sapiens
ttttaatctctccttctctgccttcctgttgggaataccccctcacttctgtggcttctttcctgtagtagacgatcaagggtggaatctacagtccatgrgccctgacttcttgccttcgtctcaaatagactctgcagccagccatctatgcagcgccccagtggctttgaaatgcaacagaaaccatcacccccggac

SEQ ID NO: 14243 - DNA, 201 bp, Homo sapiens
ggagcagtcaatacccacttggcatctccgtaatcacagagatgtccaccttcatcccttgcaactattggaagccaaagaatgggagcaaaccacacgaygggcgttgggaagcaccgtaattacagggttgggaggcaggatgcctgcgctgggggaggaggtgcctttcaaacctgggatgcagctgggacagtgtca

SEQ ID NO: 14244 - DNA, 201 bp, Homo sapiens
agcagcagtgccatcatcccgtgcccacccacacgccccatccagggtgcccgagacgagcccatctcgggctgcacggcctcctgactgatggcagctcraggacacctgggtcctttatgccagagctggacattccctgggcaggagtcactgtggggagaggaggagaggtggagggggtgggtgccccgggggaag

SEQ ID NO: 14245 - DNA, 201 bp, Homo sapiens
cacttgaacccgggaggtagaggttgcagtgagctgagatcgcaccactgcactccagcctgggcgacaagagcgaaactctgtctcaaaaaaacacacayacacacacacgtttgggaccatccctatttcctcgctctgcctaagctgcgtcacaccattcatcactaggtgacatcctactacagataccttgtaagc

SEQ ID NO: 14246 - DNA, 201 bp, Homo sapiens
tcccgagtagctgggactacaggcgcccgccaccactcccggctaattttttttgtatttttagtagagacggggtttcaccgtggtctcgatctcctgayctcgcgatccgcccacctcggcctcccaaagtgctgggattacaagcgtgagccactgcgcctggcaacctggccaaatgttaaacattttttttgtaga

SEQ ID NO: 14247 - DNA, 201 bp, Homo sapiens
gtgagctgtgatcgtgccactgtactccagcctgggcaacagagtgagaactgtctcaaaaataaataggccaggcacagtggctcatgcctgtaatctcracactttgggaggccaaggcgggcagatcacctgaggtcaggagtttgagaccagcctggccaacatggtgaaaccctgtttctactaaaaatacaaaaa

SEQ ID NO: 14248 - DNA, 201 bp, Homo sapiens
actttgaggggaaaataataaccttatgtcttaacacttccttcttcctggaaggccctatccaccctggcaaggctcaccggccttggcatgctccctcygagcctcgttcagcctcctctctgtgtctgagagttgctcccgcagccgagtttccacttcagccaccttttcttgcagggctggggtgaaagtgcagac

SEQ ID NO: 14249 - DNA, 201 bp, Homo sapiens
ccatctgtccaggatccagggacagcagggagcctgctccaacctctgagggtgccccagtgtctccctcacccagggaatcatctgggcactgagggaartggccacaggaaggggctgagataagggccttgagaggcaatgggtgtgttggggacggtgatctaggagggcgtggtgagctctgtaatggagggtggg

SEQ ID NO: 14250 - DNA, 201 bp, Homo sapiens
gggccagtcgctgcccctcctccttccgggcctcctcctgcagacgcctgagttcctggctccgctccttttcctgggcggctctgcgctgaatctggcgyaaggagaccactacagagaggccaaggcacagaggaggcaggtgtgagtcaggccagaggcagccaggcaccatgaagacaggaacaaacgctgggtcac

SEQ ID NO: 14251 - DNA, 201 bp, Homo sapiens
agcgccgggccagtcgctgcccctcctccttccgggcctcctcctgcagacgcctgagttcctggctccgctccttttcctgggcggctctgcgctgaatmtggcgcaaggagaccactacagagaggccaaggcacagaggaggcaggtgtgagtcaggccagaggcagccaggcaccatgaagacaggaacaaacgctg

SEQ ID NO: 14252 - DNA, 201 bp, Homo sapiens
acagtttactgagccatctgtccaggatccagggacagcagggagcctgctccaacctctgagggtgccccagtgtctccctcacccagggaatcatctgrgcactgagggaaatggccacaggaaggggctgagataagggccttgagaggcaatgggtgtgttggggacggtgatctaggagggcgtggtgagctctgt

SEQ ID NO: 14253 - DNA, 201 bp, Homo sapiens
agaggagacccaggactccaagaaggcaaaaagtctgcacctagtccccacagtttactgagccatctgtccaggatccagggacagcagggagcctgctycaacctctgagggtgccccagtgtctccctcacccagggaatcatctgggcactgagggaaatggccacaggaaggggctgagataagggccttgagagg

SEQ ID NO: 14254 - DNA, 201 bp, Homo sapiens
cgctgcttcacctgcagcaagactgtgggcaacacgtgggaggcctacctggggctgctgcagtccaagtacgctgatggggacgccctgggcctgaagcrccacagccgctgcctgccgcatgctgctggcccacgtggacctgatgcggaaactgctcaattatgccctcctggggaagtgacctggttagacccaccc

SEQ ID NO: 14255 - DNA, 201 bp, Homo sapiens
agtgtcttctgctcccttcctgccttgtatagaggtgcaggcacaaatgtgagacagagataccatttaaagtgatgctgctcggctgggcacggtggctyacgcttgtaatcccagcactatgggaggccgatgcgggcggatcacttgaggccaggagttcgagatcagcctggccaacatggcgaaaccccgtctcta

SEQ ID NO: 14256 - DNA, 201 bp, Homo sapiens
tttcgcaaggtttttgtgaacatcaaatgggaaattatcaaaaaggttaaatgggacaaggggtgcagtcccccagtaggaagcccagcaaatggagccckgcaggtgctcctgtcttcatccttccactgggggagacaaataggccagcttcacccccacagccccaggctccctttcctgagtctccagcccagccaa

SEQ ID NO: 14257 - DNA, 201 bp, Homo sapiens
attccctctacctcctgaccgccctttaagttcagaccagcaggaggatggaaatgtttcctgtctgtgctgtccgatacggtagccactggccacatggrgcaagtttaaccaccaaagatttggagctttaattttaattaattgtaatgatgtggttggccacgtgcagctagtggctgccatctagtcttgctcttg

SEQ ID NO: 14258 - DNA, 201 bp, Homo sapiens
atagttcctgccgccggccaccaggtggcagaagggaacacagtaccatagccctgccccagcgatcgcgcgggcaggaagaccgggtgggaggtaggtgsggccgaggcctggaggcgaggtaggagagtaggcttaggctgtcagaggaaaaaacgggcgatgtgaggactaagtatggatctcaggaggggacaggaa

SEQ ID NO: 14259 - DNA, 201 bp, Homo sapiens
tgggccccttgggctggtctctcccattccctctacctcctgaccgccctttaagttcagaccagcaggaggatggaaatgtttcctgtctgtgctgtccsatacggtagccactggccacatggagcaagtttaaccaccaaagatttggagctttaattttaattaattgtaatgatgtggttggccacgtgcagctag

SEQ ID NO: 14260 - DNA, 201 bp, Homo sapiens
aagaaaacatgatttttatttttccgtttcatggaagcagcagctgtctactgatagttcctgccgccggccaccaggtggcagaagggaacacagtaccrtagccctgccccagcgatcgcgcgggcaggaagaccgggtgggaggtaggtggggccgaggcctggaggcgaggtaggagagtaggcttaggctgtcaga

SEQ ID NO: 14261 - DNA, 201 bp, Homo sapiens
attgcgttggcctccctcctgctctggcccctgccccgccccagccaattaattgctcactagtattgcgggagtatcagtatcggagggaggtgcctgcragtccagcaagctgccctctcctcccccaggcctcagacacccctgctcccctcacccaaactcacttcccaaacctcatctcctcacaaaggcagctct

SEQ ID NO: 14262 - DNA, 201 bp, Homo sapiens
ataggcggggctgttgggagtgatttagcactctgggagtccgtaggcacaaaaatggtaaaggggttcaagaagaaatgcgtagaacacagtccctgccycacaaggttcatggcctgggaagggaagacagacatgaataaatcattgccatagggtgactggggtgaagggcgttgggggtcgggtggggtgcgggaa

SEQ ID NO: 14263 - DNA, 201 bp, Homo sapiens
cattgcgttggcctccctcctgctctggcccctgccccgccccagccaattaattgctcactagtattgcgggagtatcagtatcggagggaggtgcctgsaagtccagcaagctgccctctcctcccccaggcctcagacacccctgctcccctcacccaaactcacttcccaaacctcatctcctcacaaaggcagctc

SEQ ID NO: 14264 - DNA, 201 bp, Homo sapiens
ggtggcgggggtgggggggggtgctgggagccagggctcagccaggggaggggcctgggctgatgacctctgtcaaagctgggccttggttactcacaggscactcacagcccctccccatggctggtaacccagacctcaagggtgagcaagaggctaagaaggctaattgggaaggtggtggccccgtagcccatctgc

SEQ ID NO: 14265 - DNA, 201 bp, Homo sapiens
aaccaaaactaggaatattcacaaggattaaacataaaaagttggtcaggcgcggtggctcgtgcctgtaatctcagcactttgggaggccaagatgggcygatcacttgagctctggagtttgagacaagcccgggcaacacggtaaaaccccatctctaaaaacgaaacaaaactaaactaaacaaatacaaaaaatta

SEQ ID NO: 14266 - DNA, 201 bp, Homo sapiens
attacaggcatgagccacctcgcccagccccttgcacatttttaagtcaacatttaacatttgtaataatttaatagcattccaaagggtaggcttttcarggaattgcaaatacatgttaaaaatcacatcactatttatgtatttatttatttatttattatttttgagatggagtctcactctgtctcccaggctgga

SEQ ID NO: 14267 - DNA, 201 bp, Homo sapiens
tctcttctgtctagtccaaagacatcattcgctgcccaaggctcagggctgtgcctggtgctttctcaaggtaacttagcttgtataattagattttaccrtgatactagttctaggttctttttttttcattggccaagcatttaataactatctgtcatgtccaaggttctgggctattgttctgtaaatctgtgatcc

SEQ ID NO: 14268 - DNA, 201 bp, Homo sapiens
aggccaaggcgggcagatcacctgaggtcaggagtttgagaccagcctggccaacatggtgaaaccctgtttctactaaaaatacaaaaattagctgggcrtagtggcgcatgcctgtaatcccagctactcaggaagcagaggcaggagaatcgcttgaactcaggaggcggagattgcagtgggccgagatcacaccac

SEQ ID NO: 14269 - DNA, 201 bp, Homo sapiens
atttaaacttgcctgtaaattctgtctctctcaattttaagttctgagtagaaactacatatttttattatttatattcttatattctcccatggcacccrgcattcgtggacacattgaggaagtaagataatgaatgaatgaatgggtgaatccagtccagcttggggcctatttaattctactaggctcaacctacaa

SEQ ID NO: 14270 - DNA, 201 bp, Homo sapiens
ccaccacgcctgatctcatgtgtagttttttggttttttatttgtttgtttttttgagatggagtctcgctctgtcgcccaggctggagtgcagtggcacratctcggctcactgcaagctccacctcccaggttcacgccattctcctgtctcagcctcccgagtagctgggactacaggcgccggccaccatgcccagc

SEQ ID NO: 14271 - DNA, 201 bp, Homo sapiens
gattttgccactcgattgggaactggagctgctgctgaaggagccggtgcctggtggggagcaggggctctgggaagcactgccgcagggatggtagggtraaccggagctgctggaaatgctagaactgctggggactcgagaactggagggagagcagggtcccttggagcccgtggagccgcctccacagagctggac

SEQ ID NO: 14272 - DNA, 201 bp, Homo sapiens
catcggggcccccagtcagtgtcaaggaggagacagacatgcaagggtgaccagaagagctggacttgctgccacaaggctgaaggatgattttgccactsgattgggaactggagctgctgctgaaggagccggtgcctggtggggagcaggggctctgggaagcactgccgcagggatggtagggtgaaccggagctgc

SEQ ID NO: 14273 - DNA, 201 bp, Homo sapiens
agcctcctacctggcaggaggagaccagccagcagcagtgccatcatcccgtgcccacccacacgccccatccagggtgcccgagacgagcccatctcggrctgcacggcctcctgactgatggcagctcgaggacacctgggtcctttatgccagagctggacattccctgggcaggagtcactgtggggagaggaggag

SEQ ID NO: 14274 - DNA, 201 bp, Homo sapiens
accactcttttgggaaggagggaaactgagctaaccctatgcctgggcactggccttctcccatatgggatatagtgtatgtgcttgtttgtgcccaaggyatgcacacacacaacagttgacttatggactgtcgagtaactctccttggggtaggaaaacttcagggtcagctagctggggccccagaggcttcacttg

SEQ ID NO: 14275 - DNA, 201 bp, Homo sapiens
cgagaccagcctggccaacatggcaaaatcccatctctactaaaaatagaaaacttatctgggtgtggtggcacacacctgtaatcccagctactcgggargttgaggcaggagaatcacttgaatccaggaggcgaagcttgcagtgagctgatatctgtcgtgccactgcactccagcctgggcgacagagagataata

SEQ ID NO: 14276 - DNA, 201 bp, Homo sapiens
tttgccactcgattgggaactggagctgctgctgaaggagccggtgcctggtggggagcaggggctctgggaagcactgccgcagggatggtagggtgaamcggagctgctggaaatgctagaactgctggggactcgagaactggagggagagcagggtcccttggagcccgtggagccgcctccacagagctggacccc

SEQ ID NO: 14277 - DNA, 201 bp, Homo sapiens
gcaggagaatcacttgaatccaggaggcgaagcttgcagtgagctgatatctgtcgtgccactgcactccagcctgggcgacagagagataatacgtctcaaaaaaaaaaaaaaagaaaagaaagaaaatgaatctcttaatgagatgggaaaggttgatttgtttcctattgacctttggcggctctgggaagggcactc

SEQ ID NO: 14278 - DNA, 201 bp, Homo sapiens
agcccgtggagccgcctccacagagctggaccccaccagtccccactggctggaacgcaatggccgaggaagctgccgactggctggggatgatggggttrctggagaagtatttgccctcagagatggggggcccagctgcaaaggaagggacccctggagagcctttcacagggttctctttggtgaagtagcccacag

SEQ ID NO: 14279 - DNA, 201 bp, Homo sapiens
agcttgcagtgagccgagatcgtgccactgtactccagcctgggcgacagagcgagacttcgtctcaaaaaaagaaaaaaacaaataaataaaaataaatraaaaagaccctaagtgttagttaaagcagcagcctagattcagaattaagaaaacatgatttttatttttccgtttcatggaagcagcagctgtctactg

SEQ ID NO: 14280 - DNA, 201 bp, Homo sapiens
gactcatgactcccagagaggatggcatctagaaggtgaggaatgctaatggtggaagaaaaggagtttgggtggggaggggaggggaggggagggagagraaacactgagggccctaaataaggggaagggggaccccacggtgaatgaggaatgggaagagaatggatttcctggagcaatgagagaggagggaaatgg

SEQ ID NO: 14281 - DNA, 201 bp, Homo sapiens
cccacttggcatctccgtaatcacagagatgtccaccttcatcccttgcaactattggaagccaaagaatgggagcaaaccacacgatgggcgttgggaascaccgtaattacagggttgggaggcaggatgcctgcgctgggggaggaggtgcctttcaaacctgggatgcagctgggacagtgtcagctactaccccag

SEQ ID NO: 14282 - DNA, 201 bp, Homo sapiens
ttggaagccaaagaatgggagcaaaccacacgatgggcgttgggaagcaccgtaattacagggttgggaggcaggatgcctgcgctgggggaggaggtgcytttcaaacctgggatgcagctgggacagtgtcagctactaccccagcctccccactcacccccgcactgaaagctccccctggggcttcgtgctttcctg

SEQ ID NO: 14283 - DNA, 201 bp, Homo sapiens
ctcctctgtgggaggagctggaaggtagaagagaaacacagcccgcttttgaaggaaaatgagggacacagagacctctagaggcgtaggaagagcaccayccagactctcagaggagacccaggactccaagaaggcaaaaagtctgcacctagtccccacagtttactgagccatctgtccaggatccagggacagcag

SEQ ID NO: 14284 - DNA, 201 bp, Homo sapiens
agacgatgggccctccactgcagggagagtcggggatgtccgaactacagggacgctggttggagctgacgctttggccactgctggataccccaaaggtytgggaagaggaagagctttgtccaggctgggaagggtttagtattccgcggtaagagttgtcattggttggcagagcagagccattccctacttggaagc

SEQ ID NO: 14285 - DNA, 201 bp, Homo sapiens
cttgaaccactccaggggcaccagaaccgtgctggtccaccaccaccaccacaggcctctgaccccctgacacagagtgggagctggggatgtaggggccrgagtgcgagacgatgggccctccactgcagggagagtcggggatgtccgaactacagggacgctggttggagctgacgctttggccactgctggataccc

SEQ ID NO: 14286 - DNA, 201 bp, Homo sapiens
agtgctggtattacaggcatgagccacctcgcccagccccttgcacatttttaagtcaacatttaacatttgtaataatttaatagcattccaaagggtakgcttttcagggaattgcaaatacatgttaaaaatcacatcactatttatgtatttatttatttatttattatttttgagatggagtctcactctgtctcc

SEQ ID NO: 14287 - DNA, 201 bp, Homo sapiens
agttttgccatgttgcctaggctggtctcaaactcctggccacaagcaatccacccgattcggcctcccgaagtgctggtattacaggcatgagccacctygcccagccccttgcacatttttaagtcaacatttaacatttgtaataatttaatagcattccaaagggtaggcttttcagggaattgcaaatacatgtta

SEQ ID NO: 14288 - DNA, 201 bp, Homo sapiens
tggagaagtatttgccctcagagatggggggcccagctgcaaaggaagggacccctggagagcctttcacagggttctctttggtgaagtagcccacaggrtagattttacccttactgtaggtcatgcctggaaccagataactgtcagaggagccacccaccacctcgtagccaccataggatttgtctacagaggtga

SEQ ID NO: 14289 - DNA, 201 bp, Homo sapiens
attttgaaaaactatgtcccttgcacatttgtattgttttgagacacggtctcactctgttgcccagactggagtgcagtggtgccatcttggctcactayagcctcaacctcccagggtcaagcaatcttcccacctcagcctcctgagtagctgggactacaggtgcgggccaccacatctggctaatttcttaaattt

SEQ ID NO: 14290 - DNA, 201 bp, Homo sapiens
  misc_feature (1)...(201): n = A,T,C or G, or insertion/deletion polymorphism (see Tables 1-2)
ctgctgctgaaggagccggtgcctggtggggagcaggggctctgggaagcactgccgcagggatggtagggtgaaccggagctgctggaaatgctagaacngctggggactcgagaactggagggagagcagggtcccttggagcccgtggagccgcctccacagagctggaccccaccagtccccactggctggaacgca

SEQ ID NO: 14291 - DNA, 201 bp, Homo sapiens
gcagtgcagtggcacgatcttggctcaccgcaacctctgcctcccaggttcaatggattctcctgcctcagcctcctgagaagctgggattacaggcgccygccaccatgcccagctaatttttttgtatttttagtagagacagggattcaccatgttggtgaggctggtctcgaactcctgacctcaggtaatccaccc

SEQ ID NO: 14292 - DNA, 201 bp, Homo sapiens
tggggcactctgccttctcagccctcacctgagagccatgttgctcacactctcactctggaccccagcagagcagggagtgtgaagatggagagaccacyggcagctctgttctgccacaggctgggcctcttgatctaggccagtgagtcaccctgcttggctgcactccctgccccgctcccatcctctcagtccttt

SEQ ID NO: 14293 - DNA, 201 bp, Homo sapiens
gggtcttgctctgtcgcccaggctgcagtgcagtggcacgatcttggctcaccgcaacctctgcctcccaggttcaatggattctcctgcctcagcctccygagaagctgggattacaggcgcccgccaccatgcccagctaatttttttgtatttttagtagagacagggattcaccatgttggtgaggctggtctcgaa

SEQ ID NO: 14294 - DNA, 201 bp, Homo sapiens
gtgttctcagattattcctaaaccctaagcttagttttgtttcattcggaccacatgtagtttttttttgttttttgttttctgagacggggtcttgctcwgtcgcccaggctgcagtgcagtggcacgatcttggctcaccgcaacctctgcctcccaggttcaatggattctcctgcctcagcctcctgagaagctggg

SEQ ID NO: 14295 - DNA, 201 bp, Homo sapiens
tccagacacactgcctgttcttctctcaggtcccgctccgggccctcctcccagaagcctcccctgactagtccagctcaccgtgactcttctgaactcayggcgtttactgccaaggctattacgttggcgctcgctcatgtcattattaggaaatatgcatttttactgtctttgatgttatttaaacttgcctgtaaa

SEQ ID NO: 14296 - DNA, 201 bp, Homo sapiens
ccttgctcccactgtttatccctccccctcacacaaagcctgtcctccaccagcaaaagaggtcttaaaatatacatcacgcgggcctggtgtggtggctygcgcctgtaatcccagcactttgggaggccgaagcgggcggatcacctgaggtcgggagttcaagaccagcctgaccaacatggagaaaccccgtctcta

SEQ ID NO: 14297 - DNA, 201 bp, Homo sapiens
gacatcattcgctgcccaaggctcagggctgtgcctggtgctttctcaaggtaacttagcttgtataattagattttaccgtgatactagttctaggttctttttttttcattggccaagcatttaataactatctgtcatgtccaaggttctgggctattgttctgtaaatctgtgatcctattctgttatttaattccg

SEQ ID NO: 14298 - DNA, 201 bp, Homo sapiens
tctcttagctggacatggtggcacatgcctgtggtcccagctactcaggacgctgtggtaggaggatcccttgagcccaggaggtcaaggctgcagtgagytgtaactgcacctctgcactgtccagcctgggcgacagagcaagaacctgtctcaaaaaataaaaaattaattaattaattaattttttttcctcctaac

SEQ ID NO: 14299 - DNA, 201 bp, Homo sapiens
aagagttgtcattggttggcagagcagagccattccctacttggaagctgctgctgctgaactgaaagctgctgctgctgctcgaatgagagctgctgctkcccgagtgagagccgctgcttcccgagtgagagctgctgctccccagctgggaggaaccggatgcaccttgtagactagagccagatccggaggagtagc

SEQ ID NO: 14300 - DNA, 201 bp, Homo sapiens
tcgctgggtcctctcccggagtctccctcccgcctccctcctgttcccagggcccccagcctcctacctggcaggaggagaccagccagcagcagtgccawcatcccgtgcccacccacacgccccatccagggtgcccgagacgagcccatctcgggctgcacggcctcctgactgatggcagctcgaggacacctgggt

SEQ ID NO: 14301 - DNA, 201 bp, Homo sapiens
tggggtccttacaggggtctgagaaggtgccaatgctcttagccaaggtccctgtggaggaaagcagtggttagtaagggccaaggaggcttggcttcctycctcacctttctgccttatctcagtaatcggcctctcgggtttctcccaagcagagcgcagggagagtttagggatggagaaaggaggaagaactggcta

SEQ ID NO: 14302 - DNA, 201 bp, Homo sapiens
ctggagccaccaccagagcttctggcactggaaatggagctgccagaactgctggagccactgtagctactgaagccgctggagtcacccttcccagtgargcaggggtcgttaggggaggtgatacgcgtggggtccttacaggggtctgagaaggtgccaatgctcttagccaaggtccctgtggaggaaagcagtggt

SEQ ID NO: 14303 - DNA, 201 bp, Homo sapiens
gagaagaggaaggaggaaggggtgataagagagagtctgcaaccttagggtagtagagaaagcagaaccactcttttgggaaggagggaaactgagctaaccctatgcctgggcactggccttctcccatatgggatatagtgtatgtgcttgtttgtgcccaaggcatgcacacacacaacagttgacttatggactgtc

SEQ ID NO: 14304 - DNA, 201 bp, Homo sapiens
ttgaggatcatggctatgtactggcccccaaagctggggtgggctgagtctgggtgcctgggaaccccaagaggctttataggggaggagtggaggagggrccagcccagtggcacaggaataccatcagaacagaactggtcaaacccgttgggaaggcctgggctgatgtgtcacccctgaaggtggcgtcccttattt

SEQ ID NO: 14305 - DNA, 201 bp, Homo sapiens
caggccaacctgcaacccaaggtgggttacaccttggcccccaggcacacagaccccagctttacaaggaccccagctccttaacacagatcccagctccraggaaactcgtcccccccacgttaatcctgaccgactttgccacatggagccagcaaaccatttctggtgagagccaaatgcaccttctgcaccatgtcc

SEQ ID NO: 14306 - DNA, 201 bp, Homo sapiens
ttgggtttccctctatcgtgctctagccccactgcaacctagggcttggaggattagggaagccagctgggatgttccaagaagagccaggagggcggagractccaggaggaaatgggttattgatacctgggtatagatgaatattcccccagctgcctcctggataccgattaatattcccccagctgcctcctggat

SEQ ID NO: 14307 - DNA, 201 bp, Homo sapiens
tgtaatcccagctactcaggaagcagaggcaggagaatcgcttgaactcaggaggcggagattgcagtgggccgagatcacaccactgcattccagtctgsgcaacgagagggagactccgtctcaaaaattgaataaataaataaataaaagtaatgaggggactgggcatgatggctcacacctgtaatcccagtgctt

SEQ ID NO: 14308 - DNA, 201 bp, Homo sapiens
tgcatcctaggttggattccccagaagcaggccctgagacaaagattcaagtaaaagagatttatttaaaactaatgagaagttgggcagggtggctcacrcctataatcccaacactttgagaggcggaggcaggagggtttcttgagctcaggagtttgagaccaggttgggcaatatagtaagacccaatctctacaa

SEQ ID NO: 14309 - DNA, 201 bp, Homo sapiens
gtcccctgtgtgaccttgcatgggtcactgtacctctctaggcctgtttctgtcttctgtgaaatgatcatgatagcattgttatgcaaattaaacgagarcttaagctgtagagcatttaccaacagtgccctatggcacatgcgcagtagaaagtagttgcaatagtgtgtagcaaatactttgcatcctaggttggat

SEQ ID NO: 14310 - DNA, 201 bp, Homo sapiens
tcagtatcggagggaggtgcctgcaagtccagcaagctgccctctcctcccccaggcctcagacacccctgctcccctcacccaaactcacttcccaaacytcatctcctcacaaaggcagctctgtccctgggccccttgggctggtctctcccattccctctacctcctgaccgccctttaagttcagaccagcaggag

SEQ ID NO: 14311 - DNA, 201 bp, Homo sapiens
atagctgggattacaggtgcgccctaccatgttcagctaacttattttgtttgttcagagacagggtcttgttatgttgcccaggcccaggcacagttctratagaggagagagactttcagatatgagctcctgcacttggcaccaagatcttccctaattttcccccgacctgtctctccaacatgtctctctcttctt

SEQ ID NO: 14312 - DNA, 201 bp, Homo sapiens
attgtcttcctcctctgtgggaggagctggaaggtagaagagaaacacagcccgcttttgaaggaaaatgagggacacagagacctctagaggcgtaggargagcaccacccagactctcagaggagacccaggactccaagaaggcaaaaagtctgcacctagtccccacagtttactgagccatctgtccaggatccag

SEQ ID NO: 14313 - DNA, 201 bp, Homo sapiens
tacctcagcctcccgagtagctgggactacaggcgcccgccaccactcccggctaattttttttgtatttttagtagagacggggtttcaccgtggtctcsatctcctgacctcgcgatccgcccacctcggcctcccaaagtgctgggattacaagcgtgagccactgcgcctggcaacctggccaaatgttaaacattt

SEQ ID NO: 14314 - DNA, 201 bp, Homo sapiens
agctggacatggtggcacatgcctgtggtcccagctactcaggacgctgtggtaggaggatcccttgagcccaggaggtcaaggctgcagtgagctgtaaytgcacctctgcactgtccagcctgggcgacagagcaagaacctgtctcaaaaaataaaaaattaattaattaattaattttttttcctcctaactaattc

SEQ ID NO: 14315 - DNA, 201 bp, Homo sapiens
ttttttgagatggagtctcactctgtcgtccaggctggagtgcagtggtgcgacctcggctcactgcaacgtccgcctcccgggttcacgccattctcctrcctcagcctcccgagtagctgggactacaggcgcccgccaccactcccggctaattttttttgtatttttagtagagacggggtttcaccgtggtctcga

SEQ ID NO: 14316 - DNA, 201 bp, Homo sapiens
ccattctcctacctcagcctcccgagtagctgggactacaggcgcccgccaccactcccggctaattttttttgtatttttagtagagacggggtttcacygtggtctcgatctcctgacctcgcgatccgcccacctcggcctcccaaagtgctgggattacaagcgtgagccactgcgcctggcaacctggccaaatgt

SEQ ID NO: 14317 - DNA, 201 bp, Homo sapiens
ggggacagggcttgcctggaaggccaccattgctacaggggggaccttgaaccactccaggggcaccagaaccgtgctggtccaccaccaccaccacaggyctctgaccccctgacacagagtgggagctggggatgtaggggccagagtgcgagacgatgggccctccactgcagggagagtcggggatgtccgaactac

SEQ ID NO: 14318 - DNA, 201 bp, Homo sapiens
ttactttacagttttggagatcagaagtctaaaacaggtctcagtggattaaaataaaggtgtcagcagggctgtgattctttctgggggcctcaggggaraatccctttccccgctttttcaccttctagaggcatcctgtgttctttggctcatggtccccttcctccatctccaaagccaaaatcagccatttcttac

SEQ ID NO: 14319 - DNA, 201 bp, Homo sapiens
aaattttttttaaaaagaagagggaatggagaaggggcaggaacaaataggtctaaaagaaaggaccctgaagagacagagaattggggaaactgaggctmtgaggagtccaggcgtaaattcttaggggaaaaatcctgggccagacagtgggaccagagggaagaagacaaaaggcaaaacaatggagggctgagaagt

SEQ ID NO: 14320 - DNA, 201 bp, Homo sapiens
tggtcaaacccgttgggaaggcctgggctgatgtgtcacccctgaaggtggcgtcccttattttagtcctccagcccaggacccagctgcctgctctcccyatcatgacccagagcctgcgtcaccccaccctggttttcacaccctccatccacaccctggagcagtcaatacccacttggcatctccgtaatcacagag

SEQ ID NO: 14321 - DNA, 201 bp, Homo sapiens
tgagctcctgcacttggcaccaagatcttccctaattttcccccgacctgtctctccaacatgtctctctcttcttcgggttattttactccaatcattcygatctactctttgttaattgggcccttcattaaataatttagcctttcacaaaacacacattaagtgtgcatgacggcccaggcactgtattctctgtca

SEQ ID NO: 14322 - DNA, 201 bp, Homo sapiens
agaagagaaacacagcccgcttttgaaggaaaatgagggacacagagacctctagaggcgtaggaagagcaccacccagactctcagaggagacccaggaytccaagaaggcaaaaagtctgcacctagtccccacagtttactgagccatctgtccaggatccagggacagcagggagcctgctccaacctctgagggtg

SEQ ID NO: 14323 - DNA, 201 bp, Homo sapiens
agaggcgtaggaagagcaccacccagactctcagaggagacccaggactccaagaaggcaaaaagtctgcacctagtccccacagtttactgagccatctktccaggatccagggacagcagggagcctgctccaacctctgagggtgccccagtgtctccctcacccagggaatcatctgggcactgagggaaatggcca

SEQ ID NO: 14324 - DNA, 201 bp, Homo sapiens
ttggcatctccgtaatcacagagatgtccaccttcatcccttgcaactattggaagccaaagaatgggagcaaaccacacgatgggcgttgggaagcaccrtaattacagggttgggaggcaggatgcctgcgctgggggaggaggtgcctttcaaacctgggatgcagctgggacagtgtcagctactaccccagcctcc

SEQ ID NO: 14325 - DNA, 201 bp, Homo sapiens
tggcccctgccccgccccagccaattaattgctcactagtattgcgggagtatcagtatcggagggaggtgcctgcaagtccagcaagctgccctctcctcccccaggcctcagacacccctgctcccctcacccaaactcacttcccaaacctcatctcctcacaaaggcagctctgtccctgggccccttgggctggtc

SEQ ID NO: 14326 - DNA, 201 bp, Homo sapiens
catccaggcccactcagtctcctccccagctaatgaagacagcctgtttgagtgccaaaatccactgcctattaataggtactaaaatctccaattgcctyatgcctcccccttctctttcccactcacctacctgccatgtcagcctgggaagaattggtttgcagccaggcagtcctccatccagtcttgactttggca

SEQ ID NO: 14327 - DNA, 201 bp, Homo sapiens
ctcctgaccgccctttaagttcagaccagcaggaggatggaaatgtttcctgtctgtgctgtccgatacggtagccactggccacatggagcaagtttaaycaccaaagatttggagctttaattttaattaattgtaatgatgtggttggccacgtgcagctagtggctgccatctagtcttgctcttgacttgctagtg

SEQ ID NO: 14328 - DNA, 201 bp, Homo sapiens
gacagagcgagacttcgtctcaaaaaaagaaaaaaacaaataaataaaaataaatgaaaaagaccctaagtgttagttaaagcagcagcctagattcagarttaagaaaacatgatttttatttttccgtttcatggaagcagcagctgtctactgatagttcctgccgccggccaccaggtggcagaagggaacacagta

SEQ ID NO: 14329 - DNA, 201 bp, Homo sapiens
cctcccagggtcaagcaatcttcccacctcagcctcctgagtagctgggactacaggtgcgggccaccacatctggctaatttcttaaattttctgtagaracagttttgccatgttgcctaggctggtctcaaactcctggccacaagcaatccacccgattcggcctcccgaagtgctggtattacaggcatgagccac

SEQ ID NO: 14330 - DNA, 201 bp, Homo sapiens
aactgcacctctgcactgtccagcctgggcgacagagcaagaacctgtctcaaaaaataaaaaattaattaattaattaattttttttcctcctaactaaytccacgttattggcttgagggtcagtttgaggggtccagacctccttcttcctttctatccttagcttcctgccacagtatacccagagatgtatgtgtt

SEQ ID NO: 14331 - DNA, 201 bp, Homo sapiens
gcagctcgaggacacctgggtcctttatgccagagctggacattccctgggcaggagtcactgtggggagaggaggagaggtggagggggtgggtgccccrggggaagttggtgtggccgggaggagcgtggtaatcagcccggtgcatctgcctactcagcagcagcagtggctgcagtgtggggtacccatggccacgg

SEQ ID NO: 14332 - DNA, 201 bp, Homo sapiens
aggacgctgtggtaggaggatcccttgagcccaggaggtcaaggctgcagtgagctgtaactgcacctctgcactgtccagcctgggcgacagagcaagamcctgtctcaaaaaataaaaaattaattaattaattaattttttttcctcctaactaattccacgttattggcttgagggtcagtttgaggggtccagacc

SEQ ID NO: 14333 - DNA, 201 bp, Homo sapiens
agaattggtttgcagccaggcagtcctccatccagtcttgactttggcacttgtgatatgacttgcacaggtgagttacctctctcagtgttggttcctcktctgtgaaatggggctaatcatttgctttattgagtgccttctaggctgggtactaggagagaaggaagggatacaaagaaagacaaggcacagttgctg

SEQ ID NO: 14334 - DNA, 201 bp, Homo sapiens
tccctggggcatttactcctaggtgagcttagccaaggcaggtagagaggaaccagcattgtctaatctgaatggataagccagcacaatgggtttccctstgcaaatacctccataccatccaggcccactcagtctcctccccagctaatgaagacagcctgtttgagtgccaaaatccactgcctattaataggtact

SEQ ID NO: 14335 - DNA, 201 bp, Homo sapiens
tttttttttcattggccaagcatttaataactatctgtcatgtccaaggttctgggctattgttctgtaaatctgtgatcctattctgttatttaattccrtgactctgtgttgacatagacgtgacggtgtccctggggcatttactcctaggtgagcttagccaaggcaggtagagaggaaccagcattgtctaatctg

SEQ ID NO: 14336 - DNA, 201 bp, Homo sapiens
tggcggaaggatctgggaggccaggcaatctctgctttcagttcaacaaatatttattgtcttcctcctctgtgggaggagctggaaggtagaagagaaayacagcccgcttttgaaggaaaatgagggacacagagacctctagaggcgtaggaagagcaccacccagactctcagaggagacccaggactccaagaagg

SEQ ID NO: 14337 - DNA, 201 bp, Homo sapiens
aaaaatttccaagtgcttccagctctctgcccctggaaaaggtcccagcagaggcataggcggggctgttgggagtgatttagcactctgggagtccgtakgcacaaaaatggtaaaggggttcaagaagaaatgcgtagaacacagtccctgccccacaaggttcatggcctgggaagggaagacagacatgaataaatc

SEQ ID NO: 14338 - DNA, 201 bp, Homo sapiens
cagctctctgcccctggaaaaggtcccagcagaggcataggcggggctgttgggagtgatttagcactctgggagtccgtaggcacaaaaatggtaaaggrgttcaagaagaaatgcgtagaacacagtccctgccccacaaggttcatggcctgggaagggaagacagacatgaataaatcattgccatagggtgactgg

SEQ ID NO: 14339 - DNA, 201 bp, Homo sapiens
gagcccggcccacctcctgctggatgaggcgggcactcagctgcagttctgcatccaggcggttccgttcttcccgcagctgctgcaactcaaggctcacrtctgtgaccggtggtggtaggggacagctgagacggggaagagaaagagtcaggagaaatcacccagctgcctgatcccaaagcccccatcccacctcag

SEQ ID NO: 14340 - DNA, 201 bp, Homo sapiens
tttagcactctgggagtccgtaggcacaaaaatggtaaaggggttcaagaagaaatgcgtagaacacagtccctgccccacaaggttcatggcctgggaarggaagacagacatgaataaatcattgccatagggtgactggggtgaagggcgttgggggtcgggtggggtgcgggaaggagtggtgtaggcagaggcatc

SEQ ID NO: 14341 - DNA, 201 bp, Homo sapiens
cctgaggagaaatgcagctggtttgggagaggacggccattccagacatagggaacagcacacacgaaggctgatgcacatacgcgcaagggctggtcccyagagctggtggttctggccacgagagctcatcacctgggggcagcttctgtacctgcaccctgtatgaggctccgggtctgcccttcctggtccatcctc

SEQ ID NO: 14342 - DNA, 201 bp, Homo sapiens
ctaaaaatagaaaacttatctgggtgtggtggcacacacctgtaatcccagctactcgggaggttgaggcaggagaatcacttgaatccaggaggcgaagsttgcagtgagctgatatctgtcgtgccactgcactccagcctgggcgacagagagataatacgtctcaaaaaaaaaaaaaaagaaaagaaagaaaatgaa

SEQ ID NO: 14343 - DNA, 201 bp, Homo sapiens
tagggaacagcacacacgaaggctgatgcacatacgcgcaagggctggtccctagagctggtggttctggccacgagagctcatcacctgggggcagcttytgtacctgcaccctgtatgaggctccgggtctgcccttcctggtccatcctccagacacactgcctgttcttctctcaggtcccgctccgggccctcctc

SEQ ID NO: 14344 - DNA, 201 bp, Homo sapiens
cttattttagtcctccagcccaggacccagctgcctgctctccctatcatgacccagagcctgcgtcaccccaccctggttttcacaccctccatccacaycctggagcagtcaatacccacttggcatctccgtaatcacagagatgtccaccttcatcccttgcaactattggaagccaaagaatgggagcaaaccaca

SEQ ID NO: 14345 - DNA, 201 bp, Homo sapiens
ctgctccaacctctgagggtgccccagtgtctccctcacccagggaatcatctgggcactgagggaaatggccacaggaaggggctgagataagggccttragaggcaatgggtgtgttggggacggtgatctaggagggcgtggtgagctctgtaatggagggtggggtggaattgggagcgaaagcccagtggcatatt

SEQ ID NO: 14346 - DNA, 201 bp, Homo sapiens
tcaggtcccgctccgggccctcctcccagaagcctcccctgactagtccagctcaccgtgactcttctgaactcacggcgtttactgccaaggctattacrttggcgctcgctcatgtcattattaggaaatatgcatttttactgtctttgatgttatttaaacttgcctgtaaattctgtctctctcaattttaagttc

SEQ ID NO: 14347 - DNA, 201 bp, Homo sapiens
gtgccaatgctcttagccaaggtccctgtggaggaaagcagtggttagtaagggccaaggaggcttggcttcctccctcacctttctgccttatctcagtmatcggcctctcgggtttctcccaagcagagcgcagggagagtttagggatggagaaaggaggaagaactggctattgtctctaaaggatattgaggtggc

SEQ ID NO: 14348 - DNA, 201 bp, Homo sapiens
ggggaggtgatacgcgtggggtccttacaggggtctgagaaggtgccaatgctcttagccaaggtccctgtggaggaaagcagtggttagtaagggccaargaggcttggcttcctccctcacctttctgccttatctcagtaatcggcctctcgggtttctcccaagcagagcgcagggagagtttagggatggagaaag

SEQ ID NO: 14349 - DNA, 201 bp, Homo sapiens
cagaactgctggagccactgtagctactgaagccgctggagtcacccttcccagtgaggcaggggtcgttaggggaggtgatacgcgtggggtccttacargggtctgagaaggtgccaatgctcttagccaaggtccctgtggaggaaagcagtggttagtaagggccaaggaggcttggcttcctccctcacctttctg

SEQ ID NO: 14350 - DNA, 201 bp, Homo sapiens
caggagttgagattatactgcaaaaggaaaggtggggatggggtggggactggggaatttggggagggaattgattactgcctctgaggatattagggggraaaacccacaggaggtgcatttggcttaattcagcaagttttttgagttttgattcagtgccaggcacctggtgggcacttaattaaagattagcaggag

SEQ ID NO: 14351 - DNA, 201 bp, Homo sapiens
ttggaacaagacctgagagccgctaccttggctctcagcattgcacgggagtttagaggttattaaagaaatccccctaaagtcccatcccaaggtcacayagagaacgaatggctaagtagcgacaagaacccaagtcacagtctgttgatctcactaccatgctatcctgcctgcccccatcacaggagttgagattat

SEQ ID NO: 14352 - DNA, 201 bp, Homo sapiens
ctgtagaccgctggctcatgaaataatcagggagagaatgtgtaaatgatgatcgtgaggtccacttggacaagcagcctgtgcctgaattttcctgaggrcttcagagcctgtctcgcctcgcctcacatgcctggctcaccttagaacggtcaccttgacggctaaagggacacctgtgtgccttgatggtggacccag

SEQ ID NO: 14353 - DNA, 201 bp, Homo sapiens
ctctctcctccctcactggaaggcagctccctgagggcagggccctgatccctttgactggctgtggtatcctctcctgtagaccgctggctcatgaaatwatcagggagagaatgtgtaaatgatgatcgtgaggtccacttggacaagcagcctgtgcctgaattttcctgagggcttcagagcctgtctcgcctcgcc

SEQ ID NO: 14354 - DNA, 201 bp, Homo sapiens
taagcatctgtgtatctctctcctccctcactggaaggcagctccctgagggcagggccctgatccctttgactggctgtggtatcctctcctgtagaccrctggctcatgaaataatcagggagagaatgtgtaaatgatgatcgtgaggtccacttggacaagcagcctgtgcctgaattttcctgagggcttcagagc

SEQ ID NO: 14355 - DNA, 201 bp, Homo sapiens
ggggacctccagtccctcctgcccaagggcatcacggcctccatacctgggagatgaagacagaccaggagcaggcccagaggagcgcagctccctgccaygcggccctgcatcctgctcagcacccgatctccctcagccccaagacagccagccctttatcctggtagtggggtgggggacagcagaaacaggctgggc

SEQ ID NO: 14356 - DNA, 201 bp, Homo sapiens
ccagtcttgactttggcacttgtgatatgacttgcacaggtgagttacctctctcagtgttggttcctcgtctgtgaaatggggctaatcatttgctttawtgagtgccttctaggctgggtactaggagagaaggaagggatacaaagaaagacaaggcacagttgctgtcttcaagaagctcatactttccaaggaaat

SEQ ID NO: 14357 - DNA, 201 bp, Homo sapiens
cagcggagggatcaggatggggagagccatcggggcccccagtcagtgtcaaggaggagacagacatgcaagggtgaccagaagagctggacttgctgccrcaaggctgaaggatgattttgccactcgattgggaactggagctgctgctgaaggagccggtgcctggtggggagcaggggctctgggaagcactgccgc

SEQ ID NO: 14358 - DNA, 201 bp, Homo sapiens
ccctatgcctgggcactggccttctcccatatgggatatagtgtatgtgcttgtttgtgcccaaggcatgcacacacacaacagttgacttatggactgtygagtaactctccttggggtaggaaaacttcagggtcagctagctggggccccagaggcttcacttgggctaggatatcccggatggagcggcaggggatc

SEQ ID NO: 14359 - DNA, 201 bp, Homo sapiens
gcccaggatgggccctagtgtctgcctgtctgccctcctgtctcctaccagcatgaggttcttatccctctctagctcctgcaagcgccgggccagtcgcwgcccctcctccttccgggcctcctcctgcagacgcctgagttcctggctccgctccttttcctgggcggctctgcgctgaatctggcgcaaggagaccac

SEQ ID NO: 14360 - DNA, 201 bp, Homo sapiens
ccgggcactcaggtggcagggacattttgctgttatccttcgtgggggtggacgtggaaggcccagcagtgaccgctgtccccggttggcccccaccctgycagcacctgacatgcacaccccaacctgcatgaggcccaggtgcccacctggcttccaggggtcaccttggcccggttcactgggatccaaggctctcac

SEQ ID NO: 14361 - DNA, 201 bp, Homo sapiens
ggacattttgctgttatccttcgtgggggtggacgtggaaggcccagcagtgaccgctgtccccggttggcccccaccctgtcagcacctgacatgcacaycccaacctgcatgaggcccaggtgcccacctggcttccaggggtcaccttggcccggttcactgggatccaaggctctcactccttctgggagggcccct

SEQ ID NO: 14362 - DNA, 201 bp, Homo sapiens
ggggcccctggcagcctttagcttttgcaggatgagaccgggaggctcctgtggtcttggcctttgcctgggctgctgtcttcatccctggggtggcaatrcctgcctgcatcttgacgggcctcctgtcggctgctggaggagctgggagctctgtcaggtaaagagaaaaaaacagcatgcatcaggatggcaggggga

SEQ ID NO: 14363 - DNA, 201 bp, Homo sapiens
gaggccttcagtcagcagggtcgcctcagcagcatttgggagcctgccctgcagctccctgcctccaccctgcacgctgtgcccacacccccccacaacaygtaggtgaaagcacaggcaccatgcggaggccccgagcaccccttagtggggcggggtggggggaggaagtcagtccataatgttgtagttacggatctt

SEQ ID NO: 14364 - DNA, 201 bp, Homo sapiens
tgggctgctgtcttcatccctggggtggcaatgcctgcctgcatcttgacgggcctcctgtcggctgctggaggagctgggagctctgtcaggtaaagagraaaaaacagcatgcatcaggatggcagggggagcaggaggctgtgctcacaggcactgcacaggtgcagcacttccgtgttcccggccagcgggggccct

SEQ ID NO: 14365 - DNA, 201 bp, Homo sapiens
aagcacaggcaccatgcggaggccccgagcaccccttagtggggcggggtggggggaggaagtcagtccataatgttgtagttacggatcttggggggccyctggcagcctttagcttttgcaggatgagaccgggaggctcctgtggtcttggcctttgcctgggctgctgtcttcatccctggggtggcaatgcctgcc

SEQ ID NO: 14366 - DNA, 201 bp, Homo sapiens
actggtgtgcagatggctgtgggtggtgacacgggcaggccaggctctggcacaggcacttgatactgcatttcccaagtaggacagataaacaacgctamggccaagcagacgccccagggaggaacctggttttaatgggccctgtgctcagggaggccttcagtcagcagggtcgcctcagcagcatttgggagcctg

SEQ ID NO: 14367 - DNA, 201 bp, Homo sapiens; identical to SEQ ID NO: 2861

SEQ ID NO: 14368 - DNA, 201 bp, Homo sapiens
cccagtcaccctcctgccggtcgcagagcattgtgttcttgtggaggacacgcgaggactcttggaagtgctttttggcggggtagtgcagtgtgttccgrgcggacgggcgtcagtttacgtgtgcgtttctcatccttgcagatacctggccccgggcactcaggtggcagggacattttgctgttatccttcgtgggg

SEQ ID NO: 14369 - DNA, 201 bp, Homo sapiens
gaggctgagacaggagaatcacttgaacccaggaggcggaggttgcagtgagccgagatcacgccactgtactccagcctgggagacagagcaagactccrtctcaaaaaaaaaaaaaacaaaaaagcaggatcggccaggtggtgtcactgggggccactcgtgtccatcttgggccggggggctctcaccccaggcagg

SEQ ID NO: 14370 - DNA, 201 bp, Homo sapiens
gacgtcacacagctgtgttgaacagccatactcctcttggacctgggataggccccgaaccaccctcctgctcatgtcctcagccctgctttgccaacctrtccagacccagcagtcaccccgtcccagggcacggccaacctctgaggctggaacagctggctggagtcggggctcccccatacaccctggatgcggctc

SEQ ID NO: 14371 - DNA, 201 bp, Homo sapiens
aactagccgggcatggtggtgggtgcctgtcatcccagctacttgggaggctgagacaggagaatcacttgaacccaggaggcggaggttgcagtgagccragatcacgccactgtactccagcctgggagacagagcaagactccatctcaaaaaaaaaaaaaacaaaaaagcaggatcggccaggtggtgtcactgggg

SEQ ID NO: 14372 - DNA, 201 bp, Homo sapiens
ccacagtcttccctccagaaggggggagacatcaggcatggggcgggcagaggcaccagtgatgggttcaagaagcaggatcaggtcaggcgtggtggctyacacctgtgatcccagcactttgggaggccaaggcaggcggatcacctgaggtcaggtgttcaagaccagcctggctaatatggtgaaaccctgtctcta

SEQ ID NO: 14373 - DNA, 201 bp, Homo sapiens
tccccctgccatcctgatgcatgctgtttttttctctttacctgacagagctcccagctcctccagcagccgacaggaggcccgtcaagatgcaggcaggyattgccaccccagggatgaagacagcagcccaggcaaaggccaagaccacaggagcctcccggtctcatcctgcaaaagctaaaggctgccaggggcccc

SEQ ID NO: 14374 - DNA, 201 bp, Homo sapiens
agatcccggacaagaccgccacccttgttggaagggagacaggcaaggtgaaccctggggccctggccttctgcctgaaggccgtttctgggctgccggcrcagggagggaagcagggcctgagcaaagctgagcacccttacggagctgagactgcactagggtctggggacacagaaggagccggcatttcagggcaga

SEQ ID NO: 14375 - DNA, 201 bp, Homo sapiens
gacaaagtatatgaaacaactgtttgcagacattggacaactggtcaaacaagaccgagatccccaacaagaccgagaccctggacgagtccgagatcccrgacaagaccgccacccttgttggaagggagacaggcaaggtgaaccctggggccctggccttctgcctgaaggccgtttctgggctgccggcacagggag

SEQ ID NO: 14376 - DNA, 201 bp, Homo sapiens
cacttaggaaagtaacttgtgttgaaataacttttagaacaaagtaaatacattaacaaataaccaaatcggcttactttctgataatatttattctatgmccacacaacggctggcactcacttctgcttctggccaggccgtagttacaaggaccagactttaatgttcctccatgaacaactagaaaactggacaaag

SEQ ID NO: 14377 - DNA, 201 bp, Homo sapiens
aggtgtgggccccacgcccagcctggcgtggagtggagcccttcacccaaacatgaaccaggaggcgagcttggtaaggagcacgtgggctccaggaatgygagggggaatgaatggaggcagctcctcagtgtgcaaaaacatgcagcgcgggcctcactggtcaccatcacagcagccttgcagtgggatcaggacagt

SEQ ID NO: 14378 - DNA, 201 bp, Homo sapiens
ttgcccaggctggagtacagtggtgtgatccaggctcactggaacctagaactctgggctccagtgatcctcctgcctcagcctcccaaggggttcctctktatttttaatagtaaatggtgccatatgagaagaaataagatacaaatacagaaaagaactcctacagatcaataaggaaaagacaaatcaccctgtgac

SEQ ID NO: 14379 - DNA, 201 bp, Homo sapiens
acccagggctttcgttcatttcgttcaggagagcaggtcgggatggccccgccatggatgggtgaggagccggctgtgacatgttaagaaacggggacagygaagaacagtctgtacctcctctgtaaacgcgcagggaacgttacagtccactcttccatctgtggcgtcactctgtgtactgacgagggaaccccctca

SEQ ID NO: 14380 - DNA, 201 bp, Homo sapiens
ttttttttgtacagatagggggtctcaatatgttacccaggctgatcttaaactcctggagtcaagggattcttccacctcggcctcccaaagtgctaggrttacaggtgtgagctaccgcgcccagcctaattttttatttatttattttttgagacagagtttcgctctgttgcccaggctggagtacagtggtgtgat

SEQ ID NO: 14381 - DNA, 201 bp, Homo sapiens
tgcatgtgcattcctcgggtgaacaggcaaacgttggtaaacatgggccaagtacactctgcatccactgttgtgggcacactcatggtgtgcctgggaargggcagggctgggctcgttccacagcctccttgcaggccatctattgtccatggctctgtacaggtcccactgctttgaatttccctttctgttttcctc

SEQ ID NO: 14382 - DNA, 201 bp, Homo sapiens
acacctgtctaatttttaaattttttttgtacagatagggggtctcaatatgttacccaggctgatcttaaactcctggagtcaagggattcttccacctyggcctcccaaagtgctagggttacaggtgtgagctaccgcgcccagcctaattttttatttatttattttttgagacagagtttcgctctgttgcccagg

SEQ ID NO: 14383 - DNA, 201 bp, Homo sapiens
actgcagcctggtcctcccaggctcacattatcttcccacctcagcctccgtagtagctgagaccacaggtgtgcgccatcacacctgtctaatttttaawttttttttgtacagatagggggtctcaatatgttacccaggctgatcttaaactcctggagtcaagggattcttccacctcggcctcccaaagtgctagg

SEQ ID NO: 14384 - DNA, 201 bp, Homo sapiens
ggaaggctgaggcaggagaatcacttgaacccaggaggcggaggttgcagtgagctgagatcacgccactgcactccagcctgggcgacagagcaagactstgtctcaaaaaaaaatgttttgagacagggtctctgctccccaggctggagtgccatgatgacatcacagctcactgcagcctggtcctcccaggctcac

SEQ ID NO: 14385 - DNA, 201 bp, Homo sapiens
ccagagtgctgggattacaggggtgagccaccgtgcctggccagaaccacttcttattaacccccaaagtggcaacggctcccagttttccatcgctcacrcttcccacgtattcggactcccacctttgtcatggtgctaaatgttccatgtgcttttggagctatatccggacggttcgttcggccactctcagtctgt

SEQ ID NO: 14386 - DNA, 201 bp, Homo sapiens
cgtgctggagtcctctagacctcaccccagccacggtgtggccacgcagtggacgctgagctcacatcttactgtggggttttttttgtttttttttttttgagatagagtttgcccttgtccgcccaggctggagtgcagtggcgcaatctcggctcactgcaacctctgcctcccgggttcaagcgactccgctgcctc

SEQ ID NO: 14387 - DNA, 201 bp, Homo sapiens
gctgggattacaggggtgagccaccgtgcctggccagaaccacttcttattaacccccaaagtggcaacggctcccagttttccatcgctcacgcttcccrcgtattcggactcccacctttgtcatggtgctaaatgttccatgtgcttttggagctatatccggacggttcgttcggccactctcagtctgttcacagg

SEQ ID NO: 14388 - DNA, 201 bp, Homo sapiens
cgttggccgcccgctgacctgcctgggtcagcctgtccagactgcccactgggccacattcagccacgtgctggagtcctctagacctcaccccagccacrgtgtggccacgcagtggacgctgagctcacatcttactgtggggttttttttgtttttttttttttgagatagagtttgcccttgtccgcccaggctgga

SEQ ID NO: 14389 - DNA, 201 bp, Homo sapiens
tgggattacaggggtgagccaccgtgcctggccagaaccacttcttattaacccccaaagtggcaacggctcccagttttccatcgctcacgcttcccacrtattcggactcccacctttgtcatggtgctaaatgttccatgtgcttttggagctatatccggacggttcgttcggccactctcagtctgttcacaggca

SEQ ID NO: 14390 - DNA, 201 bp, Homo sapiens
atccttctctctcagggttttcttggttatttgcatgtatttgttttttcttttttctttctttttaaatttagtagagagaggactggaggcagtggctygtgcctataatctcagcactttgggaggctaaggcaggtggatcagttgaggtcaggagttcaagaccagcctggccaacatggtgaaaccccgtctcta

SEQ ID NO: 14391 - DNA, 201 bp, Homo sapiens
ttactccctcccagtccctacccaccaggccacaactgcccagtccccctgcacccctccagactccccagccaccctcagaacagaagtggttttttaartatatgtgtatatcctcttttcttgtcaattgcatatcgtgggggcagcttgcttttttatttatgtctgcagtattttttatgtcagtacacacagagc

SEQ ID NO: 14392 - DNA, 201 bp, Homo sapiens
aaatacaaaaattcactgggcctggtggcgcatgcctgtaatcccagctacttgggaggctgaggcatgagaatcacttgaacctgggaggtggaggttgyagggagctgagattgcaccactgcactccagtctgggtgacggaatgagactctgcctcaaaaaaaaaaaaaaaatttagtagagatggtgtctccctat

SEQ ID NO: 14393 - DNA, 201 bp, Homo sapiens
catgtttttaaatgtttattatggtgtttttttatgtccatattttttatttttatgtaatttaatgtccttgttttttatcttgtctgttttttttttttcctttgagatggagttttgctcttgttgctcgggctggagtgcaatggcgcgatctcagctcactgcaagctcctcctcccaggttcaaatgattctcct

SEQ ID NO: 14394 - DNA, 201 bp, Homo sapiens
tgggcctggtggcgcatgcctgtaatcccagctacttgggaggctgaggcatgagaatcacttgaacctgggaggtggaggttgcagggagctgagattgyaccactgcactccagtctgggtgacggaatgagactctgcctcaaaaaaaaaaaaaaaatttagtagagatggtgtctccctatgttgcccaggctgatc

SEQ ID NO: 14395 - DNA, 201 bp, Homo sapiens
aaaggaagcagtcgcagcttaaagagtgtgagcacgcgcccactccccacagacacacccggcctgccccgccccacgctgcccctgccctggagaaagcraggctccttcctttcctggagacgccggccacagttcttcagtgaaacgcttcactctctggtcatagaggtaggaaactatagctgtcccaactaaatg

SEQ ID NO: 14396 - DNA, 201 bp, Homo sapiens
taaaggaagcagtcgcagcttaaagagtgtgagcacgcgcccactccccacagacacacccggcctgccccgccccacgctgcccctgccctggagaaagygaggctccttcctttcctggagacgccggccacagttcttcagtgaaacgcttcactctctggtcatagaggtaggaaactatagctgtcccaactaaat

SEQ ID NO: 14397 - DNA, 201 bp, Homo sapiens
actcagcctgtaaacccagcactttgggaggctgaggtgggcggatcacttgagcccaggagttcaagaccagcctgggcaacatctctgcaaaaaaaaaataataataataataatgaaatgatactgaaatagttaacaatttagtggcatctaaattaatgacatgaacgactattgtaggatatggtgtttagtcac

SEQ ID NO: 14398 - DNA, 201 bp, Homo sapiens
cagcctcccaaggggttcctctgtatttttaatagtaaatggtgccatatgagaagaaataagatacaaatacagaaaagaactcctacagatcaataagraaaagacaaatcaccctgtgacaaacaggcaaagggtctgatcagaaggtactggggacgaagcccggggggcagtgagcatcaggctgtgcccgtgatc

SEQ ID NO: 14399 - DNA, 201 bp, Homo sapiens
ttggcgtggtggctcacaccagtgatcccagccactttgggaggctgaggcgggcagatcatctgaggtcaggagttcgagaccagcctggccaacatgaygaaaccccatctctactaaaaatacaaaaattagccagttgtggtggcaggcacctataatcccagctactcgggaggctgaggcaggagaatcgcttga

SEQ ID NO: 14400 - DNA, 201 bp, Homo sapiens
tcttgggctcaagtgattctcccacctcagcctcccaagtagctgggaccacagggacacgccaccacgctcagctaagattgttttagttttttgtaggkacaaggtgtcgctctgttgcccaggctggtctcgaactcctgggctcaagtgatcctcccaccttacgctctcaaagtgctgggattacgggcatgagcc

SEQ ID NO: 14401 - DNA, 201 bp, Homo sapiens
aagatccgtaactacaacattatggactgacttcctccccccaccccgccccactaaggggtgctcggggcctccgcatggtgcctgtgctttcacctacrtgttgtgggggggtgtgggcacagcgtgcagggtggaggcagggagctgcagggcaggctcccaaatgctgctgaggcgaccctgctgactgaaggcctc

SEQ ID NO: 14402 - DNA, 201 bp, Homo sapiens
ccctctgggattctcttttctcctaatggctccgcaatggctgcagacactcccaccatcccctgagaaggccaaaaggtgaagggcctctctctcctgawtctttttcttttaatcagggagggagaagctgcccagagccctcagcagacctgctgtccatctcctggctgtgggggtcatgttgcctccctatgaccc

SEQ ID NO: 14403 - DNA, 201 bp, Homo sapiens
ctcagtattggtggatttagcaaatggtttgtttgtttgtttgtttgttggccaatctgataagtcaaaactgatacttcattattggttttaatttgccttttttttctagtccattttattttatgtatgtattttgagatggagtctcactccgtcgcccaggctggagtgtagtgccgcagccatggctcactaaag

SEQ ID NO: 14404 - DNA, 201 bp, Homo sapiens
caggctggagtgtagtgccgcagccatggctcactaaagcctcaacctcccaggcttctcaacctcccgggctcaagcattcctccttcctcagcattccragtagctgggaccacaggcacgtaccaccacacctggctaattttttacattttgtagacaggatcttgccatgttgcccaggctggtctcgaactcctg

SEQ ID NO: 14405 - DNA, 201 bp, Homo sapiens
gtaagccaccatgcccagctaatttttaaaaactttttttgtacagacagggtcttactatgttgcccaatatggtcttgaactcctgggttcaagcaatsctcccatgtcagcctccctaagcgctgggattacaggcgtaagccaccatgcctggcccataaaatgtatcctaaggtcgcataattctgttaactggct

SEQ ID NO: 14406 - DNA, 201 bp, Homo sapiens
gtcttactatgttgcccaatatggtcttgaactcctgggttcaagcaatgctcccatgtcagcctccctaagcgctgggattacaggcgtaagccaccatccctggcccataaaatgtatcctaaggtcgcataattctgttaactggctgctaactcggttaatttttttaaactgtttgtagaattagagcatttctgg

SEQ ID NO: 14407 - DNA, 201 bp, Homo sapiens
tgttagctcttttcttgaaattgtagtgacgaaaccatgactgccacttaggaaagtaacttgtgttgaaataacttttagaacaaagtaaatacattaasaaataaccaaatcggcttactttctgataatatttattctatgcccacacaacggctggcactcacttctgcttctggccaggccgtagttacaaggacc

SEQ ID NO: 14408 - DNA, 201 bp, Homo sapiens
ctccctcctctcttccaggaacggaacaaggtcagggaagcacttgctgccagcccatgttcctactcctgaaacaaggaattaggtcctaccctcagggygtacccttgccttagagaaatgccctctgctctttctggggtctgtaacgaggcatctgtatgtctttgacacagcccttgccgagttcctgcagccttt

SEQ ID NO: 14409 - DNA, 201 bp, Homo sapiens
ccaagattgtaccactgcactccagcctaggtgataaagcaagactccatctcaaaaaaaaaaaaaaaaaaaaaagttttgtctgggtgtggtggctcacrcctgtaatcccagcactttttggggccaaggcgagcagattacttgaggtcaggagttcgagaccagcctggccaatttggcaaaactccatctctactg

SEQ ID NO: 14410 - DNA, 201 bp, Homo sapiens
tatagttattagtaacatttcaatgtgttttctgctgggtttttgttttgttttggtttggttttggttctcatttgtttgtttgtttgttttttgagacggtcttgctctgttgcccaggcttgagtgcagtggtgcaatctcggctcactacaacctccccctcccggttcaagcaattctcctgagtcagccttccga

SEQ ID NO: 14411 - DNA, 201 bp, Homo sapiens
gccttgcagagaaggctcctgggaatgaatgactggggaagcctgctccattcctcctgtctgggaaacaggtcccttcagtccgggctgtcaccaaatgrtgtgagtctttaataccagaaatgtgggaaggcatttcttcccaatcttgtgggaaaactcactgacatgcaccatcagtacatgtgaataccagagtcc

SEQ ID NO: 14412 - DNA, 201 bp, Homo sapiens
tggccaggctggtttcaaactcctgacctcaggtgatccacccgcctctgcctcccaaagtgctgggattacaggcatgaaccaccgcgcccagcccccatttttttttattttttcattacaaattgtatcatgtatatgttttactatagctttaaatatctgggtactatttttttaatctggtatgataagtgaaaa

SEQ ID NO: 14413 - DNA, 201 bp, Homo sapiens
cttcagtccgggctgtcaccaaatggtgtgagtctttaataccagaaatgtgggaaggcatttcttcccaatcttgtgggaaaactcactgacatgcaccrtcagtacatgtgaataccagagtcctctcatttaaatccccacggcaggacgccaagagtgccgaggatgaggctccttccagacacttgggaaagcacc

SEQ ID NO: 14414 - DNA, 201 bp, Homo sapiens
ctcatttaaatccccacggcaggacgccaagagtgccgaggatgaggctccttccagacacttgggaaagcaccagccccgctcagcacaggtgggcagcrgacttgacgccctgcaaggcccgaaggtgagagtggcggcgcccgagcaagtgcagctgtgtggggtgtggccagcagggaagccggggcctgggtgctc

SEQ ID NO: 14415 - DNA, 201 bp, Homo sapiens
ctggagtgcagtggcacagtctcggcttattgcaacgtctgtctcccaggctcaagtgatctttccacctcagcctcccaagtagctgggactacaggcaygcaccaccacgcctggctaatttttgtttgtttgtttgttttttaatagagacagggtttcaccgtgtcactcaggctggtctcaaactcctggactgaa

SEQ ID NO: 14416 - DNA, 201 bp, Homo sapiens
taaatccccacggcaggacgccaagagtgccgaggatgaggctccttccagacacttgggaaagcaccagccccgctcagcacaggtgggcagcagacttracgccctgcaaggcccgaaggtgagagtggcggcgcccgagcaagtgcagctgtgtggggtgtggccagcagggaagccggggcctgggtgctctgggcc

SEQ ID NO: 14417 - DNA, 201 bp, Homo sapiens
ttcaccgtgtcactcaggctggtctcaaactcctggactgaagcaatttgcccacctctgcctcccaaatgctgggattacaggcgtgagccaccaggccyggcatgtatttattttatttatttattcattatgagatggagtctcactttgtcgcccaggctagactgcagtggtgtggtcttgactcactgcaacctc

SEQ ID NO: 14418 - DNA, 201 bp, Homo sapiens
gtaacatttcaatgtgttttctgctgggtttttgttttgttttggtttggttttggttctcatttgtttgtttgtttgttttttgagacagtcttgctctrttgcccaggcttgagtgcagtggtgcaatctcggctcactacaacctccccctcccggttcaagcaattctcctgagtcagccttccgagttgctgggat

SEQ ID NO: 14419 - DNA, 201 bp, Homo sapiens
atccccacggcaggacgccaagagtgccgaggatgaggctccttccagacacttgggaaagcaccagccccgctcagcacaggtgggcagcagacttgacrccctgcaaggcccgaaggtgagagtggcggcgcccgagcaagtgcagctgtgtggggtgtggccagcagggaagccggggcctgggtgctctgggcctct

SEQ ID NO: 14420 - DNA, 201 bp, Homo sapiens
ccttcgctctgcatgcctgcctttgtgccgtcatcagggactgctcacaatggcagggtgagctgcagagcgtttgccgggtggtcccacaagggtggtamgagtgttaggagggccccgggacccctaaagcacatggggcccacgctggcctttcctttctgtgcccctcagggtatctgccctgcatttcagctcatt

SEQ ID NO: 14421 - DNA, 201 bp, Homo sapiens
gcccctgaggcccggaagccaggcgaggagcccaggaggcctttggatcgcagcccacctttgggacaggtgcagccccattttacatctcaggtaacacyccttcatctaagacatgcatttttaaaaatatttccctaattgtgtcgttttcattacagaaacttcagattacaataaacacaatataaaaagcctcca

SEQ ID NO: 14422 - DNA, 201 bp, Homo sapiens
gtggagggaccgtgggaaccagatcacgtgggcctccctccccctgtaccccattgctctcctgttgtcacactcagtcccacaaaggcagccccggggcyacggtgaccccccagggctgagctccaggagctcaggggtgggggtgtccattaggagactttagcaggtgagggttgacgcaggctggggagacacggg

SEQ ID NO: 14423 - DNA, 201 bp, Homo sapiens
gccacagaatggacttgaggcctgagctgccatcagggccaggccctccccagccccaaggcaggctctggagaaccagggaaggcgtgggctcaccgtcyggcccttcccaaagccctaggaagccacgtaggtgtgcccaggggcacccagagagcccggagcagcctggagaatgagccaccagaggccaacttggtc

SEQ ID NO: 14424 - DNA, 201 bp, Homo sapiens
ggtgtctcacctgtgctcaggtctttaggctaaggctgtacagctactaccatcccattgtcaaatgcagaaatgaggcccaacgctacatggccacagakcccatagctgagggtcccaaggcccagcccttgttctgcaccctggagttctggaagggacttgtctgattagagcagggggagggccaagcatgtcctg

SEQ ID NO: 14425 - DNA, 201 bp, Homo sapiens
agctggcctggtggtgggaaacggttctggcagattcctttcatttcctcttacatgctcagcatccaggctgagagcccgaggccggccacaggctctgmaggaggaaggagcggtgtaggaggcttgagaaagtgggttgtaaaatggtgggttggcgcctcaggaagcagatccggcagagagtgaagagggccacca

SEQ ID NO: 14426 - DNA, 201 bp, Homo sapiens
gctgagacgggagtgagggccgcaccttccctgcaataggacaggctatgtcctccctgagattccaccagcttcaaacctccaagccgggcttggtggcycacacctgtaatcccagcactttgggaggccgaggtgggtggatcacgaggtcaggagatcgagaccatcctggttaacatggtgaaaccccgtctctat

SEQ ID NO: 14427 - DNA, 201 bp, Homo sapiens
ggggtcagaggagatgcttggccagagcttctgaggaattcggctgtgctgtgggggtggggaagactgcataggagaagtgggtagggccgccatgtagrgcctcatcaagattggggccagggctcagtgggccgcccctgggccgctccctgggggtgggatttggaggcggtccctgccatgcaccctgtgggtggg

SEQ ID NO: 14428 - DNA, 201 bp, Homo sapiens
cgaggccggccacaggctctgaaggaggaaggagcggtgtaggaggcttgagaaagtgggttgtaaaatggtgggttggcgcctcaggaagcagatccggsagagagtgaagagggccaccaagctctctgtgagaccagggagctggtgaccacaggagtcacctggggccaaggccgtgctgcaggaaggagcgttcct

SEQ ID NO: 14429 - DNA, 201 bp, Homo sapiens
taggacaggctatgtcctccctgagattccaccagcttcaaacctccaagccgggcttggtggcccacacctgtaatcccagcactttgggaggccgaggygggtggatcacgaggtcaggagatcgagaccatcctggttaacatggtgaaaccccgtctctattaaaaatacaaaaaacttagcggggcgtggtggcgg

SEQ ID NO: 14430 - DNA, 201 bp, Homo sapiens
gggttggcgcctcaggaagcagatccggcagagagtgaagagggccaccaagctctctgtgagaccagggagctggtgaccacaggagtcacctggggccraggccgtgctgcaggaaggagcgttcctgacacagcagcacacgtccaccgaggctgagagtgtgggtggcctgggagggaaggcgggctggtgtggatc

SEQ ID NO: 14431 - DNA, 201 bp, Homo sapiens
acaggctatgtcctccctgagattccaccagcttcaaacctccaagccgggcttggtggcccacacctgtaatcccagcactttgggaggccgaggtgggyggatcacgaggtcaggagatcgagaccatcctggttaacatggtgaaaccccgtctctattaaaaatacaaaaaacttagcggggcgtggtggcgggcgc

SEQ ID NO: 14432 - DNA, 201 bp, Homo sapiens
actcctggcctcaagcaatcctcctgtcccagcctcctgagtagctgggattacaggcgggagccaccatgcctggcaacggctggtatttcttagcatcrgtgttgcaattaaaaagcaagcaagaggccgggcgcggtagctcacccctgtaatcccagcactttgggaggccgaggtgggtggatcactaggtcagga

SEQ ID NO: 14433 - DNA, 201 bp, Homo sapiens
gcactagggtctggggacacagaaggagccggcatttcagggcagaatcccgcaaggaggaaactgcagaaaagagctccagaaatctgcacagggttctattgagtctgtactgaggaccagcctgtacatgtatagaagaaaactccacaaagccaggcaaagaggagaaaggagcatgtaaggtgaacaacttccaga

SEQ ID NO: 14434 - DNA, 201 bp, Homo sapiens
ctgagtagctgggattacaggcgggagccaccatgcctggcaacggctggtatttcttagcatcggtgttgcaattaaaaagcaagcaagaggccgggcgyggtagctcacccctgtaatcccagcactttgggaggccgaggtgggtggatcactaggtcaggagatcgagaccatcctggctaacacggtgaaaccctg

SEQ ID NO: 14435 - DNA, 201 bp, Homo sapiens
aggtcaggagatcgagaccatcctggctaacacggtgaaaccctgtctctactaaaaatacaaaaaattagccgggcgtggtggcggacgcctgtagtccyagctacttgggaggctgaggcaggagagtgctgtgaacccgagaggcggagcttgcagtgagccgaggttgcaccactgcactccagcctgggcgacaga

SEQ ID NO: 14436 - DNA, 201 bp, Homo sapiens
gtaaggggtgccacttaagggcaccgggtttctggttaagatgcgacactgcgccctccagtgcaccgacactaggacagagcgcagctcggcagtcgctygccagacaagcagtctgaaagctccattctagaaacggagaggaagtttcctcctcttttttaaacgtgttccatgcattgtgggtaacagagtatgcac

SEQ ID NO: 14437 - DNA, 201 bp, Homo sapiens
gacactaggacagagcgcagctcggcagtcgctcgccagacaagcagtctgaaagctccattctagaaacggagaggaagtttcctcctcttttttaaacrtgttccatgcattgtgggtaacagagtatgcacactacacagtcatgattggagtttaaagtaataatgttgccaggcacagtgactcagcctgtaaacc

SEQ ID NO: 14438 - DNA, 201 bp, Homo sapiens
agtcatgattggagtttaaagtaataatgttgccaggcacagtgactcagcctgtaaacccagcactttgggaggctgaggtgggcggatcacttgagccyaggagttcaagaccagcctgggcaacatctctgcaaaaaaaaaataataataataataatgaaatgatactgaaatagttaacaatttagtggcatctaa

SEQ ID NO: 14439 - DNA, 201 bp, Homo sapiens
cctttgtgccgtcatcagggactgctcacaatggcagggtgagctgcagagcgtttgccgggtggtcccacaagggtggtaagagtgttaggagggccccrggacccctaaagcacatggggcccacgctggcctttcctttctgtgcccctcagggtatctgccctgcatttcagctcattccccatcgaaacgaaacag

SEQ ID NO: 14440 - DNA, 201 bp, Homo sapiens
agcactgagattcaggccctgcccacactcagcgttcccagcgctgagactcgctccccggatgcatccctgtctgcagctgcctctcctgggtgatcctrggagcatctgcctgggcctttaagccaggcccactgtcgccttactgctccgaggggagtggttggggggagtcctgtggcttcctctgggttggagagg

SEQ ID NO: 14441 - DNA, 201 bp, Homo sapiens
acgatgatgtcttttctagacacaacacagcatccacacggtgacctgtaaatcacctcggcagaaagaagacaggtccccaaagccaccccaggctcccmagcaccctgaggagcatggtcgccaatcccacagctcctcctcctttgccagtggcaccctccaggacacgtggaggttgctagacctgggatccagccc

SEQ ID NO: 14442 - DNA, 201 bp, Homo sapiens
gacaggtccccaaagccaccccaggctcccaagcaccctgaggagcatggtcgccaatcccacagctcctcctcctttgccagtggcaccctccaggacaygtggaggttgctagacctgggatccagcccttctggtgtcacctcccagggtgactcaactccaggtaggagactgccctccccaggagctgcccacagc

SEQ ID NO: 14443 - DNA, 201 bp, Homo sapiens
aggctgctcccagcagcagtgtctgagagtcctgtagccacacggaacttttgccggtggcagcgggattggcatcagcgcctctgctgggaggtcgtgcrtcttcgtgtgtgtttaggagccacttcctttccctgttcttcagttacctgcccatttgtatattagattgtggtctttcttattgatttgtagcagctc

SEQ ID NO: 14444 - DNA, 201 bp, Homo sapiens
agcgggattggcatcagcgcctctgctgggaggtcgtgcatcttcgtgtgtgtttaggagccacttcctttccctgttcttcagttacctgcccatttgtrtattagattgtggtctttcttattgatttgtagcagctcattatatgtgatagaaattaggccttttcggtgacaacaatttaaatgttttctcccagtt

SEQ ID NO: 14445 - DNA, 201 bp, Homo sapiens
cgtgtgctccagtgctggcatcacgaatgtggcgcgtttctctctgtcttccacgcagccgcgtcccactccgtcttcctgaccctcccacctgcactccrtggctctcctctgtgctcaggattcttaggggcaccgcctccttgcatttttaattcaccacaaaacattttgtccaaattttcatcaactcaatggaaa

SEQ ID NO: 14446 - DNA, 201 bp, Homo sapiens
caggaggcagaggctgcagtgagccgagatggcaccactacactccagcctgggcgacagagcaagactcccgtctcaaaaaaaaaaaaaaaaagcaaggytgtctctacagaaagataaaaataaaaataaattacccatttgtggtagtccacaccttgtaatcccagactcaggaggttgaggtgagaggactgcttg

SEQ ID NO: 14447 - DNA, 201 bp, Homo sapiens
ttatatgtgatagaaattaggccttttcggtgacaacaatttaaatgttttctcccagttcttcatgtttttaaatgtttattatggtgtttttttatgtycatattttttatttttatgtaatttaatgtccttgttttttatcttgtctgttttttttttttcctttgagatggagttttgctcttgttgctcgggctg

SEQ ID NO: 14448 - DNA, 201 bp, Homo sapiens
acttgaacctgggaggtggaggttgcagggagctgagattgcaccactgcactccagtctgggtgacggaatgagactctgcctcaaaaaaaaaaaaaaaatttagtagagatggtgtctccctatgttgcccaggctgatctcaaattcctgggctcaagcgatcctcccgcttcagcctcccaaagtgctgagactgca

SEQ ID NO: 14449 - DNA, 201 bp, Homo sapiens
gtgcccagtggaggggcaggcccagtccctgccaagcaggacccactgagcaaggcgaggccacagctctctggtcactccaggatcctttggccttcacrgactcctggaggaaagccaggccaagggtcacagggcccccgctggccgggaacacggaagtgctgcacctgtgcagtgcctgtgagcacagcctcctgc

SEQ ID NO: 14450 - DNA, 201 bp, Homo sapiens
ttatgtaatttaatgtccttgttttttatcttgtctgttttttttttttcctttgagatggagttttgctcttgttgctcgggctggagtgcaatggcgcratctcagctcactgcaagctcctcctcccaggttcaaatgattctcctgcctcagcctccccagtagctggagctacaggcacccgccaccactccaggc

SEQ ID NO: 14451 - DNA, 201 bp, Homo sapiens
agggcccccgctggccgggaacacggaagtgctgcacctgtgcagtgcctgtgagcacagcctcctgctccccctgccatcctgatgcatgctgttttttyctctttacctgacagagctcccagctcctccagcagccgacaggaggcccgtcaagatgcaggcaggcattgccaccccagggatgaagacagcagccca

SEQ ID NO: 14452 - DNA, 201 bp, Homo sapiens
ttgtctgttttttttttttcctttgagatggagttttgctcttgttgctcgggctggagtgcaatggcgcgatctcagctcactgcaagctcctcctcccrggttcaaatgattctcctgcctcagcctccccagtagctggagctacaggcacccgccaccactccaggctaattttgtatttttagtagagacggggtt

SEQ ID NO: 14453 - DNA, 201 bp, Homo sapiens; identical to SEQ ID NO: 2870

SEQ ID NO: 14454 - DNA, 201 bp, Homo sapiens
tttttttttttgagatagagtttgcccttgtccgcccaggctggagtgcagtggcgcaatctcggctcactgcaacctctgcctcccgggttcaagcgacyccgctgcctcagcctcctaagtagctgggattacaggtgcccgccaccgtgcccggctaattttttgtatttttagtagagacggcgtttcaccattgtt

SEQ ID NO: 14455 - DNA, 201 bp, Homo sapiens
gagaatcacttgaacccaggaggcggaggttgcagtgagccgagatcacgccactgtactccagcctgggagacagagcaagactccatctcaaaaaaaamaaaaacaaaaaagcaggatcggccaggtggtgtcactgggggccactcgtgtccatcttgggccggggggctctcaccccaggcaggccatgcataggct

SEQ ID NO: 14456 - DNA, 201 bp, Homo sapiens
tgaaaccaaacacctttacaccacaaaagagagaaggaggaatagaatacagctgtcacttaccaatgtgtctaagtcttattgctatctcagttaatctrctttgaacacttaaaaaacaaagtgccattctccaagtttcagcttgcactaagtcttaaccagaaggaaaataccttaatttcatttatcttaattcaa

SEQ ID NO: 14457 - DNA, 201 bp, Homo sapiens
gtctttactaaaatacaaaaaattagtcaggcgtggtggcatgcccctgtagtcccaactacttgggaggctgagacgagaattgcttgaacctgggaggyggagtttgcagtgagcagatattgtgccactgcactccagcctgggtgacagagtgagactctgtttccaaaataaataaataaataaataacctttggt

SEQ ID NO: 14458 - DNA, 201 bp, Homo sapiens
agtaacctttggctgggcgtgggcgtggtagctcgcgcctgtaatctcagcactttagggggctgaggtgggtggattgccagagctcaggagttcgagaycagtctgggtaacacggacacggtgaaaccccgtctttactaaaatacaaaaaattagtcaggcgtggtggcatgcccctgtagtcccaactacttggga

SEQ ID NO: 14459 - DNA, 201 bp, Homo sapiens
tagtggtgagaaactattttaatcccttttattgctcatagtctgtaactaataaatgttgtacttagtttgggacttctacatcaagacagtaaataagrtgtaatcatcatagggcctctacttctattataaactgaaaaactattgaagttggatccaggatcagtgttcagactttgatgttaccaccaaatgaac

SEQ ID NO: 14460 - DNA, 201 bp, Homo sapiens
tgcatattctatttatcactttggaaacctctgctgtaatcagtaacctttggctgggcgtgggcgtggtagctcgcgcctgtaatctcagcactttaggrggctgaggtgggtggattgccagagctcaggagttcgagaccagtctgggtaacacggacacggtgaaaccccgtctttactaaaatacaaaaaattagt

SEQ ID NO: 14461 - DNA, 201 bp, Homo sapiens
gttgtcttctgttgcaggttctgggcatttggaaaagtttctcttcgggctgttaagcaaggctaaagaggagaggaaaaaaatgttaaaatgtgtgttgycttcctagttttccatttgtctgtgttcattttggagttggacataattgaaagcaccaaagctaataacagctaccatttattcaacagcttgtatttt

SEQ ID NO: 14462 - DNA, 201 bp, Homo sapiens
tcttacaccctagtgcatattctatttatcactttggaaacctctgctgtaatcagtaacctttggctgggcgtgggcgtggtagctcgcgcctgtaatcycagcactttagggggctgaggtgggtggattgccagagctcaggagttcgagaccagtctgggtaacacggacacggtgaaaccccgtctttactaaaat

SEQ ID NO: 14463 - DNA, 201 bp, Homo sapiens
ctctcccctcctcccccggcccgcagtgcaccccacagggagccccgccgggtccactcttgctccgacccccatttcgcgcgccccctcggctctatctyccagatcctcaggcgacgaatggaaagggggtcccttccctctcacctgggacggaggcgctcgctcatggcagctggcggatggaagctacgcggcgcc

SEQ ID NO: 14464 - DNA, 201 bp, Homo sapiens
gggtgcggggaggtgggcaggctggtaacgcagcgggaggagggaaaggcggctggagagcgccggaggtgagggtgaggattagtggaactattgaggtyctccttgagcccggaggctggggaggtcttaactctctgctttccggaacctgtgtttctatttggttcagtatcgtgccgcgtttactcactgtgcatg

SEQ ID NO: 14465 - DNA, 201 bp, Homo sapiens; identical to SEQ ID NO: 2905

SEQ ID NO: 14466 - DNA, 201 bp, Homo sapiens
gggctttcaggtcttccgaggtgaggacggtgctctgtggggagcttgcaagggcgggtttgttttccgcggcccacgttctaagtctgggggagactctyctgagcggagagggtagggaatcgggtgccggggccggcggagggtcttcctggaaccgcaggaggaaatcctcggtggggctgcgggaacggctgtccc

SEQ ID NO: 14467 - DNA, 201 bp, Homo sapiens
ccagcctgggcaatatagtgaaaccccacctctaccaaaaatacacagattagctgggtgtggtagctcacacctgtgctccagctactcaggaggctgaygtgggaggatcacctgagcctgggaggttgaggctgcagtgaggcatgatggggccactgcactccagcctggtcgacagagtgagactctgtcaatcaa

SEQ ID NO: 14468 - DNA, 201 bp, Homo sapiens
ccctagtttcagtcgctgtaacaacaagctgtgtttccttttgaacaggctggatcaggtgcaacaccaccataaggaagagtggattcggtggcatcackatgctcttcacaggatacttcgtcctgtgttgtagctggagtttcagacgtctgagtaagtctttctatatttctagcctaaataacaggtcccattccg

SEQ ID NO: 14469 - DNA, 201 bp, Homo sapiens
gtgtaaatctctgaattacagttccatcactcaggctaactgggaaaacttgaatgactcgcggatactggccctagtttcagtcgctgtaacaacaagcygtgtttccttttgaacaggctggatcaggtgcaacaccaccataaggaagagtggattcggtggcatcacgatgctcttcacaggatacttcgtcctgtg

SEQ ID NO: 14470 - DNA, 201 bp, Homo sapiens
aattatgtcataataatatcatacaagtatttgagttgaatccgtgtaacatattttaaaacaggcggacctatccggcagtggtgcagacggcctgacgmggttccttggccgggggttgggcaggggcctggggggcttccctggggggcttgtcgccggggccgcctgggctttcaggtcttccgaggtgaggacggt

SEQ ID NO: 14471 - DNA, 201 bp, Homo sapiens
tgtttaaaatatgtgcgtgtaaatctctgaattacagttccatcactcaggctaactgggaaaacttgaatgactcgcggatactggccctagtttcagtygctgtaacaacaagctgtgtttccttttgaacaggctggatcaggtgcaacaccaccataaggaagagtggattcggtggcatcacgatgctcttcacag

SEQ ID NO: 14472 - DNA, 201 bp, Homo sapiens
caggttctgggcatttggaaaagtttctcttcgggctgttaagcaaggctaaagaggagaggaaaaaaatgttaaaatgtgtgttgtcttcctagttttcyatttgtctgtgttcattttggagttggacataattgaaagcaccaaagctaataacagctaccatttattcaacagcttgtattttttaatacctacccc

SEQ ID NO: 14473 - DNA, 201 bp, Homo sapiens
ctaataacagctaccatttattcaacagcttgtattttttaatacctacccccaactttcccttgcccacattgattgtgcctcctcccaaagccagaaaractctaaacctcaagttaaccagttgtattagcctcctcccactaaagattttaaccaagcacccaaaacaagagtaactaatttgaatctagtcaagtt

SEQ ID NO: 14474 - DNA, 201 bp, Homo sapiens; identical to SEQ ID NO: 2891

SEQ ID NO: 14475 - DNA, 201 bp, Homo sapiens
ccgaggtgaggacggtgctctgtggggagcttgcaagggcgggtttgttttccgcggcccacgttctaagtctgggggagactctcctgagcggagagggkagggaatcgggtgccggggccggcggagggtcttcctggaaccgcaggaggaaatcctcggtggggctgcgggaacggctgtccctgacccaggagctgc

SEQ ID NO: 14476 - DNA, 201 bp, Homo sapiens
tgttaaaatgtgtgttgtcttcctagttttccatttgtctgtgttcattttggagttggacataattgaaagcaccaaagctaataacagctaccatttaytcaacagcttgtattttttaatacctacccccaactttcccttgcccacattgattgtgcctcctcccaaagccagaaaaactctaaacctcaagttaac

SEQ ID NO: 14477 - DNA, 201 bp, Homo sapiens
aaccccctgccggacttacaacctccaacttctctctaatgaggctcttgggagctgtacaaaaaggtgaggctggagtttgactgttgtcttctgttgcrggttctgggcatttggaaaagtttctcttcgggctgttaagcaaggctaaagaggagaggaaaaaaatgttaaaatgtgtgttgtcttcctagttttcca

SEQ ID NO: 14478 - DNA, 201 bp, Homo sapiens; identical to SEQ ID NO: 2892

SEQ ID NO: 14479 - DNA, 201 bp, Homo sapiens; identical to SEQ ID NO: 2893

SEQ ID NO: 14480 - DNA, 201 bp, Homo sapiens
ccacgcgggaggctgaggcaggagaaccgtttgaacctgggaggctgaggttgctgtgagccgagatcgcgccactgcactccagcctgagtgatagagcragactccatctcaaaaaaaaaaagaccaaacaacaacaaagtaaaaatgattactgtaatctgttggcagaaaacagttttgttttgaaggacttcgtac

SEQ ID NO: 14481 - DNA, 201 bp, Homo sapiens
gggggtacgtttcggtaaacaatgacagtgacttctgtttggaaccatagtttctttgttggaacgaagctcaactcatataaggagtttggaaccccctrccggacttacaacctccaacttctctctaatgaggctcttgggagctgtacaaaaaggtgaggctggagtttgactgttgtcttctgttgcaggttctgg

SEQ ID NO: 14482 - DNA, 201 bp, Homo sapiens
gtactgaataatatttaaacgtttatatctaaagaattaagtgaacaaatattgtatgccaggctcagtgctaggtttttacatacagctgtgtgcaggayagatatgtttcctgccctctggaactttatagaaagaataagagatgtagaaaggaaataactttcaactaaacattggaattaaacattttcttttctg

SEQ ID NO: 14483 - DNA, 201 bp, Homo sapiens
gggaaaatagaattttttcttcagtaacaagttccttccaaatagtggtgagaaactattttaatcccttttattgctcatagtctgtaactaataaatgytgtacttagtttgggacttctacatcaagacagtaaataaggtgtaatcatcatagggcctctacttctattataaactgaaaaactattgaagttggat

SEQ ID NO: 14484 - DNA, 201 bp, Homo sapiens; identical to SEQ ID NO: 2894

SEQ ID NO: 14485 - DNA, 201 bp, Homo sapiens
gaagtcaataccttgtttgatatgttattgatacatttcactgttagctcctaagaatacaataataagatacagtaacttaaaacattaaattaccaagrttatgagacaggatataggagggaaaatagaattttttcttcagtaacaagttccttccaaatagtggtgagaaactattttaatcccttttattgctca

SEQ ID NO: 14486 - DNA, 201 bp, Homo sapiens; identical to SEQ ID NO: 2896

SEQ ID NO: 14487 - DNA, 201 bp, Homo sapiens
ttacaacctccaacttctctctaatgaggctcttgggagctgtacaaaaaggtgaggctggagtttgactgttgtcttctgttgcaggttctgggcatttsgaaaagtttctcttcgggctgttaagcaaggctaaagaggagaggaaaaaaatgttaaaatgtgtgttgtcttcctagttttccatttgtctgtgttcat

SEQ ID NO: 14488 - DNA, 201 bp, Homo sapiens
tagcccaaagctacattttctttaactaccttctataaacaggcctaacgtctagacctttttgcacaaagttgtagtcacaaagtcaagccccttctccrtaataaacacatttaattatattaacatttgtgttgctttgtggttttcagagtgcctccatctgtattttttttattttgggcacaaggtggacagaga

SEQ ID NO: 14489 - DNA, 201 bp, Homo sapiens
taaagtgggagatcacctgatcccggaaaatcagggctgcagtgagccgagtatgtgccacttcactgcagcctgggcgacgggaatgagaccctgtctcaaaaaaaaaaaattgtcctgaaaacattacttcttgcttcagtggtcagtagtggtggtttatccctctctttttctctcccccaagagttgagggttaca

SEQ ID NO: 14490 - DNA, 201 bp, Homo sapiens
ccttctataaacaggcctaacgtctagacctttttgcacaaagttgtagtcacaaagtcaagccccttctccataataaacacatttaattatattaacatttgtgttgctttgtggttttcagagtgcctccatctgtattttttttattttgggcacaaggtggacagagaggtgggcagagtgaatttatcctatttt

SEQ ID NO: 14491 - DNA, 201 bp, Homo sapiens
tcattgtgcttaatactctatttctaaacttataaaacaaaaagagaatgatctgtagaggcaaaagatagtaacagtcattggaagtggcctctcggatycttacatttgtctctgtttatccaaagagctgcagcggtggcgtaagtagtgttgacctggacatcacttaaagctctggaacagcaaagggcgtacagt

SEQ ID NO: 14492 - DNA, 201 bp, Homo sapiens
gtagcaaacatctagcttgttccaaatgaatttaaaagatacaacacataagtaaaatattggtatgtacaaactatgtgcttctcataatctcacatttmcctttttcaggaataggatgagtgataatccacccagaatggaagtgtgtccttactgtaagaagccatttaaacgattaaaatcccacttgccatactg

SEQ ID NO: 14493 - DNA, 201 bp, Homo sapiens; identical to SEQ ID NO: 2903

SEQ ID NO: 14494 - DNA, 201 bp, Homo sapiens; identical to SEQ ID NO: 2904

SEQ ID NO: 14495 - DNA, 201 bp, Homo sapiens
ttgctgtaaccgtaagtagcaaacatctagcttgttccaaatgaatttaaaagatacaacacataagtaaaatattggtatgtacaaactatgtgcttctyataatctcacatttacctttttcaggaataggatgagtgataatccacccagaatggaagtgtgtccttactgtaagaagccatttaaacgattaaaatc

SEQ ID NO: 14496 - DNA, 201 bp, Homo sapiens
ggctgggcgtgggcgtggtagctcgcgcctgtaatctcagcactttagggggctgaggtgggtggattgccagagctcaggagttcgagaccagtctgggyaacacggacacggtgaaaccccgtctttactaaaatacaaaaaattagtcaggcgtggtggcatgcccctgtagtcccaactacttgggaggctgagacg

SEQ ID NO: 14497 - DNA, 201 bp, Homo sapiens; identical to SEQ ID NO: 2887

SEQ ID NO: 14498 - DNA, 201 bp, Homo sapiens; identical to SEQ ID NO: 2888

SEQ ID NO: 14499 - DNA, 201 bp, Homo sapiens
ctggttaccttggactaggggtgttgccagggaagcctcagtgttggaatgcaatgacccagaagccacaacttatcagtccccagggggaaagactctcrcaaggtaaacaagcttattttcaattgccatctgtcccatccaaaatgctctctctgccttttgaatttataagggtcaaaatactaacattttcagtca

SEQ ID NO: 14500 - DNA, 201 bp, Homo sapiens
aactctcccaaacagtaagcctcaagtagagtttaaagaccacagatagaagtcaataccttgtttgatatgttattgatacatttcactgttagctcctragaatacaataataagatacagtaacttaaaacattaaattaccaaggttatgagacaggatataggagggaaaatagaattttttcttcagtaacaagt

SEQ ID NO: 14501 - DNA, 201 bp, Homo sapiens; identical to SEQ ID NO: 2890

SEQ ID NO: 14502 - DNA, 201 bp, Homo sapiens
caaacagtgaacctgaagttgagtttaaagaccacagatagaagagtcaggtgaacctggaggtattaactactaactctcccaaacagtaagcctcaagyagagtttaaagaccacagatagaagtcaataccttgtttgatatgttattgatacatttcactgttagctcctaagaatacaataataagatacagtaac

SEQ ID NO: 14503 - DNA, 201 bp, Homo sapiens
ggctggagtgcaatggcacaatcacggctcactgcaacctccacctcccaggttcaagcgattctcctgcttcaggctccagagtagctgggattacaggygcctgccaccacgcccagctaattttttttttttttaagtagagatggggttttgccatgttggccaggctggtctcgaactcctgacctcaggtgatcc

SEQ ID NO: 14504 - DNA, 201 bp, Homo sapiens
cccaggctggagtgcaatggcacaatcacggctcactgcaacctccacctcccaggttcaagcgattctcctgcttcaggctccagagtagctgggattayaggtgcctgccaccacgcccagctaattttttttttttttaagtagagatggggttttgccatgttggccaggctggtctcgaactcctgacctcaggtg

SEQ ID NO: 14505 - DNA, 201 bp, Homo sapiens
aattgaaggacttgtgtattttctgtactacattttatagtgcttaggagtgtccttgatacacacttttcattttagaggaaaaagtgagggacctgacrtttatctgtgatgactatgactatcgttatgctagatacattatgtcatttaatcctcataacagctctgagtgacaccactgtcccaccctcttattcc

SEQ ID NO: 14506 - DNA, 201 bp, Homo sapiens; identical to SEQ ID NO: 2895

SEQ ID NO: 14507 - DNA, 201 bp, Homo sapiens
tgcgccaccacgcccggctaattttgtatttttagtagagatggggtttctccgtgttggtcaggctggtcttgaactcgtgacctcaggtgatctgcccrcctcaacctcccaaagtgctgggattacaggtgtgaaccaccgtgtccagccttctgtgtttttcagttgcagatgcacacactccccccatgataaatc

SEQ ID NO: 14508 - DNA, 201 bp, Homo sapiens; identical to SEQ ID NO: 2897

SEQ ID NO: 14509 - DNA, 201 bp, Homo sapiens; identical to SEQ ID NO: 2898

SEQ ID NO: 14510 - DNA, 201 bp, Homo sapiens; identical to SEQ ID NO: 2900

SEQ ID NO: 14511 - DNA, 201 bp, Homo sapiens; identical to SEQ ID NO: 2902

SEQ ID NO: 14512 - DNA, 201 bp, Homo sapiens
aacccaggaggcagaggttgcagtgagccgagatcgcgccactactccagcctgggcaacaagtgaaactgcatctcaaaaaaaaaaaaaaaaaaaaaaamccaccagtatttttgtacaattaaaacaaaaagcccactttcagatgaaaacttcaggtgtaaaagtacaagataacgatgaattctgaaggccagcata

SEQ ID NO: 14513 - DNA, 201 bp, Homo sapiens
atggaagctacgcggcgccgctccgcgaagagagggaacagagggggttgtgtttcggcggccgccacgcccaccccctcgggccttggctctcgcagccsctcgggtggacgcagccggtggcgagtacccctcagtcggacccgtaccaccactacttccggcgtctgctccgcgcccccccatgtcgctgccgccgtg

SEQ ID NO: 14514 - DNA, 201 bp, Homo sapiens
ggttctttgatgttagcctttatgtgtttaaaatatgtgcgtgtaaatctctgaattacagttccatcactcaggctaactgggaaaacttgaatgactcrcggatactggccctagtttcagtcgctgtaacaacaagctgtgtttccttttgaacaggctggatcaggtgcaacaccaccataaggaagagtggattcg

SEQ ID NO: 14515 - DNA, 201 bp, Homo sapiens
atccctctctttttctctcccccaagagttgagggttacactagggcaggctggcgatactgaaagcagttgagtttctgccttgagaagaggcatgtccrgtagaaactggatgggtaaacagactggagaaaaatataaagacttaaaattcagctagatagaataagcactgtgttcagaatccagtcaggaccaggt

SEQ ID NO: 14516 - DNA, 201 bp, Homo sapiens
tgagccgagtatgtgccacttcactgcagcctgggcgacgggaatgagaccctgtctcaaaaaaaaaaaattgtcctgaaaacattacttcttgcttcagkggtcagtagtggtggtttatccctctctttttctctcccccaagagttgagggttacactagggcaggctggcgatactgaaagcagttgagtttctgcc

SEQ ID NO: 14517 - DNA, 201 bp, Homo sapiens
gtttgactgttgtcttctgttgcaggttctgggcatttggaaaagtttctcttcgggctgttaagcaaggctaaagaggagaggaaaaaaatgttaaaatrtgtgttgtcttcctagttttccatttgtctgtgttcattttggagttggacataattgaaagcaccaaagctaataacagctaccatttattcaacagct

SEQ ID NO: 14518 - DNA, 201 bp, Homo sapiens
cagccggtggcgagtacccctcagtcggacccgtaccaccactacttccggcgtctgctccgcgcccccccatgtcgctgccgccgtggtaccgccctctygcggctgcgcagtggcaccatcccaaccgcaccgactggtaaccccgcccacgggaagaggcgggctcggagcgggaggagcgactaggagcttctggga

SEQ ID NO: 14519 - DNA, 201 bp, Homo sapiens; identical to SEQ ID NO: 2899

SEQ ID NO: 14520 - DNA, 201 bp, Homo sapiens; identical to SEQ ID NO: 2901

SEQ ID NO: 14521 - DNA, 201 bp, Homo sapiens
cttaactctctgctttccggaacctgtgtttctatttggttcagtatcgtgccgcgtttactcactgtgcatgctgccaagtcacctgtctgatcgtgtcytacacaggctgacattcacgtttcattctgccacactcgggaacggtgatcggggaagcatggggatccgggagaagcacccacaaaactagcatcctcc

SEQ ID NO: 14522 - DNA, 201 bp, Homo sapiens
agggtgaggattagtggaactattgaggtcctccttgagcccggaggctggggaggtcttaactctctgctttccggaacctgtgtttctatttggttcastatcgtgccgcgtttactcactgtgcatgctgccaagtcacctgtctgatcgtgtcctacacaggctgacattcacgtttcattctgccacactcgggaa

SEQ ID NO: 14523 - DNA, 201 bp, Homo sapiens
ttcagcaatatatccctgtatcctagaattctctgtaaggaaaaaagttgtggttgaggggaagagttctacattcagttattttagtttaatattactargaacttcattggaacccagaacaatcttccctgccgaaagagctttgtgcccattctctgtgaatgctctttaggagagatgcttaaggattctctccac

SEQ ID NO: 14524 - DNA, 201 bp, Homo sapiens
atccctttctcaagagtttctgtgcattactgagaaattcctctccatttgttagggttgtttttggctggtgggttttctgtgtctcttcatctcatcaractattcagtgtctgattttttgacttctgctttggcccacagagagtaacttggatacttacaggtagaaaaagctttgaggaaatttaggcaacgttg

SEQ ID NO: 14525 - DNA, 201 bp, Homo sapiens
gaggcaagagaatcgcttgaacctgggaggcggaggttgcagtgagccgagattgtgccattgcactccaacctgggcaacaagagcgaaactccgtctcaaaaaaaaaataaaaaaagaaagtgaaccatgaggagggcctaggagaagccaaaggaactaaggaactacaccatttgaaagggaggtggaggagctggc

SEQ ID NO: 14526 - DNA, 201 bp, Homo sapiens
atggcagctgatcctgggccatcgtgaagggataatagggtacagtgaggacttggcaaacacgatctaagggggtggcctcttctcagcttcatccagcratgccatgcaagaacatgggttcagtgttgtctgatctttcaatcaggagaagttggaaatccatatttttatgcagtgtcctgattttttcaattgaaa

SEQ ID NO: 14527 - DNA, 201 bp, Homo sapiens
gaaggatttcgtatgcctttaaaatttccaaacaagtataagtctttatcttttgagaatacatattgaaatatggagtgataccatgtctgaaatttctktcagtgaggcactgcgggtagtggagagggtaaagatgaaagatgattgtatataagttggtaatttttaagctagaagatggatagatggggtttcatt

SEQ ID NO: 14528 - DNA, 201 bp, Homo sapiens
aatcgcttgaacctgggaggcggaggttgcagtgagccgagattgtgccattgcactccaacctgggcaacaagagcgaaactccgtctcaaaaaaaaaawaaaaaaagaaagtgaaccatgaggagggcctaggagaagccaaaggaactaaggaactacaccatttgaaagggaggtggaggagctggccaagaaggct

SEQ ID NO: 14529 - DNA, 201 bp, Homo sapiens
  misc_feature (1)...(201): n = A,T,C or G, or insertion/deletion polymorphism (see Tables 1-2)
gaactcttaaagaccagatcagaccactttgagatttacaagaactgtaaccagtttattgctttttgaaaaatgaagtaaggaagaacttacaaagaaangcatattaaaatggtgggatgccattttatacctattgaattgacctccttccttaccccaattaatggtaatatccaatatcaatgagtttttttggtg

SEQ ID NO: 14530 - DNA, 201 bp, Homo sapiens
acagatttattgaaataaaagtatgctctacagagtaagagtgggcttgaagcgcaagctaatctattatttttattttgatcttcacattctccccaatkaggctggtgggagccctcttccgaactgagaaaaattcttgaaaaactgaggagagtcccagagcacagattttttttaagtaaatgtttttgaggtatt

SEQ ID NO: 14531 - DNA, 201 bp, Homo sapiens
aaatcactttgtttccaggttcaatttcagaagcttcagcaactgcgccttacacagtaccatggaggatccttaccaaatgtgagccagctgcggagcartgcgtcagagtttcaggtacctccagatatgtactttcttgaagctgaatggagtgtaaaaaatagacaaagattatcactaaaaagatgagatcttgaa

SEQ ID NO: 14532 - DNA, 201 bp, Homo sapiens
cgccatctcggctcacggcaagctccgcctcccgggttcatgccattctcctgcttcagcctcctgagtagttgggactgcaggcgcccaccaccatgccyggctaatttttttgtacttttagtagagacagggtttcaccgtgttagccaggatggtctcgatctcctgacctcgtgatccgcccgcctcggcctccca

SEQ ID NO: 14533 - DNA, 201 bp, Homo sapiens
ttcacatatactatttgaaatctttcataataaatgtaaaaaggaaattatcagagagcttcataggttcaacaatgcttttggtaaaccaaacttcacctttttttttttttttttgagtttgtaattagtatgatcatcgagggaaagatgggacaaaggaaaagagcatggcagaaatgggcatatgggctttgaggc

SEQ ID NO: 14534 - DNA, 201 bp, Homo sapiens
tcacatatactatttgaaatctttcataataaatgtaaaaaggaaattatcagagagcttcataggttcaacaatgcttttggtaaaccaaacttcacctttttttttttttttttgagtttgtaattagtatgatcatcgagggaaagatgggacaaaggaaaagagcatggcagaaatgggcatatgggctttgaggct

SEQ ID NO: 14535 - DNA, 201 bp, Homo sapiens
cacatatactatttgaaatctttcataataaatgtaaaaaggaaattatcagagagcttcataggttcaacaatgcttttggtaaaccaaacttcacctttttttttttttttttgagtttgtaattagtatgatcatcgagggaaagatgggacaaaggaaaagagcatggcagaaatgggcatatgggctttgaggctg

SEQ ID NO: 14536 - DNA, 201 bp, Homo sapiens
gcgggtagatagcttgagcccaggaattctagaccagcctaggtaacatggtgaaatccgtctctaaaaaaaaaaaacgaaaattagctgggcgtggtggygcgtgcctgtatttgggaggtggaggttgcagtgagctgtgattgtgacactgcactccagcctgggcaacagagaccctgtctcaaaaaaaaaaaaaaa

SEQ ID NO: 14537 - DNA, 201 bp, Homo sapiens
attttatacctattgaattgacctccttccttaccccaattaatggtaatatccaatatcaatgagtttttttggtgaaacttttctcatatgtatattagtaaactctttgggaaagcatttcggcagtatacgttgagagccaccaaaaggcccatatccagagatttagtaatcaccctttggaaggtgttctaagga

SEQ ID NO: 14538 - DNA, 201 bp, Homo sapiens
cctgttaatgatgatgttctcttttatcaattaaggtggtgtccaccaggcatggtggctcacacctgtaatcccagcattttgggaggctgaggcaggcrgatcgcttgagctcaggagtttgagccagcctgggcaacatggagagaccctgtctctactgaaaaaaaaaaaaaaaaaggccagatgtggtggtgcacg

SEQ ID NO: 14539 - DNA, 201 bp, Homo sapiens
ctttttctagctcagtgagtctaaatttcaaaagaggaaaatgtcaaaataactcagagtttgaagaggtagctgagatcagcaataatgataatatcttaagaagttgaccagagctttacatttgacataccactcttgtatctgtgtcatttaatcctcactttatcttgtgcaggaggcatcagagttgtttgccca

SEQ ID NO: 14540 - DNA, 201 bp, Homo sapiens
accagaggactaactcagcatatcaccctggagtgttgattggacttgaatatttgcgcagactcattattttcatgtgaaaataaaccaatgataagacaatagatatgtcatagattagcgagctctcaggatggaggagagagagaagatggaaatattaggtttgggctaaatattgaggactttccttttgcgagg

SEQ ID NO: 14541 - DNA, 201 bp, Homo sapiens
catatgataattcagtcaccactttattctaattactacaaaattatggtgtcattttgcccttcacctggtacagggaatcatttacatattaattctgyccgtgttttcttcttggccagttaccagtaaagtaacactgcttggctccaccgtgttcataaacacatctgtaaatgataacactgaatttggctacta

SEQ ID NO: 14542 - DNA, 201 bp, Homo sapiens
tgtgacctcggccttaggctaatcattctttggttcacatgttcatcatctgtaaacatgaaggtgttgaagacagtctcaaagttctttttctagctcartgagtctaaatttcaaaagaggaaaatgtcaaaataactcagagtttgaagaggtagctgagatcagcaataatgataatatcttaagaagttgaccaga

SEQ ID NO: 14543 - DNA, 201 bp, Homo sapiens
ttaagttctgtattttgccctctaacatgtttttggttttggcccaaaatgtggttagttggttggttggttggttggttggttttaattaggactaacartgaatattgggattttatagtaaaatctggactttggtttcttttgaaaaatgagataatccaacgacactcacccgacatttctggacggcaccagttg

SEQ ID NO: 14544 - DNA, 201 bp, Homo sapiens
gtcaaaataactcagagtttgaagaggtagctgagatcagcaataatgataatatcttaagaagttgaccagagctttacatttgacataccactcttgtrtctgtgtcatttaatcctcactttatcttgtgcaggaggcatcagagttgtttgcccaaccacacgggagttgcaggttacaaagtcacatcatccgatt

SEQ ID NO: 14545 - DNA, 201 bp, Homo sapiens
aggctaattgtgagacgttgaggagtggacgggggtggggaatggagatagggttggaaacttattccagaagtttggctgtgaagagcaacttgtgttgmggaaccagaggactaactcagcatatcaccctggagtgttgattggacttgaatatttgcgcagactcattattttcatgtgaaaataaaccaatgataa

SEQ ID NO: 14546 - DNA, 201 bp, Homo sapiens
aataatgataatatcttaagaagttgaccagagctttacatttgacataccactcttgtatctgtgtcatttaatcctcactttatcttgtgcaggaggcrtcagagttgtttgcccaaccacacgggagttgcaggttacaaagtcacatcatccgattccaggtccagtgctttttgtttttttagagtctcgctctgt

SEQ ID NO: 14547 - DNA, 201 bp, Homo sapiens
cagtgatttgtatatctgtctttttgacaatagcacactgtctgtatattatagctttataataaggcttaaaacctggtaatttaagtcctctaacttasctctttttgaaaattgctctggccaggtgccatggctcatgcctgtaatcccagcactttgggaggctgaggcgggtagatagcttgagcccaggaattc

SEQ ID NO: 14548 - DNA, 201 bp, Homo sapiens
  misc_feature (1)...(201): n = A,T,C or G, or insertion/deletion polymorphism (see Tables 1-2)
tccgaaaatagagtaatcaaaacccagaaagcaccggaaaccttgagggtgtgatcacttacgtcgagaagaaattgaaacaagactttcattcttgaacngttcccctacaaaatactatactttgatgcttctttagatctttgctgttacctctcagcgttcttaaatcactttgtttccaggttcaatttcagaagc

SEQ ID NO: 14549 - DNA, 201 bp, Homo sapiens
attctcctgcttcagcctcctgagtagttgggactgcaggcgcccaccaccatgcccggctaatttttttgtacttttagtagagacagggtttcaccgtsttagccaggatggtctcgatctcctgacctcgtgatccgcccgcctcggcctcccaaagttctgggatttacaggtatgagccactgctcctggcctttt

SEQ ID NO: 14550 - DNA, 201 bp, Homo sapiens
gcacatccataaattttagaattatcttgtcaatgtctctgaaaggacccgctgggattttggattgtaatcgtgttggctattgtgagacttttctcaamaaggaattaatgaggcctggatctcatttcctgtaggcattaaagaaaattccactgagatgtgtgactgtaggccaaaggtcactaactcagtaagtga

SEQ ID NO: 14551 - DNA, 201 bp, Homo sapiens
ttttgagacagagtctcactgtgtcacccaggctgtagtacagtggcatgatcttggctcactgcaacctctgcttcctgggttcaagcaattcttctgcytcatcctcccaagtagctaggattgcaggcatgcaccaccacagctggctaatagttagtagagacggggtttcaccgtgttggccaggctagccgtgtt

SEQ ID NO: 14552 - DNA, 201 bp, Homo sapiens
ttttggattgtaatcgtgttggctattgtgagacttttctcaacaaggaattaatgaggcctggatctcatttcctgtaggcattaaagaaaattccactragatgtgtgactgtaggccaaaggtcactaactcagtaagtgaggcaggtaaggaaaatgaatggaggggccaggaatgagatgatcatggcagctgatc

SEQ ID NO: 14553 - DNA, 201 bp, Homo sapiens
gcggcgcggcttctggtcgctccgaacatcccccaccatcgagccctgctgttctgccggcgtggaaggccgcgggcaccccagggtcccacgcgctcgtrgggggagctctgtgcacaagtccatccagggcccggccctggggtggctcgggttgttggaaccacgacgggattccgtgtcgagtgtgaggctctgctc

SEQ ID NO: 14554 - DNA, 201 bp, Homo sapiens
  misc_feature (1)...(201): n = A,T,C or G, or insertion/deletion polymorphism (see Tables 1-2)
aactgttatatacccactaaaaattactctgtaatagcatagaaaaggcttatgatgagcatgctaggttgtacctatcttatgatcacagctatgcagtncttaccataaatgtaaacggaggctggaaaagagcatgaagaagggaaaacagctaatgtgttagggttgtggatagtagcttagtttttctttcagaaa

SEQ ID NO: 14555 - DNA, 201 bp, Homo sapiens
ctctgatgctttcaaattatactccaaatcaaaccaccttccaccaccatgacaatccttgcccaaacaccaatatctcttgcctcctaccttgtttcctkgatactcctcttgccttcttatagtctattcacctcaccacagcgagggagatccttaataagtacctcttaaatgaagaaagtaatttactattgttat

SEQ ID NO: 14556 - DNA, 201 bp, Homo sapiens
tagtactcaaagtttagtttaacttaaatatatcacatataaaagctgccatggttattccaaaatttttttgaaattaaatttattcttagtatttttcyagcaaatgttaagtgcagcgcatgaaagtttttataacaaatttcaagtgcagcatattaaaatgttcggcatttcagtggtattttccatttttgtggc

SEQ ID NO: 14557 - DNA, 201 bp, Homo sapiens
ttctagcaaatgttaagtgcagcgcatgaaagtttttataacaaatttcaagtgcagcatattaaaatgttcggcatttcagtggtattttccatttttgyggcaactctattaacatcttgatgtattttcccttttttttttcattgagacagagtcttgctctgtgggccaggctggagtgcagtggcactatctcgg

SEQ ID NO: 14558 - DNA, 201 bp, Homo sapiens
ctttcccaaccctctgaagattttcaaccatcactgaaagcaggaggaggcctccattcctgtaggtcccttatattgtgcagggagcctgcctgaggctygccatacaagcaactcttgatcttcccgttgtttctatttatgatactccctagagcgagtgttgggaaatggaaatttccttcacagtggtgaagcata

SEQ ID NO: 14559 - DNA, 201 bp, Homo sapiens
actgtgtaaaactgggaggacacatatagtctgaagagggtagctgctgcctgctccagccaacctcttcatgcaagaattcagattcagagttgccaaarcatctcacttaatccagatagtaggtaaaattttccaagttttaaacatgacagacatctgggttactctaacagattgcaaacatacttacatactccc

SEQ ID NO: 14560 - DNA, 201 bp, Homo sapiens
catatattcaaaggaaataaaaatcattatcctgaagagatgtttgcactcccatattcattgcagcattatttacaatacccgggatagaggaataaacwaggtgtccatcagtggatgaatggataaagaaaatgtgatacacagacacacacacatacacacacacacacacaatgaaatattatacagccttaggaa

SEQ ID NO: 14561 - DNA, 201 bp, Homo sapiens
cttaattcccatcacaatgactgccaagtatggaaggagagcactcattttcagaaaagaagctgaaaaaaaaatactattgtcttcacatttctgagtakatctttaactatactttagtgaaatagcaaatgatattatgattcaacataatttaaatcaactacaaagtatcaatattactatttacttttacacttt

SEQ ID NO: 14562 - DNA, 201 bp, Homo sapiens
cctggctaacacagtgaaaccctgtctctactaaaaatacaaaaaaataataataataataagtcgggcatggtggcgggtgcctgtagttccaggtactygggaggctgaggcaggagaatggcatgaacccaggagccagagcttgcagtaagccgagatcacgccaccgcactccagcctgggtgacagagcaagact

SEQ ID NO: 14563 - DNA, 201 bp, Homo sapiens
gtttattactcacaggttttaattaaatgtgatccaaccaatacctatccttaaagtaacgaaaaggaagggattcacttgccctatcccaactcaggccrcaaccatatgatactgatttcaaagtgcactgttgttgaagtatagatggtgctcacttaaatctcttctcatctgaaaacagagctcccaaattagcca

SEQ ID NO: 14564 - DNA, 201 bp, Homo sapiens
catgaaagtttttataacaaatttcaagtgcagcatattaaaatgttcggcatttcagtggtattttccatttttgtggcaactctattaacatcttgatrtattttcccttttttttttcattgagacagagtcttgctctgtgggccaggctggagtgcagtggcactatctcggcttactgcaatctccgtctcccgg

SEQ ID NO: 14565 - DNA, 201 bp, Homo sapiens
tgtattttcccttttttttttcattgagacagagtcttgctctgtgggccaggctggagtgcagtggcactatctcggcttactgcaatctccgtctcccrggcacaggcaattctcctgcctcagcctcctgagtagctgggattacaggcgtgtaccaccaggcccagagaatttttgtattttcactagagacagggt

SEQ ID NO: 14566 - DNA, 201 bp, Homo sapiens
aaactctgcctgtttttttaatgtcattaaacttataaattaagccatgaggagattttgtctccagtttcttgcctaactggatatttgagggtgttgaytgggtaatcctctgtagtgataccaaaactacagaaatagaatatccaaattgatttttctttcttttgtttatgttttcagagagatccaaaagagatt

SEQ ID NO: 14567 - DNA, 201 bp, Homo sapiens
attccaccttatgaatatacaatatttttctattatttctactaccgatgcattctcaatgtttccaatttctgctatcacaaataatgctgcaaagacartccttaagtagatggaaaagagtttatccggggtacataccctgaagtaggattagtgttcacattgtatatgagcatttatgtaatttatgcatatttt

SEQ ID NO: 14568 - DNA, 201 bp, Homo sapiens
ttcgtttttccgtggattttattttctgttccagtgatcttttgtcttttactgaaccaatactccattgctttcactactaaaactttataacatttattacaaaaaatagcacattatctttgttctttttcagaaatgtgttggctattctttgaccttttctcttacacaagaatttcataatttctcaaaatctat

SEQ ID NO: 14569 - DNA, 201 bp, Homo sapiens
tatacccttcaataatgtaatataattttcttcagaaaggtcttgcatgtcttttgctgcattaattcttatacacatacttgttttttgtttcggatgtkaatactatctctctacatggattttacaaataattattgttggaatataagttatatgttgtatatttgagagtagattttgtatctagccaccctgctg

SEQ ID NO: 14570 - DNA, 201 bp, Homo sapiens
ctctacatggattttacaaataattattgttggaatataagttatatgttgtatatttgagagtagattttgtatctagccaccctgctgtgctcttagarttctaataattttcagattcttttgaattctatatgtaaaaaatcatgtcatctgcaaaatctgataatcttgagtttccttttccaattcttaaaacca

SEQ ID NO: 14571 - DNA, 201 bp, Homo sapiens
ctgctggtatattagaattccttgtttcttttgttttacttagtgtttttctggattttgttttatgtatcctgatatttgtaacatgtgtactatttaayttttctttaaaaattaaagataatcggtatcttcttccaagactagataataacttttatttgaccatcttccctccaaactactctttccaaattctcc

SEQ ID NO: 14572 - DNA, 201 bp, Homo sapiens
aagtaagtactctacttctcagctggtcatatgtggggacttttcttatcttagttgtttctatttctaagtgcctcatatttctcatattcatttgcttytacattacccaaagtcttcaagattaggactgcaagtcaacctttttgattcgtaactgtagtatttcccattattttagttctaaactcagcttccaag

SEQ ID NO: 14573 - DNA, 201 bp, Homo sapiens
tgcttgttgtttattatttattattgttgataagaatctatcactagtttgatgtttgttcctaagtaaatatattttcaagattctctttatttttgtgytctgcatttaattataatgtttataggtgtgagattaactttttatgagtgtgaggttatcctgagcaggataaatgaagtgaatctcacacccacaatg

SEQ ID NO: 14574 - DNA, 201 bp, Homo sapiens
tggaacttgaagttctattttctcagccttttgtttttccattatccagaattcaaccagctgataattagttttctggaaatttctagtgcctttgattwaaaaaaaaatgttcaagcaagtatatcactagtaaatttaccaatagaaaaaaaaatgagtaggaaaagaaacaagaaaggggtaacaaaaagtatcttt

SEQ ID NO: 14575 - DNA, 201 bp, Homo sapiens
ggatttctgtttgcttatttttcagtaatttcacagagaaccgcaagtaagtactctacttctcagctggtcatatgtggggacttttcttatcttagttrtttctatttctaagtgcctcatatttctcatattcatttgcttctacattacccaaagtcttcaagattaggactgcaagtcaacctttttgattcgtaa

SEQ ID NO: 14576 - DNA, 201 bp, Homo sapiens
tatggtaaatggttttaatagaaattattcattaataaaaattgatgaactaaacatgagctcaagatgattaaaaaaggaaaaatctcaagagtaggacmcaataataaaaatgtcctacttttattaggcaaaaattaatgaaatgaaaagtatttaaaaataacagaataattttgattattttgaaacaaaattaaa

SEQ ID NO: 14577 - DNA, 201 bp, Homo sapiens
acttgaacctaggaggcagaggttgcggtgagccgagattgcaccattgcactccagcctaagtgacaagagcgaaattctgtctcaaaaaaaaaaaaaamcaggcaattaacaacaaaacaaaacttgatataattgtgcaaatatcagataaaatataagtgaaagttgtgagcttatagcatagcctttgaaatacat

SEQ ID NO: 14578 - DNA, 201 bp, Homo sapiens
ccaagtagctgggactacaggcgcccgccactacgcccggctaattttttgtatttttagtagagacggggtttcaccgttttagccgggatggtctcgayctcctgacctcgtgatccgcccgcctcggcctcccaaagtgctgggattacaggcgtgaaaaagcaaatttttttaaatgagggttaaaaaagtctaaat

SEQ ID NO: 14579 - DNA, 201 bp, Homo sapiens
gcaaaattttttttttttttttttttgagacggagtctcgctctgtcgcccaggctggagtgcagtggcgggatctcggctcactgcaagctccgcctccygggttcacgccattctcctgcctcagcctcccaagtagctgggactacaggcgcccgccactacgcccggctaattttttgtatttttagtagagacggg

SEQ ID NO: 14580 - DNA, 201 bp, Homo sapiens
agtttccattctgtggactcaatctttctaattacagaaaaatttaactttaattgctatgaattttgcccatatttatatctatatctaacaacaaactrtagtctctacttctaaaattactatgtatgtaaagattttccttccatctttcagatcttgtgacttctcttttatatttcttatctgcactgattaagt

SEQ ID NO: 14581 - DNA, 201 bp, Homo sapiens
ctaggaacaaatctgcttccttgctttttcagcttctagaggctggccacattccttggttcatggctcccttcttctatcttcaaagtgaacaaaaatgratcaagtcctcacatcacaccattctgcccttcttccactgtagtacctctttctcttactctcttttatctccctctcccactcttaaaaatctttgtg

SEQ ID NO: 14582 - DNA, 201 bp, Homo sapiens
ttaaacacaggtccccagtgaaagaattatcaaagggacatacttcagggagtttacttttgagtaaaaactcaaaaagaagttagaaccaagaaacatatgtaagaaaacaaatcaacaaaacatgacagtaaatctaaaatgttgactataaagaaaaaaaagagaaggaagagaagaaggagaaggaaaagcagaaag

SEQ ID NO: 14583 - DNA, 201 bp, Homo sapiens
tctagaggctggccacattccttggttcatggctcccttcttctatcttcaaagtgaacaaaaatgaatcaagtcctcacatcacaccattctgcccttcytccactgtagtacctctttctcttactctcttttatctccctctcccactcttaaaaatctttgtgattatattaggcccactcagatataccaaaatca

SEQ ID NO: 14584 - DNA, 201 bp, Homo sapiens
attaaacacaggtccccagtgaaagaattatcaaagggacatacttcagggagtttacttttgagtaaaaactcaaaaagaagttagaaccaagaaacatatgtaagaaaacaaatcaacaaaacatgacagtaaatctaaaatgttgactataaagaaaaaaaagagaaggaagagaagaaggagaaggaaaagcagaaa

SEQ ID NO: 14585 - DNA, 201 bp, Homo sapiens
cataaccagacacttcaataatcagtcaaaagtaaatgcaagtttctagtggtttattatgatgacatgaagagagcaatttccaaacctgaagtgttggraaaacagagtaaataaaggataagagcaaaaagttagtaagaaaaataagatgaggatgaggataatatagaatgagggataaatgatattagctgtgtc

SEQ ID NO: 14586 - DNA, 201 bp, Homo sapiens
ctaagcactggaaatatagccatgagcaagacaaagtccttgcacttaaggagtttatatgttgagataaaacaggcaaataatgccaagtaaacatacastaaatgtcaggcagataaattcatgtagaaaaataagaagagtaacagactaaagaaagatggtatagaagggggagtgtgcttcaggcaaaaggaacaa

SEQ ID NO: 14587 - DNA, 201 bp, Homo sapiens
atgacatgaagagagcaatttccaaacctgaagtgttgggaaaacagagtaaataaaggataagagcaaaaagttagtaagaaaaataagatgaggatgargataatatagaatgagggataaatgatattagctgtgtcctcagaattttaaagctttacatggctagcacgaaagggcagccttccctgaggcatcccc

SEQ ID NO: 14588 - DNA, 201 bp, Homo sapiens
agatgaggatgaggataatatagaatgagggataaatgatattagctgtgtcctcagaattttaaagctttacatggctagcacgaaagggcagccttccytgaggcatccccaagtcaggctggcagcaatggaagagatggctaattccctatccccctgagctgcaactgacactaagggtttggtgctcccaggcgt

SEQ ID NO: 14589 - DNA, 201 bp, Homo sapiens
gcaaggagggaaatttcatatttccaaattctaagtctctttagtgtgtcacagaactaaggaacattccctaaccctgctgagattttgtccctcacctscttttccttccccatcattgagcattttgtctaaaattaatgagaacttcgaagaatgagaagtccaccgattaaagaataaagagaggattaaaatggt

SEQ ID NO: 14590 - DNA, 201 bp, Homo sapiens
cagcactttgggaggccgaggcaggaggacttcttgagactaggagttcgagactggcctgggcaacatagtgagactccgtctctaaaaaaaaaaaaaaatcagttggatgtggtggtgcacacctgcagtcccagctactcaggagtctgaggtgggaggattgcttgagcccaagagtttgatgctgcagtgagccac

SEQ ID NO: 14591 - DNA, 201 bp, Homo sapiens
ttttagctggcaatcatagtttcagcaaaacagtaataaattcattaacttaggaataggagggaagaagagagaggcttgtgaagagaccagggaatggragtaggggacaaggagaggtttgtaattaaagcaagtcatctttcttgactatttacagatattacacatgaggaaaaaatgaaatttaaagatattatt

SEQ ID NO: 14592 - DNA, 201 bp, Homo sapiens
tcattcttcttttgatgtgttttattttagcactgtctcgatcaagtattggtaagttcctttacttttcttcaattctgctgacatttagccccagttartcaagaggatatcttcctaaacttcccagacttcttcgctgcagcacagcagaagcttaagcttcacatttctccaatttctttgttctccataaccaga

SEQ ID NO: 14593 - DNA, 201 bp, Homo sapiens
gaactcattcttcttttgatgtgttttattttagcactgtctcgatcaagtattggtaagttcctttacttttcttcaattctgctgacatttagccccakttaatcaagaggatatcttcctaaacttcccagacttcttcgctgcagcacagcagaagcttaagcttcacatttctccaatttctttgttctccataac

SEQ ID NO: 14594 - DNA, 201 bp, Homo sapiens
aaagtggtaaattattgtattgctaagaaattaatataggagtctgtttatgagaaattaagaatcttataatttttcttcaattctctagacacttcatrtgataaccgaggtaagtatatgtagagatttttgtaaaattaaaggaaaatcaggcttcttcctgccacaacataaaaggctataaaaactgaccaaaat

SEQ ID NO: 14595 - DNA, 201 bp, Homo sapiens
tttaaaagatcactctattattgtggaggattaactggggtgagagtgagggctcaagagggcaagtaggaagaccagttaagaggcctgaaattaaggtkagtgtggcaaggagagagtgatcagagtggaagtgggaagaaggtcttcagattttatttattttgggggcaaagccaacagggcctgctgttcgactga

SEQ ID NO: 14596 - DNA, 201 bp, Homo sapiens
ccttaccacaaaagtattggaatccatatgtagatatccagctgctcaccacattgcattgcaattgataccaggaaataagttgtgactcatttctatcytcttttccacaacctttctgcaatatagtgtctatggcatctaagttctccctgggacaaacagaactcattcttcttttgatgtgttttattttagcac

SEQ ID NO: 14597 - DNA, 201 bp, Homo sapiens
taattttaaaagatcactctattattgtggaggattaactggggtgagagtgagggctcaagagggcaagtaggaagaccagttaagaggcctgaaattaaggtgagtgtggcaaggagagagtgatcagagtggaagtgggaagaaggtcttcagattttatttattttgggggcaaagccaacagggcctgctgttcga

SEQ ID NO: 14598 - DNA, 201 bp, Homo sapiens
ttataattttaaaagatcactctattattgtggaggattaactggggtgagagtgagggctcaagagggcaagtaggaagaccagttaagaggcctgaaaytaaggtgagtgtggcaaggagagagtgatcagagtggaagtgggaagaaggtcttcagattttatttattttgggggcaaagccaacagggcctgctgtt

SEQ ID NO: 14599 - DNA, 201 bp, Homo sapiens
agggcctccctgacacccaagttcatattgctcagaaacagtgaacttgagtttttcgttttaccttgatctctctctgacaaagaaatccagatgatgcragacctgatgaagacaatacatggaaaatgacagtcttgggtatggactaactccctctttgaggcttcctcaactctagtagttcaggagtctcctctt

SEQ ID NO: 14600 - DNA, 201 bp, Homo sapiens
caaaacagccagccaggctagaaagaaggaggcagagcaggaggtagggccagagcgacaaaagccagattatgtcgggccctgcagtccttaataaaaarttgcagatttcattctaggtgtcatgagaggcaactgaagggcttgaacagggaaatgatagggcccactttataattttaaaagatcactctattattg

SEQ ID NO: 14601 - DNA, 201 bp, Homo sapiens; identical to SEQ ID NO: 2950

SEQ ID NO: 14602 - DNA, 201 bp, Homo sapiens
tatctcctctctgtcccttaatgatgcattagaacccataattttatcttttttatctttgtaaataacagctttattgagatgatattcacatatgacayaattcactcatttaaagtgtggaatttaatgctttttagtatattcactgggttgtgcaaccatcaccacaatgaattttagaacattctcatcaccccc

SEQ ID NO: 14603 - DNA, 201 bp, Homo sapiens
cagcttcaatcttctgcatatggctggccagttatcccagtatcgtttattgaataggaagccctttccccattgcttgtttttctcagctttgttaaagwtcagatagttgtagtcatgtggccttatttctgggctctgtattctgttgcattgatctatgtgtctatttcctactagtgccatactgttttgcttact

SEQ ID NO: 14604 - DNA, 201 bp, Homo sapiens
tatcgtttattgaataggaagccctttccccattgcttgtttttctcagctttgttaaagttcagatagttgtagtcatgtggccttatttctgggctctstattctgttgcattgatctatgtgtctatttcctactagtgccatactgttttgcttactgtagcctggtagcataccataattttctaatcatgttaaa

SEQ ID NO: 14605 - DNA, 201 bp, Homo sapiens
ttcatttccccatatcgtaactgttaggttttggagggaaggcgagggttaaagaaaagacacagagagagtggcggctgtacagcaaatgtaggctttaygtccagcataagacctacagaagtggggaaccagcctaatgccagtgcccactgctgcttacaggctgggggtacttataggtataggcgggaggggtct

SEQ ID NO: 14606 - DNA, 201 bp, Homo sapiens
agaacatcacagtgttcgccaggatggtcttgatctcctgacctcgtgatccgcctgcctcgacctcccaaagtgctgggattacaggtgtgagccaaggmgcctggcctaccctactcatttctaactctgtgtgcagctacctgactcaaagctcccagtttcctctgccctctgctaatctagcttctccctgagaag

SEQ ID NO: 14607 - DNA, 201 bp, Homo sapiens
aatctagcttctccctgagaaggaagcttacatttacatgatttcaaacacatatgtactttgcacctcctatagaattatataggtgctttaattacatwatcccatttaatccttagaatcactccactaacccctttgtaagagataagaaactgacccaaatacttacccaagaatgcagtcataaagaattggagc

SEQ ID NO: 14608 - DNA, 201 bp, Homo sapiens
gaatgcatagtgtccttttcagaggagtcatcaaagaggatgggcagggaaataatgtaaaaatccaatacccgaggggtagggagaaagaaaaaaggaawgctaaagtaactagggtttataacacctcatttttggctggctaagtcttggctggaaatatttttaaatgaaaaatgcacagtcatacctaagcataaa

SEQ ID NO: 14609 - DNA, 201 bp, Homo sapiens
tgcatagtgtccttttcagaggagtcatcaaagaggatgggcagggaaataatgtaaaaatccaatacccgaggggtagggagaaagaaaaaaggaatgcyaaagtaactagggtttataacacctcatttttggctggctaagtcttggctggaaatatttttaaatgaaaaatgcacagtcatacctaagcataaagaa

SEQ ID NO: 14610 - DNA, 201 bp, Homo sapiens
taagtctccctaatgatctcataactgatatcacttcctctcccctgctctacctctcaaagcctcacttctaggataaaattagtgaaaaatacactctmcaaataactgtactaatatgccaatttgaatttctttttagtgcaaactccaggacctattggtaagctgcctgtatatatcaacttatctctactggct

SEQ ID NO: 14611 - DNA, 201 bp, Homo sapiens
gtaaaggcctagaggagaaaaagtgagagaatgagtaacacaaataataacagatacagaatgaagatgcagtttagaaagagataaataggagaaaattkaaaaagaacaaaagtaggaagaaaattggaagcagaaagagtaagtgaattggcacataagagaataaagaagggaaatgagtatgttgagaaagagaat

SEQ ID NO: 14612 - DNA, 201 bp, Homo sapiens; identical to SEQ ID NO: 2949

SEQ ID NO: 14613 - DNA, 201 bp, Homo sapiens
aggacaatagccaccaagaagagagccacaacccagggtatttatatcatagaatatccatgaaagatagcccccaaggaataagaaactactaaaagttmtgaaatctatgagaaaatccagcaccatgtgagtggtgagtgatacctcacaagccccaacaaattggagaattccaacccagagaaatataactagagc

SEQ ID NO: 14614 - DNA, 201 bp, Homo sapiens
gggtaacaaaaagtatctttgcttgtttttcagtcagatcgcatcctcacacaatcagtaagtctatgtgttcattgaattctctcctttaggactcagttggtctctagtggagtccaagagtctttatctgcccatattgggatacaaagggcttgagatatatcttggcctcttgctgtctcattatcaaaacctctc

SEQ ID NO: 14615 - DNA, 201 bp, Homo sapiens
ggggtaacaaaaagtatctttgcttgtttttcagtcagatcgcatcctcacacaatcagtaagtctatgtgttcattgaattctctcctttaggactcagttggtctctagtggagtccaagagtctttatctgcccatattgggatacaaagggcttgagatatatcttggcctcttgctgtctcattatcaaaacctct

SEQ ID NO: 14616 - DNA, 201 bp, Homo sapiens
aggggtaacaaaaagtatctttgcttgtttttcagtcagatcgcatcctcacacaatcagtaagtctatgtgttcattgaattctctcctttaggactcagttggtctctagtggagtccaagagtctttatctgcccatattgggatacaaagggcttgagatatatcttggcctcttgctgtctcattatcaaaacctc

SEQ ID NO: 14617 - DNA, 201 bp, Homo sapiens
cattcccaccgaaaccacctccatgaccaccacctaagtttccagaaccacttcgacctcttcggctggatggagcactagccatctcttgctttgacagrctttcctaacttcacagttgtggccattcacactgtggtatttctgaatgacagtcttatccacggagtcatggtcatcaaaggttacaaaggcaaagcc

SEQ ID NO: 14618 - DNA, 201 bp, Homo sapiens
caccaccaccacagctgccaccaaagccaccacaaccactgaagtttcctccatgatcaaagttgtcattcccaccgaaaccacctccatgaccaccaccwaagtttccagaaccacttcgacctcttcggctggatggagcactagccatctcttgctttgacaggctttcctaacttcacagttgtggccattcacact

SEQ ID NO: 14619 - DNA, 201 bp, Homo sapiens
gccaccatatccaccaccaccacagctgccaccaaagccaccacaaccactgaagtttcctccatgatcaaagttgtcattcccaccgaaaccacctccaygaccaccacctaagtttccagaaccacttcgacctcttcggctggatggagcactagccatctcttgctttgacaggctttcctaacttcacagttgtgg

SEQ ID NO: 14620 - DNA, 201 bp, Homo sapiens
aggtgctttaattacataatcccatttaatccttagaatcactccactaacccctttgtaagagataagaaactgacccaaatacttacccaagaatgcartcataaagaattggagcttttaacagagaattagccattgtcatccagagctgtgtgactaccaagattctccccaacacaaatatctctccctagaagg

SEQ ID NO: 14621 - DNA, 201 bp, Homo sapiens
ctaatattgagattaaagggtagtaaaggcctagaggagaaaaagtgagagaatgagtaacacaaataataacagatacagaatgaagatgcagtttagaragagataaataggagaaaattgaaaaagaacaaaagtaggaagaaaattggaagcagaaagagtaagtgaattggcacataagagaataaagaagggaaa

SEQ ID NO: 14622 - DNA, 201 bp, Homo sapiens
aggctctattttcagcaacttttagcaacctagtcacattctttgagtgatccctataatgtcttactactgtttttttaaccctcgcgtacattactttrttgcatctaaacaacattcaaatggcaatgagtaaggcagttattatccccatatttagagatgaggaaactgagggtcaggagtcatttctcaaaaaaa

SEQ ID NO: 14623 - DNA, 201 bp, Homo sapiens
ttaatgatgtcttagaacccataattttctagttatgctaaattatttaaaatgcttaagccatcccctttaaaaccctctcctctcctaatggcccgtcycaggcacactgactcagaatggggaggagaaatacaatgtgcttccccttcctgtccactctccttgttgctataattcccaccgttgttataattccca

SEQ ID NO: 14624 - DNA, 201 bp, Homo sapiens
catgcaatctccttcctctgttagttgtaggttcttttctctgagaacctgagactgactgtcctttgatgtcatctagagcagacacccaaatgtcttgyacaatacatattccagttctttggaggaacatacaagaactcgaccatgcctagtccctgatgtgggagtactgactctagtcttgccaattccagagcc

SEQ ID NO: 14625 - DNA, 201 bp, Homo sapiens
gagactgactgtcctttgatgtcatctagagcagacacccaaatgtcttgtacaatacatattccagttctttggaggaacatacaagaactcgaccatgyctagtccctgatgtgggagtactgactctagtcttgccaattccagagcccctcaactccctctcgagcaatacacttcattgctcgtactgcagagatg

SEQ ID NO: 14626 - DNA, 201 bp, Homo sapiens
agaactcgaccatgcctagtccctgatgtgggagtactgactctagtcttgccaattccagagcccctcaactccctctcgagcaatacacttcattgctygtactgcagagatgcccttaccaagtaggccacccacttgagtgacatactagcaagaaggctcaagccaggatgtattttgcactgcccactgaaccct

SEQ ID NO: 14627 - DNA, 201 bp, Homo sapiens
ctagctaagcaagttcaaattagccagctggaagacaggcaatggcctgtgtaatctcctgagatacaagcaggacacccgtggggaaaggggaaggaacrctgcctgaccaaatgtgcgtctccacagttccagctggcagattccaccagtaaccgggatcctccaagatgaagaaagaagcatttataaacttaattt

SEQ ID NO: 14628 - DNA, 201 bp, Homo sapiens
ttaaatctcctgccctttacagttgtttgcttatgttgtcttggaaaaagggtgacacttgagataggagagctaatttggccatcatgtcaaggccggcragcagcacctctgcactgcacagcctcaagaatcctttcccttttaattatggagctggcaatgctgcaatccctcctgagggcttgtctcacctcagtt

SEQ ID NO: 14629 - DNA, 201 bp, Homo sapiens
aatttcaagtgcagcatattaaaatgttcggcatttcagtggtattttccatttttgtggcaactctattaacatcttgatgtattttcccttttttttttcattgagacagagtcttgctctgtgggccaggctggagtgcagtggcactatctcggcttactgcaatctccgtctcccgggcacaggcaattctcctgc

SEQ ID NO: 14630 - DNA, 201 bp, Homo sapiens
acttgagataggagagctaatttggccatcatgtcaaggccggcgagcagcacctctgcactgcacagcctcaagaatcctttcccttttaattatggagytggcaatgctgcaatccctcctgagggcttgtctcacctcagtttgctgaggagggtaatgggaagttataacctctttttcctcagctttgtgatccta

SEQ ID NO: 14631 - DNA, 201 bp, Homo sapiens
cagatgaggctatagattctagctaagcaagttcaaattagccagctggaagacaggcaatggcctgtgtaatctcctgagatacaagcaggacacccgtsgggaaaggggaaggaacgctgcctgaccaaatgtgcgtctccacagttccagctggcagattccaccagtaaccgggatcctccaagatgaagaaagaag

SEQ ID NO: 14632 - DNA, 201 bp, Homo sapiens
agaaggagaaccagtaaagggggggtctcgcagcactcaagagaagatagtatttcaatatggaaaaaataaacaacagcatcaaaaacagctaagcaatraatttttggagtaagaactgacaaggaattttgcaaaatgaatgtcataagtaaccttgataagataggagggaagaaatgcctaaatggaggaggtgaa

SEQ ID NO: 14633 - DNA, 201 bp, Homo sapiens
gtgtgtgtgtatgtgtatgtgtgtgtgtggtcataaagaagaagactgttactgcattattaacaagtatgtgggtctagtgtctcaattcctttgcccamcactcatacctataaatgtcttaagtcaacctagcagtttctattcccttttacatggcaggccaagttactctgttgaataagggccaaaatcactaca

SEQ ID NO: 14634 - DNA, 201 bp, Homo sapiens
ttgataagataggagggaagaaatgcctaaatggaggaggtgaaggagataataaaattttaaacggtaaggcagctgatacggcatatgacagctagtayagcatgaaaaggccacgaaaggctggagttctgataggttgtggcttacctattggggaataaaagaaagactatcctttctaaaaagattaaaaatata

SEQ ID NO: 14635 - DNA, 201 bp, Homo sapiens
ggaacattattaaaataatcaagtcaaactttgagagcaaatactgggtaggtatcataaaagcacatattaggccaagcacagtggctcatacatgtaaycccagcactttgggaggccaaggtgagagaatcacttatagcctatgaggtgtagagaggtgtggtggggtgtgtgtgtgtgtatgtgtatgtgtgtgtg

SEQ ID NO: 14636 - DNA, 201 bp, Homo sapiens
tattaatcacagtttaaaagagtaaactggaagacagaactgaggaaatctcagttcaaaatagtacatggaaaatattgaaaatctcagctcaaaataayacacagaagatattgaaaatatgaaaaagaagagctgtaaatagaatgaggtcaggtgtaatggaatttgataagagagaattaaaagaataaatgtcag

SEQ ID NO: 14637 - DNA, 201 bp, Homo sapiens
tgagcccctgagacaggactaactctgaaggaaggagaaaaaaagtgatttgataattaaagctcatggtatatcacatcctgtgtctactcctcttggaktatttacacaaatggaacattattaaaataatcaagtcaaactttgagagcaaatactgggtaggtatcataaaagcacatattaggccaagcacagtgg

SEQ ID NO: 14638 - DNA, 201 bp, Homo sapiens
ctcttctaaaaatacaaaaattagctgggcatggtggcaggtaactgtaagcctagccgctcgggagactgaggcaggagaattgtttgaacccaggagayggaggttgcagtgagccgagatcacgccattgcactccagcctgggtgacagtgcaagactccatctcaaaaaaaaaaaaaaaaatcacagagtttagca

SEQ ID NO: 14639 - DNA, 201 bp, Homo sapiens
ttaccttttctctcattaatcttccaaattattgaaaatagtccagaattttatcgatacttttataattttatgtacagagaaccatcattttagataasttgagattcagaaaaattttagtttgtcagttttaagacaaaaaaggaaccagtatcaaggggaaaaaaatagaaataaagagaaaatacttgatatcta

SEQ ID NO: 14640 - DNA, 201 bp, Homo sapiens
gtctcgatctcctgacctcgtgatccacccgcctcggcctcccaaagtgctgggaacataggcgtgagccaccacgcccggcccgataaacttattttttmatgaactgttggtaaacttaatatgtttttttctttcctaaaagatttttcttctcagagatctaaaagaggaagaggtaaacagatttctatctaacaa

SEQ ID NO: 14641 - DNA, 201 bp, Homo sapiens
tggattgagactaatgataaacttttttttttttttttttttttttttttgagacggagtctcgcactgtcgcccaggctggagtgcagtggcgcaatctyggctcactgcaagctccgcctcccgggttcacgccattctcctctctcagccttctgagcagtgaccacaggcacctgccaccacgcccggccaattttt

SEQ ID NO: 14642 - DNA, 201 bp, Homo sapiens
gaacctaaagaaaatgggaatatctgggaaactagcaaatcttttagtagttggattgagactaatgataaacttttttttttttttttttttttttttttgagacggagtctcgcactgtcgcccaggctggagtgcagtggcgcaatcttggctcactgcaagctccgcctcccgggttcacgccattctcctctctca

SEQ ID NO: 14643 - DNA, 201 bp, Homo sapiens
caacactcaatgttctctttcagtatccactcaccagggctgcctatagatgttccctcggctgtctctctctctctttctctctctctctctctctctctttccttccctctttctctctttctgactagtcctatctccagaactcaacaagaaccactagagctacctctcattcttgctggaagccactaaagttgt

SEQ ID NO: 14644 - DNA, 201 bp, Homo sapiens
ccaacactcaatgttctctttcagtatccactcaccagggctgcctatagatgttccctcggctgtctctctctctctttctctctctctctctctctctctttccttccctctttctctctttctgactagtcctatctccagaactcaacaagaaccactagagctacctctcattcttgctggaagccactaaagttg

SEQ ID NO: 14645 - DNA, 201 bp, Homo sapiens
actgattgttgtaattgccaaaatcattgtagcttccaccacctccaaaattgctcccatcattaccaaatccattatagccatcctcactgccaccatawccaccaccaccacagctgccaccaaagccaccacaaccactgaagtttcctccatgatcaaagttgtcattcccaccgaaaccacctccatgaccaccac

SEQ ID NO: 14646 - DNA, 201 bp, Homo sapiens
gaggcagaggttgcagtgagctgaggtcatgccactgcactccagcctgggcaacagagcaagactctgtctcaaaaagaaaaaaaaaaaaaagaaagaaagaaaataaaagaaaaagaaaatgagactgacaaaagtacatataagtttaagacattatgaacctctagaagtgtttcaagcatttactgttcctaaatg

SEQ ID NO: 14647 - DNA, 201 bp, Homo sapiens
tgggaggcagaggttgcagtgagctgaggtcatgccactgcactccagcctgggcaacagagcaagactctgtctcaaaaagaaaaaaaaaaaaaagaaagaaagaaaataaaagaaaaagaaaatgagactgacaaaagtacatataagtttaagacattatgaacctctagaagtgtttcaagcatttactgttcctaa

SEQ ID NO: 14648 - DNA, 201 bp, Homo sapiens
ctgtaatcgcttgaacctgggaggcagaggttgcagtgagctgaggtcatgccactgcactccagcctgggcaacagagcaagactctgtctcaaaaagaaaaaaaaaaaaaagaaagaaagaaaataaaagaaaaagaaaatgagactgacaaaagtacatataagtttaagacattatgaacctctagaagtgtttcaa

SEQ ID NO: 14649 - DNA, 201 bp, Homo sapiens
cctgtaatcgcttgaacctgggaggcagaggttgcagtgagctgaggtcatgccactgcactccagcctgggcaacagagcaagactctgtctcaaaaagaaaaaaaaaaaaaagaaagaaagaaaataaaagaaaaagaaaatgagactgacaaaagtacatataagtttaagacattatgaacctctagaagtgtttca

SEQ ID NO: 14650 - DNA, 201 bp, Homo sapiens
agcttgcagtaagccgagatcacgccaccgcactccagcctgggtgacagagcaagactccgtctcaaaaaaaaaaaacctacaaaaatgagccagacttsgtggcaggtacctgtaatcgcttgaacctgggaggcagaggttgcagtgagctgaggtcatgccactgcactccagcctgggcaacagagcaagactctg

SEQ ID NO: 14651 - DNA, 201 bp, Homo sapiens
ttgggaggccaaggcgggcagatcacgaagtcaggagatggagaccatcctggctaacacagtgaaaccctgtctctactaaaaatacaaaaaaataataataataataagtcgggcatggtggcgggtgcctgtagttccaggtactcgggaggctgaggcaggagaatggcatgaacccaggagccagagcttgcagta

SEQ ID NO: 14652 - DNA, 201 bp, Homo sapiens
ctttgggaggccaaggcgggcagatcacgaagtcaggagatggagaccatcctggctaacacagtgaaaccctgtctctactaaaaatacaaaaaaataawaataataataagtcgggcatggtggcgggtgcctgtagttccaggtactcgggaggctgaggcaggagaatggcatgaacccaggagccagagcttgcag

SEQ ID NO: 14653 - DNA, 201 bp, Homo sapiens
cttctgttttagagatgaggaaattaatgttcaaaacatttagtgacttgcccaaaatcacagagctagagaatagcaaaagtcggactcagctctttaayctcaagactgtttgtaccacacctgaggagggggaggagggaatgggattgtctatctccatgccttctgaaagtctaaatctaagtaatgttacacttt

SEQ ID NO: 14654 - DNA, 201 bp, Homo sapiens
tggttaataggtacaaaaatagttagatagaatggataagatctaatatttgatagcacaacagggtgactatagtcaaaggaaatttattgtacattttkaaacaactaaaagaatataattgcaatgtttgtaacacaaagaaatgataaatgcttaaggtgatattcagttaaccctgatgtgattactacacattat

SEQ ID NO: 14655 - DNA, 201 bp, Homo sapiens
aaggtactaaggtacacaagaagatagggttgttttaaagattaaaataacagaaattaataaatcaaaaataaaaacagaattaagtgcacattataatrctctgctgtcaggactcagaactttccaaaggacagtcagaaataagaggaaaaattaaagcagaaaaaagtaaaatataaagtagcttactactttgcc

SEQ ID NO: 14656 - DNA, 201 bp, Homo sapiens
taggtacaaaaatagttagatagaatggataagatctaatatttgatagcacaacagggtgactatagtcaaaggaaatttattgtacattttgaaacaaytaaaagaatataattgcaatgtttgtaacacaaagaaatgataaatgcttaaggtgatattcagttaaccctgatgtgattactacacattattacacat

SEQ ID NO: 14657 - DNA, 201 bp, Homo sapiens
tcatttctggggaaagctactatttccctccccaaaacagcaaagtaacaaataagggaaaaataattatacacaaagaaggaaacaaattattcaattaytttaagaaaaaaaattgcaaaattttcaacatcttaaaatatgattggttatttctcaagacagaagcaacagagattaaaatgacataattaaggtact

SEQ ID NO: 14658 - DNA, 201 bp, Homo sapiens
tagaatggataagatctaatatttgatagcacaacagggtgactatagtcaaaggaaatttattgtacattttgaaacaactaaaagaatataattgcaatgtttgtaacacaaagaaatgataaatgcttaaggtgatattcagttaaccctgatgtgattactacacattattacacattgtatgagtgtaccaaaata

SEQ ID NO: 14659 - DNA, 201 bp, Homo sapiens
tagaaaaacagacatctcttcccaaatgctgagggtagatcctgtcatttctggggaaagctactatttccctccccaaaacagcaaagtaacaaataagsgaaaaataattatacacaaagaaggaaacaaattattcaattactttaagaaaaaaaattgcaaaattttcaacatcttaaaatatgattggttatttct

SEQ ID NO: 14660 - DNA, 201 bp, Homo sapiens
caaaggaaatttattgtacattttgaaacaactaaaagaatataattgcaatgtttgtaacacaaagaaatgataaatgcttaaggtgatattcagttaamcctgatgtgattactacacattattacacattgtatgagtgtaccaaaatatttcatgtacctacttgcacctactatatacccataaaaattaaaaata

SEQ ID NO: 14661 - DNA, 201 bp, Homo sapiens
tgcagtgagctgagactgtgccactgcactccagtctgggtgacagagagagattgtctcaaaaaaaaaaaagaaagaaaaattcctttctcctcattatyccatattactttaggtcaggaatggaatatatatgacctgtgttacatttctgctcatgcctttgcctgtggcagaaatcagtaattgatcatgattctc

SEQ ID NO: 14662 - DNA, 201 bp, Homo sapiens
cataagatacaatcagcaaaattatcatttatgagtgagactgaaatgaagtcattttgtatattcaagaacatagaaactcattaaacacaggtccccartgaaagaattatcaaagggacatacttcagggagtttacttttgagtaaaaactcaaaaagaagttagaaccaagaaacatatgtaagaaaacaaatcaa

SEQ ID NO: 14663 - DNA, 201 bp, Homo sapiens
agtgcagcatattaaaatgttcggcatttcagtggtattttccatttttgtggcaactctattaacatcttgatgtattttcccttttttttttcattgaracagagtcttgctctgtgggccaggctggagtgcagtggcactatctcggcttactgcaatctccgtctcccgggcacaggcaattctcctgcctcagcc

SEQ ID NO: 14664 - DNA, 201 bp, Homo sapiens
gacaacatagtgaggctctgtctctacagaacaattaaaagaattagtagggcatggtggcatgcctgtagtcctagctacatgggaggctgagttgggakgatcacttgagcccagtagtgagaggttatagtgagctatgcaaccactgaacttcaacctgggcaacagagtgaaaccctgtcccccccaccccagccc

SEQ ID NO: 14665 - DNA, 201 bp, Homo sapiens
catcaggtgagtgtggtggtgcatgcctgtagtcacagctactcagtaggctgaggtgggaggattgctcgagcctgggaggtcaaagcagcagtaagccrtgatcatgccaccgcactccagcctaggagcaagaccctgtcaaaaaaaaaaaaaaaagcaggaagaaaagaaggagaaggagagagtgaaggagaaata

SEQ ID NO: 14666 - DNA, 201 bp, Homo sapiens
tgtatatacaactgtgaacaggtgcccttagaaagctatcaagctcaatattttattacttttataattaaaacatgttttatctagttttactttgtttkcatctaacttatggaaagggtaaaatatttgggagttgaaacatgctaaacaataaactcaaatcttcagtttcttcagcaaaatctgcagaggacccat

SEQ ID NO: 14667 - DNA, 201 bp, Homo sapiens
aaaaacatatgacctggccaggcgtggtggctcatgcctgtaatcccagcactttggaaggccaaggcaggaggattgcctgaggtcaggagttcgagacyagcctggccaacatggcaaaaccccatctctactaaaaatacaaaaattagctgggtgtggtggcacacacctgtaatcccagctacttgggaggctgag

SEQ ID NO: 14668 - DNA, 201 bp, Homo sapiens
acccccaggacatcattaaatgtatttactcttccaatccaaagtattctttggaaataaaatgtttgttccaaggaatttagaaaatcatgcatatgttraaaatatattacttcaatttttaaaatgtaatttgaaaatcttaaaatgtaaattaatataaaatatcagaattagtgtgctaatccaatactgtgccat

SEQ ID NO: 14669 - DNA, 201 bp, Homo sapiens
aaaattacaaagttttccagagccaatataccttctaagctatatgtctacgtgtaagtgtgcattcatctaaagacataagtcattaacttcttctaatstgtgactaagatgtgagtcctgaaggctttcctctagagcttcagtaaatttacttaatctaaatgggtccaggtgctggagtgattacccttatcttgt

SEQ ID NO: 14670 - DNA, 201 bp, Homo sapiens
aactttctgtactgtaaaaaaaatacagtgagagctggtataatggtagagatttgaaaggaagagaaaacatgaaaagacaaaaaagacgatgaagagakaacataaattagtaacctttaactattagccagtctcctgaaagaatgtgacctagtttaagaatgtttaaaaaaatattttatttcattagaaaaagtg

SEQ ID NO: 14671 - DNA, 201 bp, Homo sapiens
tttcagtaagccccgaggttctaaatactttcactactttgactctttagcttctaatattattcaagaacttcctgatttggtctcttgctattcttcayctccatagggcacaagtgaattttggaaagtggaaacccctgttgaagcagttaggtggtaattgtttggtgtaacaaaaaatcttttcgaacaaaggga

SEQ ID NO: 14672 - DNA, 201 bp, Homo sapiens; identical to SEQ ID NO: 2953

SEQ ID NO: 14673 - DNA, 201 bp, Homo sapiens
tcaagaacttcctgatttggtctcttgctattcttcacctccatagggcacaagtgaattttggaaagtggaaacccctgttgaagcagttaggtggtaaytgtttggtgtaacaaaaaatcttttcgaacaaagggaaaacagaaaattaaggagagagaggaagaggtggaggaaaggtagagaaggaaagaacagagc

SEQ ID NO: 14674 - DNA, 201 bp, Homo sapiens
gtcgcgactgtagtgagctaggattgcaccactgcattccagcctgggtgacagagtgagaccttatctcaaaaaacaaaacaaaacaaaacaaaaaaaamcagaaggttttgttgactctttgctcacagactctaaagctaatcaaagcagcagtcactgctctatcactctccaataagctggaagctgtgagaagaa

SEQ ID NO: 14675 - DNA, 201 bp, Homo sapiens
gcactttgggaggccaaggcgggcagatcacgaagtcaggagatggagaccatcctggctaacacagtgaaaccctgtctctactaaaaatacaaaaaaawaataataataataagtcgggcatggtggcgggtgcctgtagttccaggtactcgggaggctgaggcaggagaatggcatgaacccaggagccagagcttg

SEQ ID NO: 14676 - DNA, 201 bp, Homo sapiens
gcgacagaacgagactctgtctcaaaaacacacacacaaaaaaatgaggccgggcgcagtggctcacgcctataatcccagcactctgggaggccccgtgrgccagatcacttaaggtcagtagttcaagaccagcctggccaacatgatgaaaccgcgcctctattaaaaatacaaaaattaggcccggcgcactggtgg

SEQ ID NO: 14677 - DNA, 201 bp, Homo sapiens
tcgcttgaacccgggaggtggaggttgcagtgagccgagatcgtgtcactgcccttcagcctgggcgacagaacgagactctgtctcaaaaacacacacamaaaaaaatgaggccgggcgcagtggctcacgcctataatcccagcactctgggaggccccgtgggccagatcacttaaggtcagtagttcaagaccagcc

SEQ ID NO: 14678 - DNA, 201 bp, Homo sapiens
agctactcaggaggcagaggcaggagaatcgcttgaacccgggaggtggaggttgcagtgagccgagatcgtgtcactgcccttcagcctgggcgacagarcgagactctgtctcaaaaacacacacacaaaaaaatgaggccgggcgcagtggctcacgcctataatcccagcactctgggaggccccgtgggccagatc

SEQ ID NO: 14679 - DNA, 201 bp, Homo sapiens
ctgtctaaaaaaaaaaaatacaaaagttagctgggcgtggtggtgcacgcctgtaatctcagctactcaggaggcagaggcaggagaatcgcttgaacccrggaggtggaggttgcagtgagccgagatcgtgtcactgcccttcagcctgggcgacagaacgagactctgtctcaaaaacacacacacaaaaaaatgagg

SEQ ID NO: 14680 - DNA, 201 bp, Homo sapiens
ttcaagaccagcctggccaacatggtgaaacttcgtctctattaaaaatacaaaaaattggccaggcatggtagcgcatgcctgtagtcccagctacttgrgaggctgaggcaggagaatcacttgaacttgggaggtggagattgcagtgagccgagatctcaccactgcactccagcctgggtgacagagtgagactct

SEQ ID NO: 14681 - DNA, 201 bp, Homo sapiens
catttgttattgactattcccctgaatcaagactgcttttctcagtactcacagattgccaagacttatagccttggaagttctcataattattacagggrggataaacataagccagctcacctcagaggaactcactggggctaaaggaagggtcacatctggtccacagttccctaatagccaccatgtgccagagaa

SEQ ID NO: 14682 - DNA, 201 bp, Homo sapiens
gagtttacagtcctataagataacttgggaaaacaaacccaaaatgtgtagagggcaggcagcatcccatacagccacactatgaccattaaaactggatwtttactgccctgaattctggttctaactatcctttttgtgaatgaataagagccatttgttattgactattcccctgaatcaagactgcttttctcagta

SEQ ID NO: 14683 - DNA, 201 bp, Homo sapiens
acatgtactcagcacctactatatgttagtcattctggtgagcattttttcattttattaatattgaatatctacaaacaaccctgtcaaccacacaaagrtgagctacccaaaaatccctccctggctgtccaaggcctccagtagcctacaggttgctttggtgcatattaggaaaaggtgttccttcctgcaagtgaa

SEQ ID NO: 14684 - DNA, 201 bp, Homo sapiens
tccctgctactcaggaggctgaggcacgagaatcccttgaacccagaaggtggaggttgcagtgagccaagatcaccctaccacactccagcctgggcgamagagtgagagactctgtctcaaaaaatagaagtgtgtgtgtgtgtgtgtgtgtgtgtgtgtgtgtgtgtttaatttgtttgtttctattttttagtacaa

SEQ ID NO: 14685 - DNA, 201 bp, Homo sapiens
acctctcaaagcctcacttctaggataaaattagtgaaaaatacactctccaaataactgtactaatatgccaatttgaatttctttttagtgcaaactcyaggacctattggtaagctgcctgtatatatcaacttatctctactggcttcttactatgtctgaaggagactggctccaactgtttaagtatctgggtta

SEQ ID NO: 14686 - DNA, 201 bp, Homo sapiens
caaaaattaaaaactcacagtgttaagtttctatgaatctctccacatcttaatccatgtttatataaaaatatatgcaaatatgagtatatgtaggaatytttttctaaaaatagggtcaaactatatacataattctgcaacttgtcttcttcgcctaacaatacatcatgggcaacacatcaatctaacattttaata

SEQ ID NO: 14687 - DNA, 201 bp, Homo sapiens
gggcaaagccaacagggcctgctgttcgactgaatgtgattttaagggaaaaagaagacaccaagggttactcctagatttggggtctaagaaacttgacraatgaaactatttattgatttaggtagtggagaagagcagatttataggatgctattgtgagttcagttttgtgtatgcttggttctagatgcctggaac

SEQ ID NO: 14688 - DNA, 201 bp, Homo sapiens
ttctgtactgtaaaaaaaatacagtgagagctggtataatggtagagatttgaaaggaagagaaaacatgaaaagacaaaaaagacgatgaagagagaacrtaaattagtaacctttaactattagccagtctcctgaaagaatgtgacctagtttaagaatgtttaaaaaaatattttatttcattagaaaaagtggcct

SEQ ID NO: 14689 - DNA, 201 bp, Homo sapiens
ttattgtggaggattaactggagtgagagtgagggctcaagagggcaagtaggaagaccagttaagaggcctgaaactaaaggtgagtgtggcaatgagaagagtgatcagagtggaagtgggaagaaggtcttcagattttatttattttgggggcaaagccaacagggcctgctgttcgactgaatgtgattttaaggg

SEQ ID NO: 14690 - DNA, 201 bp, Homo sapiens
gacatccctctgctccacggcaagaacccacacaattccttggtggctcagatatttcttttacttaattcagggaaccatattacttaaaaaaaacaaaagcaaataaaaaatacctagcagaagccaataaattcaggtttgttaaatcacacaggaattgagacgtaacagctgatttacctgaacatgatcaaagga

SEQ ID NO: 14691 - DNA, 201 bp, Homo sapiens
tagtaacctttaactattagccagtctcctgaaagaatgtgacctagtttaagaatgtttaaaaaaatattttatttcattagaaaaagtggccttcactyatataacccatcatacgtgccattcaaaatggcctggatatttaagttattaaagtggagttaaaattgacttaataagagatagcatattcctagaaga

SEQ ID NO: 14692 - DNA, 201 bp, Homo sapiens
ctaaatgtatttaaaaacaagttgcaactatctatgctgcctgtagcagacacactccagctctaaggatacatatagaatgaaagtaaagggatgaaaaraagatgctccatgcaaatggaaaacaaaagacggtaggggtggctatacttacatcaggcaaaatagacttttagtcaaaaattataacaagagacaaag

SEQ ID NO: 14693 - DNA, 201 bp, Homo sapiens
ctctattattgtggaggattaactggagtgagagtgagggctcaagagggcaagtaggaagaccagttaagaggcctgaaactaaaggtgagtgtggcaakgagaagagtgatcagagtggaagtgggaagaaggtcttcagattttatttattttgggggcaaagccaacagggcctgctgttcgactgaatgtgatttt

SEQ ID NO: 14694 - DNA, 201 bp, Homo sapiens
tagccagtctcctgaaagaatgtgacctagtttaagaatgtttaaaaaaatattttatttcattagaaaaagtggccttcacttatataacccatcatacstgccattcaaaatggcctggatatttaagttattaaagtggagttaaaattgacttaataagagatagcatattcctagaagatttaatgtttcccaaag

SEQ ID NO: 14695 - DNA, 201 bp, Homo sapiens
taggcatcatgagaagtaactgaagggcttgaacagggaaatgatagggtctactttataattttaaaagatcactctattattgtggaggattaactggrgtgagagtgagggctcaagagggcaagtaggaagaccagttaagaggcctgaaactaaaggtgagtgtggcaatgagaagagtgatcagagtggaagtgg

SEQ ID NO: 14696 - DNA, 201 bp, Homo sapiens
atacaagcaactcttgatcttcccgttgtttctatttatgatactccctagagcgagtgttgggaaatggaaatttccttcacagtggtgaagcatactgrtatctttttctttctccctctttctctctcacagccggagctacaggacctatcagtaagtttgctctctgattctccacagtgagcattttactttcct

SEQ ID NO: 14697 - DNA, 201 bp, Homo sapiens
tagagcaatctgaagaagactaaaataagaaacctaacagcattgaacaagtcaaacactaaaggaaaaaaaagaaaaagtcttcaaagatattaatgcaytttaaaaatatatgtattcaacaaatatatattggcctattgtaggccaggcattatcctaagcactggaaatatagccatgagcaagacaaagtccttg

SEQ ID NO: 14698 - DNA, 201 bp, Homo sapiens
ttttaaataagtcaaaggcccacagaaacaagaaaccacatagaaaggaccaaaatcaatttgttcttctggttagagagttaagttgcaaaagagaagcmagaggaaataatgctgggaaaatatgctgggaagactatggaaataatacactaagaagtttgtatcacagtctgaagccacagggtcacaagatgaaac

SEQ ID NO: 14699 - DNA, 201 bp, Homo sapiens
agactatggaaataatacactaagaagtttgtatcacagtctgaagccacagggtcacaagatgaaactccaaaagataaaaggtagaaataataaaaacwagaagatgtagcaaatgggagtagaagaagggacagactgcaaaatgcaaacagagaaaacactaaaatagaattcaagataaaaaagaaagattgatct

SEQ ID NO: 14700 - DNA, 201 bp, Homo sapiens
gaagtggaagctgcagtgagccatgttcatgccactgcactgcagcctgggagactgagaccctgtctcaaaaaaatatattaaaaaaaaattcgtatcamtgtcaaaaaataatgttagcacacatcttctaagcaagaccattatatgtcctatattttataaattgtaatcttgacattctagacaaaattgataatg

SEQ ID NO: 14701 - DNA, 201 bp, Homo sapiens
gtgagtgatacctcacaagccccaacaaattggagaattccaacccagagaaatataactagagcaatctgaagaagactaaaataaggaacctaacagcrctgaacaagtcaaacactaaaggaaaaaaaagaaaaagtcttcaaagatattaatgcattttaaaaatatatgtattcaacaaatatatattggcctatt

SEQ ID NO: 14702 - DNA, 201 bp, Homo sapiens
ttaccaccagatgaaacttcagaaatgactggttaagttccatgtctattgtatgatagctgcctttggcttcctatagggcctggcatacttttcctctytgctcatttctgtcttgtgtgtgtagaaactcacatttcttcatttcttttgcttattcctctatttagctgctgctccactcctataaggaatgaataa

SEQ ID NO: 14703 - DNA, 201 bp, Homo sapiens
tattggtaagctgcctgtatatatcaacttatctctactggcttcttactatgtctgaaggagactggctccaactgtttaagtatctgggttaaagaagytgaaaatcatatttcttagactttcatttccccatatcgtaactgttaggttttggagggaaggcgagggttaaagaaaagacacagagagagtggcggc

SEQ ID NO: 14704 - DNA, 201 bp, Homo sapiens
tttgcttattcctctatttagctgctgctccactcctataaggaatgaataaaggagaataccaaacccaaaatagagagataaagttcggaaactacccraagtttatagtgacttgtcaacaagggaagggaaggatatttgtatgaataaatgaaagctttcacaggatggcagaaatagggagaagaaaggtaaagg

SEQ ID NO: 14705 - DNA, 201 bp, Homo sapiens
ggaaggatatttgtatgaataaatgaaagctttcacaggatggcagaaatagggagaagaaaggtaaaggcagcacagtttaaagaaattaccaatccccygcaggatttccagcagtaaccactcactgcaaaaagggaagagatcaatcatctccctttcctgcagcctcctatactaagcagaaggcagaatccccac

SEQ ID NO: 14706 - DNA, 201 bp, Homo sapiens
caatcatctccctttcctgcagcctcctatactaagcagaaggcagaatccccacaaggcatgatggcaggtatattccccagcacagcgctctatgcccytgccctaagaaggatgtttcttccattgccatttctgatatttcctttcaggaaagtagtacgaaaactagctcctctttcagcaggctgtacacgttga

SEQ ID NO: 14707 - DNA, 201 bp, Homo sapiens
agatgaggctatagattctagctaagcaagttcaaattagccagctggaagacaggcaatggcctgtgtaatctcctgagatacaagcaggacacccgtgrggaaaggggaaggaacgctgcctgaccaaatgtgcgtctccacagttccagctggcagattccaccagtaaccgggatcctccaagatgaagaaagaagc

SEQ ID NO: 14708 - DNA, 201 bp, Homo sapiens; identical to SEQ ID NO: 2956

SEQ ID NO: 14709 - DNA, 201 bp, Homo sapiens
gccatgatctatgcaggtgtccacatagccacctaggacctattctgtttggccttctgtcagttgagttgggagctgacctagcttagaaaccccacagrtccaccaggaactaaaatctcctataagaaccccatacacattacctgcagggatcccgtaaggaatatgaccaaatacatgggtcactacactcaggga

SEQ ID NO: 14710 - DNA, 201 bp, Homo sapiens
aacagctatccctctgctgtgggagtagtactcgccatgatctatgcaggtgtccacatagccacctaggacctattctgtttggccttctgtcagttgarttgggagctgacctagcttagaaaccccacagatccaccaggaactaaaatctcctataagaaccccatacacattacctgcagggatcccgtaaggaat

SEQ ID NO: 14711 - DNA, 201 bp, Homo sapiens
gaggaatggggaaggtggtgagaaagcacataaagatggaggaaaggagaaaaacttgcaattttactgttctctcttttaccagtgtgaggaatttgagrctgatttcaagatcctctaagtgactgattaattttttcatttaacaaagtggaaattcttataataaaaactagattaattaatgaaattgtgaaaaag

SEQ ID NO: 14712 - DNA, 201 bp, Homo sapiens
tacaactcagtcctttttttactgacacctaataattgtacaaatttatgggatacatgtgatattttgatacatgcataccatgtgtaatgattttgatmttctataatgtgcctgctaccagaggaatggggaaggtggtgagaaagcacataaagatggaggaaaggagaaaaacttgcaattttactgttctctctt

SEQ ID NO: 14713 - DNA, 201 bp, Homo sapiens
tgccctgcatttttaaaaataatttcaacttttattttagattccggtggtgcatatgcaggtttgctaatgggtatattgtgtgatgctgaggtttaggrgtgacttgcttttttaacactgtctttctcaactcccctggcattcctattacatagtttccaaagaggccatgcacgaagtgttaagaaatctcacagg

SEQ ID NO: 14714 - DNA, 201 bp, Homo sapiens
actcagtaggacctaagggaggaagcacagtttgccagcaagggcattaacagctatccctctgctgtgggagtagtactcgccatgatctatgcaggtgtccacatagccacctaggacctattctgtttggccttctgtcagttgagttgggagctgacctagcttagaaaccccacagatccaccaggaactaaaatc

SEQ ID NO: 14715 - DNA, 201 bp, Homo sapiens
tactcagtaggacctaagggaggaagcacagtttgccagcaagggcattaacagctatccctctgctgtgggagtagtactcgccatgatctatgcaggtgtccacatagccacctaggacctattctgtttggccttctgtcagttgagttgggagctgacctagcttagaaaccccacagatccaccaggaactaaaat

SEQ ID NO: 14716 - DNA, 201 bp, Homo sapiens
tgggtagggcatggacttttcaccatctctatcccttataactagcagattcacaatcatgagacctgctgggccccttaatgcaactgagtttgtgatcratccccacagagataatcaggaattctgtctggtatggaaaatgtggtactctctaaaagaactaactctgatgctcccattaggaagaatatccacaga

SEQ ID NO: 14717 - DNA, 201 bp, Homo sapiens
gtggcatgatctccactcactgcaagctccacctcgtgggttcaagccgttctcctgtcttagcctaccgagtagctgggactacaggcacccaccaccaygcccggctaatttttttgtatttttagtagagatggggtttcactctgttagccagaatggtctcgatctcctgacctcgtgatccgcccgcctcagcct

SEQ ID NO: 14718 - DNA, 201 bp, Homo sapiens
tcacttaaatctcttctcatctgaaaacagagctcccaaattagccaccactagcccggtgccacctatagatgtgttttgtttggtcaggatggtattaytttaaattttgaatttgaatgcctctgggtagggcatggacttttcaccatctctatcccttataactagcagattcacaatcatgagacctgctgggcc

SEQ ID NO: 14719 - DNA, 201 bp, Homo sapiens
gcaagacatccctctgctccacggcaagaacccacacaattccttggtggctcagatatttcttttacttaattcagggaaccatattacttaaaaaaaamaaaagcaaataaaaaatacctagcagaagccaataaattcaggtttgttaaatcacacaggaattgagacgtaacagctgatttacctgaacatgatcaa

SEQ ID NO: 14720 - DNA, 201 bp, Homo sapiens
cctttctttattttttttgagatggagtctcgctctgtcatccgggctggagtgcagtggcatgatctccactcactgcaagctccacctcgtgggttcamgccgttctcctgtcttagcctaccgagtagctgggactacaggcacccaccaccacgcccggctaatttttttgtatttttagtagagatggggtttcac

SEQ ID NO: 14721 - DNA, 201 bp, Homo sapiens
gattaatctcaaaggatgatgagtaattagttatgtagagtatttagctgaaagatgcatagggccacaggaagctattcatccctgaagctcaagatgaygtgtggtcctacagaatggatgaggccctcttgagagataattctcataggcaattcactggactgtgataactcgagaaagggcctctcaaaccaggac

SEQ ID NO: 14722 - DNA, 201 bp, Homo sapiens
aaaacagtgaatctttgaggattaactgatttaccttaataaacccattaaacccagctagcaggaataataaacctaggtcttctttttttttttttttktttttttgtgtgtgtgtgtgtgagatggagtatcgctctgtcacctagactggagtgcagtggtgcaatcccagcccactgcaacccctgcctcccgggt

SEQ ID NO: 14723 - DNA, 201 bp, Homo sapiens
cattattagattatcttcactttgtaaaataatgcaaattttaagtttcctttctttattttttttgagatggagtctcgctctgtcatccgggctggagygcagtggcatgatctccactcactgcaagctccacctcgtgggttcaagccgttctcctgtcttagcctaccgagtagctgggactacaggcacccacca

SEQ ID NO: 14724 - DNA, 201 bp, Homo sapiens
acctctgcctcacgggttcaagtgattctcctgcctcagcctcccaagtagctgggattacaggcatgtgccaccatgcccagctaattttgtatttttartagagacagggtttcactatgttggtcaggctggtctcgaactcctgacctcaggtgatctgcccacttcagcatcccaaagtgctgggattacaggcgt

SEQ ID NO: 14725 - DNA, 201 bp, Homo sapiens
ttgggaggccgaggtgaggggatcactcaaggccaggagtttgagaccagcctggccaacatggtgaaaccccatctctactaaaaatacaaaaattagcygggcgtggtggcacatgcctgtaatcccagctactcaggaggccgaggcacaagaatgacttcaacccaggaggtgaaggttgcagtgagctgagactgt

SEQ ID NO: 14726 - DNA, 201 bp, Homo sapiens
acgatcttgcctcactgcaacctctgcctcacgggttcaagtgattctcctgcctcagcctcccaagtagctgggattacaggcatgtgccaccatgcccrgctaattttgtatttttaatagagacagggtttcactatgttggtcaggctggtctcgaactcctgacctcaggtgatctgcccacttcagcatcccaaa

SEQ ID NO: 14727 - DNA, 201 bp, Homo sapiens
cccagtatggaggctcacacctgtaatcccagcactttgggaggccgaggtgaggggatcactcaaggccaggagtttgagaccagcctggccaacatggygaaaccccatctctactaaaaatacaaaaattagccgggcgtggtggcacatgcctgtaatcccagctactcaggaggccgaggcacaagaatgacttca

SEQ ID NO: 14728 - DNA, 201 bp, Homo sapiens
gggcaattaattaatttttttttttttggacaaagtttcgttcttgtcgcccaagctggagtgcaatggcacgatcttgcctcactgcaacctctgcctcmcgggttcaagtgattctcctgcctcagcctcccaagtagctgggattacaggcatgtgccaccatgcccagctaattttgtatttttaatagagacaggg

SEQ ID NO: 14729 - DNA, 201 bp, Homo sapiens
ccattaacctattttcttgttttgattttcaggaatacctcaagttcacactagtaagttcctaatatatttttattacattagtttcttgtagggctggrgtgagcaaattttttctacaaatgtttttaatgttttatgtttgtttttgtttgctgggtttttgtgttttttggtttgtttggtgtttttggttttgtt

SEQ ID NO: 14730 - DNA, 201 bp, Homo sapiens
gttcacactagaaagagagtgggtttggagggaaaggaaggcagggagatgaagttgaaaggggcaattaattaatttttttttttttggacaaagtttcrttcttgtcgcccaagctggagtgcaatggcacgatcttgcctcactgcaacctctgcctcacgggttcaagtgattctcctgcctcagcctcccaagtag

SEQ ID NO: 14731 - DNA, 201 bp, Homo sapiens
caccagcatggcacatgtatacatatgtaactaacctgcacattgtgcacatgtaccctaaaacttaaagtacaataataataaaataaaataaataaatwaattaaattaaataaatgcagttccaaaagatggtgagaattatcaaactttgcatagtcatttaacagtcaatgtaagacaaataagactaatgcccag

SEQ ID NO: 14732 - DNA, 201 bp, Homo sapiens
aaatactattttagacattgaaatttgaatttcatacaattttcatgtgccacaaaatattattattattattattattattattattattattattatttcaactatttaaatatgtaaaatccattcttacctcacaggacatgcaaaaatagcatgtcctagatgctatttttatttggaaaactagatttatatgga

SEQ ID NO: 14733 - DNA, 201 bp, Homo sapiens
agcacaccagcatggcacatgtatacatatgtaactaacctgcacattgtgcacatgtaccctaaaacttaaagtacaataataataaaataaaataaatwaataaattaaattaaataaatgcagttccaaaagatggtgagaattatcaaactttgcatagtcatttaacagtcaatgtaagacaaataagactaatgc

SEQ ID NO: 14734 - DNA, 201 bp, Homo sapiens
aaaatactattttagacattgaaatttgaatttcatacaattttcatgtgccacaaaatattattattattattattattattattattattattattatttcaactatttaaatatgtaaaatccattcttacctcacaggacatgcaaaaatagcatgtcctagatgctatttttatttggaaaactagatttatatgg

SEQ ID NO: 14735 - DNA, 201 bp, Homo sapiens
tatcaatgtcaaaaaataatgttagcacacatcttctaagcaagaccattatatgtcctatattttataaattgtaatcttgacattctagacaaaattgmtaatgatcaatgataagtaaaggtgatttaaagtagcttatcacaaggtctttgtaaactacactgggcaaagagaagggggaagggaaatgaagtttct

SEQ ID NO: 14736 - DNA, 201 bp, Homo sapiens
taaaatactattttagacattgaaatttgaatttcatacaattttcatgtgccacaaaatattattattattattattattattattattattattattatttcaactatttaaatatgtaaaatccattcttacctcacaggacatgcaaaaatagcatgtcctagatgctatttttatttggaaaactagatttatatg

SEQ ID NO: 14737 - DNA, 201 bp, Homo sapiens
ttcacatttaaataaatgaaatttagttgttaatgacacagatcccactcaatgcagaggtttggggactgggaagaagggaatgcccagtacctactgawgtgtttgcctttatctctttcagtggacagttctggaaaaatcagtaagtttggatcatttccttgccttacctatttctgtgcctaggacctttaagtt

SEQ ID NO: 14738 - DNA, 201 bp, Homo sapiens
ataaaatactattttagacattgaaatttgaatttcatacaattttcatgtgccacaaaatattattattattattattattattattattattattattatttcaactatttaaatatgtaaaatccattcttacctcacaggacatgcaaaaatagcatgtcctagatgctatttttatttggaaaactagatttatat

SEQ ID NO: 14739 - DNA, 201 bp, Homo sapiens
aaatgaaatttagttgttaatgacacagatcccactcaatgcagaggtttggggactgggaagaagggaatgcccagtacctactgaagtgtttgcctttrtctctttcagtggacagttctggaaaaatcagtaagtttggatcatttccttgccttacctatttctgtgcctaggacctttaagttctttttcccaaat

SEQ ID NO: 14740 - DNA, 201 bp, Homo sapiens
gaagaagggaatgcccagtacctactgaagtgtttgcctttatctctttcagtggacagttctggaaaaatcagtaagtttggatcatttccttgccttasctatttctgtgcctaggacctttaagttctttttcccaaatgttcttgtgttacgagttcctctaccttacagcagtcaatatttcttcaataagtgatt

SEQ ID NO: 14741 - DNA, 201 bp, Homo sapiens
tttgcctttatctctttcagtggacagttctggaaaaatcagtaagtttggatcatttccttgccttacctatttctgtgcctaggacctttaagttcttyttcccaaatgttcttgtgttacgagttcctctaccttacagcagtcaatatttcttcaataagtgatttcctcatatttcaattttaattcttcttatct

SEQ ID NO: 14742 - DNA, 201 bp, Homo sapiens
aggctttcctaacttcacagttgtggccattcacactgtggtatttctgaatgacagtcttatccacggagtcatggtcatcaaaggttacaaaggcaaakccccttttcttgcaactgcctcggtcagtcatgttttcaatcacttcaatttttccatactactcaaaataatttcttaggtgatttcttcagtgtcttc

SEQ ID NO: 14743 - DNA, 201 bp, Homo sapiens
ctaccaaagattattggtagcatatattcccagctaatctatcacaacagagcctatttcctctgtgctataatctggcaactaataatttttactaaaaragaaaatcctctaagattgacaaaaagaatatgtgtcaggactagatgtgattttggtaattgatcaacaatatacatttttcaaacggaccagaacagt

SEQ ID NO: 14744 - DNA, 201 bp, Homo sapiens
tctacattacccaaagtcttcaagattaggactgcaagtcaacctttttgattcgtaactgtagtatttcccattattttagttctaaactcagcttccawggtaacacataccaacagtgactcaatatttaaaccaggtcaagcactaacaatgatgatatttaatatagaattcgtgaaaccgcctttcacactatgt

SEQ ID NO: 14745 - DNA, 201 bp, Homo sapiens
tgtgctataatctggcaactaataatttttactaaaaaagaaaatcctctaagattgacaaaaagaatatgtgtcaggactagatgtgattttggtaattratcaacaatatacatttttcaaacggaccagaacagtgagcaaaaaactgttttgcagaagacatatgaaagacttatcaaagaacaaagaaaggcagga

SEQ ID NO: 14746 - DNA, 201 bp, Homo sapiens
caaatgtcagttcatttacagtacattttaccttttctctcattaatcttccaaattattgaaaatagtccagaattttatcgatacttttataattttaygtacagagaaccatcattttagataacttgagattcagaaaaattttagtttgtcagttttaagacaaaaaaggaaccagtatcaaggggaaaaaaatag

SEQ ID NO: 14747 - DNA, 201 bp, Homo sapiens
aaaaaaatgacagaaaaatgatatagatccatttctgctttctagataagtcatctatacaggcaattagtcagttatttatttgtttctctgtggtgcayttatcaaagtccactgatgtctattggaacttgagttgcaacatggaacttgaagttctattttctcagccttttgtttttccattatccagaattcaac

SEQ ID NO: 14748 - DNA, 201 bp, Homo sapiens
agaaaagaacttagaatgtggtggaataatgatttgtggcttacttctgcaatgcaaagttgaaataaaagtgaacctcactttatgggatagctagattmctcaaaaataaatcctgtaaatctaatctatgttaattaaattcaagatttaaaagatgacagcaaatatattaaaataagggtatgaagattctattag

SEQ ID NO: 14749 - DNA, 201 bp, Homo sapiens
tttcctccgtgttttgctttcatgtgacacatcattctctcaccttttaaataactctatggaaaaaatcaaacttactattttattaaaaaataaagggmaggggagaaagtttatcagcaggtcaaaatgatatattacaagggacttaacaaactgaaagacaatttgagcaatggggaaagaaaaaggagataattg

SEQ ID NO: 14750 - DNA, 201 bp, Homo sapiens
tactcaagaatacatagtcatagaatcataatttagacccagaaaggtgtccaagtttctcccctacacaaatatacctccctagagggaaccttgtttcyttcaaagaaatcttcaccaatatctaatttggtttttaggtccacccatggcacccataagtaagtataacatctctttttcttctttggttctctatgg

SEQ ID NO: 14751 - DNA, 201 bp, Homo sapiens
ataatttagacccagaaaggtgtccaagtttctcccctacacaaatatacctccctagagggaaccttgtttctttcaaagaaatcttcaccaatatctamtttggtttttaggtccacccatggcacccataagtaagtataacatctctttttcttctttggttctctatggtccccttcatttcacttctgtcaaagt

SEQ ID NO: 14752 - DNA, 201 bp, Homo sapiens
ttcatttcacttctgtcaaagtgatttgagtttcccattcttctcttgcttccttattaccctgcttgccctataatttttttaaaatactaattaaaagygggactaagctagcattcatcaacaataaactgaacaatactatgaaataacaagtaggaggaattttcaggggggtggagagagaaagagagagagaga

SEQ ID NO: 14753 - DNA, 201 bp, Homo sapiens
aaagaacaccaagttcctgagaggggaagaagagtagcatgtatgagagattgcaggaaggccagttgtgaaagatcgtggaggagtttgaaaggtagggmgaggccagatcacaaaaagtcttttagaataaaatatggagaacaattctgagcaccacaataagccattgttttcatcagggaagggataaagccacat

SEQ ID NO: 14754 - DNA, 201 bp, Homo sapiens
ctgggtgaagatatggtctttttagattcaactaaccacgcagacttagaagattaccatagctctcatctgggaacagtctactcagtaggacctaaggsaggaagcacagtttgccagcaagggcattaacagctatccctctgctgtgggagtagtactcgccatgatctatgcaggtgtccacatagccacctagga

SEQ ID NO: 14755 - DNA, 201 bp, Homo sapiens
ttccctttctagataattcctactatgattactagactatcatagtaaattctacggagaaaacaaattaagataatatgatagagcaagaccaagaagtragggcctttagctaggagattagaagaaatttccctgaggagatatctgaactgactctgaatggcgaaaagctggcagccacaggaggatcttagggaa

SEQ ID NO: 14756 - DNA, 201 bp, Homo sapiens
aaatgtggatatttctcattctgagtgacactgaagtgaaggattattaactgcaatgcccactgggtgaagatatggtctttttagattcaactaaccaygcagacttagaagattaccatagctctcatctgggaacagtctactcagtaggacctaagggaggaagcacagtttgccagcaagggcattaacagctat

SEQ ID NO: 14757 - DNA, 201 bp, Homo sapiens
tgagttgggatgatcacttgagcccagtagtgagaggttatagtgagctatgcaaccactgaacttcaacctgggcaacagagtgaaaccctgtccccccsaccccagccccccaaaaaaaacctaaggtcttccaagttcccttaacagtttcagtctttacaaaggctgagaagaaaaggaaaagggaatcaccttctc

SEQ ID NO: 14758 - DNA, 201 bp, Homo sapiens
agtgggactaagctagcattcatcaacaataaactgaacaatactatgaaataacaagtaggaggaattttcaggggggtggagagagaaagagagagagrgatgaaatccaaaatgatgtctaaatggagagaaaccttcagtgttctttcaaacattatagtgcaaggatccagtggtcttttcccaacactatgccca

SEQ ID NO: 14759 - DNA, 201 bp, Homo sapiens
gaggctgagttgggatgatcacttgagcccagtagtgagaggttatagtgagctatgcaaccactgaacttcaacctgggcaacagagtgaaaccctgtcycccccaccccagccccccaaaaaaaacctaaggtcttccaagttcccttaacagtttcagtctttacaaaggctgagaagaaaaggaaaagggaatcacc

SEQ ID NO: 14760 - DNA, 201 bp, Homo sapiens
actttgggaggccgaagtaggaggatcctggaggccaggaactcaagaccagcctggacaacatagtgaggctctgtctctacagaacaattaaaagaatyagtagggcatggtggcatgcctgtagtcctagctacatgggaggctgagttgggatgatcacttgagcccagtagtgagaggttatagtgagctatgcaa

SEQ ID NO: 14761 - DNA, 201 bp, Homo sapiens
aataaaatactattttagacattgaaatttgaatttcatacaattttcatgtgccacaaaatattattattattattattattattattattattattattatttcaactatttaaatatgtaaaatccattcttacctcacaggacatgcaaaaatagcatgtcctagatgctatttttatttggaaaactagatttata

SEQ ID NO: 14762 - DNA, 201 bp, Homo sapiens
ccaataaaatactattttagacattgaaatttgaatttcatacaattttcatgtgccacaaaatattattattattattattattattattattattattattatttcaactatttaaatatgtaaaatccattcttacctcacaggacatgcaaaaatagcatgtcctagatgctatttttatttggaaaactagattta

SEQ ID NO: 14763 - DNA, 201 bp, Homo sapiens
caaatattttaaattttataagccttaaagtctctgtcacaactactcaaccctgctgttgtagcacaaaaacagtcatagacaatatataaaagaatgarcatgggtatgtcccaataaaatactattttagacattgaaatttgaatttcatacaattttcatgtgccacaaaatattattattattattattattatt

SEQ ID NO: 14764 - DNA, 201 bp, Homo sapiens
cagatgtgtgccaccatgcttggctaacttttttttattttttgtagaaactgagtcttgctatgttgcctaggctggtctcaaagtcctggcctcaaacratccccttgccttagcctcctaaagtgctgggattacaggtataagccaccatgcccagccaaatattttaaattttataagccttaaagtctctgtcac

SEQ ID NO: 14765 - DNA, 201 bp, Homo sapiens
tggagtgcagggtgcaacctcggctcgctgcaactccacctcccgggttcaagcgattcttgtgcctcagccacccaagcagctgggattacaggcgtgcrccacaatacccagctaatttttgtatttttagtagagacagggttttgccatcttgcccaggctggtcttgaactcctggcctcaagtgatttgccctcc

SEQ ID NO: 14766 - DNA, 201 bp, Homo sapiens
atctcgattcctttatttgcactgacacttttgttgtttttggtttctattttggtttagtttgggtctttctttctttctttcttttgttcattcgctcrttctttcttcttccttcctttctttctttcttcttcctgtctttgtcttttaaataagtcaaaggcccacagaaacaagaaaccacatagaaaggaccaa

SEQ ID NO: 14767 - DNA, 201 bp, Homo sapiens
taagaacacttaaaatctactctcttagcaaatgtcaagtataacacattattaactacgatcaccatgttatacaatagatctcctgaaagtattcctcycatctaactgcaattttgtatgctttgagcaacatctgagatacagtatttttttaaaaaattgagatagaatctcactccattacccaggctggagtgc

SEQ ID NO: 14768 - DNA, 201 bp, Homo sapiens
caaggcatatagctagcaaaagagtaaaactgaggttctaaacactggcctttggactccaagtcctgaggttgtccaactacccccaggacatcattaaatgtatttactcttccaatccaaagtattctttggaaataaaatgtttgttccaaggaatttagaaaatcatgcatatgttaaaaatatattacttcaatt

SEQ ID NO: 14769 - DNA, 201 bp, Homo sapiens
tacttttattaggcaaaaattaatgaaatgaaaagtatttaaaaataacagaataattttgattattttgaaacaaaattaaagaaaaggaaaagcactamcaatacaaggaacaaaatagaaatgtggagagaaagcaaaatttcctcaaaatcataagaaaatgcactaaaaaaatggaaatactgcaaaatgaatact

SEQ ID NO: 14770 - DNA, 201 bp, Homo sapiens
agggtatgaagattctattagaagtaactagaggtatttttcagtgtagtgggagaaagaataaaaagttttttaattctgtgaaattaggaaaggtgtarctagaataaacactgggtgcttcaggaaatcctataatacttaattttggtttacaaagcctatataatttagaaggtaaatttaggttaaaatgagtca

SEQ ID NO: 14771 - DNA, 201 bp, Homo sapiens
agagtaggacacaataataaaaatgtcctacttttattaggcaaaaattaatgaaatgaaaagtatttaaaaataacagaataattttgattattttgaamcaaaattaaagaaaaggaaaagcactaacaatacaaggaacaaaatagaaatgtggagagaaagcaaaatttcctcaaaatcataagaaaatgcactaaa

SEQ ID NO: 14772 - DNA, 201 bp, Homo sapiens
gccactgcccccagcccaagtcttctgattcagcttttatattcagtattctttctactatagtaaatattaaatattagattttctcaaagcaagacatscctctgctccacggcaagaacccacacaattccttggtggctcagatatttcttttacttaattcagggaaccatattacttaaaaaaaacaaaagcaaa

SEQ ID NO: 14773 - DNA, 201 bp, Homo sapiens
gatgattaaaaaaggaaaaatctcaagagtaggacacaataataaaaatgtcctacttttattaggcaaaaattaatgaaatgaaaagtatttaaaaatamcagaataattttgattattttgaaacaaaattaaagaaaaggaaaagcactaacaatacaaggaacaaaatagaaatgtggagagaaagcaaaatttcct

SEQ ID NO: 14774 - DNA, 201 bp, Homo sapiens
caagttatacacactgtaactacatacatacatactatacatactataataaatacgtgtattatacaaggaaaaaaaattagtgccaaagattacagagwtaagaagtgaaatatactaacaacaacattgtaccctgagatgtttcaccctggtgaaagaaattaaaccttgtatgggagtggataaacttttagaatg

SEQ ID NO: 14775 - DNA, 201 bp, Homo sapiens
gcccaagtcttctgattcagcttttatattcagtattctttctactatagtaaatattaaatattagattttctcaaagcaagacatccctctgctccacrgcaagaacccacacaattccttggtggctcagatatttcttttacttaattcagggaaccatattacttaaaaaaaacaaaagcaaataaaaaataccta

SEQ ID NO: 14776 - DNA, 201 bp, Homo sapiens
cttgcttccttattaccctgcttgccctataatttttttaaaatactaattaaaagtgggactaagctagcattcatcaacaataaactgaacaatactaygaaataacaagtaggaggaattttcaggggggtggagagagaaagagagagagagatgaaatccaaaatgatgtctaaatggagagaaaccttcagtgtt

SEQ ID NO: 14777 - DNA, 201 bp, Homo sapiens
agagacaatggttccgacccagggatgaggctgcaaaatccatatgcccatgtttgggaataggccctataattgggcacagggaccaatgcccacctgargtcaggagaagggattactggtctcacagctagaaattacaagccaaaatccaaattgaaggcatagtgtccttttcagagaagtcatcagagagtatgg

SEQ ID NO: 14778 - DNA, 201 bp, Homo sapiens
tttcttttacttaattcagggaaccatattacttaaaaaaaacaaaagcaaataaaaaatacctagcagaagccaataaattcaggtttgttaaatcacamaggaattgagacgtaacagctgatttacctgaacatgatcaaaggacctgaaatttttgcagagtttgcagatattgcaagaagtagtctacagtaatga

SEQ ID NO: 14779 - DNA, 201 bp, Homo sapiens
gattataccacctgctttttggatagctaagtgttggctggccaatcccattactgggtatagactcaaaggaatataaaccattctatcataaagacacwtgcacagttatgttaaacacagaactattcacaatagcaaatacatggaatcaacctaaatgcccatcaatggtagactgaataaagaaaatgtgataca

SEQ ID NO: 14780 - DNA, 201 bp, Homo sapiens
ttacagtacattttaccttttctctcattaatcttccaaattattgaaaatagtccagaattttatcgatacttttataattttatgtacagagaaccatyattttagataacttgagattcagaaaaattttagtttgtcagttttaagacaaaaaaggaaccagtatcaaggggaaaaaaatagaaataaagagaaaat

SEQ ID NO: 14781 - DNA, 201 bp, Homo sapiens
attcacaatagcaaatacatggaatcaacctaaatgcccatcaatggtagactgaataaagaaaatgtgatacatatacaccatggaatactacgcagccraaaaaagaatgagatcatgtcctttgctggaacacggatggatctagaggccattacccctagcaaactaatgcaggaacagaaaaccagataccacatg

SEQ ID NO: 14782 - DNA, 201 bp, Homo sapiens
aatagaaataaagagaaaatacttgatatctaaatcacgcccttttgttgtatgctcagttatattaacaggttacatggatgaagaacttgcaaaaaaaycttgttccaaaatccagattctaaaatgtggaggcactgcaaggtctcagaatagccgagaagaaaacaaggaagcactaaagaatgacatcatatttac

SEQ ID NO: 14783 - DNA, 201 bp, Homo sapiens
gacacacagaggggaaaaatagacactggggcctgtcagagggtggagggtgggagcgggagaggatcaggaaaaataactagatttaatatctgggtagmaaaataatctgtacaacaaacccccatgacacaagtttacctatataacaaccttgcacatgtgtccctgaatttaaaataaaagtttaaaaagtgttac

SEQ ID NO: 14784 - DNA, 201 bp, Homo sapiens; identical to SEQ ID NO: 2954

SEQ ID NO: 14785 - DNA, 201 bp, Homo sapiens
aaataatctgtacaacaaacccccatgacacaagtttacctatataacaaccttgcacatgtgtccctgaatttaaaataaaagtttaaaaagtgttacckggcaatatctataaatgaaaaatatacagccaagcttaagcataaaaaaggtgggtaagatttccaaggagcagaaattgaatataggaacacattgcaa

SEQ ID NO: 14786 - DNA, 201 bp, Homo sapiens
aaggggtaacaaaaagtatctttgcttgtttttcagtcagatcgcatcctcacacaatcagtaagtctatgtgttcattgaattctctcctttaggactcagttggtctctagtggagtccaagagtctttatctgcccatattgggatacaaagggcttgagatatatcttggcctcttgctgtctcattatcaaaacct

SEQ ID NO: 14787 - DNA, 201 bp, Homo sapiens
aggaacaaaggtagggtttcaacatctgctcccaaatgacagcaaaagcctcaagatacaacatgcggaaaactgaaattaggcccctctgagtaaagccrgtagcagaaaatatactgcctccccatgcacagaagccaaaatatcttcacccatctgccccaggcatgaaaacagagccacccacacaggtccagagtt

SEQ ID NO: 14788 - DNA, 201 bp, Homo sapiens
caaaaggtcagatgtactgattaacttttcatcttattaaatatatacatttgaatatttatggcaaaaataaaagacaactattaatataatagaaatgygacatacatcttctgaacccatagggaaaataaaaagaagaaagaaaactatattagtccacaagaaagcaagaaaaaagaaaaagagaaagcaaataaa

SEQ ID NO: 14789 - DNA, 201 bp, Homo sapiens
gtagcagaaaatatactgcctccccatgcacagaagccaaaatatcttcacccatctgccccaggcatgaaaacagagccacccacacaggtccagagttrgatctgtccagggtgcagagccctgctggaggtgtgctacccatgcagtgtgcataatattccaagtcaaaacagctgagatctggttaagtggcagtgt

SEQ ID NO: 14790 - DNA, 201 bp, Homo sapiens
cacccatctgccccaggcatgaaaacagagccacccacacaggtccagagttagatctgtccagggtgcagagccctgctggaggtgtgctacccatgcartgtgcataatattccaagtcaaaacagctgagatctggttaagtggcagtgtacccaggaagttaggacaatagccaccaagaagagagccacaacccag

SEQ ID NO: 14791 - DNA, 201 bp, Homo sapiens
tgtgcaataaaattccaagggtgcaaagaaatactgctgttgtctactgttgtcatttacatctcatatttcttgggaaaaaacctctccagtaacagtcyaccagaataccagatttaaccagtgcaagaagctacctcagtgttaggaatttaagggtacacggataagcaaaataaaactacacactataagaaggga

SEQ ID NO: 14792 - DNA, 201 bp, Homo sapiens
atttcaaacattccaaacactgacacaaacacaaaatatgtccttatatttaatcgtgtttaagcctcattcttctttctcagttcacactagaaagagartgggtttggagggaaaggaaggcagggagatgaagttgaaaggggcaattaattaatttttttttttttggacaaagtttcgttcttgtcgcccaagctg

SEQ ID NO: 14793 - DNA, 201 bp, Homo sapiens
ttcctgcaagtgaatgcagccccaccccagagacactgttgtggatttcagttcccttaaccctttgtgcagtgagccaacctatataatcatagcacacrtgtcctgaagatatatgaaaggcatctcactcttagcatgtctaaaacccaagccctaatcccttctacacactggtgctagcacctgtattcacctaat

SEQ ID NO: 14794 - DNA, 201 bp, Homo sapiens
ggaaggaagaaaatatagaaaaactgaagaaacaaaattttgaagtgatcacctatccaaggatttagtaacttatgtcaagagggcaggtatcataagasttctacttcagaatcaaagatacatatttgtagatacaggcaaagcaactattaagttagcataatatctaaatgtgtaactggtttactgctcatagcc

SEQ ID NO: 14795 - DNA, 201 bp, Homo sapiens
gattaaaatggttttagctggcaatcatagtttcagcaaaacagtaataaattcattaacttaggaataggagggaagaagagagaggcttgtgaagagaycagggaatggaagtaggggacaaggagaggtttgtaattaaagcaagtcatctttcttgactatttacagatattacacatgaggaaaaaatgaaattta

SEQ ID NO: 14796 - DNA, 201 bp, Homo sapiens
tatccccctgagctgcaactgacactaagggtttggtgctcccaggcgttcctggttctgatactcattcctgccctgtcccctgcaaaaaaaaaaaaaaaagaaagaaatggatagtttttgagccagacaaccacatgaattttttgtttatatttacttttaggagagcaaggagggaaatttcatatttccaaattc

SEQ ID NO: 14797 - DNA, 201 bp, Homo sapiens
tttcgtttttccgtggattttattttctgttccagtgatcttttgtcttttactgaaccaatactccattgctttcactactaaaactttataacatttattacaaaaaatagcacattatctttgttctttttcagaaatgtgttggctattctttgaccttttctcttacacaagaatttcataatttctcaaaatcta

SEQ ID NO: 14798 - DNA, 201 bp, Homo sapiens
atttcgtttttccgtggattttattttctgttccagtgatcttttgtcttttactgaaccaatactccattgctttcactactaaaactttataacatttattacaaaaaatagcacattatctttgttctttttcagaaatgtgttggctattctttgaccttttctcttacacaagaatttcataatttctcaaaatct

SEQ ID NO: 14799 - DNA, 201 bp, Homo sapiens
tgtatacatatgtaacaaacctgcatgttgtgcacatataccctagaacttaaagtataataataataaaaagaaatcaaggaataaattcttaaaagttyatcacattaagatatgacttgtgcaataaaattccaagggtgcaaagaaatactgctgttgtctactgttgtcatttacatctcatatttcttgggaaaa

SEQ ID NO: 14800 - DNA, 201 bp, Homo sapiens
ttggtcactgatgccatggagtttacagtcctataagataacttgggaaaacaaacccaaaatgtgtagagggcaggcagcatcccatacagccacactaygaccattaaaactggatatttactgccctgaattctggttctaactatcctttttgtgaatgaataagagccatttgttattgactattcccctgaatca

SEQ ID NO: 14801 - DNA, 201 bp, Homo sapiens
tggggagggatagcattaggagatatacctaatgtaaatgacgagttaatgggtgcagcataccaacatggcacatgtatacatatgtaacaaacctgcaygttgtgcacatataccctagaacttaaagtataataataataaaaagaaatcaaggaataaattcttaaaagttcatcacattaagatatgacttgtgca

SEQ ID NO: 14802 - DNA, 201 bp, Homo sapiens
aagatatggttggtcactgatgccatggagtttacagtcctataagataacttgggaaaacaaacccaaaatgtgtagagggcaggcagcatcccatacarccacactatgaccattaaaactggatatttactgccctgaattctggttctaactatcctttttgtgaatgaataagagccatttgttattgactattcc

SEQ ID NO: 14803 - DNA, 201 bp, Homo sapiens
aggaacaagtacaacatgcacaggcctgctatggaggtgcaaaacagccagccaggctagaaagaaggaggcagagcaggaggtagggccagagcgacaaragccagattatgtcgggccctgcagtccttaataaaaaattgcagatttcattctaggtgtcatgagaggcaactgaagggcttgaacagggaaatgata

SEQ ID NO: 14804 - DNA, 201 bp, Homo sapiens
ggggagtggggagggatagcattaggagatatacctaatgtaaatgacgagttaatgggtgcagcataccaacatggcacatgtatacatatgtaacaaamctgcatgttgtgcacatataccctagaacttaaagtataataataataaaaagaaatcaaggaataaattcttaaaagttcatcacattaagatatgact

SEQ ID NO: 14805 - DNA, 201 bp, Homo sapiens
caagacaaagtccttgcacttaaggagtttatatgttgagataaaacaggcaaataatgccaagtaaacatatactaaatgtcaggcagataaattcatgyagaaaaataagaagagtaacagactaaagaaagatggtatagaagggggagtgtgcttcaggcaaaaggaacaagtacaacatgcacaggcctgctatgg

SEQ ID NO: 14806 - DNA, 201 bp, Homo sapiens
tcctaagcactggaaatatagccatgagcaagacaaagtccttgcacttaaggagtttatatgttgagataaaacaggcaaataatgccaagtaaacatayagtaaatgtcaggcagataaattcatgtagaaaaataagaagagtaacagactaaagaaagatggtatagaagggggagtgtgcttcaggcaaaaggaac

SEQ ID NO: 14807 - DNA, 201 bp, Homo sapiens
gaaagagtaagtgaattggcacataagagaataaagaagggaaatgagtatgttgagaaagagaataaaaataaaggtacaaaaagtcacaaattgaaacyggaaaggaaggaagaaaatatagaaaaactgaagaaacaaaattttgaagtgatcacctatccaaggatttagtaacttatgtcaagagggcaggtatca

SEQ ID NO: 14808 - DNA, 201 bp, Homo sapiens
aacccagggtatttatatcatagaatatccatgaaagatagcccccaaggaataagaaactactaaaagttatgaaatctatgagaaaatccagcaccatrtgagtgatacctcacaagtcccaacaaattggagaattccaacccagagaaatataactagagcaatctgaagaagactaaaataagaaacctaacagca

SEQ ID NO: 14809 - DNA, 201 bp, Homo sapiens
gaaaatatctcctctctgtcccttaatgatgcattagaacccataattttatcttttttatctttgtaaataacagctttattgagatgatattcacataygacataattcactcatttaaagtgtggaatttaatgctttttagtatattcactgggttgtgcaaccatcaccacaatgaattttagaacattctcatca

SEQ ID NO: 14810 - DNA, 201 bp, Homo sapiens
gtggaagtgggaagaaggtcttcagattttatttattttgggggcaaagccaacagggcctgctgttcgactgaatgtgattttaagggaaaaagaagacmccaagggttactcctagatttggggtctaagaaacttgacgaatgagactatttattcatttaggtagcggagaagagcagatttataggatgctattgt

SEQ ID NO: 14811 - DNA, 201 bp, Homo sapiens
tatttcgtttttccgtggattttattttctgttccagtgatcttttgtcttttactgaaccaatactccattgctttcactactaaaactttataacatttattacaaaaaatagcacattatctttgttctttttcagaaatgtgttggctattctttgaccttttctcttacacaagaatttcataatttctcaaaatc

SEQ ID NO: 14812 - DNA, 201 bp, Homo sapiens
aaaagaaaaagtcttcaaagatattaatgcattttaaaaatatatgtattcaacaaatatatattggcctattgtaggccaggcattatcctaagcactgraaatatagccatgagcaagacaaagtccttgcacttaaggagtttatatgttgagataaaacaggcaaataatgccaagtaaacatatactaaatgtcag

SEQ ID NO: 14813 - DNA, 201 bp, Homo sapiens
tataaattgcttgttcatttactttacccatttatctattagttattgatctgtagtaattctttattattatgaaagatcaacttttatatgttatgttaaatatctgcaattatctcatccaattctgtctcttagctttaaatttttatgctgtctcttgacttttagaaggcctctactcactctcccccagcacca

SEQ ID NO: 14814 - DNA, 201 bp, Homo sapiens
tgctataatctggcaactaataatttttactaaaaaagaaaatcctctaagattgacaaaaagaatatgtgtcaggactagatgtgattttggtaattgaycaacaatatacatttttcaaacggaccagaacagtgagcaaaaaactgttttgcagaagacatatgaaagacttatcaaagaacaaagaaaggcaggaaa

SEQ ID NO: 14815 - DNA, 201 bp, Homo sapiens
atataaattgcttgttcatttactttacccatttatctattagttattgatctgtagtaattctttattattatgaaagatcaacttttatatgttatgttaaatatctgcaattatctcatccaattctgtctcttagctttaaatttttatgctgtctcttgacttttagaaggcctctactcactctcccccagcacc

SEQ ID NO: 14816 - DNA, 201 bp, Homo sapiens
tgtgtaaaactgggaggacacatatagtctgaagagggtagctgctgcctgctccagccaacctcttcatgcaagaattcagattcagagttgccaaagcrtctcacttaatccagatagtaggtaaaattttccaagttttaaacatgacagacatctgggttactctaacagattgcaaacatacttacatactcccct

SEQ ID NO: 14817 - DNA, 201 bp, Homo sapiens
tatataaattgcttgttcatttactttacccatttatctattagttattgatctgtagtaattctttattattatgaaagatcaacttttatatgttatgttaaatatctgcaattatctcatccaattctgtctcttagctttaaatttttatgctgtctcttgacttttagaaggcctctactcactctcccccagcac

SEQ ID NO: 14818 - DNA, 201 bp, Homo sapiens
ctatataaattgcttgttcatttactttacccatttatctattagttattgatctgtagtaattctttattattatgaaagatcaacttttatatgttatgttaaatatctgcaattatctcatccaattctgtctcttagctttaaatttttatgctgtctcttgacttttagaaggcctctactcactctcccccagca

SEQ ID NO: 14819 - DNA, 201 bp, Homo sapiens
cctatataaattgcttgttcatttactttacccatttatctattagttattgatctgtagtaattctttattattatgaaagatcaacttttatatgttatgttaaatatctgcaattatctcatccaattctgtctcttagctttaaatttttatgctgtctcttgacttttagaaggcctctactcactctcccccagc

SEQ ID NO: 14820 - DNA, 201 bp, Homo sapiens
ctgcctcactaatgttctaagtctctgttatgacacagattctagaaccttcacaggccacactcccatcatttgcttaggtctgatcaatctgctccacrcaatttctcagtgatcctctgcatctctgcctacaagggcctccctgacacccaagttcatattgctcagaaacagtgaacttgagtttttcgttttacc

SEQ ID NO: 14821 - DNA, 201 bp, Homo sapiens
gatacaccggattaagaaaatgtggcacatatacaccatggaatactatgcagcaatagaaaaggatgagttcgtgtcctttgtaggaacatggatggatgaagctggaaaccatcattctcggcaaactatcgcaaggacaaaaaatcaaacacctcatgttctcactcacaggtgggaattgaacaatgagaacacttg

SEQ ID NO: 14822 - DNA, 201 bp, Homo sapiens
acctcatgttctcactcacaggtgggaattgaacaatgagaacacttggacacaggaaggggaacatcacacaccggggcctgttgtggggtgaggggagyggggagggatagcattaggagatatacctaatgtaaatgacgagttaatgggtgcagcataccaacatggcacatgtatacatatgtaacaaacctgcat

SEQ ID NO: 14823 - DNA, 201 bp, Homo sapiens
tgatacaccggattaagaaaatgtggcacatatacaccatggaatactatgcagcaatagaaaaggatgagttcgtgtcctttgtaggaacatggatggatgaagctggaaaccatcattctcggcaaactatcgcaaggacaaaaaatcaaacacctcatgttctcactcacaggtgggaattgaacaatgagaacactt

SEQ ID NO: 14824 - DNA, 201 bp, Homo sapiens
atgatacaccggattaagaaaatgtggcacatatacaccatggaatactatgcagcaatagaaaaggatgagttcgtgtcctttgtaggaacatggatggatgaagctggaaaccatcattctcggcaaactatcgcaaggacaaaaaatcaaacacctcatgttctcactcacaggtgggaattgaacaatgagaacact

SEQ ID NO: 14825 - DNA, 201 bp, Homo sapiens
aatgatacaccggattaagaaaatgtggcacatatacaccatggaatactatgcagcaatagaaaaggatgagttcgtgtcctttgtaggaacatggatggatgaagctggaaaccatcattctcggcaaactatcgcaaggacaaaaaatcaaacacctcatgttctcactcacaggtgggaattgaacaatgagaacac

SEQ ID NO: 14826 - DNA, 201 bp, Homo sapiens
ctcacttcctgtagcatggtcactctatataatctgcctcaactcagaaataatgatttcctctcattttccctattaatagggtggaccatcttctaacygccctatagacagggcatttcagacactaaaggaagaaaaggaatatacagtagtactgagtacaccatctagttatcctttcctccccgatgagttatt

SEQ ID NO: 14827 - DNA, 201 bp, Homo sapiens
cacaacagccaagacttggaaccaacccaaaagtccatcaatgatacaccggattaagaaaatgtggcacatatacaccatggaatactatgcagcaataraaaaggatgagttcgtgtcctttgtaggaacatggatggatgaagctggaaaccatcattctcggcaaactatcgcaaggacaaaaaatcaaacacctca

SEQ ID NO: 14828 - DNA, 201 bp, Homo sapiens
atcttctaactgccctatagacagggcatttcagacactaaaggaagaaaaggaatatacagtagtactgagtacaccatctagttatcctttcctccccratgagttatttaacactagaaaaaaaaattcacataatagagggcatattgactacttgctgttcattttagaggtacattagaagaaaatctccaaaag

SEQ ID NO: 14829 - DNA, 201 bp, Homo sapiens
catcacaaaatgaaaaatagaagtaagtatttgaagtggtagatatattaattagcttgattgtggcaatcatttcacaatgtatacatatattagaatcrcacactgtaataccttaaatatatataatttttataattatacctcaataaagctaaagaaaagaaaaaaataatctgagtagtcaagagaaattcaaca

SEQ ID NO: 14830 - DNA, 201 bp, Homo sapiens
ctataatgtattatacacttgaaatttactaagagtgtaggttttacatattctcatcacaaaatgaaaaatagaagtaagtatttgaagtggtagatatrttaattagcttgattgtggcaatcatttcacaatgtatacatatattagaatcacacactgtaataccttaaatatatataatttttataattatacctc

SEQ ID NO: 14831 - DNA, 201 bp, Homo sapiens
tacaaacttgcagttttatgacaaatacgttatgtagacccaatgtacagcatggtgactataatgtattatacacttgaaatttactaagagtgtaggtyttacatattctcatcacaaaatgaaaaatagaagtaagtatttgaagtggtagatatattaattagcttgattgtggcaatcatttcacaatgtatacat

SEQ ID NO: 14832 - DNA, 201 bp, Homo sapiens
ctcagaaaaggtaaataattctccttcttaagaccatcaaaagaattcatttccatcttctgtctacttccaagatattagaaaggttaaggaaccgctcygaaacaatttcctggatgtttaaaatgtggataaaatgaatatgaaatggaatagtatatgtgaaaatacactttgaaagccatacagtagaagaggtaa

SEQ ID NO: 14833 - DNA, 201 bp, Homo sapiens
aatacccgggatagaggaataaactaggtgtccatcagtggatgaatggataaagaaaatgtgatacacagacacacacacatacacacacacacacacaatgaaatattatacagccttaggaaaagaaagaaatcttgccatttgtgacaacatggatgaacctggaagaccttaggctaagtataattagccacgcat

SEQ ID NO: 14834 - DNA, 201 bp, Homo sapiens
tatcctagaataacgagagtgaacacagttagggtaattatgattgagaagagtaccaacttcaggatgtgaagaattgaagaagactttccatggaaagrtctggagagatgccaaagttgttaagaaagatagcacaggattggtatgaggcaaaaaccaggagactagctgctgaagtatcaagaggtaaaagaaact

SEQ ID NO: 14835 - DNA, 201 bp, Homo sapiens
gagaaagatatggttggtcactgatgccatggagtttacagtcctataagataacttgggaaaacaaacccaaaatgtgtagagggcaggcagcatcccayacagccacactatgaccattaaaactggatatttactgccctgaattctggttctaactatcctttttgtgaatgaataagagccatttgttattgacta

SEQ ID NO: 14836 - DNA, 201 bp, Homo sapiens
ttccttcatctagctgagctcctaccatgtatctgatactaagctgagcactgaggataaagtcatgaataagggagagaaagatatggttggtcactgaygccatggagtttacagtcctataagataacttgggaaaacaaacccaaaatgtgtagagggcaggcagcatcccatacagccacactatgaccattaaaa

SEQ ID NO: 14837 - DNA, 201 bp, Homo sapiens
ccagagttagatctgtccagggtgcagagccctgctggaggtgtgctacccatgcagtgtgcataatattccaagttaaaacagctgagatctggttcagwggcagtgtacccaggaagttaggacaatagccaccaagaagggatccacaacccagggtatttatatcatagaatatccatgaaagatagcccccaagga

SEQ ID NO: 14838 - DNA, 201 bp, Homo sapiens
aggcttcctcaactctagtagttcaggagtctcctcttagggacttagggactttaacacaactgctttatcttccttgcctgcttccttttcaaattcartattttttctttcactcttattgattcctctggaagcctgggggaaacaacccacagttaactaagctctaggctgatagtgctggtttctcctttggtt

SEQ ID NO: 14839 - DNA, 201 bp, Homo sapiens
accacttggagtaaagccaggagcagaaaacacgctgcctccccacgcggagaagccaaaatatcttcacccatctgccccaggcatgaaaacaaagccayccacacaggtccagagttagatctgtccagggtgcagagccctgctggaggtgtgctacccatgcagtgtgcataatattccaagttaaaacagctgaga

SEQ ID NO: 14840 - DNA, 201 bp, Homo sapiens
gatcctagatggtggacaaagcctcaagatacaacatgtagaaaactggaattccaccacttggagtaaagccaggagcagaaaacacgctgcctccccaygcggagaagccaaaatatcttcacccatctgccccaggcatgaaaacaaagccatccacacaggtccagagttagatctgtccagggtgcagagccctgc

SEQ ID NO: 14841 - DNA, 201 bp, Homo sapiens
atgtaactaacctgcacattgtgcacatgtaccctaaaacttaaagtataataataataataataaaacaaatcatgctgctataaagacacatgcacacrtatgtttattgcggcactattcacaacagccaagacttggaaccaacccaaaagtccatcaatgatacaccggattaagaaaatgtggcacatatacacc

SEQ ID NO: 14842 - DNA, 201 bp, Homo sapiens
cactggccatcagagaaatgcaaatcaaaaccacaatgagataccatctcacaccagttagaatggcgatcattaaaaagtcaggaaacaacaggtgctasagaggatgtggagaaacaggaacacttttacactgttggtggggctgtaaactagttcaaccattgtggaagtcagtgtggctattcctcagggatctag

SEQ ID NO: 14843 - DNA, 201 bp, Homo sapiens
ttaatgggtgcagcacaccaacatggcacatgtatatatatgtaacaaacctgcacattgtgcacatgtaccctagaacttaaagtataataaaaaaaaaagagagagagaaaaaaacaaaataaaataaaataaaatggactaaggacctaaatagacattttttcagagaagacttacagccaactaataaataaaggt

SEQ ID NO: 14844 - DNA, 201 bp, Homo sapiens
ttatcctttcctccccgatgagttatttaacactagaaaaaaaaattcacataatagagggcatattgactacttgctgttcattttagaggtacattagwagaaaatctccaaaagttgatttggcaggagaattttctcacaggaccaaacacctagaagactcagtagacaaatgcctaatctgccctggttggaggt

SEQ ID NO: 14845 - DNA, 201 bp, Homo sapiens
gaaaggacaagctatcaaaatgacaccatgtttaacaaaatgatgaaaattttaagaaaatacataaatatatacttctaagatagtggcaatataaaagyaggaatgtgaaacttaccttaagaaatcaatagtaaattttgttttgcaaataaactaatacaaatgtcaaatgtcctgttcacaagaatggaatagaag

SEQ ID NO: 14846 - DNA, 201 bp, Homo sapiens
gtccatcaatgatacaccagattaagaatatgtggcacatatacaccatggaatactatgcagcaataaaaaatgatgagttcatgtcctttgtagggacrtggatgaagctggaaaccatcattctcagcaaactattgcaaggacagaaaaccaaacactgcatgttttcactcataggtgggaactgaacaatgagaa

SEQ ID NO: 14847 - DNA, 201 bp, Homo sapiens
cattgtggaagacagtgtggtgattcctcaaggatctagaactagaaataccatttgacccagccatctcattattgggtatatacccaaaggattataaatcatgctactataaagacacatgcacacgtgtgtttattgtggcactattcacaatagcaaagacttggaaccaacccaaaagtccatcaatgatacacc

SEQ ID NO: 14848 - DNA, 201 bp, Homo sapiens
agtcaggaaacaggtgctggagaggatatggagaaataggaatgtttttacaatgttggtgggagtgtaaactagttcaaccattgtggaagacagtgtggtgattcctcaaggatctagaactagaaataccatttgacccagccatctcattattgggtatatacccaaaggattataaatcatgctactataaagaca

SEQ ID NO: 14849 - DNA, 201 bp, Homo sapiens
gcaagaagcatagcttagagtgagaagagtttgatcagaggaagaacacttctcctaagtaactaataaaaacattttgcctaattcttccacagaaatgyatatctccagatacagttcagaacaaagtaagtacttatactcatgagaaaaataaatatagtattatagaattttcacaagtcaggaatgaaatctgtc

SEQ ID NO: 14850 - DNA, 201 bp, Homo sapiens
ccttcctgctagtggcgactctctgcggattcctgaagtggtacagggcataacatggcaaggtggctaacatgctgtgcttaggtcgttcctcttctttytttttttttttttttttttgagacggagtctggctctgttgcccaggctggagtgcagtggcgcgatctcggctcactgcaggctctgcctcccgggttc

SEQ ID NO: 14851 - DNA, 201 bp, Homo sapiens
attcagaaagaagagaaaattgtaaagaatatgaaggaaaacgtgctgaacttaaagtcaagcaaactggaagctaaaactgcctttaattttttgcataytcaggcacagcccttccctttctcaatctcggttttcttttcttataaaactagaacctttgtaacattgcctttctttggttcttgaggctatcacatt

SEQ ID NO: 14852 - DNA, 201 bp, Homo sapiens
tccatgcaaatggaaaacaaaagacggtaggggtggctatacttacatcaggcaaaatagacttttagtcaaaaattataacaagagacaaaggagctcaytatataattataaagggctaattcatcaagaggatataaaaattataagtacatatgcacataatgtcagagcacctaaatatataatatttacataact

SEQ ID NO: 14853 - DNA, 201 bp, Homo sapiens
ctgaatattcccctgaaactttcactcctgcatagtgtctaagggggaaaagacatgggatcacttgcaagtgtggccactttatgagcctacctacaggsgaatggaaagtctaataacctgagggaggacactatttctgggaagacttttgggaaattgatggattattgaaactttagactgacttgaataattgtt

SEQ ID NO: 14854 - DNA, 201 bp, Homo sapiens
tagagagcttccaagatgatggatcaagtacaagaaagaataagagaagtcaaagaccaatatttaaaattatctagtcagagtacaaaaaaaaaaaaaaaccacaaagaaaagaaatgaagaaatatgtacaagatttatgggacaccatcaagggagctaactttttgcattattggagtctcagaggaaaagagaaat

SEQ ID NO: 14855 - DNA, 201 bp, Homo sapiens
aaaacattttgcctaattcttccacagaaatgtatatctccagatacagttcagaacaaagtaagtacttatactcatgagaaaaataaatatagtattayagaattttcacaagtcaggaatgaaatctgtcttgtttacagttgtgtttccagaaccttgcatagtgcaccattgcatgaactgaactgcttctaagtg

SEQ ID NO: 14856 - DNA, 201 bp, Homo sapiens
atggattattgaaactttagactgacttgaataattgttattgttctttagctttacctcaaggatccatgagtaagtttatcttcttgtttcaaactctsgtgttgttgggctcctatgctaggcagaggacttctccctgtcttaactatttcctgtttcctgctatgtcagggtgaaagggcttaagactcataattc

SEQ ID NO: 14857 - DNA, 201 bp, Homo sapiens
atagagagcttccaagatgatggatcaagtacaagaaagaataagagaagtcaaagaccaatatttaaaattatctagtcagagtacaaaaaaaaaaaaaaaccacaaagaaaagaaatgaagaaatatgtacaagatttatgggacaccatcaagggagctaactttttgcattattggagtctcagaggaaaagagaaa

SEQ ID NO: 14858 - DNA, 201 bp, Homo sapiens
tgaagtatcaagaggtaaaagaaactctgaaactccttctgactatcatttagcctggctaatattataaaattggtgattgacacagtcacttatcatcrtcagctcttgtagcttatgcacaattcctagttcctgcaaagtaaattaattcacatcattattcaccattaggagttcatgtttacattagttctcaga

SEQ ID NO: 14859 - DNA, 201 bp, Homo sapiens
agtccgttacataactaatttcaacaaccagttgaaaattaatcaaataaaagaacagagaagaggctgggcaccatggctcacgcccgtaatcatgacaytttaggaggctgaggcaggtggatcacctgaggtcaggagttcgagaccagcctgctgaaaccccgtctctaccaaaaatacaaaattagttgggcgtgg

SEQ ID NO: 14860 - DNA, 201 bp, Homo sapiens
tctctaaaagaactaactctgatgctcccattaggaagaatatccacagagacaatgtccttaatccaaaacacacaatattcagtattttggcaggatawgtacatcgtaagttttttttatcttcttctttactctgtaaggcaacaagtaaataccttccactgccctgcttatttgtcttcagctgggaaacgccac

SEQ ID NO: 14861 - DNA, 201 bp, Homo sapiens
gcagtggcgcaatcttggctcactgcaagctccgcctcccgggttcacgccattctcctctctcagccttctgagcagtgaccacaggcacctgccaccaygcccggccaatttttttgtgtgtttttagtagagacggggtttcaccgtgttagccaggatggtctcgatctcctgacctcgtgatccacccgcctcggc

SEQ ID NO: 14862 - DNA, 201 bp, Homo sapiens
ccgtgttagccaggatggtctcgatctcctgacctcgtgatccacccgcctcggcctcccaaagtgctgggaacataggcgtgagccaccacgcccggccmgataaacttattttttaatgaactgttggtaaacttaatatgtttttttctttcctaaaagatttttcttctcagagatctaaaagaggaagaggtaaac

SEQ ID NO: 14863 - DNA, 201 bp, Homo sapiens
gactctgtctcaaaaaatagaagtgtgtgtgtgtgtgtgtgtgtgtgtgtgtgtgtgtgtttaatttgtttgtttctattttttagtacaatatcctggayccaatggtaagtaccttatctatccttctccctccaggttccttgatcttctacagtgtctagagggcctgttccctgtctcaaatgccctagatgtgtc

SEQ ID NO: 14864 - DNA, 201 bp, Homo sapiens
accacaaccactgaagtttcctccatgatcaaagttgtcattcccaccgaaaccacctccatgaccaccacctaagtttccagaaccacttcgacctcttyggctggatggagcactagccatctcttgctttgacaggctttcctaacttcacagttgtggccattcacactgtggtatttctgaatgacagtcttatcc

SEQ ID NO: 14865 - DNA, 201 bp, Homo sapiens
attctaatgtctacctctggaacatattagttgatcagaaataaagattttagtgaaagaacagtcccttgagaaagaaatatcttctactcttactgacrggaagtgtttcacctttccctaccatcagtaatgttaatacctaataacaaagttttgcctttccctagtatcccttaggttggcaaggatcctataaaa

SEQ ID NO: 14866 - DNA, 201 bp, Homo sapiens
tgtaatcgaatctggaaaagaatataagaaatgaacaagaacataaagatagctgagagtgaaacagagtgatctgaggaaaaacactgggggaatatggggaaaggaatacaattaaggatctcatctccaacacctataatgaaaagcaagaatgaagtggttatgctaaaacagggttaataatctcctaaaagaaga

SEQ ID NO: 14867 - DNA, 201 bp, Homo sapiens
tgtctatctccatgccttctgaaagtctaaatctaagtaatgttacacttttcaatttttattataggtagtataaaatgtttacaaacaactgaagaacytccttgtaagtttcccatatatacaactcagtcctttttttactgacacctaataattgtacaaatttatgggatacatgtgatattttgatacatgcat

SEQ ID NO: 14868 - DNA, 201 bp, Homo sapiens
tctatccttcatttttgaggatgttcagagcttgagcccctgagacaggactaactctgaaggaaggagaaaaaaagtgatttgataattaaagctcatgktatatcacatcctgtgtctactcctcttggagtatttacacaaatggaacattattaaaataatcaagtcaaactttgagagcaaatactgggtaggtat

SEQ ID NO: 14869 - DNA, 201 bp, Homo sapiens
cccattattttagttctaaactcagcttccaaggtaacacataccaacagtgactcaatatttaaaccaggtcaagcactaacaatgatgatatttaatayagaattcgtgaaaccgcctttcacactatgtcctacctttccaaaatgcaaatttggttctcatatctcagttacaaatgatttaagcaaacctaacatc

SEQ ID NO: 14870 - DNA, 201 bp, Homo sapiens
ctgccctgcatttttaaaaataatttcaacttttattttagattccggtggtgcatatgcaggtttgctaatgggtatattgtgtgatgctgaggtttagsggtgacttgcttttttaacactgtctttctcaactcccctggcattcctattacatagtttccaaagaggccatgcacgaagtgttaagaaatctcacag

SEQ ID NO: 14871 - DNA, 201 bp, Homo sapiens
ccctggcattcctattacatagtttccaaagaggccatgcacgaagtgttaagaaatctcacaggctaacatttaaaaatataaaccaaaacagccctctyagaaatagtcataatgatccatcagcaagggaaggtacacctttcaaataaaccatgtctctaaggaaactaggggcaaggggcaagaaaatgtaagaag

SEQ ID NO: 14872 - DNA, 201 bp, Homo sapiens
tcgtgatccacccgcctcggcctcccaaagtgctgggaacataggcgtgagccaccacgcccggcccgataaacttattttttaatgaactgttggtaaasttaatatgtttttttctttcctaaaagatttttcttctcagagatctaaaagaggaagaggtaaacagatttctatctaacaaaaaataatatagactca

SEQ ID NO: 14873 - DNA, 201 bp, Homo sapiens
gacctcgtgatccacccgcctcggcctcccaaagtgctgggaacataggcgtgagccaccacgcccggcccgataaacttattttttaatgaactgttggkaaacttaatatgtttttttctttcctaaaagatttttcttctcagagatctaaaagaggaagaggtaaacagatttctatctaacaaaaaataatataga

SEQ ID NO: 14874 - DNA, 201 bp, Homo sapiens
aatctcacaggctaacatttaaaaatataaaccaaaacagccctcttagaaatagtcataatgatccatcagcaagggaaggtacacctttcaaataaacyatgtctctaaggaaactaggggcaaggggcaagaaaatgtaagaagaaaaatagaggcataacagattaatatggagtgagtctttcccaaccctctgaa

SEQ ID NO: 14875 - DNA, 201 bp, Homo sapiens
acaggctaacatttaaaaatataaaccaaaacagccctcttagaaatagtcataatgatccatcagcaagggaaggtacacctttcaaataaaccatgtcyctaaggaaactaggggcaaggggcaagaaaatgtaagaagaaaaatagaggcataacagattaatatggagtgagtctttcccaaccctctgaagatttt

SEQ ID NO: 14876 - DNA, 201 bp, Homo sapiens
atttccttcacagtggtgaagcatactgatatctttttctttctccctctttctctctcacagccggagctacaggacctatcagtaagtttgctctctgwttctccacagtgagcattttactttcctgcagtatcttagggatcgctacctggtttccatgttgggatttcaagggtttggagttcacattttcttcaa

SEQ ID NO: 14877 - DNA, 201 bp, Homo sapiens
gccagtctcaggcacactgactcagaatagggaggagaaatttttttgtatttttagaacatcacagtgttcgccaggatggtcttgatctcctgacctcrtgatccgcctgcctcgacctcccaaagtgctgggattacaggtgtgagccaaggcgcctggcctaccctactcatttctaactctgtgtgcagctacctg

SEQ ID NO: 14878 - DNA, 201 bp, Homo sapiens
ttcctctcctatccaactcctaattatttaacaaaagtaatatgagagaaaggcatcagcaaaatagtagaataggagctttcttcccacacagaagcatsaatttagacaactatccacagatgagacaataccattgtgggagtccaggagtccagcagagaagttccagcacgctgtcaggttataaaatcctagaac

SEQ ID NO: 14879 - DNA, 201 bp, Homo sapiens
tagaacatcaatctatttttatttcaattattcatgcccaaggactcaaggatcaagtccttctgccacctcataatctcacccagtactccagattggaytcatccaggttctgcaataaaaatatattaactatgaagctgaaatgcaaagtgaaaaatatcctgctagagatggtcctaagctgtttccacttcagca

SEQ ID NO: 14880 - DNA, 201 bp, Homo sapiens
acaactatccacagatgagacaataccattgtgggagtccaggagtccagcagagaagttccagcacgctgtcaggttataaaatcctagaacagatgtaytaaagagggtaagaagaacagtttcactttacccacatcactcctcccccaaggtggcacaactcaatgctgagacagacccacttggcccacaatttct

SEQ ID NO: 14881 - DNA, 201 bp, Homo sapiens
ctttgtaaaataatgcaaattttaagtttcctttctttattttttttgagatggagtctcgctctgtcatccgggctggagtgcagtggcatgatctccaytcactgcaagctccacctcgtgggttcaagccgttctcctgtcttagcctaccgagtagctgggactacaggcacccaccaccacgcccggctaattttt

SEQ ID NO: 14882 - DNA, 201 bp, Homo sapiens
aagagggtaagaagaacagtttcactttacccacatcactcctcccccaaggtggcacaactcaatgctgagacagacccacttggcccacaatttctccmacagaaaaaatgtgcagaacttaatgagtgcccacatcccccagccattcaggatgctgtccgataagcccacttatttctcactccacccagaacattg

SEQ ID NO: 14883 - DNA, 201 bp, Homo sapiens
aacagtttcactttacccacatcactcctcccccaaggtggcacaactcaatgctgagacagacccacttggcccacaatttctccaacagaaaaaatgtrcagaacttaatgagtgcccacatcccccagccattcaggatgctgtccgataagcccacttatttctcactccacccagaacattgagatgatcagcata

SEQ ID NO: 14884 - DNA, 201 bp, Homo sapiens
cccacatcactcctcccccaaggtggcacaactcaatgctgagacagacccacttggcccacaatttctccaacagaaaaaatgtgcagaacttaatgagkgcccacatcccccagccattcaggatgctgtccgataagcccacttatttctcactccacccagaacattgagatgatcagcatagttgaatggttagga

SEQ ID NO: 14885 - DNA, 201 bp, Homo sapiens
cattgagatgatcagcatagttgaatggttaggagaggctgggagcagggaaaagagactgcagaacccactcatcagaaagcctcatcagaaagcctgcyatttgagatgcgtgacctatgctccttgcactactgacccacaggcacgcctttcacacatttcactctcccatctaggctgagtccccaaatgagccac

SEQ ID NO: 14886 - DNA, 201 bp, Homo sapiens
gtacagctaagatttccaggcttggggtgcatactactttaaccacttactttcctatcatcaaaattccatgaagttattaatgattttttgaaagttcrcattctgctgattcatattaaaaataaatgaataccaaagggaaagttttccctattgttataatgacctaccaagaagaaactctctacatagaaagga

SEQ ID NO: 14887 - DNA, 201 bp, Homo sapiens
ggaaaagagactgcagaacccactcatcagaaagcctcatcagaaagcctgccatttgagatgcgtgacctatgctccttgcactactgacccacaggcaygcctttcacacatttcactctcccatctaggctgagtccccaaatgagccaccatggacaacaaaaggaaacatctcacagtcagtttgactttgtagga

SEQ ID NO: 14888 - DNA, 201 bp, Homo sapiens
actaatattaaaaaccaaagttcctgtcaaggttaaaaatgcagatgccaaaagagcccaggcaggtcagtaaatgagtgagatgaggtgaatctcctggraactgtgtaaaactgggaggacacatatagtctgaagagggtagctgctgcctgctccagccaacctcttcatgcaagaattcagattcagagttgccaa

SEQ ID NO: 14889 - DNA, 201 bp, Homo sapiens
atttaggtagtggagaagagcagatttataggatgctattgtgagttcagttttgtgtatgcttggttctagatgcctggaacatttaggactaattaatyaaataatctgaccttagcaagcttcaagcatgttctctgccatgtgtctccttcctatcatttaatgatgtcttagaacccataattttctagttatgct

SEQ ID NO: 14890 - DNA, 201 bp, Homo sapiens
agcaaggaaaccatacaaaacaaagtagaataataacttttgtttaattctgtaaacatatgatcaaaagaagcaaataagacttaaacctagtgagacaygtttcaagcatttcaaacattccaaacactgacacaaacacaaaatatgtccttatatttaatcgtgtttaagcctcattcttctttctcagttcacact

SEQ ID NO: 14891 - DNA, 201 bp, Homo sapiens
aaataggagaaaattgaaaaagaacaaaagtaggaagaaaattggaagcagaaagagtaagtgaattggcacataagagaataaagaagggaaatgagtakgttgagaaagagaataaaaataaaggtacaaaaagtcacaaattgaaaccggaaaggaaggaagaaaatatagaaaaactgaagaaacaaaattttgaag

SEQ ID NO: 14892 - DNA, 201 bp, Homo sapiens
gagctagaaaatcaactgaaggccaaattctcattaaaaactgaaggttttggccaggcatgggctcacacctgtaatttctgcactttgggaggctaagrcaggaggatcacttgagaccaggagttcaagatcagcctgagcaacaacagagcaagaccccatctctacaaaaatttttttaattagccaggaatagtg

SEQ ID NO: 14893 - DNA, 201 bp, Homo sapiens
tacaaaaatttttttaattagccaggaatagtggcatgcagctgtagtcctagctactcaagaggctgaggtgggaggatcacttgagcccaggaggtcgmgactgtagtgagctaggattgcaccactgcattccagcctgggtgacagagtgagaccttatctcaaaaaacaaaacaaaacaaaacaaaaaaaaccaga

SEQ ID NO: 14894 - DNA, 201 bp, Homo sapiens
atcttatctctttatttcattcaagttaaaatcaaagtcctgtcagtagctcactagatgttacaattttttttgaggcggggtcttgctctgttgcccargctggagtacagtggaacaatcatagctcactgcagcctcaacctcctgggatcaaagggtcttcccctgcctcagtcttctgagtaactggactacagg

SEQ ID NO: 14895 - DNA, 201 bp, Homo sapiens
gcacgcctttcacacatttcactctcccatctaggctgagtccccaaatgagccaccatggacaacaaaaggaaacatctcacagtcagtttgactttgtrggatcggaaaaaaggacacaaacttgagaattccagagcaccaccctagggaaaacaaagggaaggctctcagaacctggactggctttgcaggattgag

SEQ ID NO: 14896 - DNA, 201 bp, Homo sapiens
tgttttggggccaggcgcagtggttcacacctgtaatcccagcactttgggaggccaaggatcacctgaggtcaggagttcgagaccagcctggccaacayggtgaaaccccatctctactaaaaatacaaaaaatagccaggcatggtggcgggcacctgtaatccctgctactcaggaggctgaggcacgagaatccct

SEQ ID NO: 14897 - DNA, 201 bp, Homo sapiens
cctttcacacatttcactctcccatctaggctgagtccccaaatgagccaccatggacaacaaaaggaaacatctcacagtcagtttgactttgtaggatyggaaaaaaggacacaaacttgagaattccagagcaccaccctagggaaaacaaagggaaggctctcagaacctggactggctttgcaggattgagacaaa

SEQ ID NO: 14898 - DNA, 201 bp, Homo sapiens
ttctaaagggcctactcaaagataatggaggagacaatgaggaggaaatgagaaaagaaaatcaaattttaagaataaatacaaaagggagaaaagacaayaaaatttaacaggaaatactatgcagggtctagtctaacctgagttctccagtcttctctccaaaggcctttctctttcctcatgtcctatccggctcac

SEQ ID NO: 14899 - DNA, 201 bp, Homo sapiens
gatcggaaaaaaggacacaaacttgagaattccagagcaccaccctagggaaaacaaagggaaggctctcagaacctggactggctttgcaggattgagasaaagcacaatcttagaaatcccatctaccctgggtgtggtagttcatgcctgaaatcccagcactttgggaggccgaggcaggaggacttcttgagacta

SEQ ID NO: 14900 - DNA, 201 bp, Homo sapiens
cgagactggcctgggcaacatagtgagactccgtctctaaaaaaaaaaaaaaatcagttggatgtggtggtgcacacctgcagtcccagctactcaggagkctgaggtgggaggattgcttgagcccaagagtttgatgctgcagtgagccacgatcatgccactgctccactctgggtagcagagtgagattttctctca

SEQ ID NO: 14901 - DNA, 201 bp, Homo sapiens
agtttgatgctgcagtgagccacgatcatgccactgctccactctgggtagcagagtgagattttctctcaaaaaaagggaaaaaatcccacctgtgaagkaggcacaaacaaatattgaacagggtgactgtttcttcaaatgtgaaaacacaagacaagacttcaaggtcataaaaatcaaggaaacatgacaccacta

SEQ ID NO: 14902 - DNA, 201 bp, Homo sapiens
aagtaggcacaaacaaatattgaacagggtgactgtttcttcaaatgtgaaaacacaagacaagacttcaaggtcataaaaatcaaggaaacatgacaccrctaaaagaacacaataatatttcagtaactaacccccaaaaatgaaggtttgcctaaaaatcaatccaccagttgcctgacaaaaaaatccaaaacaatt

SEQ ID NO: 14903 - DNA, 201 bp, Homo sapiens
taatgtcaaagaaaaagtcacaggccgggagcggtggctcacgcctgtaatcccagcactttgggaggccgaggcgggcggatcacaaggtcaggagttcmagaccagcctgaccaaaatggtgaaaccctgtctcttctaaaaatacaaaaattagctgggcatggtggcaggtaactgtaagcctagccgctcgggaga

SEQ ID NO: 14904 - DNA, 201 bp, Homo sapiens
gcagtttgttatataggtaaacttgtgtcatgcaggtttgttgtacagattatttcatcacccaggtattaagcctagaaccccttagttatttttcctgwctgtctacgtcctctcaccctccacccttcaataagccccagtgcctgttgtttccttctgtgtccatgtgttctcatcatttatctcccatttgtaagt

SEQ ID NO: 14905 - DNA, 201 bp, Homo sapiens
agacatctcgatatatgaaactcaaaactctccaattgtatttaacccaaagaagacttctccaagacattatgtcaaattgtcaataatcaaagttaaasagagaatcttgaaagaagcatatcacatttaaaggtacatcaaaaggatattagcacttctatgcagacattttctaggccagtatatagtgggatgata

SEQ ID NO: 14906 - DNA, 201 bp, Homo sapiens
taatcaaagttaaacagagaatcttgaaagaagcatatcacatttaaaggtacatcaaaaggatattagcacttctatgcagacattttctaggccagtayatagtgggatgatatattcaatttgctgaaagaaaaaaactgccaaccaataactctttacccgtaaagctgtttttcagatctgagaaagagatagtct

SEQ ID NO: 14907 - DNA, 201 bp, Homo sapiens
aaattttaagtttcctttctttattttttttgagatggagtctcgctctgtcatccgggctggagtgcagtggcatgatctccactcactgcaagctccamctcgtgggttcaagccgttctcctgtcttagcctaccgagtagctgggactacaggcacccaccaccacgcccggctaatttttttgtatttttagtaga

SEQ ID NO: 14908 - DNA, 201 bp, Homo sapiens
aggatacatatagaatgaaagtaaagggatgaaaaaaagatgctccatgcaaatggaaaacaaaagacggtaggggtggctatacttacatcaggcaaaayagacttttagtcaaaaattataacaagagacaaaggagctcattatataattataaagggctaattcatcaagaggatataaaaattataagtacatatg

SEQ ID NO: 14909 - DNA, 201 bp, Homo sapiens
attacatctaaacttggaccactagtgctgcagagattaagccttttctgacttcccctccttgaaagaattgggacttgcctctcataacaatcaggcawatcacagaaatttattttgtgtaggtctaaatacaccaattttttcaaaagattaccagagtacattaaaaacatgacctaactatatcctatctacaag

SEQ ID NO: 14910 - DNA, 201 bp, Homo sapiens
acataaaggtggtaaaaactgtcaggttcttataacacactaagggatctgttgtctcatcatatttcattgtattctgctagaagtctttatggtacccyagaaaaaacaactagggaattgggagtaggaaagaactgtacttctgttccaaaaatgctgccattaacctattttcttgttttgattttcaggaatacc

SEQ ID NO: 14911 - DNA, 201 bp, Homo sapiens
tccttaactatcaataattacttgaacgtaaatggattaaattttctaatgaaaagacacagagtagctaaatgtatttaaaaacaagttgcaactatctrtgctgcctgtagcagacacactccagctctaaggatacatatagaatgaaagtaaagggatgaaaaaaagatgctccatgcaaatggaaaacaaaagacg

SEQ ID NO: 14912 - DNA, 201 bp, Homo sapiens
cctatactagatacacaaaacagaaagatattaaagcataccactacagaaaatcagcaaatcacaaagaaagacaggaagaaaggaagaaaggatatacwaaacagccaaaaaacaaccaagaaaataactatattaagtccttaactatcaataattacttgaacgtaaatggattaaattttctaatgaaaagacaca

SEQ ID NO: 14913 - DNA, 201 bp, Homo sapiens
aatctattttaataatctaagttattattagcttcaaatagactgttgaaaccatgttttatgtaagcttatggtaaccacaaaccaaaaacctatactasatacacaaaacagaaagatattaaagcataccactacagaaaatcagcaaatcacaaagaaagacaggaagaaaggaagaaaggatatacaaaacagcca

SEQ ID NO: 14914 - DNA, 201 bp, Homo sapiens
ctgcttttctcagtactcacagattgccaagacttatagccttggaagttctcataattattacaggggggataaacataagccagctcacctcagaggawctcactggggctaaaggaagggtcacatctggtccacagttccctaatagccaccatgtgccagagaatctacatggatacatgaattccctttcccttt

SEQ ID NO: 14915 - DNA, 201 bp, Homo sapiens
caaagttaaacagagaatcttgaaagaagcatatcacatttaaaggtacatcaaaaggatattagcacttctatgcagacattttctaggccagtatatartgggatgatatattcaatttgctgaaagaaaaaaactgccaaccaataactctttacccgtaaagctgtttttcagatctgagaaagagatagtctttat

SEQ ID NO: 14916 - DNA, 201 bp, Homo sapiens
tttattcctttctagctttcccctaagttataagcgatttggagaaagtgcaaaatgaactgattaaaatttaaatgactttaacaaaaattagtggctcscaacagccctagtaaagaagagtaggaagaaagcttttcaagtcaataaaaattattgggtggaatattcactatttgggtaatgggtacactaaaagcc

SEQ ID NO: 14917 - DNA, 201 bp, Homo sapiens
agaatcttgaaagaagcatatcacatttaaaggtacatcaaaaggatattagcacttctatgcagacattttctaggccagtatatagtgggatgatataytcaatttgctgaaagaaaaaaactgccaaccaataactctttacccgtaaagctgtttttcagatctgagaaagagatagtctttatcagacaaacaaaa

SEQ ID NO: 14918 - DNA, 201 bp, Homo sapiens
taactcccaaggtttacattatcaataatgtcaaagaaaaagtcacaggccgggagcggtggctcacgcctgtaatcccagcactttgggaggccgaggcrggcggatcacaaggtcaggagttcaagaccagcctgaccaaaatggtgaaaccctgtctcttctaaaaatacaaaaattagctgggcatggtggcaggta

SEQ ID NO: 14919 - DNA, 201 bp, Homo sapiens
attaaaatttaaatgactttaacaaaaattagtggctcgcaacagccctagtaaagaagagtaggaagaaagcttttcaagtcaataaaaattattgggtrgaatattcactatttgggtaatgggtacactaaaagcccagacttcaccactatgccatatatgacataagaaatctgtacttgtacctcttaaatataa

SEQ ID NO: 14920 - DNA, 201 bp, Homo sapiens
tcatgtcctttgctggaacacggatggatctagaggccattacccctagcaaactaatgcaggaacagaaaaccagataccacatgttcttatttataaaygggagctaaatgatgagaacacatggacacacagaggggaaaaatagacactggggcctgtcagagggtggagggtgggagcgggagaggatcaggaaaa

SEQ ID NO: 14921 - DNA, 201 bp, Homo sapiens
gaaagaagcatatcacatttaaaggtacatcaaaaggatattagcacttctatgcagacattttctaggccagtatatagtgggatgatatattcaatttrctgaaagaaaaaaactgccaaccaataactctttacccgtaaagctgtttttcagatctgagaaagagatagtctttatcagacaaacaaaagctgaggg

SEQ ID NO: 14922 - DNA, 201 bp, Homo sapiens
caagagtgactaaagaaaatgaggccagggccaggcatggtggctcatgcctgtaatctcagcactttgggagcccgaggcaggtggatcacgaggtcagsagttcgagaccagcctgacaaacatggtgaaaccccgtctctactaaaaatacaaaaatttggccaggcaaggtggctcatgcctgtaatcctagcactt

SEQ ID NO: 14923 - DNA, 201 bp, Homo sapiens
aatataaaagttaaaagacaaaatattaaaagtatataatttgttaatgaatatacaattttttaaatgtaaattttgacactgagaatgtaaaaagtagkgagaataatatgtagagtttttgtatgtaatctattttaataatctaagttattattagcttcaaatagactgttgaaaccatgttttatgtaagcttat

SEQ ID NO: 14924 - DNA, 201 bp, Homo sapiens
taagttattattagcttcaaatagactgttgaaaccatgttttatgtaagcttatggtaaccacaaaccaaaaacctatactagatacacaaaacagaaakatattaaagcataccactacagaaaatcagcaaatcacaaagaaagacaggaagaaaggaagaaaggatatacaaaacagccaaaaaacaaccaagaaaa

SEQ ID NO: 14925 - DNA, 201 bp, Homo sapiens
aagcttatggtaaccacaaaccaaaaacctatactagatacacaaaacagaaagatattaaagcataccactacagaaaatcagcaaatcacaaagaaagmcaggaagaaaggaagaaaggatatacaaaacagccaaaaaacaaccaagaaaataactatattaagtccttaactatcaataattacttgaacgtaaatg

SEQ ID NO: 14926 - DNA, 201 bp, Homo sapiens
aaagatattatttaacttgacccaaggcatatagctagcaaaagagtaaaactgaggttctaaacactggcctttggactccaagtcctgaggttgtccarctacccccaggacatcattaaatgtatttactcttccaatccaaagtattctttggaaataaaatgtttgttccaaggaatttagaaaatcatgcatatg

SEQ ID NO: 14927 - DNA, 201 bp, Homo sapiens
ggctaacatgctgtgcttaggtcgttcctcttctttttttttttttttttttttttgagacggagtctggctctgttgcccaggctggagtgcagtggcgygatctcggctcactgcaggctctgcctcccgggttcacgccattctcctgcctcagcctcccgagttgctgggactacaggcgcctgccactacgcccgg

SEQ ID NO: 14928 - DNA, 201 bp, Homo sapiens
aactcattaatccattagtggattaatccatttatgtgggtagaaccctcatgatataatcacctctttaaggcctcacttctcaatgctgtcacattgargattaagtttcaacatgagtttcggagaggacattaaaaccacagcaatatccaaaatatataaggaactcatacaactcaaaagcaagatacaactcaa

SEQ ID NO: 14929 - DNA, 201 bp, Homo sapiens
ggtttcattcacttcttaacacatttctatccttcatttttgaggatgttcagagcttgagcccctgagacaggactaactctgaaggaaggagaaaaaaagtgatttgataattaaagctcatggtatatcacatcctgtgtctactcctcttggagtatttacacaaatggaacattattaaaataatcaagtcaaact

SEQ ID NO: 14930 - DNA, 201 bp, Homo sapiens
gttaattgttttttggttttggtgagtgattttagtaataatacaggtgagatctaattttcctttcatctggaaaaccaactagagggatttcgtctcaycttgttccaactagatttattgactggtgcattctttctctgctgatttgtaatgccatcttcatcttatatatttcgtttttccgtggattttattttc

SEQ ID NO: 14931 - DNA, 201 bp, Homo sapiens
atgttaaatatctgcaattatctcatccaattctgtctcttagctttaaatttttatgctgtctcttgacttttagaaggcctctactcactctcccccarcaccacacaatttattgtaataaaatttgtcaatctcttgttttcttttagagtttctgctttttagtttctttggccttatctgggtatcacaaagatt

SEQ ID NO: 14932 - DNA, 201 bp, Homo sapiens
aaaatgatgagttcatgtcctttgtagggacgtggatgaagctggaaaccatcattctcagcaaactattgcaaggacagaaaaccaaacactgcatgttytcactcataggtgggaactgaacaatgagaacacttggacacagggtggggaacatcacacactggggcctgttgcggggtgggggaagcagggagggat

SEQ ID NO: 14933 - DNA, 201 bp, Homo sapiens
gtttcaacacctgatcctagatggtggacaaagcctcaagatacaacatgtagaaaactggaattccaccacttggagtaaagccaggagcagaaaacacrctgcctccccacgcggagaagccaaaatatcttcacccatctgccccaggcatgaaaacaaagccatccacacaggtccagagttagatctgtccagggt

SEQ ID NO: 14934 - DNA, 201 bp, Homo sapiens; identical to SEQ ID NO: 2951

SEQ ID NO: 14935 - DNA, 201 bp, Homo sapiens
atatctaatttttttaggtcagctggcagcacctataagtaagtattacatgtctttttctactttggttctctttggtccccttcacttcacttctgtcmaagtgatttgtggttcccattattcccttgcttccttattaccctacatggtctatattacagagaatctttttaaacactaattaaaagagggactaag

SEQ ID NO: 14936 - DNA, 201 bp, Homo sapiens
atgtgtgactaagatgtgagtcctgaaggctttcctctagagcttcagtaaatttacttaatctaaatgggtccaggtgctggagtgattacccttatctygtctcctgctaaatatggagttccttcagaagacccccaataaacttgtttgtgaaggcctggggagtttcttcagaccccccaataaacttgttttaat

SEQ ID NO: 14937 - DNA, 201 bp, Homo sapiens
gaagtatagatggtgctcacttaaatctcttctcatctgaaaacagagctcccaaattagccaccactagcccggtgccacctatagatgtgttttgtttsgtcaggatggtattattttaaattttgaatttgaatgcctctgggtagggcatggacttttcaccatctctatcccttataactagcagattcacaatca

SEQ ID NO: 14938 - DNA, 201 bp, Homo sapiens
atactgatttcaaagtgcactgttgttgaagtatagatggtgctcacttaaatctcttctcatctgaaaacagagctcccaaattagccaccactagcccrgtgccacctatagatgtgttttgtttggtcaggatggtattattttaaattttgaatttgaatgcctctgggtagggcatggacttttcaccatctctat

SEQ ID NO: 14939 - DNA, 201 bp, Homo sapiens
cctatcccaactcaggccacaaccatatgatactgatttcaaagtgcactgttgttgaagtatagatggtgctcacttaaatctcttctcatctgaaaacrgagctcccaaattagccaccactagcccggtgccacctatagatgtgttttgtttggtcaggatggtattattttaaattttgaatttgaatgcctctgg

SEQ ID NO: 14940 - DNA, 201 bp, Homo sapiens
agatagcatattcctagaagatttaatgtttcccaaaggtctgttttctggtgttccaagtggattttcaataggaactcaatacataatttaaaaaaaaactgatttgttttattttatttttagcaattggtccaatagcaaccagtaagctcctactgtttttctcagtttcctctggtcttttgtagcatctcgatt

SEQ ID NO: 14941 - DNA, 201 bp, Homo sapiens
aatgtcaagggataacaagtgttggcaaggatatggagaaaagggaacccttgtacactgttgttaggaatgtaaagtaatacagccattatggaaaacartattgtggttcctccaataaattaaaaatagaactaccatatgattcaggaatgctacttctgggcatatattcaaaggaaataaaaatcattatcctga

SEQ ID NO: 14942 - DNA, 201 bp, Homo sapiens
ggttcctccaataaattaaaaatagaactaccatatgattcaggaatgctacttctgggcatatattcaaaggaaataaaaatcattatcctgaagagatrtttgcactcccatattcattgcagcattatttacaatacccgggatagaggaataaactaggtgtccatcagtggatgaatggataaagaaaatgtgata

SEQ ID NO: 14943 - DNA, 201 bp, Homo sapiens
tagccacgcatagaaagacaaatactacatgatctcatgtatatatggaaccttaaaaagttgaactcagcagaaaggtgattaccagaagttagggggtrgaagaaatgggcagaagttggccaaagggtacaaacttgcagttttatgacaaatacgttatgtagacccaatgtacagcatggtgactataatgtatta

SEQ ID NO: 14944 - DNA, 201 bp, Homo sapiens
ggctgtccaaggcctccagtagcctacaggttgctttggtgcatattaggaaaaggtgttccttcctgcaagtgaatgcagccccaccccagagacactgytgtggatttcagttcccttaaccctttgtgcagtgagccaacctatataatcatagcacacgtgtcctgaagatatatgaaaggcatctcactcttagca

SEQ ID NO: 14945 - DNA, 201 bp, Homo sapiens
tcaagaggatataaaaattataagtacatatgcacataatgtcagagcacctaaatatataatatttacataactgaagggagaaacagcaatataataaycgtagcggacttcagtaacccattattgacaatgaatagagcatccacacagaaaattaacaagggagaaaataaagttaccaagaatacccaataggga

SEQ ID NO: 14946 - DNA, 201 bp, Homo sapiens
tgtcctggttggggctgagccatggtctcaatatagagcccgagtcgatggtgaacctggcgtttgtcaagaatgactcgtatgagaagggcccggattcmgtggtggtgcacgtgtacgtgaaggagatctgcagggacacctcaagagtacttttccgtgagcaggacttcacgctcatcttccagaccaggtgggtgg

SEQ ID NO: 14947 - DNA, 201 bp, Homo sapiens
agaacaagccctacacagagaccgtggattcagatgggcggcccgatgaggtcagggttagggacagagggtgggcatgtctcatgagcatcccagccccyggtactctttggttctcaccactctgcctctcaggtggtagctgaggaagcatggcagcggcacaagatgaggaatgactctttcatcgtggacctattt

SEQ ID NO: 14948 - DNA, 201 bp, Homo sapiens
tgtggagacctctcaggttgggacttcttgtcagcttggacccctgaccagtgggctttggcttctccagccgcctccagtgctgcgtgatttgattctgwtgtaccttcaattcttctgacccgcattataaacattataattttattctaaaaattgtaattttttttgcattttggaagtgactgctgctgtttaaat

SEQ ID NO: 14949 - DNA, 201 bp, Homo sapiens
actctcattggtcagcgagtgaatgccgacctgcagactggggcctaagtttcttttagtttccggtgtctctgcaatggcggctctagactccctgtcgmtcttcactagcctcggcctgagcgagcagaaggcccgcgagacgctcaagaactcggctctgagcgcgcagctgcgcgaggccgctactcaggtgcgagc

SEQ ID NO: 14950 - DNA, 201 bp, Homo sapiens
cacagcttcctcttaaccgtgggcagggctgcgatgtgaagcttgtgcccctgggcactttggggacccatcaaggccaggtggccggtgccaactgtgtragtgcagtgggaacattgacccaatggatcctgatgcctgtgacccccacacggggcaatgcctgcgctgtttacaccacacagagggtccacactgtgc

SEQ ID NO: 14951 - DNA, 201 bp, Homo sapiens
acccagagtgagggtgtgggttcccagaatatctctaaaggtggctttcctgaaccacatggtttggctttctgcaggtggaggctgctattaacaggcaycggccccagctcctggtggaacgttaccatttcaacatggggctgctgatgggtgagcagggcctggaacggggctatattgttctctctggtcatgcct

SEQ ID NO: 14952 - DNA, 201 bp, Homo sapiens
ccaacggcactttgctacttcttgccaccaggatgaatattcccagcagattgtgtgccactgccgggcaggctatacgggtgagtggatgggggcaggcrtgggatcagggtgagttggctgggctgagcactcacagcttcctcttaaccgtgggcagggctgcgatgtgaagcttgtgcccctgggcactttggggac

SEQ ID NO: 14953 - DNA, 201 bp, Homo sapiens
gattgcagagcgagtccggagcctggcagatgtggatgcgatcctggcacgtactgtaggagatgtgcgtcgtgccgagcagctactgcaggatgcacggygggcaaggtctgaccccatccctggcccctatccctgacacctggttttgatacctccaggttctgattcccccttctccccaggagctgggctgaggat

SEQ ID NO: 14954 - DNA, 201 bp, Homo sapiens
tgggtgtagctaaagagcaagttgttgggtcttggcagtgatcactggcttctttccattaggctgtccgttccttgctggagaatttggccacaaagagytgccaagatagctgggccaggaagaaagcgccgcagccctgacccagacgctgttgccgaccccggggcactctggctgtcgaccaagcggctcaagatg

SEQ ID NO: 14955 - DNA, 201 bp, Homo sapiens
cattcagccacctgagctccagctggtgacccctatggctgagggggacacagggcttccccgggtgtgggcagcccctgaccggggtcctgtgcccagcrccagtggaatttcttctgagatgctggccagtgggcccattgaggttggctccttgccagctggcgagagggtgtcccgacccgaaggtaagatccagtg

SEQ ID NO: 14956 - DNA, 201 bp, Homo sapiens
cctcttatagaggctctgaccctgccttgttcccaccccagttcacagggcagtgccactgccgtgccggctttggagggcggacttgttctgagtgccargagctccactggggagaccctgggttgcagtgccatggtgagggagccagcggggccagggtagatggaggacttcccagaatgccccacagtgacccta

SEQ ID NO: 14957 - DNA, 201 bp, Homo sapiens
agtgggcccattgaggttggctccttgccagctggcgagagggtgtcccgacccgaaggtaagatccagtgaaaggctctagaagctggggaggaggataygggaggatggagggggctgttgtttagggcctggtgggcctggtgaggccctgatgggcagggaagctttgattatcatgttctcacacagctgctgtgc

SEQ ID NO: 14958 - DNA, 201 bp, Homo sapiens
gctgaagcctctctaaacacccccctctccatcattgcaggcgtgaaattggggaggccactgagcacctgactcagctcgaggcagacctgacagatgtkcaagatgagaacttcaatgccaaccatgcactaagtggtctggagcgagataggcttgcacttaatctcacactgcggcagctcgaccagcatcttgact

SEQ ID NO: 14959 - DNA, 201 bp, Homo sapiens
tttcttctgagatgctggccagtgggcccattgaggttggctccttgccagctggcgagagggtgtcccgacccgaaggtaagatccagtgaaaggctctrgaagctggggaggaggataggggaggatggagggggctgttgtttagggcctggtgggcctggtgaggccctgatgggcagggaagctttgattatcatg

SEQ ID NO: 14960 - DNA, 201 bp, Homo sapiens
tatctgcctcacacctggtctttcaggccctctgatgcaccaggctccttatggcattgggcactgagacaggtgccagcagaggcataagcctatttggrcctacagacctcaccactgcccacatagacccaaggcagggccaagccttcttaaactctggggcagggctagggaaagggcttatcctcacgtgggatc

SEQ ID NO: 14961 - DNA, 201 bp, Homo sapiens
ccacctggcagacccagggctgattctttccacaatcttgccattaataggttgaggctgatgaacagctttgcataccaccgctgaactcccaaacctgyctcctgggctcagaggagaatttagcccctttggcaggagagaaagcagtgcctcccgggaatgacccagtctctccagccatggtccggagcagaaacc

SEQ ID NO: 14962 - DNA, 201 bp, Homo sapiens
ccaaccgagagcagcggctagaggacaaaggtgtctgaggctgtgggtgggagccatggggtgggttgagctggctgttctccacagctgcatgacctctytccctgcgaatctccaggagacaccccactggagctgggtgacgactgtagcctggctctcgtctggcggaacaatgagcgcttgcaggagtttgtgttg

SEQ ID NO: 14963 - DNA, 201 bp, Homo sapiens
atgtgtatgtctgtagatgccaatgactgtacacacgtctgtggtgagtacacacacacatccacacatgtgatagcccaaggaaggacaaagatacctcrgccaaacgcaggttctcaggcttcacatgaacactctgagagagggagtccaatacttcgctcgcagtggagttctccttgctgacgctcaccaggaact

SEQ ID NO: 14964 - DNA, 201 bp, Homo sapiens
gggcctggtgggcctggtgaggccctgatgggcagggaagctttgattatcatgttctcacacagctgctgtgcctgggtaccagcatccaagtgaagctwtgaatgcccacacaccccagttcttcatctataaaattgattcatccaaccgagagcagcggctagaggacaaaggtgtctgaggctgtgggtgggagcc

SEQ ID NO: 14965 - DNA, 201 bp, Homo sapiens
ggtaattaagaatcgttttcatcgtgtgttcctaccctcccactcactggacactgtgtccccatctgatacgctcctctgctttgagctgctatcctcaragttggctaaggagcgggtagtggtgctagaggtgcaacaggtgagtgggggccaacctgatggcacagcgccctggtgggtggggcacttcttcctggt

SEQ ID NO: 14966 - DNA, 201 bp, Homo sapiens
cagagattgcaccacagcactccagcctgggtgacagagtgagactctgtctcaaaaataaataaataaatagataaaaaaataaaaatagggccaggcgyggtggctcatgcctgtaatcccagctctttgggaggccaaggctgatggatcacaaggtcaggagatccagaccaccctggcttacatggtgaaacccca

SEQ ID NO: 14967 - DNA, 201 bp, Homo sapiens
cagcgagtgaatgccgacctgcagactggggcctaagtttcttttagtttccggtgtctctgcaatggcggctctagactccctgtcgctcttcactagcytcggcctgagcgagcagaaggcccgcgagacgctcaagaactcggctctgagcgcgcagctgcgcgaggccgctactcaggtgcgagcccctctgccccc

SEQ ID NO: 14968 - DNA, 201 bp, Homo sapiens
  misc_feature (1)...(201): n = A,T,C or G, or insertion/deletion polymorphism (see Tables 1-2)
cggctcgggtctctaaacagccccttacccgcctcgacgtccctggggcatgggggagggacgcgaccttcggctggggcctgggtgcaagaaggaggcgncggtggcaggtgtcattaaagatccagcccaccagtaccacatctgacctgtagaagggtatcctgccatccctccttcctcctttacacacttagggga

SEQ ID NO: 14969 - DNA, 201 bp, Homo sapiens
gcggctggagaagccaaagcccactggtcaggggtccaagctgacaagaagtcccaacctgagaggtctccacacccaaatcatacccctcagcttcccaytgacagagccagtgtcctctgggttagagaaggagaagcggcaaggagctggccctctgtgtgggtgtcccaaacccagtcccccccatcagccagggac

SEQ ID NO: 14970 - DNA, 201 bp, Homo sapiens
agatggggctaagggcctatccttgtcttcctcttcccgtcaggctctgccagaaaacccactggcctgaccacaagggcctctgccgacctgagaacatyggctaccccttcctggtcagtgtacctgcctcacgcctcacttatgcccgcctcgctcagttgctagagggctatgcccggtaagtgcccagtggttgga

SEQ ID NO: 14971 - DNA, 201 bp, Homo sapiens
gaatctttcctgcctgccatccctgccatgcatgcttcggggattgggaccgagtggtgcaggacttggcagcccgtacacagcgcctagagcagcgggcrcaggagttgcaacagacgggtgtgctgggtgcctttgagagcagcttctggcacatgcaggagaagctgggcattgtgcagggcatcgtaggtgcccgca

SEQ ID NO: 14972 - DNA, 201 bp, Homo sapiens
agtagctgggattacaggtgcatgccaccacgcaaggctaattttttttttttttttgagacaatgtctcactctgtcatccaggctagagtgtagtggcrtcttggctcactgcgggctctgcctcccgggttcaagtgattctgctgcctcagcctcccaagtagcctcagcctcccaagtagctgggattacaggtat

SEQ ID NO: 14973 - DNA, 201 bp, Homo sapiens
gagactggagcagctatgagtgggttggttggtgggcaggcttcccagggatgacacatttcttcttcctcctccctgcaggtgcattgctggtttccacrgggacccacggctgccatatgggggccagtgccggccctgtccctgtcctgaaggccctgggagccaacggcactttgctacttcttgccaccaggatga

SEQ ID NO: 14974 - DNA, 201 bp, Homo sapiens
tggcggggccagtgccacaggcccaaggagagggcccccaggactggaggacaccactagtaagaagaagcagaaggatcgagcaaaccaggagagcaagsatggagatcctaggaaaggtgggagtggcattcccagagtaattgtggccttctctgcctcccatcttattggtatacagattggggtttgggagatgac

SEQ ID NO: 14975 - DNA, 201 bp, Homo sapiens
tttgctttttctccttgcgatactttactgaggatgatggtttccagcttcacccatgtccctacaaaggacatgaactcatccttttttatggctgcatrgtattccatggtgtatatgtgccacatattcttaatccagtctaacattgatggacatttgggttggttccaagtctttgctattgtgaatagtgccgca

SEQ ID NO: 14976 - DNA, 201 bp, Homo sapiens
agccaactgaggattacttgaatggcctcaaaaagttaacaaaactattaagacaccttactgttgttaacttaagcctctgaaaaagagggaaaagaagyaaatacctaactattttctacagttagcctttttgttttaaaaacatttcagtttggtcttgtgggcaacttagacaatattatggacttaaaataacaa

SEQ ID NO: 14977 - DNA, 201 bp, Homo sapiens
gatggtagtttcttttgctgtgcagaagatctttagtttaattagatcccttttgtcaattttggcttttgttcccattgcttttggtgtgttagacatgragtccttgcccatgcctatgtcctgaatggtattgcctaggttttcttctagggtttttatggttttaggtctaagatttaagtcttcaatccatcttga

SEQ ID NO: 14978 - DNA, 201 bp, Homo sapiens
gaaggtgatgtgcagaaaatggaagtgaggaacagaaacagctagattggttacagctgggtgtttgctttatttgaatagggtttgaacagttgaccgcmtgtgattggctgaaactcggatgcaatgattggctgagacttggctacttgttataagagtaagttacagtctatttatacatccagttaggttacagtt

SEQ ID NO: 14979 - DNA, 201 bp, Homo sapiens
ctgtctgttattggtgtataagaatgcttgtgatttttgcacattgattttgtatcctgtgactttgctgaagttgcttatcagcttaaagagattttggscagagacaatggggttttctaaatacacaatcatgtcatctgcaaacagggacaatttctttctcctgcctgattgccctggccagaacttccaacacta

SEQ ID NO: 14980 - DNA, 201 bp, Homo sapiens
caactatgtggtcaattttggaataagtgtggtgtggtgctgagaaaaatgtatattctgttgatttgggatggagagttctgtagatgtgtatttggttygcttggtgtggagctgagttcaattcctggctatccttgtgaactttctctctcgttgatctgtctaatgttgacagtggggtgttaaaatctcccatta

SEQ ID NO: 14981 - DNA, 201 bp, Homo sapiens
tttttgagtaatgctgcttaggagcttagagagtggagttatgaaatggtgggtgtcagtcagggagaagcagcattgtcccttttgaaaactgggaaacygttcttcaaatattctcagagtctgagaataaattcagagtcaggaaaattctccttggattctctcttaaaggatactgatggaaaaaaaagacatgag

SEQ ID NO: 14982 - DNA, 201 bp, Homo sapiens
gagcatagtgcatcaggggtataacaagggaagaggagcctgagaaggagagtgaggagaatttaataggggttcaaaagatttcttgatctagaacaccrgggttcaaaatggtttaatgagttcaattgattccattttattttttaattaaatcacttaatggcagagagcatcaattggggttcaatgctccagata

SEQ ID NO: 14983 - DNA, 201 bp, Homo sapiens
ccatcaaacagttgaaatatagtgaggtatagtgacctaaaaatgttcattgttaccacatcagcagctgtatctccttcattcctgctttataactcaawtgcccacttccagctctgtctcttaccaccttatgtgctactcacaccttcccctcttcctaccaaccccgcaccctgtacaaatatgcacagatatgga

SEQ ID NO: 14984 - DNA, 201 bp, Homo sapiens
catctttgttctattgctgggtaggagctgcattcctttggagggggagaggtgctctgatttttagaattttcagcttttctgctctgttttttccccayctttgtggttttatctccctttggtctttgatgatggtgacgtacagatggggttttggtgtggatgtcctgtctgtttgttagttttccttctaacagt

SEQ ID NO: 14985 - DNA, 201 bp, Homo sapiens
ctttggtctttgatgatggtgacgtacagatggggttttggtgtggatgtcctgtctgtttgttagttttccttctaacagtcaggaccctcagctgcagrtctgttggagtttgctggaggtccactccagatcctgtttgcctgggtatcagcagtgtaggctgcagaacagcgaatattgttgaacagcaaatgttgc

SEQ ID NO: 14986 - DNA, 201 bp, Homo sapiens
tcaggagttcaagaccagcctgggcaacatagcaagatctcatttctacaaaaaatttaaaaattagccaagcatggtgtgcgcacctcccagctatgtgrcaggctgaggcagaaggatctgttgagcccaagaggttgtggctgcagtgagccatgttcatgccactgcagtccagcctgggcaacagagtgagaccct

SEQ ID NO: 14987 - DNA, 201 bp, Homo sapiens
cctgctagtgaaagggtgtctcatgataccatttgactgtgtttcaggaaaacagtgcatgtgcttggtggatctggatcgagcaagagctgcagaagaaygtggatactccgttcaagtgatatccatggagccagagagctgctctcccaaaaataacatgattgtgggagtccccatttaaaatgagatattcacatt

SEQ ID NO: 14988 - DNA, 201 bp, Homo sapiens
gtatcagcagtgtaggctgcagaacagcgaatattgttgaacagcaaatgttgctgcctgatcattcctctggaagcttcgtctcagaggggtacccggcygtgttaggtgtcattctgcccctactggggagtgcctcccagttaggctactcggggggtcagggacccacttgaggaggcaatctgtcagttctcagat

SEQ ID NO: 14989 - DNA, 201 bp, Homo sapiens
tctgcattgcttccttttcctctgatagaatgaaaagccacttagcaggccaggcacggtacctcatgcctgtaatcccagcactttgggaggcagaggcrggcagatcacaaggtcaggagttcgaaaccagcctggccaacatggtgaaaccctgtctctactaaaaaaaataaataaatacaaaaattagccagcatg

SEQ ID NO: 14990 - DNA, 201 bp, Homo sapiens
tgtaatgttactgttttttactttgcaattaagtaatttgtggtagtctgagactatgtacatatcttattcctcacctgcttttcatttagcatctgtcrtagtttgttttttgttgctgtaacagaatatcatagactaggtaaattataaaaatagaaatttatttggctcatggtttttgaggtggagaagtcgaag

SEQ ID NO: 14991 - DNA, 201 bp, Homo sapiens
acttagcaggccaggcacggtacctcatgcctgtaatcccagcactttgggaggcagaggcgggcagatcacaaggtcaggagttcgaaaccagcctggcyaacatggtgaaaccctgtctctactaaaaaaaataaataaatacaaaaattagccagcatggtggcgtgcgcctgtagtgccagctactcaggaggctag

SEQ ID NO: 14992 - DNA, 201 bp, Homo sapiens
gcaattaagtaatttgtggtagtctgagactatgtacatatcttattcctcacctgcttttcatttagcatctgtcgtagtttgttttttgttgctgtaasagaatatcatagactaggtaaattataaaaatagaaatttatttggctcatggtttttgaggtggagaagtcgaagagcatggcactagcatctggtgag

SEQ ID NO: 14993 - DNA, 201 bp, Homo sapiens
tataatgtttgcaaaattgtgactttctagcacccataatttattctacattcattaattggcaaactaaggaaaagctttcctttctcttccccacttaycatttgttttctttatctgtatcaggataaattcgtggattcttattttttcaatggattacattctattattatcattatttattttgatactcaaatt

SEQ ID NO: 14994 - DNA, 201 bp, Homo sapiens
aaggcctctacattggaaaaagagaagggagaaaactatctctatttgcagataacatgatcttctatacagaaaatcctaagacatccactgaaaaactrttacaattactaaacaagtttactaatattgcagaatataaaagcaatatacaagttagttgaacttgcacctgcaatgaacaatctgaaagtgaaagga

SEQ ID NO: 14995 - DNA, 201 bp, Homo sapiens
cgtgcgcctgtagtgccagctactcaggaggctagggcaggagtattgcttgaacccaggaggcggaggttgcagtgagccgagattgtgccactgcactsgagcctggacaacagagcaaaactccgtctcaaaaaaaaaaaagaaagaaaagaaaacccacttagcaagactgcctagaaccacattccagagtttcaa

SEQ ID NO: 14996 - DNA, 201 bp, Homo sapiens
tgattggctgaaactcggatgcaatgattggctgagacttggctacttgttataagagtaagttacagtctatttatacatccagttaggttacagttcaytatgtatggagaaacctttaggtcaaacataaaatatgtaaggagtaaacttaaggttaaacttaatttaaacaaccaattttactgacttttatctaca

SEQ ID NO: 14997 - DNA, 201 bp, Homo sapiens
ggctacttgttataagagtaagttacagtctatttatacatccagttaggttacagttcactatgtatggagaaacctttaggtcaaacataaaatatgtraggagtaaacttaaggttaaacttaatttaaacaaccaattttactgacttttatctacattagaatcgtttcattaaaaaaatcttgttgcttcattta

SEQ ID NO: 14998 - DNA, 201 bp, Homo sapiens
ctgactccctttactagagaagagcatttagaaattaagattagagcagtaagtatgctcattgttaatgaactgttacagcttctaggtcatctcagtagggacctgtatgtatagatctataggaaatagatgtatgcatgcattcatgtacacatacaaacacatatacaactatacacatcaatatctactgataca

SEQ ID NO: 14999 - DNA, 201 bp, Homo sapiens
agcatttagaaattaagattagagcagtaagtatgctcattgttaatgaactgttacagcttctaggtcatctcagtagggacctgtatgtatagatctataggaaatagatgtatgcatgcattcatgtacacatacaaacacatatacaactatacacatcaatatctactgatacatctatatcttttatccatctat

SEQ ID NO: 15000 - DNA, 201 bp, Homo sapiens
aaatagatatatattacatacgatatgtattatatattgtatatatgagtgatatatagagcaaaacatgtgttaaatttatttctttttctgggagaaagttagagaagtcagccagagtaataggaaaaataatttaaactggcaaagagatggataaaattttactgggcaaaattgtccattatgacattaaacatt

SEQ ID NO: 15001 - DNA, 201 bp, Homo sapiens
aatagatatatattacatacgatatgtattatatattgtatatatgagtgatatatagagcaaaacatgtgttaaatttatttctttttctgggagaaagttagagaagtcagccagagtaataggaaaaataatttaaactggcaaagagatggataaaattttactgggcaaaattgtccattatgacattaaacattc

SEQ ID NO: 15002 - DNA, 201 bp, Homo sapiens
aagttcttgtgctgtgtttttcagttccagcaggtcatttatgttcttctctaaactggttattctattagcaattcctctaaccttttttcaaggttctkagcttctttgcattgggttagaacatgttcttttagcttgaaggcatttgctattgccttctgaatcctacttctgtcaattcgccaaactcattttcca

SEQ ID NO: 15003 - DNA, 201 bp, Homo sapiens
atagatatatattacatacgatatgtattatatattgtatatatgagtgatatatagagcaaaacatgtgttaaatttatttctttttctgggagaaagttagagaagtcagccagagtaataggaaaaataatttaaactggcaaagagatggataaaattttactgggcaaaattgtccattatgacattaaacattcc

SEQ ID NO: 15004 - DNA, 201 bp, Homo sapiens
ttatgattcagcactcagcagctatcacttacttgaggagaatccacttctcctgaaagaacgaatatcccctccctattattttgtagggtcgtaaaaargaagcagtatggaaggaccagcactgtcaaaacttctcaaggatattatccccagacagctctcagtatttttggttaatttatttccccttctatttat

SEQ ID NO: 15005 - DNA, 201 bp, Homo sapiens
gacaagcttattctaaattttatatggaaaaaaaattttgaaaaagagcaacagaatcactctagtgagtgttaagacttactatatagctatagtaattrgagagatagacatacagaacaataaaacagaataataaaacaataaaacagaatagagaagcataaaatgcataaaagcaactcaatggaagaaggatag

SEQ ID NO: 15006 - DNA, 201 bp, Homo sapiens
gctcaataattaagcctggctgatagtttatcctaggctccctgaaaacttcaagacatcttgaggatgttatggtgttatagatgttatgttcatggagaaggagaagtaggggaaattctttcatactgaaagcttaatagtatccaatttcaattatacatctccattcaaaataactgaaaactgaaactaagtatc

SEQ ID NO: 15007 - DNA, 201 bp, Homo sapiens
tcaataattaagcctggctgatagtttatcctaggctccctgaaaacttcaagacatcttgaggatgttatggtgttatagatgttatgttcatggagaaggagaagtaggggaaattctttcatactgaaagcttaatagtatccaatttcaattatacatctccattcaaaataactgaaaactgaaactaagtatctt

SEQ ID NO: 15008 - DNA, 201 bp, Homo sapiens
atatataaattatatatacagttggatgtattcatgaaccaccctaggattaaaaatatttgaaaaaaatttgcatctgtactgtacatgtacagactttyttcttgtcatgatgccctaaacaacacagtagaacagctatttacatagcatttacattgtattaggtattacaaataatctagagatgacagtatatgg

SEQ ID NO: 15009 - DNA, 201 bp, Homo sapiens
gaacagcacaggaaagaattgaccccatgattcagttacctcccactgggttcctcccatgacatgtgggaattgtggaagttacaattcaagatgagatktgggtggggacacagccaaaccatattgacctggaatgttgatattcactcttatttccattttttgtcatatcatttttattttagctgatttttatgt

SEQ ID NO: 15010 - DNA, 201 bp, Homo sapiens
tggctttcacggaagattattaaatccttttattgtacttacatagaaatttacaaatacctgtattagtccatttcacactgctgataaagacatacccragactgggcaatttacaaaggaaagaggtttaatggacttgcagttatacatggctggggaggcctcacaattatggtggaaggcaaggagagcaagtca

SEQ ID NO: 15011 - DNA, 201 bp, Homo sapiens
gatcacaaggtcaggagttcgaaaccagcctggccaacatggtgaaaccctgtctctactaaaaaaaataaataaatacaaaaattagccagcatggtggygtgcgcctgtagtgccagctactcaggaggctagggcaggagtattgcttgaacccaggaggcggaggttgcagtgagccgagattgtgccactgcactc

SEQ ID NO: 15012 - DNA, 201 bp, Homo sapiens
ggtaaacacaaaattcagtatagtggttatttcagggctgggaaaggtgagggagatacagttggttagggatatgtacataggacttcaaaaatactacwaattttttgtttttgtaaagctggataatggatacttcagtagtttttatcatcaccattattatttataactcatgtagtttaaaatgtatttctattt

SEQ ID NO: 15013 - DNA, 201 bp, Homo sapiens
tcttcccctagataatccatacaccttactctctcactttattcagatctcaatgtcaccttattagagaggccctttcaggtcagcctatctgtaatacrtttactcttccttgctctttctcccctttctaatttttctttttaacccctaatatagtatatttatttgttttgtgtgtatcacctatctacccccact

SEQ ID NO: 15014 - DNA, 201 bp, Homo sapiens
tctcaatgtcaccttattagagaggccctttcaggtcagcctatctgtaatacatttactcttccttgctctttctcccctttctaatttttctttttaamccctaatatagtatatttatttgttttgtgtgtatcacctatctacccccactggaatgtgtactccatggcagcaaggactgcaatatacccaaccctt

SEQ ID NO: 15015 - DNA, 201 bp, Homo sapiens
gtatccatgttatggggaaatttaaatatttttatattatgattcagcactcagcagctatcacttacttgaggagaatccacttctcctgaaagaacgartatcccctccctattattttgtagggtcgtaaaaaagaagcagtatggaaggaccagcactgtcaaaacttctcaaggatattatccccagacagctctc

SEQ ID NO: 15016 - DNA, 201 bp, Homo sapiens
ttatcacatttctatttatctttcaatatgcagcttagatattagatagcaagtcttccttcctttctcaacatcttccttctttttctatggaacattamtttttaaccttgaactataagttacttaggttcacattttctcctccatgagactgctaccttttgcaggcaggaagtagcttaaaagcataagcttttg

SEQ ID NO: 15017 - DNA, 201 bp, Homo sapiens
ctgatacaacataaaagcctagcccagggatgattgagctcaaaacttatttcccaataagacagttattttttctaaagttatattgaaattaaaaaatmttttcatttcttgttttgtttttgttttgtaggttagtcagtggaccaggctatgtgaactcaccatccctttggctattgagaattttctcagagaatc

SEQ ID NO: 15018 - DNA, 201 bp, Homo sapiens; identical to SEQ ID NO: 3000

SEQ ID NO: 15019 - DNA, 201 bp, Homo sapiens
agcaggacttgctgttgtattgagacacataatccagaaatcctatgaagcagaccccttaaagaaggaacttttggaacttctgggctttaaaaagactwgcttgaaagcctgtgctgaagtaagtataatgtcttttttctgttatttgaagctacacagtgataacataattacctgaccatttaatattttaacttc

SEQ ID NO: 15020 - DNA, 201 bp, Homo sapiens
ctggttggggtagttctcctggataatatcccaaggagtgtttttcaactaggttccagtctccctgtcactttcaggtacaccaatcaaacttagtttcrtctttttacatagtcccatatttcttggaggctttgttcattccttttcattcttttttctctaatcttgtcttcatgctttatttcattacattgatcg

SEQ ID NO: 15021 - DNA, 201 bp, Homo sapiens
agtccaaaaaactgtgccttatgcagcttagtaatttggtcagttaatgacatgaacatttggctaagatttgagaaaaaaaaaataggcaaaaaaaaaamcaaaaaagagagaattcaagtataaaatacagtgaattccaagttagtaagggctgcctcaaggacaagagagaaagccctctaatattaaactgtggga

SEQ ID NO: 15022 - DNA, 201 bp, Homo sapiens
aatacaagagaaaaatttttagtatcatgggagagggaagtcttagggcaagagctgggcaacaggcctagaaagcattgagtccatattttagtaaaacrtcagaaagcccaggaaagatgtctctaggaaagaaaaaatggagctgaccaattatttgaaagttttcaaacagtggaaatttatattgtagagcatttt

SEQ ID NO: 15023 - DNA, 201 bp, Homo sapiens
catcagtacctaatttattgagtgtttttagcatgaagtggtgtggaattttatcgagggccttttctgcatctattgagataatcatgtggtttttgtcwttggttctgtttatatgatggattacatttattgatttgcatatgttgaaccagctttgcatcccagggatgaagccaatttgatcatggtggataagct

SEQ ID NO: 15024 - DNA, 201 bp, Homo sapiens
aactggatcctccttaaacagactgagctacttgagggcatcaactgttcatgtttgtaacttttatgcctagctgagtcaccagcaaaaagaaggcagaratttaatgaatactgaaatgaaataatgaatgaattgtagggaaaaatagtatgggaggtaactggagttataaactataatattgaatgtgaccaccat

SEQ ID NO: 15025 - DNA, 201 bp, Homo sapiens
ttaatttagaaagaggctatttccttttctaggaaaagggcattgaagtgatgttttctccccacccttgccctacttggactcttgattggaatgttctscctgcagcagtcagcccaaaggaaggtgagttttcttttttctttaagttttattcatactttggatactgtcttcagatatgtcttctaattctctaaa

SEQ ID NO: 15026 - DNA, 201 bp, Homo sapiens
tgagtgtttttagcatgaagtggtgtggaattttatcgagggccttttctgcatctattgagataatcatgtggtttttgtcattggttctgtttatatgmtggattacatttattgatttgcatatgttgaaccagctttgcatcccagggatgaagccaatttgatcatggtggataagctttttgatgtgctactgga

SEQ ID NO: 15027 - DNA, 201 bp, Homo sapiens
aggttacattaatagaaaacaaggaattatcattaattcgtgctaagaagagaagtgatgaactgggtttaagcaacatttggttcattcaagcaaatatrgaatattttactgggatgtttaatattggagtaagtaatcaagtaatttcaatttctttaattagctaaataagaaaaattacatgccttagagtaaata

SEQ ID NO: 15028 - DNA, 201 bp, Homo sapiens
gaattttatcgagggccttttctgcatctattgagataatcatgtggtttttgtcattggttctgtttatatgatggattacatttattgatttgcatatrttgaaccagctttgcatcccagggatgaagccaatttgatcatggtggataagctttttgatgtgctactggatttggtttgccagtattttattgagga

SEQ ID NO: 15029 - DNA, 201 bp, Homo sapiens
tgatggacacttaggttgattccatatcttgcctattgtgaatagtgctgcaataaacatgtaagggcagatatctcttcactatactgatttcttttctwttggatatatatccagcaagggaattgctagatcctatagtagttctaatttcatttttgagaaaactccatactgtgtttcataatggctgtactagtt

SEQ ID NO: 15030 - DNA, 201 bp, Homo sapiens
agggccttttctgcatctattgagataatcatgtggtttttgtcattggttctgtttatatgatggattacatttattgatttgcatatgttgaaccagcyttgcatcccagggatgaagccaatttgatcatggtggataagctttttgatgtgctactggatttggtttgccagtattttattgaggatttttgcttca

SEQ ID NO: 15031 - DNA, 201 bp, Homo sapiens
agtgatttttgttccaactctccaacatgctgggatgaaggactggcctctttttgtcctactgttaaagtctgggtccctattattagcaaataccctcrgggcagccatagtgtcagttcaagactattacacaaattttcagcaatccccccaactttttaccccctcacattcttaaggccctataaattttcctta

SEQ ID NO: 15032 - DNA, 201 bp, Homo sapiens
tttttccactttcaatgtaagtcttaattttatacctggtcttttttcctcctaagacattgtttacattgtctcaaagtatactgcagtgagaaattgtstttttctaggttgtataaattaatgggttatttatagtgttgctgctgctactactaatcccagtatgtttttctcagtatttggatatgattccttaaa

SEQ ID NO: 15033 - DNA, 201 bp, Homo sapiens
gtcagttcaagactattacacaaattttcagcaatccccccaactttttaccccctcacattcttaaggccctataaattttccttattctgagaaacccrcctagacatgtaaaggatgcttgtttaattttaaataccattttaggtgttttttagatagagaattctttataatagctcaatttcttcacttattcac

SEQ ID NO: 15034 - DNA, 201 bp, Homo sapiens
tgttattctggattaaacactttctgtactgcaagactccttagcacttttactatgctagtgggcattgcgattctccaaaaaaatagaaaaggtattamttttctaaagctacctgatggtagaactcactatttttctctctaaatatctttttatatctctttcctcttagtatcttgagagactactgttccacaa

SEQ ID NO: 15035 - DNA, 201 bp, Homo sapiens
gccatatataattcttaatttttaatcctctttgaagtagttgccttcccttttcatattctttttttctgtgatgctacctaatattgcctgtatctcaygggtcatttctattctgttaatcaaggaaataatttagaattctctcagtatggaagaagatcatgttggagaattaagatttctgccccaaagatattt

SEQ ID NO: 15036 - DNA, 201 bp, Homo sapiens
tctgctcttgaaaattttatttagaggaaaaactgaagtaaaatacattttatgattgactctgaataattaaatttttccctaagatataattactaggraatcactcatttccctgctagaaagcacctcatttccttgaacgcacgcatatgaaaaagacaccagcattgaaattctgacatcacaattaattaaaag

SEQ ID NO: 15037 - DNA, 201 bp, Homo sapiens
gcaacgcattgacatggaaagatatttacaatatttcatattttgtaatataacattttatattttatacctagctagaacacataaaatttatgaatatmattgaaagtaaccatacatgtacataaaatgttatcgctgaattatgatgctataaatttttttatatagttttttatttacatttaaaaatctttccta

SEQ ID NO: 15038 - DNA, 201 bp, Homo sapiens
aattatagctcactgtagcctcaaactcctgagctaaagggatcctccccctcagccccccaagtacttaggaatacaggcgtgtgccatcatgctcagctttttttttttttttaaagtttttgtagagatggagccttttgctttattgcccaggctggtctcgaactcctggcctcaagcaatcctgtagccttagcc

SEQ ID NO: 15039 - DNA, 201 bp, Homo sapiens
atatatatatatatatataatatgtcttattatttcaccgattttcactgaccaaaaccatccatatgccagatggcaaggaagccagttgagtagccaaygcagatcaaccttcaaagcagagagcaggttaaattgaaggggcaaatactctgcagatatctgacagagtaattgtggaaattcagagccaggagagac

SEQ ID NO: 15040 - DNA, 201 bp, Homo sapiens
aaaacaaaacaaaacaaaacaaccaccaaaaaacaggagaaagataaaaacatcattcatggcttcataatatataggaattatgattacttgagaatccttttttttttgagacagagtcttgctctgtcactcaggctggagtacaatgctgtgatcttggctcactgctacctcctcctgggttcaaacgattctcat

SEQ ID NO: 15041 - DNA, 201 bp, Homo sapiens
agatcttgctttcctcttcctgatagagtattgtttgtattgtttttagctttccagttcaaagggggcatctggtttataatattttactttcgctgggsgcggtggctcatgcctgtaatcccagcactttgggaggccgaggtgggcggatcacctgcggtcgggagttggagaccagcctgaccaacatggtgaaac

SEQ ID NO: 15042 - DNA, 201 bp, Homo sapiens
taggacagctttggtaaaatgggctcacagctttagtgcctcattgccacataatgtatggcttactgggtttctctctctctttttctgtttgtgagccrtgaaaccagattgtcttcttaggaaaatacaatgccttttttaaaactgtactaactgtagcatgtgattaaaagagaaaggttaaaagtcttttttctt

SEQ ID NO: 15043 - DNA, 201 bp, Homo sapiens
gaagagaagaactcctttatgtttgtccctgatttttcccctggatccagtttttactgaaatttagaagcaaggctatccaggagacaggcaactagaartctattggctttagcacttctctctgtatttccgaataaatttaaaactgtaaccgtacataatgtctatgagaggcagtcaagtatagtaaagtgttta

SEQ ID NO: 15044 - DNA, 201 bp, Homo sapiens
gtaaagcctttagaagtggcaagaataagtattcaataaatgtgaactgttgctaataatggtagcaatgtcacaggatccttggggcgtcgctttgccarctggatcctctgtggttggtggagcgtttgcctgagttttgcttgggcccattgggctcactccactcactcagcctggcaggctgcttttggcttgcac

SEQ ID NO: 15045 - DNA, 201 bp, Homo sapiens
ttaaggatatgagttaagcatttttcttctcagcctttatatatgtctgtctttaacatttacaaagtgtttagtgtgtggaaaacattatcttaatattractcctagagcacacattaacaacccaatgatatatgaactgctgtcatcccattgcacaggtaaagaactgaagtatagagaaattaggttatttgcac

SEQ ID NO: 15046 - DNA, 201 bp, Homo sapiens
gaagacataattagtatggtggatggatgggtacatggtagatgtgtgttttaggtatcaaactaaaggggagtatctggcagggaagttgctagagtggygggggtgggggtgggcatttggcaatgggaagaacggggggaatcacattgagagaaagctgtcacgtctacatctctgctttacacaggccattcctcc

SEQ ID NO: 15047 - DNA, 201 bp, Homo sapiens
cagaagagggaatgattagttctgattgttggattaaggaagacttgattggagttggcatttgaactttcacgtctgagttatgatttgacagaaatgarcaacaaaaaaacattggaagccaatgacatgcaatttcagggagaagtgtcagctaagctttacattaataatagaacctactcaatgggtcggtttgtt

SEQ ID NO: 15048 - DNA, 201 bp, Homo sapiens
tggactgtggagaagtatgcttgtttttaatatgtttactgtttatctctcattctctgtgttttatcaaggctaagatatattcattagaatgaaagtgaaaaaaaaaaaccagatctgaatgcctaaatattaaacctatgactaattccaccatttaaaaatatattagaacattcctgagtaatgaaatcaaagaca

SEQ ID NO: 15049 - DNA, 201 bp, Homo sapiens
aagggagaaaactatctctatttgcagataacatgatcttctatacagaaaatcctaagacatccactgaaaaactattacaattactaaacaagtttacyaatattgcagaatataaaagcaatatacaagttagttgaacttgcacctgcaatgaacaatctgaaagtgaaaggaagaaaataatcccatttacaaccc

SEQ ID NO: 15050 - DNA, 201 bp, Homo sapiens
atttatgtgaagtatactaaattgaaaacttttagtattatgtatttttggagccaagtaagtcacaatatatacttttaaaaagcccttttctcaaaacttttttttttttttttgtatattcaggatattgaccaaggtagcatcatacctggtcaagtatactattttaacataatctttttctgttgtaaagttttg

SEQ ID NO: 15051 - DNA, 201 bp, Homo sapiens
agcgggcctaaggatcatcactttttgagtaatgctgcttaggagcttagagagtggagttatgaaatggtgggtgtcagtcagggagaagcagcattgtyccttttgaaaactgggaaaccgttcttcaaatattctcagagtctgagaataaattcagagtcaggaaaattctccttggattctctcttaaaggatact

SEQ ID NO: 15052 - DNA, 201 bp, Homo sapiens
tgtggtggcacgtgcctgtggtcccagctattcaggaggctaaggcaccagaatagcttgaacttcggagggcggaggtttcagtgggccgagattgtacygctgtactccagcttgggcaacaaagtgagactctgtctcggaaaaaaaaaaaaaagaaatataaagattaatatctcaatttacattccaaggttttgt

SEQ ID NO: 15053 - DNA, 201 bp, Homo sapiens
tttcctaagccctatctctgatcaatctgttttcaagcttacaaataagaaattattgctaattttttggggtgtgatatcatgattatgttttttttttwaaaaaaaatctttataagagatacatactgacatatttcaaggtgaaataatatgattgtctggaattttctttaagattaaaacagagttcattcttaa

SEQ ID NO: 15054 - DNA, 201 bp, Homo sapiens
tgtagacatttttctgagacctgctttggttgtatctcataagtattgatatatcatgttctccttgttcttcatttcttaatagtgcttttgttctgatkaatattttagagtatttatgaagtattttttatttttaggtgtttattgttgggatgagtttaaggacagtttttgttgcattgtgagcagaatctctaa

SEQ ID NO: 15055 - DNA, 201 bp, Homo sapiens
agtttcgctttctgtggtttagttacccgcagtcaactgtggcccaaaaatattaaatgaaaaattccagaaataaacaatttataacttttaaatagcayatcattctaagtagcatgatgaaatctggcacaatcccactgcgttctgcctgggacatgaatcattcctttgcccagcaaatccacactgtgtacacta

SEQ ID NO: 15056 - DNA, 201 bp, Homo sapiens
caataattaagcctggctgatagtttatcctaggctccctgaaaacttcaagacatcttgaggatgttatggtgttatagatgttatgttcatggagaaggagaagtaggggaaattctttcatactgaaagcttaatagtatccaatttcaattatacatctccattcaaaataactgaaaactgaaactaagtatctta

SEQ ID NO: 15057 - DNA, 201 bp, Homo sapiens
aaaaaacacacagaatactgttggtgtgctatatctcaaacaaatgttttgaaaacaaaacagcaaaagaatatttagtaaagacatctaatgagtatccrtgcactcttttataagtaagttataacttgtaagatacttgttattttaagctaagaaacaaaaaattaagagctgcctgatttgggacataaattacta

SEQ ID NO: 15058 - DNA, 201 bp, Homo sapiens
ttggtgtgctatatctcaaacaaatgttttgaaaacaaaacagcaaaagaatatttagtaaagacatctaatgagtatccatgcactcttttataagtaarttataacttgtaagatacttgttattttaagctaagaaacaaaaaattaagagctgcctgatttgggacataaattactacactgaacatgtgtgctggt

SEQ ID NO: 15059 - DNA, 201 bp, Homo sapiens
acattgtgccctggaaattgcgtaccaattttctcagttcttcaaacatgccatattctttctcatcttgggccttcatgtgtttctctccctaaaatacycttccattccccccaaaccgatttgtattcattttttaggcctcagttaatatgttacttccccatgaaaatagtcatcaagtttgaatgctcccattaa

SEQ ID NO: 15060 - DNA, 201 bp, Homo sapiens
ctcattttcaccctttacaccctgtccccccatcactactatcaccatgacacacattgtgccctggaaattgcgtaccaattttctcagttcttcaaacrtgccatattctttctcatcttgggccttcatgtgtttctctccctaaaatacccttccattccccccaaaccgatttgtattcattttttaggcctcagt

SEQ ID NO: 15061 - DNA, 201 bp, Homo sapiens
ttacagactactaaaacttcttttatcataattgcatgatctggtttcagtttacctctccagcctcattttcaccctttacaccctgtccccccatcacyactatcaccatgacacacattgtgccctggaaattgcgtaccaattttctcagttcttcaaacatgccatattctttctcatcttgggccttcatgtgtt

SEQ ID NO: 15062 - DNA, 201 bp, Homo sapiens
ttagaagttcatatctaacagagttcatggaatatattactcattacatccctataattggatcatcttgttttcataatattatgacaaagaagcaactytaacagcagggctacagggtatactcacattacattcactgtttcttaaaaggtttatagtctgttaaagtaaggcagaattgtggcattttaagtttgt

SEQ ID NO: 15063 - DNA, 201 bp, Homo sapiens
catctagttgattcttctctcttgtcttctttattagtcttgccagcagtctatcaattttgttgatcttttcaaaaaaccagctcctggattcattgatwttttgaagggttttttgtgtctctatctccttcagttctgctctgatctcagttatttcttgccttctgctagcttttgaatgtgtttgctcttgcttct

SEQ ID NO: 15064 - DNA, 201 bp, Homo sapiens
ctcaatcatagctcattgcagcctctaactattgagtgcaagcaatcctcccaccttatcttcccaattagctaggactacaggtgcatgccatcataccwggctaattttttagttttgtgtagagacggaggtcacactgtgttgcctaggctggaccttttgtaatttctctctctttttttttttttttgagacaga

SEQ ID NO: 15065 - DNA, 201 bp, Homo sapiens
ttttaaaggagctgggtgtaatatttcctctaatgctagttaattgcacagggtggaatttttttcttttggaagtcatttagtcagtcttcagaaacaarccttatagcattattatctactgcaaatttttactgatttctagaacaggcttttgaaacattcatcttttattttagcttctaaatgattatattctaa

SEQ ID NO: 15066 - DNA, 201 bp, Homo sapiens
cattccttgtcataaattcttgaatatcaagaaaatgccagctttagtaatatattgtgtgctacattattgataaagaaggtggtgtatttctattttayctaagcttatctgtaaaaacaatgtttacaggagaaaatgcaaaagctagcaagaactagtgatgtgataattttaaacatgtaaacatagtcatttaaa

SEQ ID NO: 15067 - DNA, 201 bp, Homo sapiens
aaggagctgggtgtaatatttcctctaatgctagttaattgcacagggtggaatttttttcttttggaagtcatttagtcagtcttcagaaacaaaccttrtagcattattatctactgcaaatttttactgatttctagaacaggcttttgaaacattcatcttttattttagcttctaaatgattatattctaagacca

SEQ ID NO: 15068 - DNA, 201 bp, Homo sapiens
ttttttttttttttgagacagagtcttgctctgttgcccaggctagagtgcagtgccgcgatctcagctcactgcaagcgccgcctcccggtttgacgccwttctcctgcctcagcctcccgagtagctgggactacaggcgcccgccaccacgcctggctaatttttttgtatttttagtagagacggggtttcaccatg

SEQ ID NO: 15069 - DNA, 201 bp, Homo sapiens
caattagcttttctaacaaagaataaatacttggaatgcagatattgaaaccatttagattaaaacaagcacaggtattgtttgctgtgaaaattcagtarttttatttcatacttggtaacatgttagccatttgcgctgtcgatcactgttaattatgaggtcgggtttagctgaaggcattatgactccatggcaaca

SEQ ID NO: 15070 - DNA, 201 bp, Homo sapiens
atttagtcagtcttcagaaacaaaccttatagcattattatctactgcaaatttttactgatttctagaacaggcttttgaaacattcatcttttattttrgcttctaaatgattatattctaagaccataatcacttcaatttatactttaggtgacccaatgaaagaagaaaatgaaagccataaagaaaagtcttaca

SEQ ID NO: 15071 - DNA, 201 bp, Homo sapiens
gagtcttgctctgttgcccaggctagagtgcagtgccgcgatctcagctcactgcaagcgccgcctcccggtttgacgcctttctcctgcctcagcctccsgagtagctgggactacaggcgcccgccaccacgcctggctaatttttttgtatttttagtagagacggggtttcaccatgttagccaggatggtctcgat

SEQ ID NO: 15072 - DNA, 201 bp, Homo sapiens
acagcttttaaagtaattttccttctaatatgtcatgtttctggtacgtatttccatggtgaatacttttaaagagtgccatctagtgtcagttttggaawtgtaatttatgtattagaacattaggaatttttgacccgggaaatgtataaacataaaaagacaggacaattgataaaaaccttaaggaatatgacttga

SEQ ID NO: 15073 - DNA, 201 bp, Homo sapiens
cgcgatctcagctcactgcaagcgccgcctcccggtttgacgcctttctcctgcctcagcctcccgagtagctgggactacaggcgcccgccaccacgccyggctaatttttttgtatttttagtagagacggggtttcaccatgttagccaggatggtctcgatctcctgacctcatgatctgccccccttggcctccca

SEQ ID NO: 15074 - DNA, 201 bp, Homo sapiens
agagaataaggaactggattttggacaggttaactttaagatagctatcagtatccatgttatggggaaatttaaatatttttatattatgattcagcackcagcagctatcacttacttgaggagaatccacttctcctgaaagaacgaatatcccctccctattattttgtagggtcgtaaaaaagaagcagtatggaa

SEQ ID NO: 15075 - DNA, 201 bp, Homo sapiens
agtttggtgtattatgagaattaccaaaatgtgacacagaaacataaagtgaacacatgctgttgggaaaacagcactgatagacttaacacagcgttgcaaaaaaaaaaaaaaaatcttcattttgtaaaaaacacagtatttctaaagcacaataagaaagaggtatatctgcttgttcttacttataagtgggagcta

SEQ ID NO: 15076 - DNA, 201 bp, Homo sapiens
tttatagtataaaagatttgttattttgggtagtaacaaagagcttgaaaaagtaacttttttctcttttgtcttgaaaaaaattgttattgacaaaagtrgatgttttaaattcattctggaataaggaaaggtgatgggattcctaaagttttaaagcaaggagataggttttaagcaaagggaacaaattatataaag

SEQ ID NO: 15077 - DNA, 201 bp, Homo sapiens
aactagtgtttgagcctgaggactccttttgttaagtccagagtcaccctctgtttttgccttgtgaatttttgtcctctgagtataaaagagggttatgktcttttgccttaagacctagaacaaagctggcctaagccacttaatccatgcattatttcactgtggccctctctgttctccagtagttcttaggtaggt

SEQ ID NO: 15078 - DNA, 201 bp, Homo sapiens; identical to SEQ ID NO: 3002

SEQ ID NO: 15079 - DNA, 201 bp, Homo sapiens
cccattaacattgtttgtctttcatttaacgcttatcacactgtattattattatttttgatgttttgtttttggtttttttgtttgcttggttggttgattggttggttggttggttggttggttggttggtttgtttgtttgtttgagacagattctccctgcgatgcccaggctggagtacagtggtgcgatctcagc

SEQ ID NO: 15080 - DNA, 201 bp, Homo sapiens
ttcactttctgggaaaaatttttctaacttaaatgtttttcatttctctaagttatatttagctttgaaattcaaaacctgcccatatttgactcagaacrctaccaatttttgagtattttctcttctattaagagtgaaattctcaatacgcattttgttgctttgtcaaaatgttatttaaagtgtttatttaaactt

SEQ ID NO: 15081 - DNA, 201 bp, Homo sapiens
cataattagtatggtggatggatgggtacatggtagatgtgtgttttaggtatcaaactaaaggggagtatctggcagggaagttgctagagtggtggggktgggggtgggcatttggcaatgggaagaacggggggaatcacattgagagaaagctgtcacgtctacatctctgctttacacaggccattcctccccagg

SEQ ID NO: 15082 - DNA, 201 bp, Homo sapiens
atggagtaactatgtgaccaaagcaagctacttcattatttttgtttacatttttcatctgataatgcaataacagtacccaacctcattgagctgttacraaaaaggattgatataataaataaaatatgcttagcacatcgtaatcattcagtagtgctaataccagcaaataagaatatccattcagtggacttcata

SEQ ID NO: 15083 - DNA, 201 bp, Homo sapiens
ccattaacattgtttgtctttcatttaacgcttatcacactgtattattattatttttgatgttttgtttttggtttttttgtttgcttggttggttgattggttggttggttggttggttggttggttggtttgtttgtttgtttgagacagattctccctgcgatgcccaggctggagtacagtggtgcgatctcagct

SEQ ID NO: 15084 - DNA, 201 bp, Homo sapiens
taagggaaaaaaaagaatgtcggccataaggctgttaatgaagaagggatgattttgcctaaatggaattctggacatctctttttatatcatttctaacmcagtttattctttgtgggatgggctcttttaaggaaaatgtacaaaataaacattttaaatgtgagtctctcattgctaattcttacctactgatttcac

SEQ ID NO: 15085 - DNA, 201 bp, Homo sapiens
tatggatggacagaaaaaagaaggtgatgtgcagaaaatggaagtgaggaacagaaacagctagattggttacagctgggtgtttgctttatttgaatagsgtttgaacagttgaccgcctgtgattggctgaaactcggatgcaatgattggctgagacttggctacttgttataagagtaagttacagtctatttatac

SEQ ID NO: 15086 - DNA, 201 bp, Homo sapiens
cattaacattgtttgtctttcatttaacgcttatcacactgtattattattatttttgatgttttgtttttggtttttttgtttgcttggttggttgattggttggttggttggttggttggttggttggtttgtttgtttgtttgagacagattctccctgcgatgcccaggctggagtacagtggtgcgatctcagctc

SEQ ID NO: 15087 - DNA, 201 bp, Homo sapiens
tttatcagtttccactgtcattcaatgtttagccattattataattgtttaggaaaaatataatgaagttctgcatagtcagtaatctttttccagggggwtgaagaagcttatatattgaatttaaagcaattgaaagtataaaagtaaatcatggctttgaatatattcagccccaaatcatttttcccaagctacttt

SEQ ID NO: 15088 - DNA, 201 bp, Homo sapiens
attaacattgtttgtctttcatttaacgcttatcacactgtattattattatttttgatgttttgtttttggtttttttgtttgcttggttggttgattggttggttggttggttggttggttggttggtttgtttgtttgtttgagacagattctccctgcgatgcccaggctggagtacagtggtgcgatctcagctca

SEQ ID NO: 15089 - DNA, 201 bp, Homo sapiens
gaagaagcttatatattgaatttaaagcaattgaaagtataaaagtaaatcatggctttgaatatattcagccccaaatcatttttcccaagctacttttraagtttgtgtttgccaaaggaaaacaaattaactgcttttcttgccagtcaggtttccttttttgtcttccaaagattgtaaatgaaatacaataccact

SEQ ID NO: 15090 - DNA, 201 bp, Homo sapiens
atttgagatttgcttataaatacatctgaaaaggttaacattctttaaattattagcagaggcaaatatatgaagtgccatgtttttgtcaccatcatctytccacattgatcaagaagtaaattgaaagaaactaaacaagacttaggggtacaaagcatgctccatagtacttgcagattttgtcactatatagattcc

SEQ ID NO: 15091 - DNA, 201 bp, Homo sapiens
tatatgaagtgccatgtttttgtcaccatcatctttccacattgatcaagaagtaaattgaaagaaactaaacaagacttaggggtacaaagcatgctccrtagtacttgcagattttgtcactatatagattcccttaaacaaactgaaactgtcctgctagtgaaagggtgtctcatgataccatttgactgtgtttca

SEQ ID NO: 15092 - DNA, 201 bp, Homo sapiens
tttgtattcattttttaggcctcagttaatatgttacttccccatgaaaatagtcatcaagtttgaatgctcccattaacattgtttgtctttcatttaaygcttatcacactgtattattattatttttgatgttttgtttttggtttttttgtttgcttggttggttgattggttggttggttggttggttggttggtt

SEQ ID NO: 15093 - DNA, 201 bp, Homo sapiens
ggtcttagggagagactaaagaagataatacattagtgaaacaaggatataatagaaaaagagggaacgatcagagaacaagaaaggacgtcttgaaaaayaaaaatgttagccaaaattgaaaacaaattaaaaattaagagataaagtatttttttaaagaagtataggataccacttgaaaaaaatagaacttaaaaa

SEQ ID NO: 15094 - DNA, 201 bp, Homo sapiens; identical to SEQ ID NO: 3009

SEQ ID NO: 15095 - DNA, 201 bp, Homo sapiens
acatggtactaatgggggcaaggtcatgagttcaaccccaatctctatcagcaagtttaaccccatttaaaaaataagtcgatctcacagccatagactgwtcaccaatttttagtcaaatggctcatcaatttattctactgggctcatgagggactgagggatagaaactttataaaccctccttcaatactggaaaaa

SEQ ID NO: 15096 - DNA, 201 bp, Homo sapiens
caattttagttctatgggtccaaacatggtactaatgggggcaaggtcatgagttcaaccccaatctctatcagcaagtttaaccccatttaaaaaataastcgatctcacagccatagactgatcaccaatttttagtcaaatggctcatcaatttattctactgggctcatgagggactgagggatagaaactttataa

SEQ ID NO: 15097 - DNA, 201 bp, Homo sapiens; identical to SEQ ID NO: 3010

SEQ ID NO: 15098 - DNA, 201 bp, Homo sapiens; identical to SEQ ID NO: 3011

SEQ ID NO: 15099 - DNA, 201 bp, Homo sapiens
agagaaaaggtaagggaactaccagcaaaatgagacagttgtaggaattgcaggaatcatgggaaattttagagattgttaggaaactgctgctaatgacrtcactgaagcagatgtttcacaagagaatgctcagaaatcacttaaatcttttctgatcaagcccacacacctaaacaagacgtcaggaagagcagtgat

SEQ ID NO: 15100 - DNA, 201 bp, Homo sapiens; identical to SEQ ID NO: 3012

SEQ ID NO: 15101 - DNA, 201 bp, Homo sapiens
gtcccaccaacagtgtaaaagtgttcctatttctccacatcctctccagcacctgttgtttcctgactttttaatgatcgccattctaactggtatgagayggtatctcattgtggctttgatttgcatgtctctgatggccagtgatgatgagcattttttcatgtgtcttttggctgcagaaatgtcttcttttgagaa

SEQ ID NO: 15102 - DNA, 201 bp, Homo sapiens
tttacagtcccaccaacagtgtaaaagtgttcctatttctccacatcctctccagcacctgttgtttcctgactttttaatgatcgccattctaactggtrtgagatggtatctcattgtggctttgatttgcatgtctctgatggccagtgatgatgagcattttttcatgtgtcttttggctgcagaaatgtcttcttt

SEQ ID NO: 15103 - DNA, 201 bp, Homo sapiens
caatggtggaactagtttacagtcccaccaacagtgtaaaagtgttcctatttctccacatcctctccagcacctgttgtttcctgactttttaatgatcrccattctaactggtatgagatggtatctcattgtggctttgatttgcatgtctctgatggccagtgatgatgagcattttttcatgtgtcttttggctgc

SEQ ID NO: 15104 - DNA, 201 bp, Homo sapiens
acttcatgggaggagcaacgagcatctcatgaaactctgttctgtacgaagcccttgcatcaagtgtttgcctcatttacaagaaaaggagaaaagttggwtatgagtctggtctcctaatagattgttttcactgcactgggagcacatcagaggtaagtaaccagtactgaagacagtaccaggtgggtagtactgtct

SEQ ID NO: 15105 - DNA, 201 bp, Homo sapiens
ccctgaggaatcgccacactgacttccacaatggtggaactagtttacagtcccaccaacagtgtaaaagtgttcctatttctccacatcctctccagcayctgttgtttcctgactttttaatgatcgccattctaactggtatgagatggtatctcattgtggctttgatttgcatgtctctgatggccagtgatgatg

SEQ ID NO: 15106 - DNA, 201 bp, Homo sapiens
ctagttctagatccctgaggaatcgccacactgacttccacaatggtggaactagtttacagtcccaccaacagtgtaaaagtgttcctatttctccacakcctctccagcacctgttgtttcctgactttttaatgatcgccattctaactggtatgagatggtatctcattgtggctttgatttgcatgtctctgatgg

SEQ ID NO: 15107 - DNA, 201 bp, Homo sapiens
tagcagcatgttttataatcctttggatatatacccagtaatgggatggctgggtcaaatggtatttctagttctagatccctgaggaatcgccacactgwcttccacaatggtggaactagtttacagtcccaccaacagtgtaaaagtgttcctatttctccacatcctctccagcacctgttgtttcctgacttttta

SEQ ID NO: 15108 - DNA, 201 bp, Homo sapiens
tctcattttttattctgatattggtcatttgtgcttgctttcactccatttctgtctcctcgatcagtcttggtgtgttttatcacttttgtgcctttttkcaaagaaccaacttttggctttgctgattttctctcgttcatttgttttgtattttcattgatttctgctcattattattttcttccattactctctgaa

SEQ ID NO: 15109 - DNA, 201 bp, Homo sapiens
ttttatttatagtttgtgaagagttttaatcatgatattatgatattaaattttctcaaatatttttactgcatatattaagggaatcatatgttttctcycttattttattaatttgtggtatatattgattgctgtttaaatgataaattgccctcacattctcatagtaaacctaatttggtttgatgtatcatcttt

SEQ ID NO: 15110 - DNA, 201 bp, Homo sapiens
ttcttttatattgcctttgtccttcctccattgccacagctcaaatattagtcatatatggagtaaatatcaggtgatttggatatcaggattatgacagyagtctgccagttggtgcatcttctagtatttctgcttttccaataaatcctgcacagccaagaaaatgcttcatgaaacaccgcaccattgctctgctca

SEQ ID NO: 15111 - DNA, 201 bp, Homo sapiens
aatagcttgattctgttgagaaacactgatctaaataaatggaaaaataacccacattcactaatgaagataataaggaagacccaatatttttttttttwaaaaaggaaagtatttttagcttttatgaaagctttaagtaatttttcctcattttcctgtttgaaacttttgaaaaggaagttcttcagtgtttggtta

SEQ ID NO: 15112 - DNA, 201 bp, Homo sapiens
ctaggaaacttgtaataggccagaaatggtagtagcttgaactacaatggtggcattgcagatggggaaaatggaaatattttagagatactaggaatgtwtattcaataggatctggtaatggattgggactgggtcagggagaaggtgtaaggaagaaagtactggtttacacagctatagatggataatggttccagt

SEQ ID NO: 15113 - DNA, 201 bp, Homo sapiens
atagcttgattctgttgagaaacactgatctaaataaatggaaaaataacccacattcactaatgaagataataaggaagacccaatatttttttttttawaaaaggaaagtatttttagcttttatgaaagctttaagtaatttttcctcattttcctgtttgaaacttttgaaaaggaagttcttcagtgtttggttag

SEQ ID NO: 15114 - DNA, 201 bp, Homo sapiens
cctatggctggcgcccataattttaagtgcctctgactttaagagctgcctagtggaagtttttttttttttttcttttgagacagagtcttgctctgtcrcctgggctagagtacagtggcacgattatcagctcactgcagtctctggctcccgagttcaagcaattctcctgcctcagcctcccgagtagctgggatt

SEQ ID NO: 15115 - DNA, 201 bp, Homo sapiens
tcagtgtgtctcatattttgtttcctaaaagtttagtagagctgtgaatgtactaggaagtcccctctgaaaaagcacagttagttagaaatctgcccatwaactcagggggactcaggcgccccccgggtcttccctctcctgcaggctctccggttagtgtcctgatttgccgtaaccatgggcctctgacctgctggc

SEQ ID NO: 15116 - DNA, 201 bp, Homo sapiens
tagttagaaatctgcccataaactcagggggactcaggcgccccccgggtcttccctctcctgcaggctctccggttagtgtcctgatttgccgtaaccaygggcctctgacctgctggcacctctggttccttggcgtgtgggtcactcacagatatgaaaacctgtgtctggctgaccaggttctcctgtagccctccc

SEQ ID NO: 15117 - DNA, 201 bp, Homo sapiens; identical to SEQ ID NO: 3014

SEQ ID NO: 15118 - DNA, 201 bp, Homo sapiens
cttgcttgtttctttttggtattttatccagcttgcatagttgttctcagagggcgggtcagcctggtaccttctgctgggccatagctagcagcgtaagmcttggagccctggcacttgaaaccccacactgtccaagcacaacttacccagccttgcctcttcacagccacctgttgtgtccaccctgtgcttagccta

SEQ ID NO: 15119 - DNA, 201 bp, Homo sapiens
agcgtaagccttggagccctggcacttgaaaccccacactgtccaagcacaacttacccagccttgcctcttcacagccacctgttgtgtccaccctgtgsttagcctagactttccacacaaccttttcttgctgctctctcagtcctgtccattcccatcaaaaatcgaattgttcttcagacctgtacaatctccact

SEQ ID NO: 15120 - DNA, 201 bp, Homo sapiens
accctgtgcttagcctagactttccacacaaccttttcttgctgctctctcagtcctgtccattcccatcaaaaatcgaattgttcttcagacctgtacartctccacttctgattcctggcattgtgacccatgagattcttcctctgcagtgaattcatagcaataactgaccggccactgtagcatttcttgatgtat

SEQ ID NO: 15121 - DNA, 201 bp, Homo sapiens
ttattctctgcctctgtttcttcatctggaaaatggaggtgaaaatagcactgtagttgtggttgtggaaaaagtatttcttttgtggtggaaaagtattmaactcagacttttcaagtgaagcatttagcacatgtctaatatataggaaatattcaatgaaaggcttaattctttacatactttgtgtcttaaaatgta

SEQ ID NO: 15122 - DNA, 201 bp, Homo sapiens; identical to SEQ ID NO: 3013

SEQ ID NO: 15123 - DNA, 201 bp, Homo sapiens
acgtgctatttgtaggcctatcttcacctacaagattgactggcccctttgtacagcagctcagttggtggctggcttattccactcatcttaacagttcktcatgtgccagaccttgtactagaactgtctttactgctggcttgttttctgccactagtgaaatagtttgaactttccaagtctccgtttcaccgtaaa

SEQ ID NO: 15124 - DNA, 201 bp, Homo sapiens
ctggttttataaattgacagatatctaacaattcagctggccacaaagttctggtaaaaaaaaaaaagagtcacctgttcttccctgagatgcttcctgtkgccacagtgagaaatcctcagcttcttgtaaaattctccttttactctccttaggtgttttagctcacttggaaaggctagagacccaagtgagcagatc

SEQ ID NO: 15125 - DNA, 201 bp, Homo sapiens
agccgtggcctcgggagcgcgccggggccgcgggatgggcgcgggggtgggcatggactctgctggctcggacgatgggagagggcgggcggctcaggaarggggatcctagccgtgacatttgtgtcatccgcggcccaggggttgtgcctgagtggtgtgtgccctgccgtctgggtttgaatgggactagatgtgatg

SEQ ID NO: 15126 - DNA, 201 bp, Homo sapiens
gtaaatactgccagtttttgaaagtgattgtactagttttacattcccagcaatagttgtataagatttcccttgttttgcatttttaccaatacttaaartggcctgccttgagttgttgatacttgtgtcatttttgacatctgtcatccagactcaacctcctagggagcttgacccttcccttttttcagttttctc

SEQ ID NO: 15127 - DNA, 201 bp, Homo sapiens
taagcccaggaagttgaggttgcagtgagctgagatcgtgccaccgcactccagcctgggtgacagagtgaaaccctatctcaaaaaaaaaaaaaaaaaaatttctcaatagtttgacatttaggttgttttttcatttttaccattcttccatggttttaacaactcagtctcaaagtgagccggagccaaggggaagaa

SEQ ID NO: 15128 - DNA, 201 bp, Homo sapiens
tcaatgatgagtattgtgtatgaaaaaatatacggaggtcaggtgctgtggctcacgcctgtaatcccagcactttgggaggccaaggcgggtggatcatstaacgtcaggagttcaagaccagcctggccaacatggtgaaaccctgtctctactaaaaatacaaaaattagcgaggcgtggtggcgcacacctgtaatc

SEQ ID NO: 15129 - DNA, 201 bp, Homo sapiens
caacctccgcctcctgattcaagcgattctcctgcctcagcctcctgagtagctgggattacagatgcccgccaccacacccagctaattttttgtttttygttttttgtttttttttttgagacggagtctcgctctgtcgcccaggctggagtgcagtggtgcggtctcggctcactgcaagttccacctcctgggttc

SEQ ID NO: 15130 - DNA, 201 bp, Homo sapiens
gcagagcagcgaatgttggtgaacagcaaatgctgctgcctgatcgttcctctggaagttttgtctcagaggagtacccagctgtgtgaggtgtcagtctrcctctactgggggatgcctcccagttaggctactcgggggtcagggacccacttgaggaggcagtctgtctgttctcagacctccagctgcgtgctggga

SEQ ID NO: 15131 - DNA, 201 bp, Homo sapiens
atgtgtctttatagcagcatgttttataatcctttggatatatacccagtaatgggatggctgggtcaaatggtatttctagttctagatccctgaggaaycgccacactgacttccacaatggtggaactagtttacagtcccaccaacagtgtaaaagtgttcctatttctccacatcctctccagcacctgttgtttc

SEQ ID NO: 15132 - DNA, 201 bp, Homo sapiens
tgtggatttgcgataaactgcagacctagataagacactgctgcctaatcagcgtgtgatagttcatatcctctctcgggctgtctttgaggaggatcctsttttacatcactctccaacctaggaggttgatgatctttgatttcaattgttagctcccctggttttataaattgacagatatctaacaattcagctggc

SEQ ID NO: 15133 - DNA, 201 bp, Homo sapiens
cttattatttgaattctccccactcatttgagaaggaaggacatggagttgtagttgcaaccagatgatttattcaaataggcagggattttgactttttytgggacaaagctgactggctaggatgagatgcaatcataacttccaaggtaaagcaggcccagcagatacactccctcttttctgtagtagcaacgctaa

SEQ ID NO: 15134 - DNA, 201 bp, Homo sapiens
aatattgttatgtgtgaatttgatcctgtcattatgatgttagctggttattttgcccattaattcatgcagtttcttcatagcattgctggtctttacartttggcatgtttttgcagtggctggtaccggttgttcctttccatgtttagtgcttccttcaggagctcttttagggcaggcctggtggtgacaaaatct

SEQ ID NO: 15135 - DNA, 201 bp, Homo sapiens
ttttgcttattatttgaattctccccactcatttgagaaggaaggacatggagttgtagttgcaaccagatgatttattcaaataggcagggattttgacyttttttgggacaaagctgactggctaggatgagatgcaatcataacttccaaggtaaagcaggcccagcagatacactccctcttttctgtagtagcaac

SEQ ID NO: 15136 - DNA, 201 bp, Homo sapiens
tggtagatcttcctccatccctttattttgagcctaagtgtgtctctgcacgtgagatgggtctcctgaatacagcacactgatgggtcttgactatccartttgccagtctgtgtcttttaattggagcatttagtctatttacatttaaggttaatattgttatgtgtgaatttgatcctgtcattatgatgttagctg

SEQ ID NO: 15137 - DNA, 201 bp, Homo sapiens
cccattattactgtgtgggagtctaagtctctttgtaggtctctaaggacttgctttatgagtctgggtgctcctgtattgggtgcatatatatttaggayagttagctcttcgtgttgaattgatccctttaccattatgtaatggtcttctttgtctcttttgatctttgttggttgaaagtctgttttatcagagact

SEQ ID NO: 15138 - DNA, 201 bp, Homo sapiens
atggtatctcattgtggctttgatttgcatgtctctgatggccagtgatgatgagcattttttcatgtgtcttttggctgcagaaatgtcttcttttgagwagtgtctgttcatgtcctttgcccactttttgatggggttgtttgtttttttcttgtacatttgtttgagttcattgtagattctggatattagcccttt

SEQ ID NO: 15139 - DNA, 201 bp, Homo sapiens
  misc_feature (1)...(201): n = A,T,C or G, or insertion/deletion polymorphism (see Tables 1-2)
gtgcagaaattctcatatcccagtttatttgagtgaaacagggaaaataggtagaatccatgaagtagacctcttgagacactttctctgtttatatactntacattactcagaccggtaagatagaacattcttgtttctaccagtcttttccttcctctttgtaaatggtaaacatgattgtccccattttcccttctc

SEQ ID NO: 15140 - DNA, 201 bp, Homo sapiens
cagaccaaaaaaaaaaaaaaaaaactgtatgggtccagtgggtccagaatatcagtgatccaggttccgattcccccagctgcactgagtgagattgaatrtcagtgatccaggctccgattcccccagctgcactgaatgagattgaatatcagtgatccaggctccgattcccccagctgcactgaatgagattgatgg

SEQ ID NO: 15141 - DNA, 201 bp, Homo sapiens; identical to SEQ ID NO: 3016

SEQ ID NO: 15142 - DNA, 201 bp, Homo sapiens; identical to SEQ ID NO: 3015

SEQ ID NO: 15143 - DNA, 201 bp, Homo sapiens
gtctgggtctgcctctagtgagttagtttgctagatgtgttatcagtcctggaattatttcataatttatagtattttacaccctctgccctcatcactcwcacacacacacacacagacacacacacagctgacgtgctatttgtaggcctatcttcacctacaagattgactggcccctttgtacagcagctcagttgg

SEQ ID NO: 15144 - DNA, 201 bp, Homo sapiens
gagaaatcctcagcttcttgtaaaattctccttttactctccttaggtgttttagctcacttggaaaggctagagacccaagtgagcagatcccgtaaacrgtctgaagagctgcagagcgtgcaggcccaggaaggtgctcttggaaccaagattcataaactaaggcgtctgcgagatgagctgagggctgtggtgcgg

SEQ ID NO: 15145 - DNA, 201 bp, Homo sapiens
tatcccaccctcttttcttttgaaactctggatggcgttgaagcctgggtactggttaaaggattatgcacccctgaatggtggtcttcaagcttttatcstaagattgtacagagtgcagttgctatacttttgatccatcagggatttatggcgtgcctactatgtaccataccgagtgccttgctgaaccttgggtat

SEQ ID NO: 15146 - DNA, 201 bp, Homo sapiens
tgttgtagtgtacctctttgtaccaagattgatttgctgcatatcttgcaggtgaaagcatgtattgccaatgtagaacccaaccaaacagtggagatcartgagcaagaagcattggaagagaaattggaaaatgtgaaagccattctgcaggcatatcattttacaggttttgtttgtttttttaacctaatttagtct

SEQ ID NO: 15147 - DNA, 201 bp, Homo sapiens
cattcttccatggttttaacaactcagtctcaaagtgagccggagccaaggggaagaatgagcctatgatactcattgaacaaacatttgtgtacaaagtrtacatattctaggcactgtggaagctactggaggcacagatgagtaagacatcaccttggcctgctgtctattgaggtgtcttcttgtttgcctcaggcc

SEQ ID NO: 15148 - DNA, 201 bp, Homo sapiens
aatgaaaaattgggtgaaatgtttttaggaggcagaaattttgaagctgccccagatttcacaccatcggtctttgatttctctgcgcagttagattccaktccccagtctctagattgcattggtccagtaaggggcagccttagtccagaccaaaaaaaaaaaaaaaaaactgtatgggtccagtgggtccagaatatc

SEQ ID NO: 15149 - DNA, 201 bp, Homo sapiens
gtgagttagtttgctagatgtgttatcagtcctggaattatttcataatttatagtattttacaccctctgccctcatcactcacacacacacacacacasacacacacacagctgacgtgctatttgtaggcctatcttcacctacaagattgactggcccctttgtacagcagctcagttggtggctggcttattccac

SEQ ID NO: 15150 - DNA, 201 bp, Homo sapiens
  misc_feature (1)...(201): n = A,T,C or G, or insertion/deletion polymorphism (see Tables 1-2)
ctgcagtgaattcatagcaataactgaccggccactgtagcatttcttgatgtattatatcatgtgccttgtatttagctttcatccagttgggggagggnggggatgttgtagtgtacctctttgtaccaagattgatttgctgcatatcttgcaggtgaaagcatgtattgccaatgtagaacccaaccaaacagtgga

SEQ ID NO: 15151 - DNA, 201 bp, Homo sapiens
tcttattgcccttgtttcttgtttaataaatctttgtctaacttaagatcatgctgatcttttccaggtattttattttttttattttttttgtttttgaracagagtctcactttgttgcccaggcaggagtgcagtggcacgatccggcaccctccacctcctgggttcaagagattcttctgcctcagcctcccgagt

SEQ ID NO: 15152 - DNA, 201 bp, Homo sapiens
gtatgagatggtatctcattgtggctttgatttgcatgtctctgatggccagtgatgatgagcattttttcatgtgtcttttggctgcagaaatgtcttcytttgagaagtgtctgttcatgtcctttgcccactttttgatggggttgtttgtttttttcttgtacatttgtttgagttcattgtagattctggatatta

SEQ ID NO: 15153 - DNA, 201 bp, Homo sapiens
cattctaactggtatgagatggtatctcattgtggctttgatttgcatgtctctgatggccagtgatgatgagcattttttcatgtgtcttttggctgcakaaatgtcttcttttgagaagtgtctgttcatgtcctttgcccactttttgatggggttgtttgtttttttcttgtacatttgtttgagttcattgtagat

SEQ ID NO: 15154 - DNA, 201 bp, Homo sapiens
taatgatcgccattctaactggtatgagatggtatctcattgtggctttgatttgcatgtctctgatggccagtgatgatgagcattttttcatgtgtctkttggctgcagaaatgtcttcttttgagaagtgtctgttcatgtcctttgcccactttttgatggggttgtttgtttttttcttgtacatttgtttgagtt

SEQ ID NO: 15155 - DNA, 201 bp, Homo sapiens
ttcctgactttttaatgatcgccattctaactggtatgagatggtatctcattgtggctttgatttgcatgtctctgatggccagtgatgatgagcatttwttcatgtgtcttttggctgcagaaatgtcttcttttgagaagtgtctgttcatgtcctttgcccactttttgatggggttgtttgtttttttcttgtaca

SEQ ID NO: 15156 - DNA, 201 bp, Homo sapiens; identical to SEQ ID NO: 3034

SEQ ID NO: 15157 - DNA, 201 bp, Homo sapiens; identical to SEQ ID NO: 3035

SEQ ID NO: 15158 - DNA, 201 bp, Homo sapiens; identical to SEQ ID NO: 3036

SEQ ID NO: 15159 - DNA, 201 bp, Homo sapiens; identical to SEQ ID NO: 3037

SEQ ID NO: 15160 - DNA, 201 bp, Homo sapiens; identical to SEQ ID NO: 3038

SEQ ID NO: 15161 - DNA, 201 bp, Homo sapiens; identical to SEQ ID NO: 3039

SEQ ID NO: 15162 - DNA, 201 bp, Homo sapiens; identical to SEQ ID NO: 3040

SEQ ID NO: 15163 - DNA, 201 bp, Homo sapiens; identical to SEQ ID NO: 3041

SEQ ID NO: 15164 - DNA, 201 bp, Homo sapiens; identical to SEQ ID NO: 3042

SEQ ID NO: 15165 - DNA, 201 bp, Homo sapiens; identical to SEQ ID NO: 3043

SEQ ID NO: 15166 - DNA, 201 bp, Homo sapiens
  misc_feature (1)...(201): n = A,T,C or G, or insertion/deletion polymorphism (see Tables 1-2)
aggagtttggtgggctggtcagtgtcatgctggcaacctgatattagacatggtagaaatatgtataccgtggaaataggcaaacattgtaatcaggactntattaattgatatttgggagctggttggttaaccatttaccagcacgacactgacggctggcgtctatcagtgattcagctttcttcaatccaggaaagt

SEQ ID NO: 15167 - DNA, 201 bp, Homo sapiens
aaacctcccattgtgtgtgcttgtatctgtcatattaaacccatgcacattcaaaccaggaagtctgacccaggccctgaactcacccctcacctgggagmatgcgtggaccggcgtccccggcggcactcctgactgtctgacagacaccttcagagtgaagaggccacatctcaggcgctctgccagcaacggtgagca

SEQ ID NO: 15168 - DNA, 201 bp, Homo sapiens; identical to SEQ ID NO: 3047

SEQ ID NO: 15169 - DNA, 201 bp, Homo sapiens
  misc_feature (1)...(201): n = A,T,C or G, or insertion/deletion polymorphism (see Tables 1-2)
tgtgtgtgcttgtatctgtcatattaaacccatgcacattcaaaccaggaagtctgacccaggccctgaactcacccctcacctgggagcatgcgtggacnggcgtccccggcggcactcctgactgtctgacagacaccttcagagtgaagaggccacatctcaggcgctctgccagcaacggtgagcatgccgatggtg

SEQ ID NO: 15170 - DNA, 201 bp, Homo sapiens
gcagaaaggaaaggacagtctctgggctggaggcgtccttcgtcagagcaggatttctggcttcgtgcatgagctccgtcactgggaggttttgggaggtmgtgggagcagtgactcacacagtgactcacaaaaacccgcctgccccagaaggtagctttcctcgtgggtgcagggatatctcgccaggtgtcatctgta

SEQ ID NO: 15171 - DNA, 201 bp, Homo sapiens
  misc_feature (1)...(201): n = A,T,C or G, or insertion/deletion polymorphism (see Tables 1-2)
gtgcatgagctccgtcactgggaggttttgggaggtcgtgggagcagtgactcacacagtgactcacaaaaacccgcctgccccagaaggtagctttcctngtgggtgcagggatatctcgccaggtgtcatctgtacctccctccctaaacatagaggcgtacttaaatttattcattgagtaaatgatattaggaacaa

SEQ ID NO: 15172 - DNA, 201 bp, Homo sapiens
ggcgaggaggagaggagagagcgagaggaggttttgaggtatgtgacccgggtcagggctggagaggacccaggcgagtccgcactcctgctaccactgcrgccccccgtggcgtctcagccttgctgccagccggcttcttagaaaggccacacctcctcacagtctttcatggttttctgtcacccagcccgggactaa

SEQ ID NO: 15173 - DNA, 201 bp, Homo sapiens
catctgtacctccctccctaaacatagaggcgtacttaaatttattcattgagtaaatgatattaggaacaaatactaataaataaataatgataaaaagwccaagtcgcaccaaagagaatcagcttgtttctgtgtttatgttcctgcctagtctctttttttttagagacggaatctcgctgtgttgcccaggctggt

SEQ ID NO: 15174 - DNA, 201 bp, Homo sapiens
  misc_feature (1)...(201): n = A,T,C or G, or insertion/deletion polymorphism (see Tables 1-2)
atctgtacctccctccctaaacatagaggcgtacttaaatttattcattgagtaaatgatattaggaacaaatactaataaataaataatgataaaaagtncaagtcgcaccaaagagaatcagcttgtttctgtgtttatgttcctgcctagtctctttttttttagagacggaatctcgctgtgttgcccaggctggtc

SEQ ID NO: 15175 - DNA, 201 bp, Homo sapiens; identical to SEQ ID NO: 3053

SEQ ID NO: 15176 - DNA, 201 bp, Homo sapiens
  misc_feature (1)...(201): n = A,T,C or G, or insertion/deletion polymorphism (see Tables 1-2)
cagcagagctcatgttccatccgtgctctgcttctccagcacgatggagaagactggatgaggactagattagcttcagagtcgccttgcgtcctgagatngggtactgtgataaggtcactggtagagtcatcagtaaccttccatgcatgccacgctttatgttatcaagacatctcacatgccctgtctcaggccctc

SEQ ID NO: 15177 - DNA, 201 bp, Homo sapiens
tggtattaatttctctttaaatgtttgatagaattcaccagcgagaccatgtggttctgggtgtttctttacttctataaggtcagtagtgaggccccctttttttttttttccccctgtattttggtaatttcgtgtctctgggttttttttcttggctaaaggtttgtcagttttgttgatcttttcaaagaaccaact

SEQ ID NO: 15178 - DNA, 201 bp, Homo sapiens
  misc_feature (1)...(201): n = A,T,C or G, or insertion/deletion polymorphism (see Tables 1-2)
ccatggcccctcccatttatgaaagcatgaactgcattgagctgtatcgtcattgtcactgccaccagcaccgtgaccatcacactggctttcagtatccntaaatgtttgcccctggagaaatcatctgcgttcatttccttccataattttagtctgtttatagagctactgtctccaccagttgatgtgtgtctgaga

SEQ ID NO: 15179 - DNA, 201 bp, Homo sapiens
tggggcttccagcccagagcaggagacaacaggaagtcccggcctgcgatggtttctggtgttgtcaggtcatagctggagccctgtggctcagggagacrtggccccaccagctctctacaggctgcctggtgtccccctgtctccgcctggaccgcccgccccaccctgccctgtgccggccttcatcacatagtgaca

SEQ ID NO: 15180 - DNA, 201 bp, Homo sapiens
tagtgcttgaaggaggcggaacagattggccattttgtgtgagtgcatgtgtgcgtgtgtgtgcgtgtgtgtgtgtgagtgcatgtgtgcatgtgtgtgaktgtgtgtgtgtgtgtgtgtgctgtgtatggttgtattctgctgactgcagtcatggatccttggactgttgtgtgattttaggtgcgtgcatgagtgtgt

SEQ ID NO: 15181 - DNA, 201 bp, Homo sapiens
gaggggcaactcctcattctatggcctgatggcagggccttctctggcttagtccggttgatcccctgcacacagcaggtgctcggttcagggcaggcagygccctgaggtctgtccttggcaatgtgtgattagaaatgggccttttgtgctcctcctgccccaccatccactgtcctaaggaagggctgagcactgtca

SEQ ID NO: 15182 - DNA, 201 bp, Homo sapiens
ccaggacaaagtcactggaataagaaggcaagaacctttataggcccaaatgccttctcattgtaatgcatatgttttggtttttgttggttttcgttttktttttttttttttttcccagctggggtcttgctctgttgcccaggctggagtgcagtggcatgattatgactcactgcagcctcgacctcctaggctcaa

SEQ ID NO: 15183 - DNA, 201 bp, Homo sapiens
tttgtttatctttctctaggtcatgtccctgggactcctgtctacagagaaaaagaagatatgtatgacgagattattgagttaaagaaggtagtatttcrgtttgttctctattgatttgaaacggtgaaagcttcctataacaatgtattagaacatcagtgcctgtgctgggaggtgcccagatgggaagagcgggag

SEQ ID NO: 15184 - DNA, 201 bp, Homo sapiens
ttttttgtgtttggtatttgtttgttttgctatttaaatctgaacatgtccctcctccttccgtgagtcccttctttcatccttttactgtcatgaaactyggtcttcacatgtttatttatttactttttgcttcatctctctctatctaccatttttggttttcttgctacttggtgtgaagtatcatgatcaggctgg

SEQ ID NO: 15185 - DNA, 201 bp, Homo sapiens
ctcagggacaggacagcacagtggggccctccctcttccctgggcccgtagtctagaagagagcacagcgctggagggaggaaggacagtgaggtgtgccrgtgctctggcaggaggggacagccgcttctactgagggagagagggcgtggcctgcctgatgggcacgttccccgggcaggtcattaacgggctgaagca

SEQ ID NO: 15186 - DNA, 201 bp, Homo sapiens
tatctgtcatattaaacccatgcacattcaaaccaggaagtctgacccaggccctgaactcacccctcacctgggagcatgcgtggaccggcgtccccggyggcactcctgactgtctgacagacaccttcagagtgaagaggccacatctcaggcgctctgccagcaacggtgagcatgccgatggtggcgaggctgagg

SEQ ID NO: 15187 - DNA, 201 bp, Homo sapiens
gtataccgtggaaataggcaaacattgtaatcaggactgtattaattgatatttgggagctggttggttaaccatttaccagcacgacactgacggctggygtctatcagtgattcagctttcttcaatccaggaaagttgattagaaacaaaacctcccattgtgtgtgcttgtatctgtcatattaaacccatgcacat

SEQ ID NO: 15188 - DNA, 201 bp, Homo sapiens
  misc_feature (1)...(201): n = A,T,C or G, or insertion/deletion polymorphism (see Tables 1-2)
atctagcaaacctgcagccagcagaacgaacccggcaccagcagatctcaattccacgtttgctctgtggactcaagggggagcctcagctccactgtctncctccagggacctctgttcgcaaagttaaggattttccctccatgtcacagagggcaggggatgctcctctgatgttccccggaggaggagggatccaaa

SEQ ID NO: 15189 - DNA, 201 bp, Homo sapiens
  misc_feature (1)...(201): n = A,T,C or G, or insertion/deletion polymorphism (see Tables 1-2)
cgctcttggaagcggcagtcccgttactagagctcccatcttccttgactgctgggccttcgctaatttacttcacaagctgagtaccggcttgctatcangcctcctgaatctgtgggtttgtctgcaacgatcttgccagctgtggatgtggctgaagtgccgagccgcccccgcggggtgtgcattccagattgtctt

SEQ ID NO: 15190 - DNA, 201 bp, Homo sapiens
aagctgagtaccggcttgctatcatgcctcctgaatctgtgggtttgtctgcaacgatcttgccagctgtggatgtggctgaagtgccgagccgcccccgyggggtgtgcattccagattgtcttttgctcagaggtccagtctctggaataccacagtcttttgcaaggagaaggccgtgtatgaggatggctggcggtt

SEQ ID NO: 15191 - DNA, 201 bp, Homo sapiens
aagggcacaccctgctctgtcccccaggtgtgcagtgtgcttgggggagggctgccagtcggtcagtgtgcccacgatggctgccacctcctgctccagcyggtgtcgcacccctgccattcacccagccttactcagggacaggacagcacagtggggccctccctcttccctgggcccgtagtctagaagagagcacag

SEQ ID NO: 15192 - DNA, 201 bp, Homo sapiens
aactttttaaaatgcacaaaaaactaggttagaaatctgagcagacatatttagcactcagaataattagtaagacatagactaccggaatgaagaaaacrgtggccgggcacagtggctcatgcctgtaatcgcagcactttgggaggccgaggcgggcagatcgtgaggtcaggagttcaagaccagcctgaccaacat

SEQ ID NO: 15193 - DNA, 201 bp, Homo sapiens
tgggttcaagtgattatcttgcctctgcctcccaagtatctgggactgtacaggcacatgccaccacacccagataatttttgtatttttagtagagatgrggttttactatgttggcaaggctgttctcgaactcctgacctcaggtgatccgcctgcctcagcctcccaaagttctaggattacaggcatgagccacca

SEQ ID NO: 15194 - DNA, 201 bp, Homo sapiens
aaaggatgtcaccccgagatgcttggaggctgttaatacagacatctatctcttcacgatccaagggggcagagactgggccagcgctggcaaaattctcwggtagccaggacctgtcggtgtggctctgcagccccgcaggctgctccggctgcggaagaggagcctcaggccatacctgagaagggtggccctgctggc

SEQ ID NO: 15195 - DNA, 201 bp, Homo sapiens
ggcacctaggacggcacaaagtaaatccttaacaaatgcctgtaagtagtgggtacttttgtaaagaaaaggctccatgtttttgttgttctggtggtgtgtgtgtgtgtgtgtgtgtgtgtgtgtgtctgtgtgtgtctgtgggtatttttttttttcttgagacagggactcactctgttgcccaggctggcgtgcagt

SEQ ID NO: 15196 - DNA, 201 bp, Homo sapiens
gcacctaggacggcacaaagtaaatccttaacaaatgcctgtaagtagtgggtacttttgtaaagaaaaggctccatgtttttgttgttctggtggtgtgtgtgtgtgtgtgtgtgtgtgtgtgtgtctgtgtgtgtctgtgggtatttttttttttcttgagacagggactcactctgttgcccaggctggcgtgcagtg

SEQ ID NO: 15197 - DNA, 201 bp, Homo sapiens
cacctaggacggcacaaagtaaatccttaacaaatgcctgtaagtagtgggtacttttgtaaagaaaaggctccatgtttttgttgttctggtggtgtgtktgtgtgtgtgtgtgtgtgtgtgtgtctgtgtgtgtctgtgggtatttttttttttcttgagacagggactcactctgttgcccaggctggcgtgcagtgg

SEQ ID NO: 15198 - DNA, 201 bp, Homo sapiens
caggcagattgcttgagtccaggagttcaacaccagtctgggcaacatagtgaaaccccatctctatttaaaagttgtctatttagaagaaaagaatgttcttttttttttttttttgagacggagtctcgctctgtcacccaggctggagtgcagtggcgcaatctcggctcactgcaagctccgcttcccgggttcatg

SEQ ID NO: 15199 - DNA, 201 bp, Homo sapiens
ccagtggcacactgtggccccggactgggctttgggtttgtttggcaagctgtgctgggtagaaaaggaagtgtgccaattgctcttctcgtgtatgagcraaaaaagcttttcttactggagacgcagatctagcaaacctgcagccagcagaacgaacccggcaccagcagatctcaattccacgtttgctctgtggac

SEQ ID NO: 15200 - DNA, 201 bp, Homo sapiens
caccagtctgggcaacatagtgaaaccccatctctatttaaaagttgtctatttagaagaaaagaatgttcttttttttttttttttgagacggagtctcrctctgtcacccaggctggagtgcagtggcgcaatctcggctcactgcaagctccgcttcccgggttcatgccattctcctgcctcagcctcccgagtagc

SEQ ID NO: 15201 - DNA, 201 bp, Homo sapiens
tgctcctggagcctgctcctgcttcagcccaacggaaagatgaagtgcggccacttagttcccgcttctggccgtaggcagcggtcaggactgtgatgttkgtcttttcagataaggtcttctccatgctagccttgtgttttcatgcatttcaatttggtatttacaggtgcatcgtctccagaccctcttggcaagttc

SEQ ID NO: 15202 - DNA, 201 bp, Homo sapiens
accagcttagcaatgcaaacctcagtccacgatttggttgttccaggcccctgggggagaagaagacgggcgccaaaaggcagaagaagatgggcagtgcyctcctgagcttgtcccggagtgtccaggagctcacggaagagaaccagagcctgaaggaggacctggaccgcgtgctgagcacctccccaaccatctcca

SEQ ID NO: 15203 - DNA, 201 bp, Homo sapiens
ggtgtcgcacccctgccattcacccagccttactcagggacaggacagcacagtggggccctccctcttccctgggcccgtagtctagaagagagcacagygctggagggaggaaggacagtgaggtgtgccggtgctctggcaggaggggacagccgcttctactgagggagagagggcgtggcctgcctgatgggcacg

SEQ ID NO: 15204 - DNA, 201 bp, Homo sapiens
catgctccgagggaccctctctactgattgtgacgctgcgtgtcagctgcagcctgagaaacttcccaagacacccaagggtgactgatgaccagtcaggktggggccagtgatccagacccctgaaccaaagtccccttcataacgtccccagcaggcagcctcagcctccgagttctggggcttatccagagagcacag

SEQ ID NO: 15205 - DNA, 201 bp, Homo sapiens; identical to SEQ ID NO: 3080

SEQ ID NO: 15206 - DNA, 201 bp, Homo sapiens
aggagggaaatgtaatgtgtagggcttttttctgctcactcatttacttgtataaatgacaacttaaatctttacgttttggaagaatttgagactatctsggaggccaggttctgtggtcccgggtaagtgaagatgcagcagggtccctgcgtctttattccctcattcacagttacggtggcgaatttcacataaatt

SEQ ID NO: 15207 - DNA, 201 bp, Homo sapiens
tgagcccaggagttcaaggatgcagcaagctgtgattgcactccagcctaggtgacagagccagaccccgtctcaaaaaaaaagaagaaaaggttctatamattgtgggcatttaaaatatagaacttgttgggaagtcaaggcacccagaggtggttcggaagcacagtgggcagcacgtccaagatccgggagaggcag

SEQ ID NO: 15208 - DNA, 201 bp, Homo sapiens
accagaggagcttgtaacagaccagccagacactgtccaaattgcacggggttcatactctgcagtcaggacagccagtatggtcgcgggtgtgggcggcycaccaggctcagtggcctgcgcgcagctgcagtgggagcatgttgccatctgatggccaggccacagccacacgagcgccctccacgagcagacagctgg

SEQ ID NO: 15209 - DNA, 201 bp, Homo sapiens
ccccaggccccgccagtgtccccacaggcacaggtgctgcagagagagtaggtcctccccaggccccgccagtgtccccacaggcacaggtgctgcagagrgagtaggtcctcccgaggccccgccagtgtccccacaggcacaggtgctgcagagagagtagatcctccccaggccccacaagcagcctcaccagggaag

SEQ ID NO: 15210 - DNA, 201 bp, Homo sapiens
aggcacaggtgctgcagagagagtaggtcctcccgaggccccgccagtgtccccacaggcacaggtgctgcagagagagtagatcctccccaggccccacmagcagcctcaccagggaagcagctctcactccctatggaaactgattgttgccggggttaaacagttgtcaatttggaaaactgttcagctcgtagtagt

SEQ ID NO: 15211 - DNA, 201 bp, Homo sapiens; identical to SEQ ID NO: 3052

SEQ ID NO: 15212 - DNA, 201 bp, Homo sapiens
ttacagagttataaagtctccatgaacatagaacgagcgaatactaaaccactgctccaatgggaggtacagggctcctgcgagcttctgctcataacatttttttttttttttttggcaaatgttgcccaggctggagtgcggtggtgtgatctcagctcactgcaacctctgcctcctgggttcaagtgattatcttgc

SEQ ID NO: 15213 - DNA, 201 bp, Homo sapiens
ttagttgtttcaggagaggtgctgggccctgggggtcctcagccacggcctcgtggggcttccagcccagagcaggagacaacaggaagtcccggcctgcratggtttctggtgttgtcaggtcatagctggagccctgtggctcagggagacatggccccaccagctctctacaggctgcctggtgtccccctgtctccg

SEQ ID NO: 15214 - DNA, 201 bp, Homo sapiens
gcgatctcaggtcacggcaacctccgcctcccgagttcaagtgattctcctccctcaacctccccagtagctgggactacaggtgcccaccaccacacccrggtaattttttgtatttttagtagagacggggtttcaccatgttagccaggatggtctcgatctcctgacctcgtgatccacccaccttggcctcctgaa

SEQ ID NO: 15215 - DNA, 201 bp, Homo sapiens
ctgtcagcaaattgacttctcgaactgatatttgagtctcaaggctggtgagtaaagagttttccaaatcttggtcatgcggagggtgtagttatgcggcyggagctgtcactgagaggcaggaggggcttggggggaaaggacgaaggctcaaccaggcccctgcatggacctgggcatgcgtcctctcctctcatctaa

SEQ ID NO: 15216 - DNA, 201 bp, Homo sapiens
ttacagagttcatagacattaggtaaaaaacattaaggtagtcattatgaaaggtaaatcacttctggaaggatctgtgatgctgtcaagtggcgtgacaagagccacctcttaggagcccttaccgtgtgacaggggctctgcgaagcactctagggttgctggcatttaatacagagactcacaggccctgagcagtcg

SEQ ID NO: 15217 - DNA, 201 bp, Homo sapiens
  misc_feature (1)...(201): n = A,T,C or G, or insertion/deletion polymorphism (see Tables 1-2)
gatggccgtgcccgaaggcaggcccttcactgtctaggaattggccaggcccagaggggcagcaaggccccagatgcccaagcatcgttaacacacagaanatgaaaagccagagcaagccgttctgtgtttgttgaagtctgtggacaggccacctgcgcctggcgcctggcccggtgtgcactgggagcagtcttgtgt

SEQ ID NO: 15218 - DNA, 201 bp, Homo sapiens
ggtctgaaaatagaggagagagagagagagagagagaaaacaaaagtgtctgaaaacactattgaaatacagccttttctgtgtggtggggttataagcatttttttttttttttttttactttcttttagtattgtctgaatttttcgtaataagcatgtattagctttgtgttattttcctactcaggaaacatttcta

SEQ ID NO: 15219 - DNA, 201 bp, Homo sapiens; identical to SEQ ID NO: 3057

SEQ ID NO: 15220 - DNA, 201 bp, Homo sapiens
gtctgaaaatagaggagagagagagagagagagagaaaacaaaagtgtctgaaaacactattgaaatacagccttttctgtgtggtggggttataagcatttttttttttttttttttactttcttttagtattgtctgaatttttcgtaataagcatgtattagctttgtgttattttcctactcaggaaacatttctat

SEQ ID NO: 15221 - DNA, 201 bp, Homo sapiens
tactaacttccaggttttccttaaagtatagccaagaattctttctactttgtagatagtctttgaaacgatttgtttatctttctctaggtcatgtcccygggactcctgtctacagagaaaaagaagatatgtatgacgagattattgagttaaagaaggtagtatttcggtttgttctctattgatttgaaacggtga

SEQ ID NO: 15222 - DNA, 201 bp, Homo sapiens
tctgaaaatagaggagagagagagagagagagagaaaacaaaagtgtctgaaaacactattgaaatacagccttttctgtgtggtggggttataagcatttttttttttttttttttactttcttttagtattgtctgaatttttcgtaataagcatgtattagctttgtgttattttcctactcaggaaacatttctatt

SEQ ID NO: 15223 - DNA, 201 bp, Homo sapiens; identical to SEQ ID NO: 3061

SEQ ID NO: 15224 - DNA, 201 bp, Homo sapiens; identical to SEQ ID NO: 3063

SEQ ID NO: 15225 - DNA, 201 bp, Homo sapiens
caggcaatctggctgccttggcttcccaaagtgctgggattataggcgtgagccactgcacccggccaactaacataatttaaaatgactttaaaatccartttaaaagttgtctgttcaagcctggtgtggtggctcacacgtataatcctagtactttgggaggccaaggcaggcagattgcttgagtccaggagttca

SEQ ID NO: 15226 - DNA, 201 bp, Homo sapiens
aggcagattgcttgagtccaggagttcaacaccagtctgggcaacatagtgaaaccccatctctatttaaaagttgtctatttagaagaaaagaatgttcttttttttttttttttgagacggagtctcgctctgtcacccaggctggagtgcagtggcgcaatctcggctcactgcaagctccgcttcccgggttcatgc

SEQ ID NO: 15227 - DNA, 201 bp, Homo sapiens; identical to SEQ ID NO: 3064
  misc_feature (1)...(201): n = A,T,C or G, or insertion/deletion polymorphism (see Tables 1-2)

SEQ ID NO: 15228 - DNA, 201 bp, Homo sapiens
gctccgcttcccgggttcatgccattctcctgcctcagcctcccgagtagctgggactacaggcgcccgccactgcgcctggctaatttttttttgtattwttagtagagacggggtttcaccttgttagccaggatggtctcgatctcctgaccccatgatccacccgcctcggcctcccaaagtgctgggattacaggc

SEQ ID NO: 15229 - DNA, 201 bp, Homo sapiens
ggaaggtgtacaagcacaaggtgaggctccccggggcgacccgggctgctccctgtgagtcttcgtgctccaaggcaagccactcactctccaggaatgastgggcctggagggccagccaggccccaggtgtctgagcaccgtaacatacagaaaatgaaaacctcattcacacgctgacacctccgttctgggtgcgtt

SEQ ID NO: 15230 - DNA, 201 bp, Homo sapiens
  misc_feature (1)...(201): n = A,T,C or G, or insertion/deletion polymorphism (see Tables 1-2)
gggctcgggactggctctgtgtttgctttcattggaatacttgcctccaagcaaattactgaggctgctgtaaacctcagagaggtttgtactctctaaangcagaatcagctggcgttttctgtttttttccagtgctaccggtaaaagaaccaccaccgcagcttctaccaggaggagatcggcttcagccacacacgg

SEQ ID NO: 15231 - DNA, 201 bp, Homo sapiens
cagctcttcctggtaatttcattcatttggattctggcaccagggcagctggtctgctgaggtctcagccaaagagtggccacctccaggaagcccgggckgtgtcgggacggaagggaggagtgtcccatctggagctgcctctgaactaagcgtcgccttatgccaggaaggcccacaacagggccccgccttggccca

SEQ ID NO: 15232 - DNA, 201 bp, Homo sapiens; identical to SEQ ID NO: 3066

SEQ ID NO: 15233 - DNA, 201 bp, Homo sapiens
agcctttgctgatgcagggatggccttgttgccgccaggtaatgatggtcccgactctgcccgacctcctctggagccccaccagtgcgggaggggagggmactgggtgcagccgggcaagggtgagtgtctgggctccccacacagcctgtgctgtggggaggactgtggtgttttccgtggtctgcctggggtagagcg

SEQ ID NO: 15234 - DNA, 201 bp, Homo sapiens
ggtttctgccttgtcggtctgctcctctccctgacctctggctggagagaagaggctttgcgtgggtttttatggtctgcacccattggcttttttaggcwgttggtttctccagcatccagctcagatgaggcagaaagaaaactgaaggagctccctgccgtgtcgatcgctggccccccggctcccggcccatccgcc

SEQ ID NO: 15235 - DNA, 201 bp, Homo sapiens
gctttgacccctgggctcaagcgatcctcctgcctcagcctcccgagtagctgagaccacagtggtgtgccaccacacccgggtattttttaaattttttmatagagatggggtctcgctatgttggccaggctggtcttgaactcctgggctcaagggatcctccctgcttggccccccacattgttgggattacaagca

SEQ ID NO: 15236 - DNA, 201 bp, Homo sapiens
gtataaaatacatgagaaatagagacatcaaataaatatttcgataatttcccactttcaaaatctcttcattcattccttccttccattcattcattctkttcatgcacactcactgatcaccagccctgcgtggggcagtctcagaggccctgggacgcaaaggctcaaacacacaagtgaacgagtggttacagcccg

SEQ ID NO: 15237 - DNA, 201 bp, Homo sapiens
aaaattagccgggcgtggtggcgggcgcccgcagtcccagctactcaggaggctgaggcaggagaatggggtgaacccggaaggcggagcttacagtgagycgagatcacgccactgcactccagcctgggcaacagagcgagactccatctcaaaaataaataaataagtaaataaataaataaataaataaataaatag

SEQ ID NO: 15238 - DNA, 201 bp, Homo sapiens
gctgtgtcgggacggaagggaggagtgtcccatctggagctgcctctgaactaagcgtcgccttatgccaggaaggcccacaacagggccccgccttggcscagcttgtcctttgtgcctggaattgccgaggtccttgctgtctttattttttgctctcagctccaacaggaccgaggtggcttcctccttcaggccagc

SEQ ID NO: 15239 - DNA, 201 bp, Homo sapiens; identical to SEQ ID NO: 3071

SEQ ID NO: 15240 - DNA, 201 bp, Homo sapiens; identical to SEQ ID NO: 3072

SEQ ID NO: 15241 - DNA, 201 bp, Homo sapiens; identical to SEQ ID NO: 3075

SEQ ID NO: 15242 - DNA, 201 bp, Homo sapiens; identical to SEQ ID NO: 3077

SEQ ID NO: 15243 - DNA, 201 bp, Homo sapiens; identical to SEQ ID NO: 3078
  misc_feature (1)...(201): n = A,T,C or G, or insertion/deletion polymorphism (see Tables 1-2)

SEQ ID NO: 15244 - DNA, 201 bp, Homo sapiens
agttttacatcctcacctaacggcccttcctattcacatttcccaaatgtccccatatgccgcctgccgctatctgtttcccgccagcattcggtcacggsggttctcagtccacatcccatcggagcctgggggtcggttggttacgtctccttagtgtggttcacagcagcccccaccctttcttttctttaaccaaca

SEQ ID NO: 15245 - DNA, 201 bp, Homo sapiens
acagggtctcactccatcactcaggctggagtgcagtggcacaatcacagctcactgcagcctcgacctcccaggctcaagcagtcctccggcctcagccycccaagtagttgggactacaggcaggcaccaccacacctggccaatttttgtagagacgggtcttgctgtgttgtccaggctggtcttgaactcctgagc

SEQ ID NO: 15246 - DNA, 201 bp, Homo sapiens
gtgctgggattacaggcgtgagccaccgcacccgggcctgcctcggcctcccaaagtgctgggattacaggcgtgagccaccgcgcccggccctacaggtratctgtgtgtactttagggactgagaaaaacttggccggtgcctcccggccagctacgttctctgctgcctgctgtgaacagtagaaggccaacccgtca

SEQ ID NO: 15247 - DNA, 201 bp, Homo sapiens
atatttctttgcttccatcgtatattctgctggtccttgtactcagttcctccttaatctcccaagggaaagatcctgtgtacagtagtacaaatgtgggkcgtgcactctgatgtacctgtcatccggccgtggtggtcattccgtgccattaagtgcacattgattaacttggcatcaacatctggggaggacttcgct

SEQ ID NO: 15248 - DNA, 201 bp, Homo sapiens
gtgcacattgattaacttggcatcaacatctggggaggacttcgctcacatctataagaacacatgctccgagggaccctctctactgattgtgacgctgrgtgtcagctgcagcctgagaaacttcccaagacacccaagggtgactgatgaccagtcagggtggggccagtgatccagacccctgaaccaaagtcccct

SEQ ID NO: 15249 - DNA, 201 bp, Homo sapiens; identical to SEQ ID NO: 3079
  misc_feature (1)...(201): n = A,T,C or G, or insertion/deletion polymorphism (see Tables 1-2)

SEQ ID NO: 15250 - DNA, 201 bp, Homo sapiens
  misc_feature (1)...(201): n = A,T,C or G, or insertion/deletion polymorphism (see Tables 1-2)
ccactgtccttacccctcacgtgaggtctcggagtgcatttatgccaattgataggtcctttgtaaaaattagtatttcacgacaagcttttccaattaancaatcattacagagttcatagacattaggtaaaaaacattaaggtagtcattatgaaaggtaaatcacttctggaaggatctgtgatgctgtcaagtggc

SEQ ID NO: 15251 - DNA, 201 bp, Homo sapiens
attacagagttcatagacattaggtaaaaaacattaaggtagtcattatgaaaggtaaatcacttctggaaggatctgtgatgctgtcaagtggcgtgacaagagccacctcttaggagcccttaccgtgtgacaggggctctgcgaagcactctagggttgctggcatttaatacagagactcacaggccctgagcagtc

SEQ ID NO: 15252 - DNA, 201 bp, Homo sapiens
gctctgatgggagaagagacgccgcggccagagtcctgcaggcccagtggaaggtgtacaagcacaaggtgaggctccccggggcgacccgggctgctccstgtgagtcttcgtgctccaaggcaagccactcactctccaggaatgagtgggcctggagggccagccaggccccaggtgtctgagcaccgtaacatacag

SEQ ID NO: 15253 - DNA, 201 bp, Homo sapiens
ctgccgtggcagctctctcctcggcgcctccctctcgcccgccgttgccccgggcactcacacccacttttctctccctgcttccttccctgacaggcggytgtggtgcttcaggcagctttcaggggacatctcacgcggacaaagctcttagcaagcaaagcacatggctcagagccacccagcgtgccaggcctccca

SEQ ID NO: 15254 - DNA, 201 bp, Homo sapiens; identical to SEQ ID NO: 3054

SEQ ID NO: 15255 - DNA, 201 bp, Homo sapiens; identical to SEQ ID NO: 3055
  misc_feature (1)...(201): n = A,T,C or G, or insertion/deletion polymorphism (see Tables 1-2)

SEQ ID NO: 15256 - DNA, 201 bp, Homo sapiens
agggcacaccctgctctgtcccccaggtgtgcagtgtgcttgggggagggctgccagtcggtcagtgtgcccacgatggctgccacctcctgctccagccrgtgtcgcacccctgccattcacccagccttactcagggacaggacagcacagtggggccctccctcttccctgggcccgtagtctagaagagagcacagc

SEQ ID NO: 15257 - DNA, 201 bp, Homo sapiens; identical to SEQ ID NO: 3056
  misc_feature (1)...(201): n = A,T,C or G, or insertion/deletion polymorphism (see Tables 1-2)

SEQ ID NO: 15258 - DNA, 201 bp, Homo sapiens
  misc_feature (1)...(201): n = A,T,C or G, or insertion/deletion polymorphism (see Tables 1-2)
gtgtaagggtgtccgtggtggcagcccctgaggtcagcgtggctgacccctctccctgtggttcatttctgcagacccctctccctcagggccacaggccntggcacctctacctggggatgacgtcaactccgatgattccgacgatattgtcattgcaccgtctctgcccacgaagaactttccagtttaggtccccgt

SEQ ID NO: 15259 - DNA, 201 bp, Homo sapiens
  misc_feature (1)...(201): n = A,T,C or G, or insertion/deletion polymorphism (see Tables 1-2)
tgccggggaagagcagacagtgtaagggtgtccgtggtggcagcccctgaggtcagcgtggctgacccctctccctgtggttcatttctgcagacccctcnccctcagggccacaggccttggcacctctacctggggatgacgtcaactccgatgattccgacgatattgtcattgcaccgtctctgcccacgaagaact

SEQ ID NO: 15260 - DNA, 201 bp, Homo sapiens
  misc_feature (1)...(201): n = A,T,C or G, or insertion/deletion polymorphism (see Tables 1-2)
tgccgtcttgcctgccggggaagagcagacagtgtaagggtgtccgtggtggcagcccctgaggtcagcgtggctgacccctctccctgtggttcatttcngcagacccctctccctcagggccacaggccttggcacctctacctggggatgacgtcaactccgatgattccgacgatattgtcattgcaccgtctctgc

SEQ ID NO: 15261 - DNA, 201 bp, Homo sapiens
gtttggaacgctctagatgcttaggaaggagcatccaagggggaatggccgagcagcttgcaagctcacagcgatccgtgccttgccccctcctgccctcyataccagtggccagcgagttaacagggaagttggcttttttttttttttttttgaagtgcagtctagctgtgttgcccaggctggtctggaactcctggg

SEQ ID NO: 15262 - DNA, 201 bp, Homo sapiens
gtcccattctagaatggattaaaagtttggaacgctctagatgcttaggaaggagcatccaagggggaatggccgagcagcttgcaagctcacagcgatcygtgccttgccccctcctgccctctataccagtggccagcgagttaacagggaagttggcttttttttttttttttttgaagtgcagtctagctgtgttgc

SEQ ID NO: 15263 - DNA, 201 bp, Homo sapiens
aaaaaaaagaaaacatttcattttcaggagaaatctgactgaattctgtcagaagacttgaattaaagtaaatctgaaagggcacatgtgcagaaatgaatttttttttgttttgcctttagtacctggaatgaatatctaaattgcaatgccttctgttcatactgtttactaaaaccccagtggtcagtggtccctgct

SEQ ID NO: 15264 - DNA, 201 bp, Homo sapiens
tgaggctgcagtttgctctaagaggagctcatggataaaaccagtagaagccaccacctatggtcccagctgctcgggaggcagcggtgggaagatcgctsgagcccaggaggtggaggctgcagagagccaaggtagcactgctgcactccatcccgggccacagatccagacccttttctcactaaaaaaagaaaagaa

SEQ ID NO: 15265 - DNA, 201 bp, Homo sapiens
tcttcctgttatatttaaaagatgctttctcgaaacctgcttgttctgtggacccctgtatctttccaggatgaggttttaacgcctcagtcctgcgccgrccttgtgctgtttttggcgtggctactcgcatttctttacctgactttcgagtgcgaagggagagtctttctgggccgtgttttggtttctttaagggaa

SEQ ID NO: 15266 - DNA, 201 bp, Homo sapiens
tgcttgttctgtggacccctgtatctttccaggatgaggttttaacgcctcagtcctgcgccgcccttgtgctgtttttggcgtggctactcgcatttctmtacctgactttcgagtgcgaagggagagtctttctgggccgtgttttggtttctttaagggaaactgaggccacacgtccattgccttatgtctcctgtt

SEQ ID NO: 15267 - DNA, 201 bp, Homo sapiens
tgaggtatgtgacccgggtcagggctggagaggacccaggcgagtccgcactcctgctaccactgcggccccccgtggcgtctcagccttgctgccagccrgcttcttagaaaggccacacctcctcacagtctttcatggttttctgtcacccagcccgggactaacctcttggtgctgagcagggcctgccctctggca

SEQ ID NO: 15268 - DNA, 201 bp, Homo sapiens
tttaacgcctcagtcctgcgccgcccttgtgctgtttttggcgtggctactcgcatttctttacctgactttcgagtgcgaagggagagtctttctgggcrgtgttttggtttctttaagggaaactgaggccacacgtccattgccttatgtctcctgttcgtacaatagttcccccctcgtttcctgccgaattttgtc

SEQ ID NO: 15269 - DNA, 201 bp, Homo sapiens
gatgtcttaaacacactaaatacaacgagaacaacaataaaacaagtttgttcacgccttctgtagaactgaaccttggggtgccctgatcgtggctcaaytggctgaatttcaggctctaactctccagatcattctctcgggcttcatcttaacttgccctcagtctgccacagataatccttaggaagtgaaggaaag

SEQ ID NO: 15270 - DNA, 201 bp, Homo sapiens
tgaggtctcagccaaagagtggccacctccaggaagcccgggctgtgtcgggacggaagggaggagtgtcccatctggagctgcctctgaactaagcgtcrccttatgccaggaaggcccacaacagggccccgccttggcccagcttgtcctttgtgcctggaattgccgaggtccttgctgtctttattttttgctctc

SEQ ID NO: 15271 - DNA, 201 bp, Homo sapiens
ccgtgagtcccttctttcatccttttactgtcatgaaacttggtcttcacatgtttatttatttactttttgcttcatctctctctatctaccatttttgsttttcttgctacttggtgtgaagtatcatgatcaggctggaaaacatggaattattttggcttttttattttcttcttttttaaaaggaaatgttactaa

SEQ ID NO: 15272 - DNA, 201 bp, Homo sapiens
tcttttttaaaaggaaatgttactaacttccaggttttccttaaagtatagccaagaattctttctactttgtagatagtctttgaaacgatttgtttatstttctctaggtcatgtccctgggactcctgtctacagagaaaaagaagatatgtatgacgagattattgagttaaagaaggtagtatttcggtttgttct

SEQ ID NO: 15273 - DNA, 201 bp, Homo sapiens
cctgacaggcggctgtggtgcttcaggcagctttcaggggacatctcacgcggacaaagctcttagcaagcaaagcacatggctcagagccacccagcgtkccaggcctcccagaccaggtaatgtcggggtgctggacgtcccagtggccatctgcagagctgctcgtctcgcactccatccatcgagaaagcgtagggc

SEQ ID NO: 15274 - DNA, 201 bp, Homo sapiens
ctgcgtggacttgagatcccgtgtcttatcctgcaattagaaaccccccattgacacctcctgtaaagggaagatgagtgcggaggcacgctgttgagacycgggactgtcgggagatggagaagggcagccttaagaccctgttgaggaggggagtgtggcgtgcggggctgtttcacgtgggaagtgtcaggcgaaggg

SEQ ID NO: 15275 - DNA, 201 bp, Homo sapiens
tctatgctgctctgcgtggacttgagatcccgtgtcttatcctgcaattagaaaccccccattgacacctcctgtaaagggaagatgagtgcggaggcacrctgttgagactcgggactgtcgggagatggagaagggcagccttaagaccctgttgaggaggggagtgtggcgtgcggggctgtttcacgtgggaagtgt

SEQ ID NO: 15276 - DNA, 201 bp, Homo sapiens
cctgctctgcccggagctgacggggatgccccagcagggccctgcctttctctggccgtcagtcccttcatgtttaaagtagagaacgggctagacagctsgaaagccactctccaccccaaatctatgctgctctgcgtggacttgagatcccgtgtcttatcctgcaattagaaaccccccattgacacctcctgtaaa

SEQ ID NO: 15277 - DNA, 201 bp, Homo sapiens
gctcccctttcctctagggccccttcagggacagcagtgtatttccacttagactgcaggagaggaccccgccccagtcactcagagctggcgctgggccycagggcttctcacgctgccttcctcctcacccacagctgcttctcagtggcagggcagactcagcacccgcttgtcctcacactccccaggtgcatctga

SEQ ID NO: 15278 - DNA, 201 bp, Homo sapiens
gaagaagccgctggcactgcaggatgccacaccctggtgtgaggcctcatccctgctctgcccggagctgacggggatgccccagcagggccctgcctttctctggccgtcagtcccttcatgtttaaagtagagaacgggctagacagctggaaagccactctccaccccaaatctatgctgctctgcgtggacttgaga

SEQ ID NO: 15279 - DNA, 201 bp, Homo sapiens; identical to SEQ ID NO: 3070

SEQ ID NO: 15280 - DNA, 201 bp, Homo sapiens
cacttagactgcaggagaggaccccgccccagtcactcagagctggcgctgggccacagggcttctcacgctgccttcctcctcacccacagctgcttctkagtggcagggcagactcagcacccgcttgtcctcacactccccaggtgcatctgatgtcagcagggttgacagctctgccgtcagggcggggcttgactt

SEQ ID NO: 15281 - DNA, 201 bp, Homo sapiens
  misc_feature (1)...(201): n = A,T,C or G, or insertion/deletion polymorphism (see Tables 1-2)
tggagccgcgcggccacccagcacttccgagtgggcagtttctccctccaaggccgcatctgcatctcatggtcctgaccccatgtgacctgggacacacngtgggctcaggagtcagggacccatccctgggcggcgagccccagccaggaggtggagggccatgcagcctgcaagcatgtccccggggaatggcagctg

SEQ ID NO: 15282 - DNA, 201 bp, Homo sapiens
  misc_feature (1)...(201): n = A,T,C or G, or insertion/deletion polymorphism (see Tables 1-2)
ctgggagccagcagggggctgccaaacagtcgtcttccctgctgtccttgcaccccagagctctcctgtgccccgcgttccgagccccatcgcccaggccncgggcagccctgtgcaggaggaggccatcgtcatcatccagtccgctctgcgggcacacctggcccgggccaggcacaggtgagtcagggtcacggggac

SEQ ID NO: 15283 - DNA, 201 bp, Homo sapiens
gcccagggtgccctgggggttgagtgctgggagccagcagggggctgccaaacagtcgtcttccctgctgtccttgcaccccagagctctcctgtgccccrcgttccgagccccatcgcccaggccacgggcagccctgtgcaggaggaggccatcgtcatcatccagtccgctctgcgggcacacctggcccgggccagg

SEQ ID NO: 15284 - DNA, 201 bp, Homo sapiens
gggactggcacacggcacagagacgtcccttcatctgcagcttgggccacctcatgtgactcctggagaattcccgccatcctaattctgcctctcacttycgtcctccttacaaaggcgtttgtttgctgggtcccggcagctcgggagggaggagccagggcagccaggcctcttgttggcttgatcgacacctgttgg

SEQ ID NO: 15285 - DNA, 201 bp, Homo sapiens
  misc_feature (1)...(201): n = A,T,C or G, or insertion/deletion polymorphism (see Tables 1-2)
aagtaggggatcagctctcagcattcacatgggaatgattaattgtaggttaaatggagtgaggagagtcggtttaagagttgcctcaaggaatttataancgtgtgaaaatttagacttttttagctgtctgtagttgtgtgagtaaatgttcatttatcttcggagaagctgattttcctttctgatcacattggcaca

SEQ ID NO: 15286 - DNA, 201 bp, Homo sapiens
  misc_feature (1)...(201): n = A,T,C or G, or insertion/deletion polymorphism (see Tables 1-2)
gtgaaaatttagacttttttagctgtctgtagttgtgtgagtaaatgttcatttatcttcggagaagctgattttcctttctgatcacattggcacaggcngcggactaacagatgatctcactttagcggaacagaggcctgaaaatgtgtcaggactgagggaagatgaggctcttcttagggttacaaaatcagaatg

SEQ ID NO: 15287 - DNA, 201 bp, Homo sapiens
tgctgcagagagagtagatcctccccaggccccacaagcagcctcaccagggaagcagctctcactccctatggaaactgattgttgccggggttaaacayttgtcaatttggaaaactgttcagctcgtagtagtcactgcataaatatttttatgtgattctaaaactgcttacattttggtggtaaaataaaggcagc

SEQ ID NO: 15288 - DNA, 201 bp, Homo sapiens
gtgccctgggggttgagtgctgggagccagcagggggctgccaaacagtcgtcttccctgctgtccttgcaccccagagctctcctgtgccccgcgttccragccccatcgcccaggccacgggcagccctgtgcaggaggaggccatcgtcatcatccagtccgctctgcgggcacacctggcccgggccaggcacaggt

SEQ ID NO: 15289 - DNA, 201 bp, Homo sapiens
tacacttgagtagaatgtgtattgtgctgttgttgagtggggtgttctgtaaatgtctgttaggtttttagtgtctgctgatcaagtttttctaactcctygttgatcttctgcctcgctctcctgtctgttaggagcctggccctgccaacaccttgattctggacttccagcctcccaaactgagacagttaatttcag

SEQ ID NO: 15290 - DNA, 201 bp, Homo sapiens
  misc_feature (1)...(201): n = A,T,C or G, or insertion/deletion polymorphism (see Tables 1-2)
gagctctcacattgggcccacatccacctccataggtgcacagcttggcctaatggagtcccttctgcacagccaggggactggcacacggcacagagacntcccttcatctgcagcttgggccacctcatgtgactcctggagaattcccgccatcctaattctgcctctcactttcgtcctccttacaaaggcgtttgt

SEQ ID NO: 15291 - DNA, 201 bp, Homo sapiens
ctggcgagaggaggagagagaaggtccaacctcaggcctccacccaccgtgggccggggtatggatagacatggaagtatgtgagcgtggacatccatgcrcacgcgcacaggcacacggggagaaccctcttcctcttccccatccagccctctggtttttggtgctcccagacgtgcgctgagtgcatgagggcctcct

SEQ ID NO: 15292 - DNA, 201 bp, Homo sapiens
tggcatgtgggaggcatggggtaaatgccctccagtgagcgggtgaggggatccgggctccttgtccgatcggccagtcagtggtgggtgccgtctccccytcctgcttctctccctggcgccccccatgcctcaggggcctcgtctctaagtaaagacagcagtgaggctgcctgtgtggggctgtggtgagcgtggggt

SEQ ID NO: 15293 - DNA, 201 bp, Homo sapiens
gtgtgcgtgtgtgtgcgtgtgtgtgtgtgagtgcatgtgtgcatgtgtgtgagtgtgtgtgtgtgtgtgtgtgctgtgtatggttgtattctgctgactgyagtcatggatccttggactgttgtgtgattttaggtgcgtgcatgagtgtgtgtgcgtgtgtgtgtgtgcatgcgtgtgtgtgtgtgcgctgtgtatgat

SEQ ID NO: 15294 - DNA, 201 bp, Homo sapiens
gggtcagccccagctgggaacgtgcgcgccagcgactggcatttttcatcacctgtgcacgtgcaagaatccccacaaaacctgcatgagtattgattttsggctgatggatccattttagcagcaagcacatttgcaattacgggacctgcagataatgaggatcgactgtactttacacctcctgggctaagaggcgaa

SEQ ID NO: 15295 - DNA, 201 bp, Homo sapiens
  misc_feature (1)...(201): n = A,T,C or G, or insertion/deletion polymorphism (see Tables 1-2)
tctgcaggcacgtccttgtgatgcccagggctgacttggcttttctgatcccccgctaacctgtgtgtccagttcccggcctgcccttcctcaattttgtncataatttcaatacactttgctaaaaggaaaacttctctctataattgtcatatgctgtttatgtcttaaaaggtcaccttaaataggtgatataaaaaa

SEQ ID NO: 15296 - DNA, 201 bp, Homo sapiens
ttctgagcccaaagggtgagggtgaggaaggccagggggtgaaggaagggtgaggcctgcccaggacccacatgccttaatttgaatgtcccttcaggacyggcccagggagccggcagccccccagtaccactccagtaagtgtgggggcccgtggcgggcggaggcctcgctttcctgggagatccctcctgtgctgac

SEQ ID NO: 15297 - DNA, 201 bp, Homo sapiens; identical to SEQ ID NO: 3046

SEQ ID NO: 15298 - DNA, 201 bp, Homo sapiens
caattttgtgcataatttcaatacactttgctaaaaggaaaacttctctctataattgtcatatgctgtttatgtcttaaaaggtcaccttaaataggtgrtataaaaaatgatataaaaaatttcagtcaatggctgatttttttaaacgctccatttatttggaatgcaccgtctttcctttgcccctcgaaatgcagt

SEQ ID NO: 15299 - DNA, 201 bp, Homo sapiens; identical to SEQ ID NO: 3049

SEQ ID NO: 15300 - DNA, 201 bp, Homo sapiens
ccgcattggaaagcaccaatatgatcttccgagggactttaaacattttatgcttctctttttggatttcaatttgagtgaatgagttaatacagaaacabttttgtcttcaaaaagcttcctttttttttttttttggccatcctcgtgctgaaatcagacagtacaagtcttatttcattccctggaccaggacaaagt

SEQ ID NO: 15301 - DNA, 201 bp, Homo sapiens
  misc_feature (1)...(201): n = A,T,C or G, or insertion/deletion polymorphism (see Tables 1-2)
ctcacaaccaacagagcaagctgtgattcacctgtccctcgtttcaagcatgtgtgaaaccagcttagcaatgcaaacctcagtccacgatttggttgttncaggcccctgggggagaagaagacgggcgccaaaaggcagaagaagatgggcagtgccctcctgagcttgtcccggagtgtccaggagctcacggaagag

SEQ ID NO: 15302 - DNA, 201 bp, Homo sapiens
gccaggtggaatcgggaaaggatgtcaccccgagatgcttggaggctgttaatacagacatctatctcttcacgatccaagggggcagagactgggccagygctggcaaaattctcaggtagccaggacctgtcggtgtggctctgcagccccgcaggctgctccggctgcggaagaggagcctcaggccatacctgagaa

SEQ ID NO: 15303 - DNA, 201 bp, Homo sapiens
actagtatctaacacatgtctgtgttgcctccagaaactaagtgtgatggagagctcaaaatcacacgccgcagagccagtcagatcacacccgccagccygccttgcatccagctctgcgctgcacagacagccacgaggggaccgcaacaaggaccacgagcgtctccgaggggctgtgagagacctgaaggaagagcg

SEQ ID NO: 15304 - DNA, 201 bp, Homo sapiens
gcaccctcatgaggccacaagtgggaaattccacccttaagtacttcacacaagctttgtttcatgcacaaagttattaaaaacacaatataaaattaccwttgcactatgggtataatgtatatatgaaacataaatgaattttgtgtttagacttgggtcccatccccaagatacctcattatatggatgcaaatattc

SEQ ID NO: 15305 - DNA, 201 bp, Homo sapiens; identical to SEQ ID NO: 3051

SEQ ID NO: 15306 - DNA, 201 bp, Homo sapiens
acctcagagaggtttgtactctctaaaagcagaatcagctggcgttttctgtttttttccagtgctaccggtaaaagaaccaccaccgcagcttctaccargaggagatcggcttcagccacacacggggacgcctcctccccacccttcctcgcagctcttcctggtaatttcattcatttggattctggcaccagggca

SEQ ID NO: 15307 - DNA, 201 bp, Homo sapiens
atgcatgccacgctttatgttatcaagacatctcacatgccctgtctcaggccctctacagaagctctgtgggacgggcagaaccacttgttacaaccackgtctgctgatgaacttgagactcagcgacgttagtggtctgtccaaggttaaccagtagcagaaccaagattcaaggtcacctgcctcccaaggccaaga

SEQ ID NO: 15308 - DNA, 201 bp, Homo sapiens
cagcaccgtgaccatcacactggctttcagtatccgtaaatgtttgcccctggagaaatcatctgcgttcatttccttccataattttagtctgtttatasagctactgtctccaccagttgatgtgtgtctgagacactgcgttcagttggggcaccagagggcaatagggcattggcagcctcgtccccagagcacgga

SEQ ID NO: 15309 - DNA, 201 bp, Homo sapiens
ggccacccagcacttccgagtgggcagtttctccctccaaggccgcatctgcatctcatggtcctgaccccatgtgacctgggacacactgtgggctcagsagtcagggacccatccctgggcggcgagccccagccaggaggtggagggccatgcagcctgcaagcatgtccccggggaatggcagctgggctgacccag

SEQ ID NO: 15310 - DNA, 201 bp, Homo sapiens
gatctggaccccgttctgtgagatctggaccccattgggtgtttggcatcgtggttgtcacaggagaccaccttccagacagggtctccctttgctcggcyttcttccttagtgggctttgcagttgacttatgtgcagggattcatctgaccacctccacctgagtggacagaggtgcgctgggctcccaagctggctgt

SEQ ID NO: 15311 - DNA, 201 bp, Homo sapiens
tttcatgcacactcactgatcaccagccctgcgtggggcagtctcagaggccctgggacgcaaaggctcaaacacacaagtgaacgagtggttacagcccggggtggcgctgggggtggccagccctgcacacaaaggccaggaggtccctgcgaggggtgacatgcaaggtgggcctcgcaggatacatcagagctcact

SEQ ID NO: 15312 - DNA, 201 bp, Homo sapiens
ccccgttctgtgagatctggaccccattgggtgtttggcatcgtggttgtcacaggagaccaccttccagacagggtctccctttgctcggccttcttccwtagtgggctttgcagttgacttatgtgcagggattcatctgaccacctccacctgagtggacagaggtgcgctgggctcccaagctggctgtgcgggcgg

SEQ ID NO: 15313 - DNA, 201 bp, Homo sapiens
ttgctcggccttcttccttagtgggctttgcagttgacttatgtgcagggattcatctgaccacctccacctgagtggacagaggtgcgctgggctcccargctggctgtgcgggcggtttgggtgggggcagatccgccatttgtgtgggaccctcagtctgaacgtcaggagcccgggcccgatggttttctgtaattg

SEQ ID NO: 15314 - DNA, 201 bp, Homo sapiens
  misc_feature (1)...(201): n = A,T,C or G, or insertion/deletion polymorphism (see Tables 1-2)
agttggccccattcccactggggtctcccagttcgcgctggagtctccccctttcatgttggggttcatgctggggtctcaggagcacgtggagtccctgntggtgccagagtgacgagccctttctcagggctgaggctgccaccaactccccagtctcccccgacagtgcctctaggccttttgttttctttttcttgc

SEQ ID NO: 15315 - DNA, 201 bp, Homo sapiens
aggagggtgccgcggaggtggggttagtccaggtggccccgaggcccctctgtctctaatgccgctctcgtgtacagcagcccgtgtgccgaccttgtgcrtacgaatgtgttcgtgaccctgtaaatcctaggccggcatcctgtgctaccccaaagcctgtggccttccctggctgtgccatctgtagatgtgtgtcta

SEQ ID NO: 15316 - DNA, 201 bp, Homo sapiens
ttcttctaacgagtttgagagatgcccatctatcaggctgggagggttcacagggctagaggcagatcgttcaaaaataagtgcttccccgaaaatggagygtgaacttctcacggagcttccctgtcttttttttttttttttgagatagagtctcactgtgtcacccaggctggagtgcagtggcccaatcttggctca

SEQ ID NO: 15317 - DNA, 201 bp, Homo sapiens
  misc_feature (1)...(201): n = A,T,C or G, or insertion/deletion polymorphism (see Tables 1-2)
cgaggcccctctgtctctaatgccgctctcgtgtacagcagcccgtgtgccgaccttgtgcgtacgaatgtgttcgtgaccctgtaaatcctaggccggcntcctgtgctaccccaaagcctgtggccttccctggctgtgccatctgtagatgtgtgtctattttatatacgcgtatcatatatttcaaaggttcagtca

SEQ ID NO: 15318 - DNA, 201 bp, Homo sapiens
  misc_feature (1)...(201): n = A,T,C or G, or insertion/deletion polymorphism (see Tables 1-2)
cgggtttctagtttcgtgagtgtagggaccatgtctgtcctgttcactcagcaagtgtttttctccaaggcctggtcaacctgcttgtaggtttgcagctnccaccacgttccgaggcttttcatcgtcctggtcactctgccaggagggcgaggcaggcgatgatgttttcctgctttccgagtttgtcgttttccgggc

SEQ ID NO: 15319 - DNA, 201 bp, Homo sapiens
ggtttctccgtgttggccaggatggtctccaactcctgaccttaggtgatttgcacatcttggcctcccaaagtgcaggaattacaggcgtgagccaccgygcccggcaagtccttcttttcatgaaaccaaaccagaccccaacgttaagtataaaatacatgagaaatagagacatcaaataaatatttcgataatttc

SEQ ID NO: 15320 - DNA, 201 bp, Homo sapiens
tgctggagtcctggtggcctctgagatgctcccctttcctctagggccccttcagggacagcagtgtatttccacttagactgcaggagaggaccccgccrcagtcactcagagctggcgctgggccacagggcttctcacgctgccttcctcctcacccacagctgcttctcagtggcagggcagactcagcacccgctt

SEQ ID NO: 15321 - DNA, 201 bp, Homo sapiens
taagagtgccttagtttttgcatacgtttattatcttttttatacttaaagagggaaaatctcagataaagaattttaaaacatttcccttactttcatayaaaatcaagaatgccctgaaacagtaagatttttctcatttattttagatattttacatattaagttctaaatattgctctgtcactatgtagtgacatt

SEQ ID NO: 15322 - DNA, 201 bp, Homo sapiens
ccctccagtgagcgggtgaggggatccgggctccttgtccgatcggccagtcagtggtgggtgccgtctccccatcctgcttctctccctggcgccccccytgcctcaggggcctcgtctctaagtaaagacagcagtgaggctgcctgtgtggggctgtggtgagcgtggggtttgccagtgtgtgcgcagtgtgtggcg

SEQ ID NO: 15323 - DNA, 201 bp, Homo sapiens
cagggtgccatgggagccttaggggtgctgtgggagtgttaggcagagggtggaggggggccgtgctgcttcccgaggccccctggcttctgtgcagagarggggatggtggcagacagaggcttctgcgcttgtctagtcgggctgctggtggcctggatgggggcagcagtgggtgtggtgaaaggtgttcagggtctg

SEQ ID NO: 15324 - DNA, 201 bp, Homo sapiens
cccttcctgcttgagagaagagttcgagaaatttcagggagtggtttgagatggagtttttaatattccttgtttgaattacattgtctttagttttctcraagacatcaaatatacacatcgtagttttatgtcatgcataaatgtggtttcgccaagtggcgctttagcctcccttggtcccgtgtggtctctacatgg

SEQ ID NO: 15325 - DNA, 201 bp, Homo sapiens
ttcgagaaatttcagggagtggtttgagatggagtttttaatattccttgtttgaattacattgtctttagttttctcgaagacatcaaatatacacatcrtagttttatgtcatgcataaatgtggtttcgccaagtggcgctttagcctcccttggtcccgtgtggtctctacatgggagtggtgagttgtcttgccag

SEQ ID NO: 15326 - DNA, 201 bp, Homo sapiens
cacgtgttggcttttccagagtcaccttatctctctaagccgagaaaagtggcctcctggaggtccctcaggacggcagggagcatgcctctgggcggccragcgtccctgaccccgcagaagctgtggctgggaaccgcaaagccaggtatgtggttgtcgcactggagacccttcctgcttgagagaagagttcgagaa

SEQ ID NO: 15327 - DNA, 201 bp, Homo sapiens
tctgtctttctgaagttcatgtgttgagctcacatgttgctgtccggcacctctgaatccacgtgttggcttttccagagtcaccttatctctctaagccragaaaagtggcctcctggaggtccctcaggacggcagggagcatgcctctgggcggccgagcgtccctgaccccgcagaagctgtggctgggaaccgcaa

SEQ ID NO: 15328 - DNA, 201 bp, Homo sapiens
ttggtattaatttctctttaaatgtttgatagaattcaccagcgagaccatgtggttctgggtgtttctttacttctataaggtcagtagtgaggccccctttttttttttttccccctgtattttggtaatttcgtgtctctgggttttttttcttggctaaaggtttgtcagttttgttgatcttttcaaagaaccaac

SEQ ID NO: 15329 - DNA, 201 bp, Homo sapiens
aaaacatggaattattttggcttttttattttcttcttttttaaaaggaaatgttactaacttccaggttttccttaaagtatagccaagaattctttctrctttgtagatagtctttgaaacgatttgtttatctttctctaggtcatgtccctgggactcctgtctacagagaaaaagaagatatgtatgacgagatta

SEQ ID NO: 15330 - DNA, 201 bp, Homo sapiens
cctgtctccactaaaaatacaaaaaaaaattagcctgacatggtggtgcacacctgtagtcccagctactgaggaggctgaggcaggagaattgctttaasctgggaggcggaggttgtggtgagccaagatcatgctattgcaccccagcctgggcaacagagcaagactccacctcaaaaaaacaaaaaatttcactca

SEQ ID NO: 15331 - DNA, 201 bp, Homo sapiens
ccgaggggctgtgagagacctgaaggaagagcggaccgcgctgcaggagcagctgctgcagagagagtaggtcctcccaaggccccgccagtgtccccacrggcacaggtgctgcagagagagtaggtcctccccaggccccgccagtgtccccacaggcacaggtgctgcagagagagtaggtcctccccaggccccgcc

SEQ ID NO: 15332 - DNA, 201 bp, Homo sapiens
gagcagggaccctagatggatgctctcctgcctctccactccctcagcgtgtgtggacgctacccgggggcagctagtcgcggcggcgtctctgtggctcrgaggtccctggctctctgctgcctccctggagggtcgcagccatgctctgctcaccatggccggtgctgcacttgcctccctggagggtcgcagccatgc

SEQ ID NO: 15333 - DNA, 201 bp, Homo sapiens
gatgaacagtgcagttccagccatgaccctttttagggaggagctagaaagtgagatctttattttgctggagtcctggtggcctctgagatgctcccctytcctctagggccccttcagggacagcagtgtatttccacttagactgcaggagaggaccccgccccagtcactcagagctggcgctgggccacagggctt

SEQ ID NO: 15334 - DNA, 201 bp, Homo sapiens
  misc_feature (1)...(201): n = A,T,C or G, or insertion/deletion polymorphism (see Tables 1-2)
agccgctgaaagggactgcagtgagcagcgggcaccttgccattcccagagtccccactgtgctgacaggtgccatgccctgtcagctccctggggcgccngtgagtttctcccagactggggtgagtgggagcacggacggctctttgagagaacgtggctgcacagcagtgaagggagtcacgttccctgctgccgtgg

SEQ ID NO: 15335 - DNA, 201 bp, Homo sapiens
  misc_feature (1)...(201): n = A,T,C or G, or insertion/deletion polymorphism (see Tables 1-2)
agtaaggggaagagacggccccgctccgtcacccccgtctgcttcaccccgcatggggtttgttcccctcttatcacagactgctctggttctcagcctcngtggtggagccgcgcggccacccagcacttccgagtgggcagtttctccctccaaggccgcatctgcatctcatggtcctgaccccatgtgacctgggac

SEQ ID NO: 15336 - DNA, 201 bp, Homo sapiens; identical to SEQ ID NO: 3082

SEQ ID NO: 15337 - DNA, 201 bp, Homo sapiens
ctcgaagacatcaaatatacacatcgtagttttatgtcatgcataaatgtggtttcgccaagtggcgctttagcctcccttggtcccgtgtggtctctacrtgggagtggtgagttgtcttgccagagccaactgttatagtcttaggagtttggtgggctggtcagtgtcatgctggcaacctgatattagacatggtag

SEQ ID NO: 15338 - DNA, 201 bp, Homo sapiens
ccttctgtccagcacttggggtcacacttgcatcgtggtctgccgccttttccagggatttctggctcacttcccatattcccttacgggtgtgtcccctyataagatgtcgcagactttaagctcatcttggcatctgctccttgaaggacttggactaaaaattatttccatctgcatatcaataactcttattccaac

SEQ ID NO: 15339 - DNA, 201 bp, Homo sapiens
ctgggagacacgggactcctctgatggccaactgtagctggaaggctcctccacggccttgctcaactctccttagattgcctgtgctctaggatgcgtcdaacaaactttctctccttctgtccagcacttggggtcacacttgcatcgtggtctgccgccttttccagggatttctggctcacttcccatattccctta

SEQ ID NO: 15340 - DNA, 201 bp, Homo sapiens; identical to SEQ ID NO: 3150

SEQ ID NO: 15341 - DNA, 201 bp, Homo sapiens
aggaattagaagccctccccactgtctactctgatagcccgaaggaaacagggaccttaatcctacaattgccagaaaccgaattctgccaacaaactctrcacaagcttgggggagaaccccaatcttaagatgaggatacaactttgcgaaactctgaacaaagagtctatcacgttaggcctggatttctgatgaagg

SEQ ID NO: 15342 - DNA, 201 bp, Homo sapiens
ccaccaacttcggccttccaaagtgctgggattacagacatgagccaccattcccggcccacaaatctttaaagtgtcatttttcaaaatgcaccttgtgygccattcctgactgattatttggaaatgaaagagaaaagaaaataccaaagttcatctcaaggatccttagcaataactacacacgttaaaacaaagcca

SEQ ID NO: 15343 - DNA, 201 bp, Homo sapiens
acggggattccgtgatgcaaagtgaagagagaggaacggggcccatttcgagggtttctccctggtttctcagacagctcctgggccaagactcggaaackttgagacagagcgcttggcacagaagtagcggggtcagggcgaagtcccagggcctcaggcatggctctcaggatctcaggccccaaaggcggtgtatgg

SEQ ID NO: 15344 - DNA, 201 bp, Homo sapiens
tggtttctcagacagctcctgggccaagactcggaaacgttgagacagagcgcttggcacagaagtagcggggtcagggcgaagtcccagggcctcaggcmtggctctcaggatctcaggccccaaaggcggtgtatggattggggaggcccagcgctggggattccccatctccgcagggtttctcttctccctctccca

SEQ ID NO: 15345 - DNA, 201 bp, Homo sapiens; identical to SEQ ID NO: 3167

SEQ ID NO: 15346 - DNA, 201 bp, Homo sapiens
cagggtctcacacccatctagaggatgtctgtctgcgacgtggggtcggacgggcgcctactccgcgggtatcaccagcttgcttacgatggcaaggatthcatcgtcctgaacgaggacctgtgctccttgacagccgcagacacggcggctcagatcacccagctcaagtgggaggcggcccggggggcggaggttcat

SEQ ID NO: 15347 - DNA, 201 bp, Homo sapiens
tcccagcactttgggaggccgaggcgcgtggatcacaaggtcaggagatcgagaccatcctggccaacatggtgaaaccccgtctctaataaaaaattacaaaaaaaattagccgggcgtggtggcggtcgcctgtagtcccagctacttgggaggctgaggcaggagaacggcgtgaacccgggaggcggtgcttgcagt

SEQ ID NO: 15348 - DNA, 201 bp, Homo sapiens
ggaaacagggaccttaatcctacaattgccagaaaccgaattctgccaacaaactctacacaagcttgggggagaaccccaatcttaagatgaggatacarctttgcgaaactctgaacaaagagtctatcacgttaggcctggatttctgatgaaggaaatgtagacaaataaatgggtgctgttttcagccactaagtt

SEQ ID NO: 15349 - DNA, 201 bp, Homo sapiens
gtcaggagatcgagaccatcctggccaacatggtgaaaccccgtctctaataaaaaattacaaaaaaaattagccgggcgtggtggcggtcgcctgtagtyccagctacttgggaggctgaggcaggagaacggcgtgaacccgggaggcggtgcttgcagtgagcgagattgcaccactgcactccagcctgggcgacag

SEQ ID NO: 15350 - DNA, 201 bp, Homo sapiens
gaggctgagggaggagcattgatcacatgagccaaggaggtagaggcttcagtgagtcatgagcgtgccactgcactttagccagggtaacagagtgacgmcctgtctgtaaataaataaaaaataaaaaaattaataataaagggagtgcatgagcactggcgaagggcactttggctgcattaagcacttgcaattctg

SEQ ID NO: 15351 - DNA, 201 bp, Homo sapiens; identical to SEQ ID NO: 3173

SEQ ID NO: 15352 - DNA, 201 bp, Homo sapiens
gtaaaaatacaacagaccagagtcacagatacacagtctgggaaagtaaaacttcactttgtgagtctaattgcaatgcgtttagacatatttatatatartggggccaaaaatcatctcttttacaaattagattcgtgaccattcaggggctaccaagattgtgctacccactgtagcacaatcggagacccacgccga

SEQ ID NO: 15353 - DNA, 201 bp, Homo sapiens
tagattggagtaaacaatttctgcctaccctagccaaacaaattattgtcatgatgctaagctagtgtatagacagaggtgtgagattcacatttttctarctgcaaagcaccctgattaggcaaatatttttgtagatgcttgagtaagaaaattggcattttgggcattcttaaaccgaattagaaacttctgaagaga

SEQ ID NO: 15354 - DNA, 201 bp, Homo sapiens
aaacatgaaagagatgcttgtacagcaatgatagcagcacaaaagaacagtgtttttcagaatcatactggagtccaaatcacttctaccacatctaattwaaaaacacagtgaaagatgttaaactttcataggatgcccactgaatagccagttattgaaaaatcttgttcctagattggagtaaacaatttctgccta

SEQ ID NO: 15355 - DNA, 201 bp, Homo sapiens
ataagaatggaaaacatgaaagagatgcttgtacagcaatgatagcagcacaaaagaacagtgtttttcagaatcatactggagtccaaatcacttctacyacatctaattaaaaaacacagtgaaagatgttaaactttcataggatgcccactgaatagccagttattgaaaaatcttgttcctagattggagtaaaca

SEQ ID NO: 15356 - DNA, 201 bp, Homo sapiens; identical to SEQ ID NO: 3176

SEQ ID NO: 15357 - DNA, 201 bp, Homo sapiens
ccatgggctgttcccagccagtgactggtcacagcaggcgttaaggcaagccattcctgggagacacgggactcctctgatggccaactgtagctggaagdctcctccacggccttgctcaactctccttagattgcctgtgctctaggatgcgtcgaacaaactttctctccttctgtccagcacttggggtcacacttg

SEQ ID NO: 15358 - DNA, 201 bp, Homo sapiens
tgcaaagccctgcttcccatgggctgttcccagccagtgactggtcacagcaggcgttaaggcaagccattcctgggagacacgggactcctctgatggcyaactgtagctggaaggctcctccacggccttgctcaactctccttagattgcctgtgctctaggatgcgtcgaacaaactttctctccttctgtccagca

SEQ ID NO: 15359 - DNA, 201 bp, Homo sapiens
tcccaaggctgtgctcctgtgctctgacatcctcagcaggattggtgcaaagccctgcttcccatgggctgttcccagccagtgactggtcacagcaggcdttaaggcaagccattcctgggagacacgggactcctctgatggccaactgtagctggaaggctcctccacggccttgctcaactctccttagattgcctg

SEQ ID NO: 15360 - DNA, 201 bp, Homo sapiens
gaaaataccaaagttcatctcaaggatccttagcaataactacacacgttaaaacaaagccacagccaattgtaaagagtcatgtgacagagaggaccagratctcatgaaaaatagccttggctagaaagaggtcatttgaccctgggctaattggcaactctctacattgtctggcatacagtgttcaatctgatgtgc

SEQ ID NO: 15361 - DNA, 201 bp, Homo sapiens; identical to SEQ ID NO: 3178

SEQ ID NO: 15362 - DNA, 201 bp, Homo sapiens
ctgttgtaagtgtgagcagaatcatccagcaacccagcctgagagggtttcatattcaagagcccagaaccctcaggaaggaaggattgagcgatactcayaggtaatgtcccaaggctgtgctcctgtgctctgacatcctcagcaggattggtgcaaagccctgcttcccatgggctgttcccagccagtgactggtca

SEQ ID NO: 15363 - DNA, 201 bp, Homo sapiens
ccccttgtcctgttgtaagtgtgagcagaatcatccagcaacccagcctgagagggtttcatattcaagagcccagaaccctcaggaaggaaggattgagygatactcataggtaatgtcccaaggctgtgctcctgtgctctgacatcctcagcaggattggtgcaaagccctgcttcccatgggctgttcccagccagt

SEQ ID NO: 15364 - DNA, 201 bp, Homo sapiens
ctggggacattcttggctatgtgtccaggagacatgtacaccaatgtttatggcaaaaactggaaacaatcacatatacatcaatgggaattaacaaaatwgtcgtataataataaaaagtaaaacttcagcagcaacagtgaatgaacagcaccctcccacatcagagataactctcctacacataacatgcatcagcat

SEQ ID NO: 15365 - DNA, 201 bp, Homo sapiens; identical to SEQ ID NO: 3179

SEQ ID NO: 15366 - DNA, 201 bp, Homo sapiens
catcatataatcccaccatctgcctcctgatcataccccctggggacattcttggctatgtgtccaggagacatgtacaccaatgtttatggcaaaaactrgaaacaatcacatatacatcaatgggaattaacaaaatagtcgtataataataaaaagtaaaacttcagcagcaacagtgaatgaacagcaccctcccac

SEQ ID NO: 15367 - DNA, 201 bp, Homo sapiens; identical to SEQ ID NO: 3181

SEQ ID NO: 15368 - DNA, 201 bp, Homo sapiens; identical to SEQ ID NO: 3180

SEQ ID NO: 15369 - DNA, 201 bp, Homo sapiens; identical to SEQ ID NO: 3182

SEQ ID NO: 15370 - DNA, 201 bp, Homo sapiens; identical to SEQ ID NO: 3184

SEQ ID NO: 15371 - DNA, 201 bp, Homo sapiens; identical to SEQ ID NO: 3186

SEQ ID NO: 15372 - DNA, 201 bp, Homo sapiens; identical to SEQ ID NO: 3185

SEQ ID NO: 15373 - DNA, 201 bp, Homo sapiens; identical to SEQ ID NO: 3187

SEQ ID NO: 15374 - DNA, 201 bp, Homo sapiens
ctccctgttcgtgtggcctggacttaatgactcacttctaactgatagagtaatgctgacataatagtttgtgattctgggtgtagaacataagactcacygaagtttctactttggttctttctttctctggaatcatgagccctgggggaagctggctgttgtgtcataaggaggcctgtggtccatgtgactaggaag

SEQ ID NO: 15375 - DNA, 201 bp, Homo sapiens; identical to SEQ ID NO: 3188

SEQ ID NO: 15376 - DNA, 201 bp, Homo sapiens
ttttgcagatatatttaaagtccccagtcagttgactttaagatgaggattatcctgcttagacggtcctaatcaggtaagctctgaaaaggattgggttyttcctgagaatagagactcacagtgtgagagggattcagcgtgaggggcttcctccactttgggctttgaaaatggagggatcatggggaaagaacactg

SEQ ID NO: 15377 - DNA, 201 bp, Homo sapiens; identical to SEQ ID NO: 3189

SEQ ID NO: 15378 - DNA, 201 bp, Homo sapiens; identical to SEQ ID NO: 3190

SEQ ID NO: 15379 - DNA, 201 bp, Homo sapiens; identical to SEQ ID NO: 3191

SEQ ID NO: 15380 - DNA, 201 bp, Homo sapiens
aaccgaattctgccaacaaactctacacaagcttgggggagaaccccaatcttaagatgaggatacaactttgcgaaactctgaacaaagagtctatcacrttaggcctggatttctgatgaaggaaatgtagacaaataaatgggtgctgttttcagccactaagtttgtggtaattggttatgtactgccaggaaataa

SEQ ID NO: 15381 - DNA, 201 bp, Homo sapiens
ctcttccaaaagccatgtgagagattcttgtgtcttgtgaatccctggccccatttgagccctcaggtgattcagccctggaagacaactagactgcaacrttgtgagaggccctgagccagaagcattcagagaaacttctcctggattcctgaccatggataactgtgggagatgataaatatttgttgatttgagctg

SEQ ID NO: 15382 - DNA, 201 bp, Homo sapiens; identical to SEQ ID NO: 3192

SEQ ID NO: 15383 - DNA, 201 bp, Homo sapiens; identical to SEQ ID NO: 3193

SEQ ID NO: 15384 - DNA, 201 bp, Homo sapiens
aacacaattatatttcattcattcattcaacaaaaattaacttagtgcctactatgtggcagatatacttttatattctgtagatacaactttgatcaaarcaacccaaagcccctgtgcttgtgccttccattctagaggcttcttgagagtaagatggagccattagaggcttttaagtgaagaaatgaaacaatctga

SEQ ID NO: 15385 - DNA, 201 bp, Homo sapiens
ttgatcaaaacaacccaaagcccctgtgcttgtgccttccattctagaggcttcttgagagtaagatggagccattagaggcttttaagtgaagaaatgamacaatctgactcacattagcaggattgctgacctttgtggggagaacagtcatgggcagcaggcaagggacagagctagggccagggacagagctagggc

SEQ ID NO: 15386 - DNA, 201 bp, Homo sapiens
atggagccattagaggcttttaagtgaagaaatgaaacaatctgactcacattagcaggattgctgacctttgtggggagaacagtcatgggcagcaggcragggacagagctagggccagggacagagctagggccacaattcagtagtgacagagtagtagagactaaggggagaggagggcctgaaggatgacaggaa

SEQ ID NO: 15387 - DNA, 201 bp, Homo sapiens
ttttaagtgaagaaatgaaacaatctgactcacattagcaggattgctgacctttgtggggagaacagtcatgggcagcaggcaagggacagagctagggmcagggacagagctagggccacaattcagtagtgacagagtagtagagactaaggggagaggagggcctgaaggatgacaggaacagagagaagggctgga

SEQ ID NO: 15388 - DNA, 201 bp, Homo sapiens
caagggacagagctagggccagggacagagctagggccacaattcagtagtgacagagtagtagagactaaggggagaggagggcctgaaggatgacaggracagagagaagggctggagaagcaggaggtgaggtaaaggaacagaaagaattctaaagcaatggaattctcagacttaaatacagtgttttatagattt

SEQ ID NO: 15389 - DNA, 201 bp, Homo sapiens
aattagaagccctccccactgtctactctgatagcccgaaggaaacagggaccttaatcctacaattgccagaaaccgaattctgccaacaaactctacayaagcttgggggagaaccccaatcttaagatgaggatacaactttgcgaaactctgaacaaagagtctatcacgttaggcctggatttctgatgaaggaaa

SEQ ID NO: 15390 - DNA, 201 bp, Homo sapiens
ataactagtgatgaaatagcaataagaatggaaaacatgaaagagatgcttgtacagcaatgatagcagcacaaaagaacagtgtttttcagaatcatacwggagtccaaatcacttctaccacatctaattaaaaaacacagtgaaagatgttaaactttcataggatgcccactgaatagccagttattgaaaaatctt

SEQ ID NO: 15391 - DNA, 201 bp, Homo sapiens
gtcctcctgggaccagacaataagaagctaaagcctcttccaaaagccatgtgagagattcttgtgtcttgtgaatccctggccccatttgagccctcagrtgattcagccctggaagacaactagactgcaacgttgtgagaggccctgagccagaagcattcagagaaacttctcctggattcctgaccatggataact

SEQ ID NO: 15392 - DNA, 201 bp, Homo sapiens
ggagcccatgggggagctcagccaccccaaaattcctcctttagtcacatcacctgtgggctctgaccagattttgtttttgttccaccccaaacaggaasagtacccagggctctgatgtgtctctcacggcttgtaaaagtgacaccttagagggcctgaagtgaaagaggagttgggcagaggggacacaactaagct

SEQ ID NO: 15393 - DNA, 201 bp, Homo sapiens
tcatttgaccctgggctaattggcaactctctacattgtctggcatacagtgttcaatctgatgtgcaaggcaattgtatcttgcaaagaatttgagaatktgatatgttgctcacattttaccacacatacaagtggattaaacttttacacagtaaaaaaaaaaagcattgttgagcaaaataaattaaatgaaaagac

SEQ ID NO: 15394 - DNA, 201 bp, Homo sapiens
aaattcctcctttagtcacatcacctgtgggctctgaccagattttgtttttgttccaccccaaacaggaacagtacccagggctctgatgtgtctctcahggcttgtaaaagtgacaccttagagggcctgaagtgaaagaggagttgggcagaggggacacaactaagctctggagattctttgatttggaatttttca

SEQ ID NO: 15395 - DNA, 201 bp, Homo sapiens; identical to SEQ ID NO: 3202

SEQ ID NO: 15396 - DNA, 201 bp, Homo sapiens
agggggcaccctggcaaggagacatttaaatgagagtccatggaaatacacattatggctgcccccagggatgtttgaatagtatgtgtccagatacaagmaggtgagaagaggaggaggcagggctgctatcacacaaggagggcaggagatgtgtgtgtggaaataagagatccacttggagaccttatggttcccctt

SEQ ID NO: 15397 - DNA, 201 bp, Homo sapiens
tcccaaagggggcaccctggcaaggagacatttaaatgagagtccatggaaatacacattatggctgcccccagggatgtttgaatagtatgtgtccagayacaagcaggtgagaagaggaggaggcagggctgctatcacacaaggagggcaggagatgtgtgtgtggaaataagagatccacttggagaccttatggtt

SEQ ID NO: 15398 - DNA, 201 bp, Homo sapiens; identical to SEQ ID NO: 3149

SEQ ID NO: 15399 - DNA, 201 bp, Homo sapiens
tcatctccaatatctgggctctgtaggggaggaggtcctggtttcccaaagggggcaccctggcaaggagacatttaaatgagagtccatggaaatacachttatggctgcccccagggatgtttgaatagtatgtgtccagatacaagcaggtgagaagaggaggaggcagggctgctatcacacaaggagggcaggaga

SEQ ID NO: 15400 - DNA, 201 bp, Homo sapiens
cacttctcatctccaatatctgggctctgtaggggaggaggtcctggtttcccaaagggggcaccctggcaaggagacatttaaatgagagtccatggaahtacacattatggctgcccccagggatgtttgaatagtatgtgtccagatacaagcaggtgagaagaggaggaggcagggctgctatcacacaaggagggc

SEQ ID NO: 15401 - DNA, 201 bp, Homo sapiens; identical to SEQ ID NO: 3151

SEQ ID NO: 15402 - DNA, 201 bp, Homo sapiens
ataatataaaagtaaagaaaaggaagttgttaatggaatatgaaaaaatgcctagggtgattctatagccaagacagtaccttttaacatttaatttctgyctccaactgaatgttttcagaacacatgagcaacacaagctctttcccattcttggtacaagcacttgagaaatcaaattagccttatctagtatgatta

SEQ ID NO: 15403 - DNA, 201 bp, Homo sapiens; identical to SEQ ID NO: 3153

SEQ ID NO: 15404 - DNA, 201 bp, Homo sapiens; identical to SEQ ID NO: 3152

SEQ ID NO: 15405 - DNA, 201 bp, Homo sapiens
cacagaatctattttacttgtgtgtgtagtatctctttgagttaacagatatttgttctattaagctactaaattttgaggtagtttgtgacacagcactwgataactattaaggctttcttaagtttccattattccatggatattatctacatatcttttaatcccttgcattttaataacattagctatacttgctgt

SEQ ID NO: 15406 - DNA, 201 bp, Homo sapiens; identical to SEQ ID NO: 3155

SEQ ID NO: 15407 - DNA, 201 bp, Homo sapiens; identical to SEQ ID NO: 3154

SEQ ID NO: 15408 - DNA, 201 bp, Homo sapiens; identical to SEQ ID NO: 3157

SEQ ID NO: 15409 - DNA, 201 bp, Homo sapiens; identical to SEQ ID NO: 3156

SEQ ID NO: 15410 - DNA, 201 bp, Homo sapiens; identical to SEQ ID NO: 3160

SEQ ID NO: 15411 - DNA, 201 bp, Homo sapiens; identical to SEQ ID NO: 3159

SEQ ID NO: 15412 - DNA, 201 bp, Homo sapiens; identical to SEQ ID NO: 3158

SEQ ID NO: 15413 - DNA, 201 bp, Homo sapiens; identical to SEQ ID NO: 3162

SEQ ID NO: 15414 - DNA, 201 bp, Homo sapiens; identical to SEQ ID NO: 3161

SEQ ID NO: 15415 - DNA, 201 bp, Homo sapiens; identical to SEQ ID NO: 3163

SEQ ID NO: 15416 - DNA, 201 bp, Homo sapiens; identical to SEQ ID NO: 3165

SEQ ID NO: 15417 - DNA, 201 bp, Homo sapiens; identical to SEQ ID NO: 3168

SEQ ID NO: 15418 - DNA, 201 bp, Homo sapiens
ccacctgcacctcccaggggctgccagccacacagagtcatggacaggtctctacagacacaacttagtgccagcttggatgaaaccctctgaggaatggstgccatctttcaggatgtggtgcatgtattgaatcaaagatgtctctatagtgctgtgtttacagaaggaagaatacgtgggtccaaaaaccaagaagta

SEQ ID NO: 15419 - DNA, 201 bp, Homo sapiens; identical to SEQ ID NO: 3169

SEQ ID NO: 15420 - DNA, 201 bp, Homo sapiens
ctttgtattgagatgtcctggactcgcacacacaaactcagagctatgaaataaagatactgtaaaaatacaacagaccagagtcacagatacacagtctrggaaagtaaaacttcactttgtgagtctaattgcaatgcgtttagacatatttatatataatggggccaaaaatcatctcttttacaaattagattcgtg

SEQ ID NO: 15421 - DNA, 201 bp, Homo sapiens
tataatggggccaaaaatcatctcttttacaaattagattcgtgaccattcaggggctaccaagattgtgctacccactgtagcacaatcggagacccacsccgaggctgcgggactcgtggagaccctcgacacaagaaccccaggtgcctatacccgattccattttcagttcaggcccaaatccccgggggattgatc

SEQ ID NO: 15422 - DNA, 201 bp, Homo sapiens
aaaaatcatctcttttacaaattagattcgtgaccattcaggggctaccaagattgtgctacccactgtagcacaatcggagacccacgccgaggctgcgrgactcgtggagaccctcgacacaagaaccccaggtgcctatacccgattccattttcagttcaggcccaaatccccgggggattgatcggggcagaggag

SEQ ID NO: 15423 - DNA, 201 bp, Homo sapiens
gacccggaccggagcctcttcgcgcggggatgaacataccctacgatggcgccagttacctcgtcctaaaccaggaactgctctcttggaccgcagcggahaaggcggctcagatgttctggaggaggaacatgcagagctgctcaaaacctacctgccgggaaggtgggcggagtggctcagcaaaggccttaagaatga

SEQ ID NO: 15424 - DNA, 201 bp, Homo sapiens
gaagaggttttgcagatatatttaaagtccccagtcagttgactttaagatgaggattatcctgcttagacggtcctaatcaggtaagctctgaaaaggaytgggttcttcctgagaatagagactcacagtgtgagagggattcagcgtgaggggcttcctccactttgggctttgaaaatggagggatcatggggaaag

SEQ ID NO: 15425 - DNA, 201 bp, Homo sapiens
ttcgcgcggggatgaacataccctacgatggcgccagttacctcgtcctaaaccaggaactgctctcttggaccgcagcggaaaaggcggctcagatgttytggaggaggaacatgcagagctgctcaaaacctacctgccgggaaggtgggcggagtggctcagcaaaggccttaagaatgagaaggagaggctgcaatg

SEQ ID NO: 15426 - DNA, 201 bp, Homo sapiens
tttttgatcttcaacttgtatgttctatttaaacatgaaaggaagatccaggctatgctaggctgattctatgatgacaccccaataaccacccttggttwctcaggttaccccagttactcagttgacactaaagcaggtgctgctgtgaagaggttttgcagatatatttaaagtccccagtcagttgactttaagatg

SEQ ID NO: 15427 - DNA, 201 bp, Homo sapiens
ctcgtcctaaaccaggaactgctctcttggaccgcagcggaaaaggcggctcagatgttctggaggaggaacatgcagagctgctcaaaacctacctgccsggaaggtgggcggagtggctcagcaaaggccttaagaatgagaaggagaggctgcaatgcgcaggtaccagaggccacgggtcgcctccctgatctcctg

SEQ ID NO: 15428 - DNA, 201 bp, Homo sapiens
cagatgttctggaggaggaacatgcagagctgctcaaaacctacctgccgggaaggtgggcggagtggctcagcaaaggccttaagaatgagaaggagagkctgcaatgcgcaggtaccagaggccacgggtcgcctccctgatctcctgcagatatccctgagccaccttccaaaagaaggggaggaaaatgggaccaac

SEQ ID NO: 15429 - DNA, 201 bp, Homo sapiens
gtccatgtgactaggaagtgagtcctcctgggaccagacaataagaagctaaagcctcttccaaaagccatgtgagagattcttgtgtcttgtgaatcccyggccccatttgagccctcaggtgattcagccctggaagacaactagactgcaacgttgtgagaggccctgagccagaagcattcagagaaacttctcctg

SEQ ID NO: 15430 - DNA, 201 bp, Homo sapiens; identical to SEQ ID NO: 3174

SEQ ID NO: 15431 - DNA, 201 bp, Homo sapiens
tctttgatactcctcctttccagaagtgcagcttcattccctccctgttcgtgtggcctggacttaatgactcacttctaactgatagagtaatgctgacwtaatagtttgtgattctgggtgtagaacataagactcactgaagtttctactttggttctttctttctctggaatcatgagccctgggggaagctggctg

SEQ ID NO: 15432 - DNA, 201 bp, Homo sapiens; identical to SEQ ID NO: 3175

SEQ ID NO: 15433 - DNA, 201 bp, Homo sapiens
accctgaaacaataatgttaattttgcttttaacatgtttataaattctttgatactcctcctttccagaagtgcagcttcattccctccctgttcgtgtrgcctggacttaatgactcacttctaactgatagagtaatgctgacataatagtttgtgattctgggtgtagaacataagactcactgaagtttctacttt

SEQ ID NO: 15434 - DNA, 201 bp, Homo sapiens
gcattcctgagccactggctcagaatttcagtacattatctgcccgcgggacacacctcagagggaaggggatgaagcgtgggccatgatgaccatggaaycccctggtcttatcaccacctgcacctcccaggggctgccagccacacagagtcatggacaggtctctacagacacaacttagtgccagcttggatgaaa

SEQ ID NO: 15435 - DNA, 201 bp, Homo sapiens
tggcattcctgagccactggctcagaatttcagtacattatctgcccgcgggacacacctcagagggaaggggatgaagcgtgggccatgatgaccatggmatcccctggtcttatcaccacctgcacctcccaggggctgccagccacacagagtcatggacaggtctctacagacacaacttagtgccagcttggatga

SEQ ID NO: 15436 - DNA, 201 bp, Homo sapiens; identical to SEQ ID NO: 3177

SEQ ID NO: 15437 - DNA, 201 bp, Homo sapiens
cagccagtatcactattggcattcctgagccactggctcagaatttcagtacattatctgcccgcgggacacacctcagagggaaggggatgaagcgtggkccatgatgaccatggaatcccctggtcttatcaccacctgcacctcccaggggctgccagccacacagagtcatggacaggtctctacagacacaactta

SEQ ID NO: 15438 - DNA, 201 bp, Homo sapiens
tctctactcttagaccctcagccagtatcactattggcattcctgagccactggctcagaatttcagtacattatctgcccgcgggacacacctcagaggdaaggggatgaagcgtgggccatgatgaccatggaatcccctggtcttatcaccacctgcacctcccaggggctgccagccacacagagtcatggacaggt

SEQ ID NO: 15439 - DNA, 201 bp, Homo sapiens
aggttaaaaaaggccgggcacggtggctcacgcctgtaatcccagcactttgggaggccgaggcgcgtggatcacaaggtcaggagatcgagaccatcctrgccaacatggtgaaaccccgtctctaataaaaaattacaaaaaaaattagccgggcgtggtggcggtcgcctgtagtcccagctacttgggaggctgagg

SEQ ID NO: 15440 - DNA, 201 bp, Homo sapiens
ctggcacagtgttacttgcaccttggtctttaatgcattctgtggggctgtctaaaacctaattgcctctctaagataaaaaggttaaaaaaggccgggcrcggtggctcacgcctgtaatcccagcactttgggaggccgaggcgcgtggatcacaaggtcaggagatcgagaccatcctggccaacatggtgaaacccc

SEQ ID NO: 15441 - DNA, 201 bp, Homo sapiens; identical to SEQ ID NO: 3183

SEQ ID NO: 15442 - DNA, 201 bp, Homo sapiens
aatacagtgttttatagatttttaatgcatttatccgcaaagcctggcacagtgttacttgcaccttggtctttaatgcattctgtggggctgtctaaaasctaattgcctctctaagataaaaaggttaaaaaaggccgggcacggtggctcacgcctgtaatcccagcactttgggaggccgaggcgcgtggatcacaa

SEQ ID NO: 15443 - DNA, 201 bp, Homo sapiens
tctccttagattgcctgtgctctaggatgcgtcgaacaaactttctctccttctgtccagcacttggggtcacacttgcatcgtggtctgccgccttttccagggatttctggctcacttcccatattcccttacgggtgtgtcccctcataagatgtcgcagactttaagctcatcttggcatctgctccttgaaggact

SEQ ID NO: 15444 - DNA, 201 bp, Homo sapiens
gaacagcaccctcccacatcagagataactctcctacacataacatgcatcagcatcacagaagaatgcacattgtgtgagttctctgtacggggaagttwaaaaaagcaggtcaaactgtgatttggatatatatatatatacttattgtaaaaatctttagagacaatgaaaaggaatagtaaatacaagactcaagat

SEQ ID NO: 15445 - DNA, 201 bp, Homo sapiens
ttaaaaaacacagtgaaagatgttaaactttcataggatgcccactgaatagccagttattgaaaaatcttgttcctagattggagtaaacaatttctgcytaccctagccaaacaaattattgtcatgatgctaagctagtgtatagacagaggtgtgagattcacatttttctaactgcaaagcaccctgattaggcaa

SEQ ID NO: 15446 - DNA, 201 bp, Homo sapiens; identical to SEQ ID NO: 3194

SEQ ID NO: 15447 - DNA, 201 bp, Homo sapiens
tcccaggttcaagcaattctcctacctcagcctcctgagtagctggaattataggcatccaccacgacacccaggtaatttttgtatttttagtagagacrgggtttcaccatattgtccaggttggtctcaaactcctgacctcaggtgatccaccaacttcggccttccaaagtgctgggattacagacatgagccacc

SEQ ID NO: 15448 - DNA, 201 bp, Homo sapiens
gcatccaccacgacacccaggtaatttttgtatttttagtagagacggggtttcaccatattgtccaggttggtctcaaactcctgacctcaggtgatccrccaacttcggccttccaaagtgctgggattacagacatgagccaccattcccggcccacaaatctttaaagtgtcatttttcaaaatgcaccttgtgtgc

SEQ ID NO: 15449 - DNA, 201 bp, Homo sapiens
aaaaaattacaaaaaaaattagccgggcgtggtggcggtcgcctgtagtcccagctacttgggaggctgaggcaggagaacggcgtgaacccgggaggcgrtgcttgcagtgagcgagattgcaccactgcactccagcctgggcgacagagcgagactccgtctcaaaaaaaaaaaaaaaggttaaaaaagaataccaaa

SEQ ID NO: 15450 - DNA, 201 bp, Homo sapiens; identical to SEQ ID NO: 3195

SEQ ID NO: 15451 - DNA, 201 bp, Homo sapiens
aaaatatacacatagcttagatgtgaataattcataataataggcaagtgcatgggccggccattatagctcatgcctgtaataccagcattttgggaggytgaggcgggaggattgcttgagcccaggagttcaagaccagccagagcaatttagggagacctcatctctacaaatattatttttagaaaaattagccag

SEQ ID NO: 15452 - DNA, 201 bp, Homo sapiens; identical to SEQ ID NO: 3196

SEQ ID NO: 15453 - DNA, 201 bp, Homo sapiens
gttatgattgtaaaggcattattgtatggcaccaaagtcttgggacactttaatttagctactgtattttctcaactctgttgcaacttatcaaagagaayattaatattaaaggcatttacaaaaaaaatctgagatattgttgtatcttctttctctgtctcaaatatttaatcaactttacagaagagaattttaaag

SEQ ID NO: 15454 - DNA, 201 bp, Homo sapiens
ttatttttagaaaaattagccaggagtggtggcacaagcctgtggtgccagctacttgggaggctgagggaggagcattgatcacatgagccaaggaggtmgaggcttcagtgagtcatgagcgtgccactgcactttagccagggtaacagagtgacgccctgtctgtaaataaataaaaaataaaaaaattaataataa

SEQ ID NO: 15455 - DNA, 201 bp, Homo sapiens
tcaccatattgtccaggttggtctcaaactcctgacctcaggtgatccaccaacttcggccttccaaagtgctgggattacagacatgagccaccattccyggcccacaaatctttaaagtgtcatttttcaaaatgcaccttgtgtgccattcctgactgattatttggaaatgaaagagaaaagaaaataccaaagttc

SEQ ID NO: 15456 - DNA, 201 bp, Homo sapiens; identical to SEQ ID NO: 3197

SEQ ID NO: 15457 - DNA, 201 bp, Homo sapiens
gattaggcaaatatttttgtagatgcttgagtaagaaaattggcattttgggcattcttaaaccgaattagaaacttctgaagagaaacaaacatagttaygattgtaaaggcattattgtatggcaccaaagtcttgggacactttaatttagctactgtattttctcaactctgttgcaacttatcaaagagaacatta

SEQ ID NO: 15458 - DNA, 201 bp, Homo sapiens
gtgctgggattacagacatgagccaccattcccggcccacaaatctttaaagtgtcatttttcaaaatgcaccttgtgtgccattcctgactgattatttggaaatgaaagagaaaagaaaataccaaagttcatctcaaggatccttagcaataactacacacgttaaaacaaagccacagccaattgtaaagagtcatg

SEQ ID NO: 15459 - DNA, 201 bp, Homo sapiens
gcaccctgattaggcaaatatttttgtagatgcttgagtaagaaaattggcattttgggcattcttaaaccgaattagaaacttctgaagagaaacaaacrtagttatgattgtaaaggcattattgtatggcaccaaagtcttgggacactttaatttagctactgtattttctcaactctgttgcaacttatcaaagag

SEQ ID NO: 15460 - DNA, 201 bp, Homo sapiens; identical to SEQ ID NO: 3199

SEQ ID NO: 15461 - DNA, 201 bp, Homo sapiens; identical to SEQ ID NO: 3201

SEQ ID NO: 15462 - DNA, 201 bp, Homo sapiens
ttaaaaaaggccgggcacggtggctcacgcctgtaatcccagcactttgggaggccgaggcgcgtggatcacaaggtcaggagatcgagaccatcctggcyaacatggtgaaaccccgtctctaataaaaaattacaaaaaaaattagccgggcgtggtggcggtcgcctgtagtcccagctacttgggaggctgaggcag

SEQ ID NO: 15463 - DNA, 201 bp, Homo sapiens
ccagtggatacacagctgcgacctggacccggaccggagcctcttcgcgcggggatgaacataccctacgatggcgccagttacctcgtcctaaaccaggmactgctctcttggaccgcagcggaaaaggcggctcagatgttctggaggaggaacatgcagagctgctcaaaacctacctgccgggaaggtgggcggagt

SEQ ID NO: 15464 - DNA, 201 bp, Homo sapiens
tgttggagttatccttttatcattgtataatgtccctctttgtcttttttaactgttgttgctttaaaatctgttttgactgatataagaatagctactcytgcttgcttttgttttccatttgtatggaatatctttttccactcctttaccttaagtttttgtgagtccttacacattagatgactcttgaagactgaa

SEQ ID NO: 15465 - DNA, 201 bp, Homo sapiens
agagttttgtgaacagaagtatttagaggaagcctgtggggcttgtgggtagggctggtctggtctccagaggacccaaaatcgaggttggagttgagatkggggcaggcctggtgtcctggctgctcatgggccccactggggttacatgtgtgtctcccttaggctgcccatgggccccgggggctgaagggagagaag

SEQ ID NO: 15466 - DNA, 201 bp, Homo sapiens
ggttggagttgagatgggggcaggcctggtgtcctggctgctcatgggccccactggggttacatgtgtgtctcccttaggctgcccatgggccccggggkctgaagggagagaagagagagcctgcagtgctggaacctgtaagtcatgctggtcacagggctgaggtggtggaaagaggagaagcaagtggggtttagt

SEQ ID NO: 15467 - DNA, 201 bp, Homo sapiens
accctgctgctgcatcccacacctcctgctcttggcacccgtgagcttctgctgcctttcctttatgctgctgtctgggtctttggggttgatgtgggatmtgggagaattttgaaacggatcattgctgtcaggatgaaggtggagaggggcattctgaagatctttgttttggggagttggggtggtggtgaatgtttc

SEQ ID NO: 15468 - DNA, 201 bp, Homo sapiens
ctcctgattctctgcagtgcccaggtgtccaacagttgagcctggagccaggccaacttgtcagcttcctgtatgaggatcagactggacgacttcaaccygcttagcccgtcttctgaggcctcaccctagtagttggcaagtaagtctatttgctcctctggtctgcctggcccacacttttgtgagaaagtgccctag

SEQ ID NO: 15469 - DNA, 201 bp, Homo sapiens
gcttataggctgctgttaatctgataggttttcctttataggttacctgatgcttttgcctcacagctcttaagattctttcctttgtcctgactttagayaacctgatgactatgtgcctgggcgataatctttctgtgataaatttcccaggtggtctttgagcttcttgtatttggttgtgtagatctctagcgaggc

SEQ ID NO: 15470 - DNA, 201 bp, Homo sapiens
tgttttgtgcctttcttttcactctgggtcatggtagccatattgttgaaggttcacttcccagatcctcttttcttggctgcttcctgtctgtacagccrcttcctgtttgtccagtttgttttgtggccatcttggccatgtttaattttccttggccctggcatcactcttgcatccaagtgtttgtcattttatttt

SEQ ID NO: 15471 - DNA, 201 bp, Homo sapiens
tcacagggctgaggtggtggaaagaggagaagcaagtggggtttagtgtgctggccctgtcacctgtgagttttaacctttgactccacagggtatgctcktggaggggccccctggtttagaaggccctgtggtgagtctagcagtgacctggtggccattgttttcttagagatccctcctatgtgttcatctgtgcct

SEQ ID NO: 15472 - DNA, 201 bp, Homo sapiens
tgttttgtggccatcttggccatgtttaattttccttggccctggcatcactcttgcatccaagtgtttgtcattttattttgtgtcccttagttgttctmatatcttccagtattctctgtcagttggactgcttcctgtctactctgctacatcttctgcctgccttgcagttatggctgccttttctaccctgctgct

SEQ ID NO: 15473 - DNA, 201 bp, Homo sapiens
cttcaaatcaactgtatgttttcccctagaagtttaaattcagtatgtctcaaacagaaaattttaccttctctcaatcacttaattatcacctttgcagkcacggatgccacaattctccacgttgcgtggttattctcgacttcttcatatccctacttctggcatgtgatttagtgattcctgtggcctctcatgtca

SEQ ID NO: 15474 - DNA, 201 bp, Homo sapiens
tgaggtggtggaaagaggagaagcaagtggggtttagtgtgctggccctgtcacctgtgagttttaacctttgactccacagggtatgctcgtggaggggmcccctggtttagaaggccctgtggtgagtctagcagtgacctggtggccattgttttcttagagatccctcctatgtgttcatctgtgccttccccacat

SEQ ID NO: 15475 - DNA, 201 bp, Homo sapiens
aggggtggtggctctctttgcctctcactctgtgtgtatttctctcgggtaccaggaggatttcctaaagatttctttctcctgactgttttctggacccrtcctggtctccaagctcccctcctgattctctgcagtgcccaggtgtccaacagttgagcctggagccaggccaacttgtcagcttcctgtatgaggatc

SEQ ID NO: 15476 - DNA, 201 bp, Homo sapiens
gaaccctaaactctctgtaattcactgtaataataattcactttttgttatcaaccagttgctgcttcttatgtatcaggtaaagctaagatactatcccrtaggtctttcaaatgccaacaacttgtatttccaggtgaaactacacttgaaaactacactccacaagacaattttgtgaatgttatgtgaatgataata

SEQ ID NO: 15477 - DNA, 201 bp, Homo sapiens
cttcttatgtatcaggtaaagctaagatactatcccataggtctttcaaatgccaacaacttgtatttccaggtgaaactacacttgaaaactacactccwcaagacaattttgtgaatgttatgtgaatgataatacttttaaatttactctgcctaaaatgtaagtgttgtggataaaattatagaaggtatcattttt

SEQ ID NO: 15478 - DNA, 201 bp, Homo sapiens
tcgtcattggtttcaactttcatcaacagatctccaaccctgttgacgcccctgcttcagtcagtcacttgaacctctcactccatgaccaggtggcaccktgtggctatggccatgaagggccagtctgtcaccctcattgttgactgcaagatgtgagtcacccggcctctcccctgaagaactagtccagtgttggac

SEQ ID NO: 15479 - DNA, 201 bp, Homo sapiens
gtggcaggactgtccacagccacttattctatccttcagtcttcatctctccatctatccatcccttgaacctatctctctcctcatccaccccatccatycactcattcaccagtccacctacgcacacatccaccacccactcccgcaaccatttacccacctatgcatcacaaacttacccatctactcatgcatgaa

SEQ ID NO: 15480 - DNA, 201 bp, Homo sapiens
atgagggccagaagaagggcaaagcatcctgctgggagaggaactgtggggtgcattgtagggggctgctctggggcttggataactgagcccaagaactrtatgttttgcaaaaggcagttatgaggcctgagtttggaatatctctgggaaatgctctccaaatttacttggagtatggatacttaacctgtgcagggt

SEQ ID NO: 15481 - DNA, 201 bp, Homo sapiens
tttctttcatttgcatttctcattttctgtgttattccttcatgttcccaataaccttcctgttacctgtttgcttcctgcattctgtgtagcatcctacrtattcacccattctccatcttctccttcatgcagcagaccatgtgtcaacatatgcggagtttgtgcagacgcacagaccctctggggagtatatgtttg

SEQ ID NO: 15482 - DNA, 201 bp, Homo sapiens
gtgtcattagtgtgtttgagatgccccctctcctctttcctggaagttttctcctgtctcttgtcttttatgaacccacttcctctctgttttcctaccamtttctagtcctctgcttttcagcctctttcttcatgtctgtgtttgtctggatgcaggagcacacactcagatccctgctatcctgactttgtgtacttt

SEQ ID NO: 15483 - DNA, 201 bp, Homo sapiens
cattgtacctgttttgtgcctttcttttcactctgggtcatggtagccatattgttgaaggttcacttcccagatcctcttttcttggctgcttcctgtckgtacagccacttcctgtttgtccagtttgttttgtggccatcttggccatgtttaattttccttggccctggcatcactcttgcatccaagtgtttgtca

SEQ ID NO: 15484 - DNA, 201 bp, Homo sapiens
cacccattaactgatgggcatttggggtggttccatatttttgcaattgtgaatcatggtgctgtaaacatgtgtgtgcaagtgtctttttcatacaatgrcttttttcctccagtagtgggattgctggatcaaatggtagatctatttctagttctttaaggcatcgctgtactgttttccataggttgtactagttta

SEQ ID NO: 15485 - DNA, 201 bp, Homo sapiens
caaaatgtgccaacctttagttttcagattttgtaaatataataaatacaaagtaacctaagctgaaccaattacatctgtgtagcccagtctatacaccrtgtatttttctttttcctttgggattcatttctgtaggtgagtaatcctctagaccctaaactcagtgggggaccctcaccatccgtgtgcggcactgaa

SEQ ID NO: 15486 - DNA, 201 bp, Homo sapiens; identical to SEQ ID NO: 3210

SEQ ID NO: 15487 - DNA, 201 bp, Homo sapiens
ttgctgtcaggatgaaggtggagaggggcattctgaagatctttgttttggggagttggggtggtggtgaatgtttcaccttctccccacccttatcttgsctatggcctggatttgggaacaggcatctgaatggaggtgtgcaagggagggaactggttggcttggagtgtacatgagggccagaagaagggcaaagca

SEQ ID NO: 15488 - DNA, 201 bp, Homo sapiens
catgtgtgtgcaagtgtctttttcatacaatggcttttttcctccagtagtgggattgctggatcaaatggtagatctatttctagttctttaaggcatckctgtactgttttccataggttgtactagtttaatttcccaccagtagcatagaagtgttctcttttcatcacacctaccccaacgtctattttttttttt

SEQ ID NO: 15489 - DNA, 201 bp, Homo sapiens
ctttcggcagtgtttttaattttcctcgtacaggtgtttaacctctattgcgggaagtcagggaccctgaatggagggaccggctgaagccacagtggaakaacataaattgtgaagatttcatggacatttatcacttccccaatcaatactcttataacttcctatgcctgtctttactttaatctcttaatcctgtca

SEQ ID NO: 15490 - DNA, 201 bp, Homo sapiens
ggtatggagcgccctccctctgccctcacggccttggcaccacctttatttcctgggcccatcgcccctcagcacctgccttcctcaatcccatgttttayggtcactttatccaaatttcaccatctcatggtttcgaatacccaacacctcccacatccaaggccagcccctgctctctgtaccttataactctgtctt

SEQ ID NO: 15491 - DNA, 201 bp, Homo sapiens; identical to SEQ ID NO: 3211

SEQ ID NO: 15492 - DNA, 201 bp, Homo sapiens
gttctttaaggcatcgctgtactgttttccataggttgtactagtttaatttcccaccagtagcatagaagtgttctcttttcatcacacctaccccaacrtctatttttttttttatttttaaattatgaccattgttacaggagtaagttggtatcacatagtggttttgatttgcatttccctgataattagtgatgt

SEQ ID NO: 15493 - DNA, 201 bp, Homo sapiens
ccatctgctgtcctcctcaccccatgttcctgccctggcctacgccttcattacttcccaccagagggcttaaaagtgctactggtcttgccttgagtccmgcctcctccagcccatccttcctacaggtgccccatccaaacacaaatctgaccgtgttactctcctgcttaagatacttcacaacttcctatgtcctgt

SEQ ID NO: 15494 - DNA, 201 bp, Homo sapiens
ctctgcagtgcccaggtgtccaacagttgagcctggagccaggccaacttgtcagcttcctgtatgaggatcagactggacgacttcaacctgcttagccsgtcttctgaggcctcaccctagtagttggcaagtaagtctatttgctcctctggtctgcctggcccacacttttgtgagaaagtgccctagaacctgtac

SEQ ID NO: 15495 - DNA, 201 bp, Homo sapiens
ttacaggagtaagttggtatcacatagtggttttgatttgcatttccctgataattagtgatgtagagcattttttcatatgtttgtcaaccatttgtatrttttcttttgagaattgtctgttcctctgcttagcccactttttgatgggagtatttgtttatttcttgctgatttgtttgagttttttgtagattctgg

SEQ ID NO: 15496 - DNA, 201 bp, Homo sapiens
acatttgaagtgtggaatttgcttcaaaatgtgccaacctttagttttcagattttgtaaatataataaatacaaagtaacctaagctgaaccaattacakctgtgtagcccagtctatacaccatgtatttttctttttcctttgggattcatttctgtaggtgagtaatcctctagaccctaaactcagtgggggaccc

SEQ ID NO: 15497 - DNA, 201 bp, Homo sapiens
ttttataccattcccatgctgttttggtgactatagccttgcagtatattttgaagtcaggtaatgtgatgctccagatttattcgttttgcttaatcttrctttggctatgtgggctcttttgtagttccatatgaattttaggattgtttttttctagctctgtaaagaatgatgatggcattttgatggggattgcat

SEQ ID NO: 15498 - DNA, 201 bp, Homo sapiens
tagtgattcctgtggcctctcatgtcattactgccatcaaatccatctgctgtcctcctcaccccatgttcctgccctggcctacgccttcattacttccyaccagagggcttaaaagtgctactggtcttgccttgagtcccgcctcctccagcccatccttcctacaggtgccccatccaaacacaaatctgaccgtgt

SEQ ID NO: 15499 - DNA, 201 bp, Homo sapiens
gtaatgtgatgctccagatttattcgttttgcttaatcttactttggctatgtgggctcttttgtagttccatatgaattttaggattgtttttttctagytctgtaaagaatgatgatggcattttgatggggattgcattgaatttgtagattgcttttggcagtatggtcattttcacaatgttgattctacccttcc

SEQ ID NO: 15500 - DNA, 201 bp, Homo sapiens
ttgagtcccgcctcctccagcccatccttcctacaggtgccccatccaaacacaaatctgaccgtgttactctcctgcttaagatacttcacaacttcctrtgtcctgtgggataaaatgcaaacacttgccatcagcacacaaggcaggttacagtgctgcctggcccacatctcccctggcttcagtcacactgaagaa

SEQ ID NO: 15501 - DNA, 201 bp, Homo sapiens
gtctccagaggacccaaaatcgaggttggagttgagatgggggcaggcctggtgtcctggctgctcatgggccccactggggttacatgtgtgtctccctyaggctgcccatgggccccgggggctgaagggagagaagagagagcctgcagtgctggaacctgtaagtcatgctggtcacagggctgaggtggtggaaag

SEQ ID NO: 15502 - DNA, 201 bp, Homo sapiens
cacacctcctgctcttggcacccgtgagcttctgctgcctttcctttatgctgctgtctgggtctttggggttgatgtgggatctgggagaattttgaaayggatcattgctgtcaggatgaaggtggagaggggcattctgaagatctttgttttggggagttggggtggtggtgaatgtttcaccttctccccaccctt

SEQ ID NO: 15503 - DNA, 201 bp, Homo sapiens
cttctctcaatcacttaattatcacctttgcaggcacggatgccacaattctccacgttgcgtggttattctcgacttcttcatatccctacttctggcaygtgatttagtgattcctgtggcctctcatgtcattactgccatcaaatccatctgctgtcctcctcaccccatgttcctgccctggcctacgccttcatt

SEQ ID NO: 15504 - DNA, 201 bp, Homo sapiens
cagggctgaggtggtggaaagaggagaagcaagtggggtttagtgtgctggccctgtcacctgtgagttttaacctttgactccacagggtatgctcgtgraggggccccctggtttagaaggccctgtggtgagtctagcagtgacctggtggccattgttttcttagagatccctcctatgtgttcatctgtgccttcc

SEQ ID NO: 15505 - DNA, 201 bp, Homo sapiens
actcccgcaaccatttacccacctatgcatcacaaacttacccatctactcatgcatgaaggcttatatccactcacctgtccatcctccccctgcttaaygactctccccttctttacacacatctattcgactatgcttttgttcatctgtcctcttcaacttatccatccatctattcactcacccacccactcacac

SEQ ID NO: 15506 - DNA, 201 bp, Homo sapiens
gagatgggggcaggcctggtgtcctggctgctcatgggccccactggggttacatgtgtgtctcccttaggctgcccatgggccccgggggctgaagggaragaagagagagcctgcagtgctggaacctgtaagtcatgctggtcacagggctgaggtggtggaaagaggagaagcaagtggggtttagtgtgctggccc

SEQ ID NO: 15507 - DNA, 201 bp, Homo sapiens
tcatggtttcgaatacccaacacctcccacatccaaggccagcccctgctctctgtaccttataactctgtcttcccttggtgccccagaggtccatgaamtaatccaggtgcctgagaccatggagatgctggtctgtgccctcggcctgctggtgggcctggcgggggtccttaatggcaccattgtctcaaagaccaa

SEQ ID NO: 15508 - DNA, 201 bp, Homo sapiens
cctgctctctgtaccttataactctgtcttcccttggtgccccagaggtccatgaactaatccaggtgcctgagaccatggagatgctggtctgtgccctsggcctgctggtgggcctggcgggggtccttaatggcaccattgtctcaaagaccaagcgatctgacagcatccccgggtccaggggctcctatgagtcat

SEQ ID NO: 15509 - DNA, 201 bp, Homo sapiens
tgtgtagatctctagcgaggccagggaagttttccttgattattccctcaaatatgttttccaaacttttagatttttgttcttcctcaagaatgccaatyattcttaggtcatttaacataatcccaaatttcttggaggctttgtttatttattaaagttcttttttctttgtctttgtctgactgggttaattcgaaa

SEQ ID NO: 15510 - DNA, 201 bp, Homo sapiens
cacggtgagggaggtaatggggtggggtctggaatcagacaccaggaggaaaggggtggtggctctctttgcctctcactctgtgtgtatttctctcgggyaccaggaggatttcctaaagatttctttctcctgactgttttctggacccgtcctggtctccaagctcccctcctgattctctgcagtgcccaggtgtcc

SEQ ID NO: 15511 - DNA, 201 bp, Homo sapiens
ttcttcctcaagaatgccaatcattcttaggtcatttaacataatcccaaatttcttggaggctttgtttatttattaaagttcttttttctttgtctttktctgactgggttaattcgaaaggcttgttgtttgagctatgaagttctttcttctacttgttggatcctattgttgaaactttccagtgcattttgtatt

SEQ ID NO: 15512 - DNA, 201 bp, Homo sapiens
gaggctttgtttatttattaaagttcttttttctttgtctttgtctgactgggttaattcgaaaggcttgttgtttgagctatgaagttctttcttctacytgttggatcctattgttgaaactttccagtgcattttgtatttctctaagtgtgtctttcatttccagaagttggattgtttcttctttatgatatctac

SEQ ID NO: 15513 - DNA, 201 bp, Homo sapiens
ttcctatcttcaggactgctgatctctgcagaataactagatgtccacttatgtggcaggactgtccacagccacttattctatccttcagtcttcatctytccatctatccatcccttgaacctatctctctcctcatccaccccatccatccactcattcaccagtccacctacgcacacatccaccacccactcccgc

SEQ ID NO: 15514 - DNA, 201 bp, Homo sapiens
taaatgtcatttacccttttcgttctgaatctcctgtattttccttaggagtcttgccagaggtctcattaaagttttcattgcctcaaaatttgattttrtcttctctatttttatatttcattgaattcagcttttgtccttattatttacatgtattttctttttgctgtttttctgcttttccatcctcttaattca

SEQ ID NO: 15515 - DNA, 201 bp, Homo sapiens
ttattctatccttcagtcttcatctctccatctatccatcccttgaacctatctctctcctcatccaccccatccatccactcattcaccagtccacctaygcacacatccaccacccactcccgcaaccatttacccacctatgcatcacaaacttacccatctactcatgcatgaaggcttatatccactcacctgtcc

SEQ ID NO: 15516 - DNA, 201 bp, Homo sapiens
catcgtcattggtttcaactttcatcaacagatctccaaccctgttgacgcccctgcttcagtcagtcacttgaacctctcactccatgaccaggtggcamcttgtggctatggccatgaagggccagtctgtcaccctcattgttgactgcaagatgtgagtcacccggcctctcccctgaagaactagtccagtgttgg

SEQ ID NO: 15517 - DNA, 201 bp, Homo sapiens
ctgaatggaggtgtgcaagggagggaactggttggcttggagtgtacatgagggccagaagaagggcaaagcatcctgctgggagaggaactgtggggtgyattgtagggggctgctctggggcttggataactgagcccaagaactgtatgttttgcaaaaggcagttatgaggcctgagtttggaatatctctgggaaa

SEQ ID NO: 15518 - DNA, 201 bp, Homo sapiens
agggaactggttggcttggagtgtacatgagggccagaagaagggcaaagcatcctgctgggagaggaactgtggggtgcattgtagggggctgctctggrgcttggataactgagcccaagaactgtatgttttgcaaaaggcagttatgaggcctgagtttggaatatctctgggaaatgctctccaaatttacttgga

SEQ ID NO: 15519 - DNA, 201 bp, Homo sapiens
ggccccactggggttacatgtgtgtctcccttaggctgcccatgggccccgggggctgaagggagagaagagagagcctgcagtgctggaacctgtaagtyatgctggtcacagggctgaggtggtggaaagaggagaagcaagtggggtttagtgtgctggccctgtcacctgtgagttttaacctttgactccacaggg

SEQ ID NO: 15520 - DNA, 201 bp, Homo sapiens; identical to SEQ ID NO: 3216

SEQ ID NO: 15521 - DNA, 201 bp, Homo sapiens; identical to SEQ ID NO: 3217

SEQ ID NO: 15522 - DNA, 201 bp, Homo sapiens; identical to SEQ ID NO: 3218

SEQ ID NO: 15523 - DNA, 201 bp, Homo sapiens
catgacatttcaattcatctctgcaaatgaaaagggttcttcctcttgggggaaatctgtgtgtcagttctgtcagctgcaagttcttgtgtaatgaagtsaatgctgtcaggccaagtgaagggaaaagagagatcagactgttactgtgtctatgtagaaaggaaagacataagagactccattttgaaaaagacctgt

SEQ ID NO: 15524 - DNA, 201 bp, Homo sapiens
acccaggaggtggaggttgcagtgagccaggatagcgccactgcactccagcttgggagacagagtgagactccctctcaaaaaataaaaaatagccggamgcggtggctcacgcctgtaatcccagcactttgggaggccgaggcgggtgggtcacgaggtcaggagatcgagaccatcctggctaacatggtgaaaccc

SEQ ID NO: 15525 - DNA, 201 bp, Homo sapiens; identical to SEQ ID NO: 3220

SEQ ID NO: 15526 - DNA, 201 bp, Homo sapiens; identical to SEQ ID NO: 3221
  misc_feature (1)...(201): n = A,T,C or G, or insertion/deletion polymorphism (see Tables 1-2)

SEQ ID NO: 15527 - DNA, 201 bp, Homo sapiens
taatcccaggtactcgggaggttgaggcaggagaattgcttgaacccaggaggtggaggttgcagtgagccaggatagcgccactgcactccagcttgggmgacagagtgagactccctctcaaaaaataaaaaatagccggacgcggtggctcacgcctgtaatcccagcactttgggaggccgaggcgggtgggtcacg

SEQ ID NO: 15528 - DNA, 201 bp, Homo sapiens
tggtgggctctcataatcccaggtactcgggaggttgaggcaggagaattgcttgaacccaggaggtggaggttgcagtgagccaggatagcgccactgcmctccagcttgggagacagagtgagactccctctcaaaaaataaaaaatagccggacgcggtggctcacgcctgtaatcccagcactttgggaggccgagg

SEQ ID NO: 15529 - DNA, 201 bp, Homo sapiens; identical to SEQ ID NO: 3222
  misc_feature (1)...(201): n = A,T,C or G, or insertion/deletion polymorphism (see Tables 1-2)

SEQ ID NO: 15530 - DNA, 201 bp, Homo sapiens; identical to SEQ ID NO: 3223

SEQ ID NO: 15531 - DNA, 201 bp, Homo sapiens; identical to SEQ ID NO: 3224

SEQ ID NO: 15532 - DNA, 201 bp, Homo sapiens; identical to SEQ ID NO: 3225

SEQ ID NO: 15533 - DNA, 201 bp, Homo sapiens
tcattatatccaaaaaacctgtcttcctttttctagtaaaaggaaaaagcacaattctgaattgtttgcgtgggtgttaaatgcagtaaaacactgggcargtacttacaataaaggcttcactgcttggttctgtttcaaaacagagtttgtggccgtgcagtttaatctgtacagctaagctgcatgataaagtagtta

SEQ ID NO: 15534 - DNA, 201 bp, Homo sapiens
acagaattgcgactagaagctgggtttcctacatttgtagctccatctccccccgcagacaagagtttttgactagagaaggccagccttttcctgtgttrtgcaaaaaggcccttaggattgtaacattttctttggaacgatcttacgcatcttctaacagggaaaaagggactttactatagaggcacttggtgccaa

SEQ ID NO: 15535 - DNA, 201 bp, Homo sapiens
gaatcaattaggtagtttcttattgttttagtgtagtacttagtagtcagtactttgcccgcttatagaagaatctttggtttcacctattgcttggctcrattagttacttgtttcttaattatgaccctgttgtttatttttctgcaaagagaaaagttgtcatttgagtttgaactttgtcttttcccagtagtaaag

SEQ ID NO: 15536 - DNA, 201 bp, Homo sapiens
gacttagtgttttgggagtatgttgaaagagaatcttgtttttatggattacttcagtattatttaccaatttcaaaatctgtgaatgtcagggttgtgtktgtgtgtgtgtgtgtgtgtgtgtgtgtgtgatttgacaaaagataagtgttttggtattgaagactagaaccgtttcgcctttaataaattattttttgt

SEQ ID NO: 15537 - DNA, 201 bp, Homo sapiens
gggtatacaatgtgaacggtaaccgatctacttaattaaaactttctggcattttagcctctttgcttttgctggtttttttgcacataatttgaaacacrtaattattattttctggcttcaggggagtttgtgagaggcaagcctgtatctcgttgttctgattgggaattacacatgactatgaaaaatgggatttta

SEQ ID NO: 15538 - DNA, 201 bp, Homo sapiens
atctgtgaatgtcagggttgtgtgtgtgtgtgtgtgtgtgtgtgtgtgtgtgtgatttgacaaaagataagtgttttggtattgaagactagaaccgtttygcctttaataaattattttttgtcttctgaaattttgagcaataattttcttgaaatactacattttggtagatagagtgaatgccctgaatttaaaact

SEQ ID NO: 15539 - DNA, 201 bp, Homo sapiens
agatatattactctttggatatggttatctagtttgcagcaagtatcttgtgatatatagcttagatctcagcaggaaagaaaaaaatcttaatttacatwtcagtttctgtatttgtaagaattctgtagcaagtgacagaaacgctgttgagattaatgtaggctaagaagaaatttattgacttacatacattaaaat

SEQ ID NO: 15540 - DNA, 201 bp, Homo sapiens
tagatcctcgcctccatacccctatgtatttcttcctctccaatctctcttttatggatctttgtttgaccacttgtactgtccctcagacactggtcaaytttaaggggaaggacaagaccatcacctatggtggctgcgtgacccagctattcattgccttgggactcggggggagtggagtgtgtcttattgtctgcc

SEQ ID NO: 15541 - DNA, 201 bp, Homo sapiens
cacaggatgtgaacaaaagcattgcactcttctatactctggtgactcctctactgaatcccctaatttacactctgaggaacaaggaagtcaaaggggcaactaagaagactagtggggaggaccatagatgcatgagaaagttaacgcagggtttgcagttccaaacatttgtgcactagaagactgctgagaagctac

SEQ ID NO: 15542 - DNA, 201 bp, Homo sapiens
acttgtactgtccctcagacactggtcaactttaaggggaaggacaagaccatcacctatggtggctgcgtgacccagctattcattgccttgggactcgsggggagtggagtgtgtcttattgtctgccatggcctatgaccgctatgcagccgtctgccgcccactccactacatggtgagcatgcatccccaactttg

SEQ ID NO: 15543 - DNA, 201 bp, Homo sapiens
ggctgcgtgacccagctattcattgccttgggactcggggggagtggagtgtgtcttattgtctgccatggcctatgaccgctatgcagccgtctgccgcycactccactacatggtgagcatgcatccccaactttgcttgcagttggttgtaaccacttggctcacagggtttggcaattctgtgatacagacagcatt

SEQ ID NO: 15544 - DNA, 201 bp, Homo sapiens
  misc_feature (1)...(201): n = A,T,C or G, or insertion/deletion polymorphism (see Tables 1-2)
ctcgtgaccagtgcctacagtattggatagatcaaactcagattattaaaacagtgatagccaacctgtatgtaagagacctgcctcactcaggtcaactngaaccacatatggtcagtttctggtagtaaaagagtctatagatttttctgaacagtatttcctgccctggatcaggggtcactaggttatggtaggcca

SEQ ID NO: 15545 - DNA, 201 bp, Homo sapiens
atatgggttaattctaagcaccttttaaaaaattatatttcttcttttcttttttccataaagcattttataattagaaagcagaaataaagagtaccttytggaaaagaaaaactctgttagcaagaacacaggactggttatgtgatgtgagaggaggcatcattcctgcagaagccctatcctacatggagaaggaca

SEQ ID NO: 15546 - DNA, 201 bp, Homo sapiens
gaagttccctgaagagtccaggagagtcgtggtggcaggggtgccttggttctggggccatggaggagcttcaagcttgagaaggctgctctataggtgcrtggtttcattgaccctgctcctgcatcatttcaggaatcaaggtctgtgagaagcgacccagcatagatctatgcatccaccactgttcatatttccaaa

SEQ ID NO: 15547 - DNA, 201 bp, Homo sapiens
aaagcagaaataaagagtaccttttggaaaagaaaaactctgttagcaagaacacaggactggttatgtgatgtgagaggaggcatcattcctgcagaagycctatcctacatggagaaggacagggccaggagaaggcaagggcaggaagcaaggactcttgctctgccctgacttgtccagtggaggcagcgaggagct

SEQ ID NO: 15548 - DNA, 201 bp, Homo sapiens
aaaaaaaaaaaaaaaaagaaaaagaaatacctgttggaacttgattggaattgcattgtaatgccgtcttaataattttaagtcttccaatatagaatatrggatgtcagctaggtgtggtggctcacgcctataatctcagcactttgagaggccaaggcaggtggtttgcttgagctcaggagttcgagatcagcctgg

SEQ ID NO: 15549 - DNA, 201 bp, Homo sapiens
actttcttcccaatttggatgacttttatttctttttattacttgattgctttggttagaactccattacaatgttgactagcagtggtgaaagatgcatycttgtcttatttctgatcttgggagaaagattttgatcttttgcaattgagtataatgatcattgtatatagttttttataggtacctttaatcatgtta

SEQ ID NO: 15550 - DNA, 201 bp, Homo sapiens
tggtgaaagatgcatccttgtcttatttctgatcttgggagaaagattttgatcttttgcaattgagtataatgatcattgtatatagttttttataggtrcctttaatcatgttaaggaagtcctttatttcctagttttctgaattttttttaattatagaagggtggtgaattttgtgaaatgctttttctgtatcag

SEQ ID NO: 15551 - DNA, 201 bp, Homo sapiens
  misc_feature (1)...(201): n = A,T,C or G, or insertion/deletion polymorphism (see Tables 1-2)
gaagaataagcatcattatgttgacttcctatttcctcccctacccccaagtatttcagttcaaagctaagacctacctgccctgggagagtcttccctangtccacaacccacaatctcctttctattcctggactctaaagatgggccccattaatccctttccccaagcccttccaggtcctaatttttgtaccttgt

SEQ ID NO: 15552 - DNA, 201 bp, Homo sapiens
  misc_feature (1)...(201): n = A,T,C or G, or insertion/deletion polymorphism (see Tables 1-2)
tttcaagtcttgacccctcttctgggtatctggtcccaacttcactcacagcatttaccagtcttttagaaagcctctttgtgcctttcctcaaattctgnttctccaattaactctaccctgggcactcctattttcttgtagcttgcttagtccctcttagtcctacaaacctgcatgccttttctgaaacttcttaag

SEQ ID NO: 15553 - DNA, 201 bp, Homo sapiens
aagagaaggaaagagggcaaagtggaggcccagtgtgactagcctttcaccgtgtactccaatcaaaaccggcagggcaggaatccaagcacctcccaatyacacccactccagggtcacgtagtgttttcatatcctcctttattcccctaatcttgaccttgctatctctttcatctgtatctagatcttattcatgtc

SEQ ID NO: 15554 - DNA, 201 bp, Homo sapiens
agaggaactaaaagataatgtaataaaatatgggttaattctaagcaccttttaaaaaattatatttcttcttttcttttttccataaagcattttataaytagaaagcagaaataaagagtaccttttggaaaagaaaaactctgttagcaagaacacaggactggttatgtgatgtgagaggaggcatcattcctgcag

SEQ ID NO: 15555 - DNA, 201 bp, Homo sapiens
ggacataagcaatgaaaagttggagtatacagggcaaagttaagtataacatcaaaggagccaggagagtggtggtgggaagcgatactagggacagtgayggagaggagaggagaaggagggatgagaggcaagttcatcttcttttctgggctctgcaaattctggagactaggggagggtttggaaatgtctcaggct

SEQ ID NO: 15556 - DNA, 201 bp, Homo sapiens
  misc_feature (1)...(201): n = A,T,C or G, or insertion/deletion polymorphism (see Tables 1-2)
ttccctctccacaggcagctctgcagggaagtctgtgactgcctggccagacttagggctcacgctctggtcagagttatggcaccccagactctgctgcntgtcctggttctctgtgtgctgctgctgcaggcccagggaggataccgtgacaagatgaggatgcagagtaggtgatgggctgctggatgggtgatggag

SEQ ID NO: 15557 - DNA, 201 bp, Homo sapiens
gtttgtatgttcgttctgcactgattcattgtgtggtcttgagcaagttgtagagcttctcattaacaacatagtttaccctggggttaacctaacatggrttatttgtgtacaggaagaatgagtgaaaggtaagttttggtaaaggatgaagaccatgcattaaactgaaggtactggatcagagagctgggacccaat

SEQ ID NO: 15558 - DNA, 201 bp, Homo sapiens
taaactaaagagcttctgtacagcaaaatagactatcatcagagtgaacagacaacctacaaaatgggagaaaatgtttgcaatctatccacctgacaaaygtctagtatccagagtctacaaggaacttaaatttataagaaaaaacaaacaggaggaggagccaagatggctgaataggaacagctccggtctacagct

SEQ ID NO: 15559 - DNA, 201 bp, Homo sapiens
gaaaatgtttgcaatctatccacctgacaaacgtctagtatccagagtctacaaggaacttaaatttataagaaaaaacaaacaggaggaggagccaagatggctgaataggaacagctccggtctacagctcctagcgtgagcgatgaagaggacgggtgatttctgcatttccatctgaggtaccgggttcatctcact

SEQ ID NO: 15560 - DNA, 201 bp, Homo sapiens
gggctggaaggaagttccctgaagagtccaggagagtcgtggtggcaggggtgccttggttctggggccatggaggagcttcaagcttgagaaggctgctstataggtgcatggtttcattgaccctgctcctgcatcatttcaggaatcaaggtctgtgagaagcgacccagcatagatctatgcatccaccactgttca

SEQ ID NO: 15561 - DNA, 201 bp, Homo sapiens
cctgacaaacgtctagtatccagagtctacaaggaacttaaatttataagaaaaaacaaacaggaggaggagccaagatggctgaataggaacagctccgktctacagctcctagcgtgagcgatgaagaggacgggtgatttctgcatttccatctgaggtaccgggttcatctcactagggagtgccagacagtgggcg

SEQ ID NO: 15562 - DNA, 201 bp, Homo sapiens
  misc_feature (1)...(201): n = A,T,C or G, or insertion/deletion polymorphism (see Tables 1-2)
tcctgcattgtacacaggtgagtacagttttcaggtgctgatatgcagggtggaggttccaagatatactctggaacacagaacaagtaagagaagggccncaccaacaggctggagtaatgttcagaactcagaaagcccagggaactgccaggaaacctgccaccctcatctgccttgcatggttccagggtggtggca

SEQ ID NO: 15563 - DNA, 201 bp, Homo sapiens
taaaatttccagacctctaatcacttgacctttctggtgaccagctccatcctgaggctacctaggggccccactccaagtaacctcattagcagaaactsaggtggaatcgaaaggggcttcttatgaatatcaaaagacacacccatcactcaggaaattccaagagttttaggaaccttgtgccaggaactggggaca

SEQ ID NO: 15564 - DNA, 201 bp, Homo sapiens
ttcgcaacctactcatctgacaaagggctaatatccagaatctacaatgaactctaacaaatttacaaggaaaaaacaaacaaccccatcaaaaagtgggygaaggacatgaacagacacttctcaaaagaagacatttatgcagccaaaaaacacatgaaaaaatgctcaccatcactggccatcagagaaatgcaaatc

SEQ ID NO: 15565 - DNA, 201 bp, Homo sapiens
  misc_feature (1)...(201): n = A,T,C or G, or insertion/deletion polymorphism (see Tables 1-2)
tgggttcatgatatggccatgaagccttgaaggctggccccaaggaggttgccatgcagtgtctggttgatatttctccttgaggttaaatatgggatcanttagcctgatgagtgcaaccaagggcaggtaatcagtgagggttgtccagatgttgatgtggtaggtccttaagaccaccaccagggcacacacagcatc

SEQ ID NO: 15566 - DNA, 201 bp, Homo sapiens
ttattgtttaagagtttttatagagcttcaactccttccttctttaacttcctggaggagagtgggtgggtctaaaatttccagacctctaatcacttgayctttctggtgaccagctccatcctgaggctacctaggggccccactccaagtaacctcattagcagaaactgaggtggaatcgaaaggggcttcttatga

SEQ ID NO: 15567 - DNA, 201 bp, Homo sapiens
ggcatgttggcaacatggccaccaaggaaaaaaaaaaaaaaggagagatccagcacagttgctggtaagggactcttctgctgggctcccaccagcagctmtaggatcagacctggatatgagatatctcttacctgttgcgcttttgaaatgtttctgatgaacagactatcccacagaaggaggaacagcactgaaatc

SEQ ID NO: 15568 - DNA, 201 bp, Homo sapiens
acttctcaaaagaagacatttatgcagccaaaaaacacatgaaaaaatgctcaccatcactggccatcagagaaatgcaaatcaaaaccacaatgggataycatctcacaccagttagaatggcaatcattaaaaagtcaagaaacaacaggtgctggagaggatgtggagaaataggaacacttttacactgttggtggg

SEQ ID NO: 15569 - DNA, 201 bp, Homo sapiens
aaaaaaaggagagatccagcacagttgctggtaagggactcttctgctgggctcccaccagcagctctaggatcagacctggatatgagatatctcttacstgttgcgcttttgaaatgtttctgatgaacagactatcccacagaaggaggaacagcactgaaatcctttctcgcaatcttcctgcattgtacacaggtg

SEQ ID NO: 15570 - DNA, 201 bp, Homo sapiens
atgaggatgcagagtaggtgatgggctgctggatgggtgatggagagttgggtagggggaatggaggagctgtgtccagtctgagtaggacctaggacttrcaacctttctgcatatccagctctgaccacaatgctgtgcagactctgggctgtcccaaaccatggccctccaacccctttacctggccctgggaatagt

SEQ ID NO: 15571 - DNA, 201 bp, Homo sapiens
gtagagggaaatttatgacactaaatgcccacaagagaaagcaggaaagatccaaaattgacaccctaacatcacaattaaaagaactagaaaagcaagarcaaacacattcaaaagctagcagaaagcaagaaataactaaaatcggagcagaactgaaggaaatagagacacaaaaaacccttcaaaaatttaatgaat

SEQ ID NO: 15572 - DNA, 201 bp, Homo sapiens; identical to SEQ ID NO: 3229

SEQ ID NO: 15573 - DNA, 201 bp, Homo sapiens
ccaaaaaacacatgaaaaaatgctcaccatcactggccatcagagaaatgcaaatcaaaaccacaatgggataccatctcacaccagttagaatggcaatmattaaaaagtcaagaaacaacaggtgctggagaggatgtggagaaataggaacacttttacactgttggtgggagtggcgattcctcagggatctagaac

SEQ ID NO: 15574 - DNA, 201 bp, Homo sapiens
agccccttgctgttttgctcactgaaccagtactcccagggggaggaactgctcatgtgcagcgtctcctgatgctaaggagaacatttctcaccctggartcagaaggacccattaagcacgagatgggtggcagttagaacccaaggtaaagagtgggaggcccccaagcactgctttggtctccttagccttggtact

SEQ ID NO: 15575 - DNA, 201 bp, Homo sapiens
ccgatcccacagaaatacaaactaccatcagataatactacaaacacctctacgaaaataaactagaaaatctagaagaaatggataaattcctcgacacrtacactctcccaagactaaaccaggaagaagttgaatctctgaatagaccaataacaggagctgaaattgtggcaataatcaatagcttaccaaccaaaa

SEQ ID NO: 15576 - DNA, 201 bp, Homo sapiens
tcatcctgataccaaagccgggcagagacacaaccaaaaaagagaattttagaccaatatccttgatgaacattgatgcaaaaatcctcaataaaatactrgcaaaccgaatccagcagcacatcaaaaagcttatccaccatgatcaagtgggcttcatccctgggatgcaaggctggttcaatatacgcaaatcaataa

SEQ ID NO: 15577 - DNA, 201 bp, Homo sapiens
aaaattcaacaaccttcatgctaaaaactctcaataaattaggtattgatgggacgtatctcaaaataataagagctatctatgacaaacccacagccaayatcatactgaatgggcaaaaactggaagcattccctttgaaaactggcacaagacagggatgccctctctcaccactcctattcaacatagtgttggaag

SEQ ID NO: 15578 - DNA, 201 bp, Homo sapiens; identical to SEQ ID NO: 3232
  misc_feature (1)...(201): n = A,T,C or G, or insertion/deletion polymorphism (see Tables 1-2)

SEQ ID NO: 15579 - DNA, 201 bp, Homo sapiens; identical to SEQ ID NO: 3233

SEQ ID NO: 15580 - DNA, 201 bp, Homo sapiens; identical to SEQ ID NO: 3234

SEQ ID NO: 15581 - DNA, 201 bp, Homo sapiens
  misc_feature (1)...(201): n = A,T,C or G, or insertion/deletion polymorphism (see Tables 1-2)
ctgtccccagtactgactgcagtggcttgggaccatggccacactccccacaccttggcttcacatcacatacatcgttccctctctgggtgcacgctggnggtccccgacttctgcactatgcgtgaaatgcccctgggacacatcatgaggcaggaattggagaaaatttccctagagtacatcatgcgctgtctgcgg

SEQ ID NO: 15582 - DNA, 201 bp, Homo sapiens; identical to SEQ ID NO: 3236

SEQ ID NO: 15583 - DNA, 201 bp, Homo sapiens; identical to SEQ ID NO: 3237
  misc_feature (1)...(201): n = A,T,C or G, or insertion/deletion polymorphism (see Tables 1-2)

SEQ ID NO: 15584 - DNA, 201 bp, Homo sapiens
ctgagagttgtgagcaactttcccctgtccccagtactgactgcagtggcttgggaccatggccacactccccacaccttggcttcacatcacatacatcrttccctctctgggtgcacgctggaggtccccgacttctgcactatgcgtgaaatgcccctgggacacatcatgaggcaggaattggagaaaatttcccta

SEQ ID NO: 15585 - DNA, 201 bp, Homo sapiens
ttcaaaactcagggtgaaataattcttcaacctaaaattctaaacttagccaaactgtaagtgtgcaagtaaaggctgaataccaacagatgtgcaagaawgaggaggaagccaagattatctttctcagagacttcttagaaatgtactttcttagaaagtttaggaggatatacttcaccaggacaagggcatgatccc

SEQ ID NO: 15586 - DNA, 201 bp, Homo sapiens
gaggtggcgagaactggaagagatggagaaaattgtgccagggagtggggtagatgaggagctcgcagagaagtgagtggattgctgagccccttagtgtycatctagggggtggtgctggcttccgcagacagctcaccctgctaggagttctcaaaggagacatccatcagagagctgcatccgctgtgaaggaatctc

SEQ ID NO: 15587 - DNA, 201 bp, Homo sapiens
caggcttttggggagtagcagagatggacactaggttggcggtgaagaagaggaagctgcaggtaaagacagctctttcagaaagttggatgtggggccaygcgtggtggctcacgcctgtaatcccagcactttgggaggccgaggcgggtggatcatccgaggtcaagagttcgagaccagcctggctaacatggggaa

SEQ ID NO: 15588 - DNA, 201 bp, Homo sapiens
ggggtcatgaatcagtaagaaaggattggaagagttcaggagatagagcttttatgtttcatttttcgtatacgcatgataacaactgataaaatagagcwtatctttggcatctccacttcagacacagttaactgaacttttgagcttcacagattgattacattctgatcataaggctttgaccattagtattcttat

SEQ ID NO: 15589 - DNA, 201 bp, Homo sapiens
tcagaggtctttgaacgagcccctaccactgctttcccctgcagagaaatgtgtttgtaaggttttaggtggataaagcaatccatgctattacattacayttcttgacatgatgcttggacactttccttaaggttcacaaagctttatgtatggaaagttattagaagtgagttgagagagggtgaggacacagactct

SEQ ID NO: 15590 - DNA, 201 bp, Homo sapiens
gttgggccagtggtcatgtgtaagggagttataggtacatggtatagtgttgattgttgcagatcgggcatcatggaactatggagtccagagtaattttrtttctgaagcttactgagcatgcctcaattataaaatgcctcatttttgtatttgcttattaaaataatttaaaataatcctaatgtaggcagctgacga

SEQ ID NO: 15591 - DNA, 201 bp, Homo sapiens
atggattcctgtggtgactatggattccaccgcgccgagaggtggcgagaactggaagagatggagaaaattgtgccagggagtggggtagatgaggagcycgcagagaagtgagtggattgctgagccccttagtgtccatctagggggtggtgctggcttccgcagacagctcaccctgctaggagttctcaaaggaga

SEQ ID NO: 15592 - DNA, 201 bp, Homo sapiens
agcacacaggtgggtttggacacctccctgccctgagttcctggcaagctcaagtgcagaggcctgttaaagctttgggaagctgcagtatgaaaaagagrggatcccagccgggtgcagtggctctaattccagcactttgggaggctgaggtgggccagttgctttagttcaggagttcgagaccagcctaggcatcat

SEQ ID NO: 15593 - DNA, 201 bp, Homo sapiens
ttcaagatacctatatcttattggtgggtttacccttatgtattaatagttatgtaatgaccctttctgtctctggttattttctttgttctgaagtctaytttatctgatattaatacagccagccctgtttttctttgattaatgtttgtatgatacatccttttccattctttcagcagtccatatcattataactga

SEQ ID NO: 15594 - DNA, 201 bp, Homo sapiens
gagcaccgtgctgggagggctgtacatcctgcagaaacacagcagacacggctctggtctcatggagcgtagtctattgagggaatgcagtattaatccawttgtgatactaatgagtgaataattaaaaaccaggcaagagttctgaaggagtgtggtccgtgaaagtgtgttagaaagaaagatgacccagacaggggt

SEQ ID NO: 15595 - DNA, 201 bp, Homo sapiens; identical to SEQ ID NO: 3244

SEQ ID NO: 15596 - DNA, 201 bp, Homo sapiens
tgatcccgcccttctcagcctcccagagtgctgggtttacaggcgtgagccaccgtgcccgtgtataaatagcatttcaaagtcacctggttccaataaaktatgaaataacttgctcttagggaaatcaccccaattgccctttaccttaatttcatgaaagatggaacaggtaaacatgtcaacaaaggaatcctgtaa

SEQ ID NO: 15597 - DNA, 201 bp, Homo sapiens
atctgtgtcccgggagccaggcgttctgagaggaggaaggcagtttctggcccagcccttcctgcacttgcccaggcagtgaaaggctcagcctgctaaartgtgaagtcatcaatcaggctagcaaagtgccatgagaagaactcaatccttagacacatgagggccaaaaatagtaagtctgagagttggtcctggagt

SEQ ID NO: 15598 - DNA, 201 bp, Homo sapiens
cccactgttcaattcctccctgaccattgtaccaaaactttttgtcctttaaagtacatgtcatcttatattctgtcctctgccagctcctcgttgctgtyatctgatgaccctggggatagtcctttttcaacaaggtcatctatcatatggtcttgctctttgctctaactcctgactgatcctaggtcactgcattgt

SEQ ID NO: 15599 - DNA, 201 bp, Homo sapiens
gccactggctgctgtatgacctagggcaacgtaattaatctctctgggccttggatttctcagagaaaaggggaataatggcagtctgtgtcatggaatcyttataaagaatcaatgtgataaagtcctgtaaaacaaagtgctggcacattgcaaggattcattaagtggcagcaattagctatgaaatcttgcctacca

SEQ ID NO: 15600 - DNA, 201 bp, Homo sapiens
tttcagggtgatttagtaaagaatgttctctctctacctgccaacctaaaatcatcacatatgggttcaaaggtcctgttcttatcaggatgaaagccccrtccttatcaggatggtttccatggtgatgaaagtggatgggcacaccagctcagctgtggaaaggtagtcaaggtttcagggagtgtttgcatttagaac

SEQ ID NO: 15601 - DNA, 201 bp, Homo sapiens; identical to SEQ ID NO: 3246

SEQ ID NO: 15602 - DNA, 201 bp, Homo sapiens
ttaatattttttaggtgttcatacagtggcatttgggacacaatcgttggaacctgaagaatctgaagttttttttaccaccatctttttctactctgtawggaagtagatctttatggggaaaagagaatttggggtgttctgcaagccagtcaaagtggcacagcaaatcatataaatcgaattaaatggacaacaccg

SEQ ID NO: 15603 - DNA, 201 bp, Homo sapiens
ccacttcagcctcctgagtagctgggaccacaggtgcatgccaccacacctggctaattttttttttttttttaattttttttgtagagacgaggtctctstctgttgctcagtctcatcccgaactcctgggctcaagtgatcctcgtgcctccacctcccaaaatgttgagatcacaggcatgagccactgtgccctgc

SEQ ID NO: 15604 - DNA, 201 bp, Homo sapiens; identical to SEQ ID NO: 3254

SEQ ID NO: 15605 - DNA, 201 bp, Homo sapiens
aaatttttttttttgagacaggggctcagtgtgtcaccctggcaggagcacagtggtgcaatcatagctcactgcaacctcgaactcctgacctcaagctrtcctcccacctcagcctctcaagtagctgggactacaggagcacaccaccatgcccagttaattatttttatttatttatttatttattttgagacagag

SEQ ID NO: 15606 - DNA, 201 bp, Homo sapiens; identical to SEQ ID NO: 3255

SEQ ID NO: 15607 - DNA, 201 bp, Homo sapiens
gagaaattcctatagctattcttttgcaggcagatgtcctggtgataaattctgttaatttttttttaaatcagagaatgtcttcatttaccctttattcyagaaaaatagtttcacaggacatagggctctgggttgaaaggttttctttctttgagcacttgaaaaatacagtcactctcttatggcctccctggcttc

SEQ ID NO: 15608 - DNA, 201 bp, Homo sapiens; identical to SEQ ID NO: 3257

SEQ ID NO: 15609 - DNA, 201 bp, Homo sapiens
tcttgacataggaatatgtctgttaccttttttcgttcagtttgaggtcttcctggttcttggtatgatgaggagttttcaactgaaacgtggatattttwatattatgttataggaccttagatctttatttaaatcttttaattgttttcctctcttggacactaccttatcactgccatcatgtctagattctggaat

SEQ ID NO: 15610 - DNA, 201 bp, Homo sapiens
ttctgggttgccagcttgttctgctccaagcctaggatacaagaggcaaaaagaacccagggaacttccttccaaatcattccttgggccctgaaatccckggtacactgaaatctctggtacactggccttcttttgctccactctttcagagtcttttttttttttttgagacggagtttcattcttgctgcccaggct

SEQ ID NO: 15611 - DNA, 201 bp, Homo sapiens
cgggctggtctcgaactcctgactgaggtgatccatccgcctcagtctcccaaagtgctgggatttacaggcatgagccaccacacccatccttttctagkgtttttagttgttcttagtgagaaaaataggaaaaagttcttctactccattgtcttggaagtggaagtccacctgggctttaagggtaatttttttgca

SEQ ID NO: 15612 - DNA, 201 bp, Homo sapiens; identical to SEQ ID NO: 3242

SEQ ID NO: 15613 - DNA, 201 bp, Homo sapiens
agagtctttgatatttcttttctagggtggttttttttgttgttgttgttgtttggttttttttttttttttttttttttggactgagttttgttctgtcrcccaggctggagtgcagtggtgcaatcttggcccattgcaacctccacctcccaggttccagcaattctcctgcctcagcctcctgagtagctgggatta

SEQ ID NO: 15614 - DNA, 201 bp, Homo sapiens
tcataggtgggaattgaataatgagaacacatggacacaggaaggggaacatcacactctggggactgttgtggggtggggggaggggggagggatagcawtgggagatatacctaatgctagatgacgagttagcggttgcagcacaccagcatggcacatgtatacatacatatgtaacctgcacattgtgcacaggta

SEQ ID NO: 15615 - DNA, 201 bp, Homo sapiens
gcagcacaccagcatggcacatgtatacatacatatgtaacctgcacattgtgcacaggtaccctaaaacttaaagtataataataataaataaataaaaggaaaaaaaaaagaaaatttaacacctcaaagtagtattcttaaatgtgtatatttgtatactggagtaatttgtataagaaactatttgtcaagacagtg

SEQ ID NO: 15616 - DNA, 201 bp, Homo sapiens
gtggtgactatggattcctgtggtgactatggattccaccgcgccgagaggtggcgagaactggaagagatggagaaaattgtgccagggagtggggtagrtgaggagctcgcagagaagtgagtggattgctgagccccttagtgtccatctagggggtggtgctggcttccgcagacagctcaccctgctaggagttct

SEQ ID NO: 15617 - DNA, 201 bp, Homo sapiens
gtagcagagatggacactaggttggcggtgaagaagaggaagctgcaggtaaagacagctctttcagaaagttggatgtggggccacgcgtggtggctcaygcctgtaatcccagcactttgggaggccgaggcgggtggatcatccgaggtcaagagttcgagaccagcctggctaacatggggaaaccccgtctgtact

SEQ ID NO: 15618 - DNA, 201 bp, Homo sapiens
agtaaaaccagtataattcttccaggtccgtgacgagaagttattaccgaggcgcggccggggctctcctcgtctatgatatcaccaggtaatgccagctycccctggtgaaggagggtgctcagtgccctgcagcccaaaggctggtcttggcgaggtgccctccgtgcagtgtgtgctttgtgtgtccagggacggtgg

SEQ ID NO: 15619 - DNA, 201 bp, Homo sapiens
ccacgcgtggtggctcacgcctgtaatcccagcactttgggaggccgaggcgggtggatcatccgaggtcaagagttcgagaccagcctggctaacatggsgaaaccccgtctgtactaaaaatacaaaaattagccaggcgtggtggcgggtgcagctactcaggaggctgaggcaggagaattgcttgaacctgggagg

SEQ ID NO: 15620 - DNA, 201 bp, Homo sapiens
atcgtgaagttaccttcttagaagcctccagatttgctcaagaaaatggcaagtgaccttttacttcttactatttttcaaatcgcatatttgaggataayagcatttctttgaatttaaaacatatattggaatttcaagattaaactagatttaggaaatgtggaatttccaattgtttttttctataaattagaccta

SEQ ID NO: 15621 - DNA, 201 bp, Homo sapiens
atgaatggctagagtaatgtccattccccattgatgtaactcttggttttagtgtcacttgtttaaatctataagcctgttaatgttctaaaattaaataygctgttcttgtttttcttttttagtcaaagatgactcaaatcatacaataggagtggaatttggttcaaagataataaatgttggtggtaaatatgtaaa

SEQ ID NO: 15622 - DNA, 201 bp, Homo sapiens
gttctaaaattaaatatgctgttcttgtttttcttttttagtcaaagatgactcaaatcatacaataggagtggaatttggttcaaagataataaatgttkgtggtaaatatgtaaagttacaaatatgggatacagcaggacaagaacgattcaggtagcttttctctaacttaataaaaatatttgaaaatttgattta

SEQ ID NO: 15623 - DNA, 201 bp, Homo sapiens
atgtcagccaaatatcttaaatgtgaaaaggtaagtcaacatatgtattgtcatttcacaagatactcagttacctctttttcctgttatattaacaactragatactaaatttgatgatcgtgatctaagaagaaattcacagcactattttgaagttattttcacagtctctttttatctttcagattttttgtttaag

SEQ ID NO: 15624 - DNA, 201 bp, Homo sapiens
taagcaccttggaagcaaagccctggctgtttaatctttgtttcccctgcagcacccagacctggaggtgcttgacaaatactgttttgaataagcgaaasctttcccagtgcatatgctgtgtgcttttttttttttctccccttttttggccttgcgtggtaagaataaacaacttgtactttgtatcagagttgaata

SEQ ID NO: 15625 - DNA, 201 bp, Homo sapiens
aattttcatatgttgcccaggctggtcttgaactcctgggctcaaacaatcctccctccttaacctcccaaagtgctcatattacagttgtgagccaacgygctcagcctggaactttttaatgctaacaaaattctaatagcattatttttagtttgattgcctgtaaccatgtgaatattatgagaggttgaataggct

SEQ ID NO: 15626 - DNA, 201 bp, Homo sapiens
atttcagtggctaggagacctttttttcctggtctttattttgtctgtgttcctgaatggctgacatttgctcaagattgaattctaattatttgatacctttcctattatctcatttgacttttctcatacggaaagttaaaagtacattagtaggatgtatctgttttagattttctgttttggggtgtggtctttccc

SEQ ID NO: 15627 - DNA, 201 bp, Homo sapiens
tcatattacagttgtgagccaacgcgctcagcctggaactttttaatgctaacaaaattctaatagcattatttttagtttgattgcctgtaaccatgtgmatattatgagaggttgaataggcttcatctctcagtggtgattaacatagttcttaagaaacgtgacagagctaggccaagcatcagtaaaggaacacac

SEQ ID NO: 15628 - DNA, 201 bp, Homo sapiens
tgctttgaagtcaccacatgaatactgtactttatgtaatatcgtgaaacaaattgaaatcttaggttttggatgaaacccttagtctgaatatgaaacarttctaccaaatgccattagatacactacattcttaaagccctggccagttagtatggcttgggacttcccaaggaactctgcttcagccatctgagacct

SEQ ID NO: 15629 - DNA, 201 bp, Homo sapiens
gagattacaaattggctgaaagtaattttgatgctaagcagcgatgttcagaaaggagctgaaaagtatatgtagtgggaaaatgccaggaatttcttttraaattaagtgctggggcagttcgagagtgaggaaaaatctaatacaaaatctctacatatattagagtttatgccgtctacaatgggaataacaaatgaa

SEQ ID NO: 15630 - DNA, 201 bp, Homo sapiens
gcgaggcctttccccctgccttaggaggctgtggggtgaagagcaaacagtccactctgcacctctacctgccaccagtccttaaagcgtgtgcctcttgstaacagtctcaaggcagagaggaaaagcttcaagctacatgaagaccttgaagcttcctgactaagagctaaaaagtacatttaaaagtagctcttcttt

SEQ ID NO: 15631 - DNA, 201 bp, Homo sapiens
ccttcaatcttaattcattctggagaaaacccttatcaggtgaatataattataaactgagtgagaaaaatttattgtgaatttgagccctcaagttaacrttcactataataaacaccgaatctaatttaagtgggcacaattatttaaccagttgacacttagttatataacctacataggcattttgccttcattaat

SEQ ID NO: 15632 - DNA, 201 bp, Homo sapiens
tcttgctaacagtctcaaggcagagaggaaaagcttcaagctacatgaagaccttgaagcttcctgactaagagctaaaaagtacatttaaaagtagctcktctttgccaagcagcaaagtaataattagtaattttgtttgtttgtttgttgcaagctgcacgggtttctttgttctccaaggatagttcattcctctgg

SEQ ID NO: 15633 - DNA, 201 bp, Homo sapiens
tatatatatatatatatatatatatatatatatatatatatatatatatattttttttttttttacatgtgcatgagtctgtgtgtcagacaaatgcccasaagtggaattgctgggtcagagaacataagcatttgggatcttggtgtagaggctgtcacattttctcctagtgatgggcttatttcactaaagccatgt

SEQ ID NO: 15634 - DNA, 201 bp, Homo sapiens
atttatccttatttattcttctcatggttcagagttattttttatttgaacaatcctttaattttaattctataaaattctcagccattatttattttaayatgggctctctaccctcattctcttatttttttaatttcaaaattcctgttagatccatgttagatcgtttccttcaatcctccatgtctcttgagttct

SEQ ID NO: 15635 - DNA, 201 bp, Homo sapiens; identical to SEQ ID NO: 3248

SEQ ID NO: 15636 - DNA, 201 bp, Homo sapiens
gcatcccaccaagtgggatggtgccacccaggagacagcacgctgagatagagggggtccactggatggggatgcttggggaacgttgctgaggagatagwgttaatgagacccaagggacaaggaaagccagcggtgtgacgagcccagacgggagtggcaggggctgggagcagggaagagaatggggccaaagggaca

SEQ ID NO: 15637 - DNA, 201 bp, Homo sapiens
ttgtcatttcacaagatactcagttacctctttttcctgttatattaacaactaagatactaaatttgatgatcgtgatctaagaagaaattcacagcacyattttgaagttattttcacagtctctttttatctttcagattttttgtttaagttcttggttattggaaatgcaggaactggcaaatcttgcttacttca

SEQ ID NO: 15638 - DNA, 201 bp, Homo sapiens; identical to SEQ ID NO: 3252

SEQ ID NO: 15639 - DNA, 201 bp, Homo sapiens; identical to SEQ ID NO: 3251

SEQ ID NO: 15640 - DNA, 201 bp, Homo sapiens
tctcatggagatatggaggcagcacttggatctgagctggagacaaaatttgagtcgaatgttaagagagcccaggacccagctctggggaatcgcaatcycagcagggcagattcagaagaatgaccagagccagagaagtggctggtgagcgggaggaagactagcagagtgcagggcgcagaggctgcgcgagtgagt

SEQ ID NO: 15641 - DNA, 201 bp, Homo sapiens
ttctgtggcaggaatcctgtttcctgacagagcagccagagaagctctaggcatacattttggataaaataacaacatttggtcctcatagtgggcttgtrttgtagttaaggcagttgctgtcatcaattctgttttataggccagaaacagacctcttgaccacacagcccatcttttaccattgactttcactgtttt

SEQ ID NO: 15642 - DNA, 201 bp, Homo sapiens; identical to SEQ ID NO: 3253

SEQ ID NO: 15643 - DNA, 201 bp, Homo sapiens
cagcctgggcaacatggcaaaaccccatctctacaaaaaatgcaaaaattagccaggcgtggtagttcatgcttgtagttccagtgatggggaggctgagrtgggaggatcacatgagcccagggaggtcgaggctgcagtgagctgtgatcacaccactccactccagcctgggcaacagagtgagacttagtctcaaaa

SEQ ID NO: 15644 - DNA, 201 bp, Homo sapiens
taggctttaagctgtatttacttttgcatttatagttatgcagattttgaaattgttcttaatattttttaggtgttcatacagtggcatttgggacacawtcgttggaacctgaagaatctgaagttttttttaccaccatctttttctactctgtatggaagtagatctttatggggaaaagagaatttggggtgttct

SEQ ID NO: 15645 - DNA, 201 bp, Homo sapiens
attataagtaatgttacagtaaataattatatatatatatatatatatatatatatatatatatatatatatatatatatatattttttttttttttacaygtgcatgagtctgtgtgtcagacaaatgcccagaagtggaattgctgggtcagagaacataagcatttgggatcttggtgtagaggctgtcacattttct

SEQ ID NO: 15646 - DNA, 201 bp, Homo sapiens; identical to SEQ ID NO: 3241

SEQ ID NO: 15647 - DNA, 201 bp, Homo sapiens
gtattctgtaactactaaagcaagaaaatagattaatattttagttgtggtttttgcacagatgcacaaagtcagaactgatattcatagttttataattmagtgaaataaaatccaccccatttgtaaacatttcacttgaagttgagtacatgtcgtatattaaataattgaagtttggctgggcacaatggcgcatgc

SEQ ID NO: 15648 - DNA, 201 bp, Homo sapiens
ggtcctctctgcaactcctcacaacagtaatgaacggaaggtctctctttgtaaccaggatgcccctggcctttagttactattttttttaaggatcttascctgcatttttcctggtagtttactcctaatggaatttccatactagttctatactgtctgggcatgaaacagactagcatagtcactgtaaccatttat

SEQ ID NO: 15649 - DNA, 201 bp, Homo sapiens
ctttaaccttgcaaagtaattattcaaagagcacagtttggaaaaccactgaattaacatgtcagccaaatatcttaaatgtgaaaaggtaagtcaacatrtgtattgtcatttcacaagatactcagttacctctttttcctgttatattaacaactaagatactaaatttgatgatcgtgatctaagaagaaattcaca

SEQ ID NO: 15650 - DNA, 201 bp, Homo sapiens
ccttttcccctgctttttaagaagaagaaagaggtagactcttcaaagtctaccaggtttattcttttgtacagaaaacacttgaaattttctaaactaastttgctgccaactgaatatgcatatttctttgaatagtggctagcaaagggacaagttttattcattccaagagtagttttcagactttaaccttgcaaa

SEQ ID NO: 15651 - DNA, 201 bp, Homo sapiens
tcctgacagagcagccagagaagctctaggcatacattttggataaaataacaacatttggtcctcatagtgggcttgtgttgtagttaaggcagttgctrtcatcaattctgttttataggccagaaacagacctcttgaccacacagcccatcttttaccattgactttcactgttttggtaaaggaggttgaattttt

SEQ ID NO: 15652 - DNA, 201 bp, Homo sapiens
gagcctggcaggatatcttgccctgaatgcatggcccataatcgaagctttcaacaggactttttgggtgagtagataggaattaagggtccaaagaaaayttgggcactgccttccttttacattgatgacttaaagaagaagaggtacattagtaggtaaagaagaaataattaccaatttagaaagagggtacagagg

SEQ ID NO: 15653 - DNA, 201 bp, Homo sapiens
atgcatttactatagtaagaagttgagaatcactttctttcctaccaaattctcaattacttcacaagcctcctaggaaagcactaaggtctttgaataamtcagctggcccgcaggagaaaaaaggaaaccgtgcaggaattagataggaatatgttatttccaagaagggccctttctcctaaagatacatcctttttt

SEQ ID NO: 15654 - DNA, 201 bp, Homo sapiens
tgctcattataagaagtgatagctatccctctgtctcagagacaggatttgtcttattctgattgacacagctcatgttatattaagtttgtgaaatgaayacaaaagctaagataacttttgtttttaatgacttgcacctttttttaaaagaactcttagggatgttataaggataaagtaacataatagatattttgc

SEQ ID NO: 15655 - DNA, 201 bp, Homo sapiens
aggaagaccaatacatagctgtgtctccaagaatctatttccaggactccatcagaatgccaagcccttcttcttataaagtaagtcagattcatttgagmacatagagaagcctgacttttaaaatctaaaagcgtttctttaaaaattgaatacaaataacaggtttcactgtcatattacattcaaaccaaagataaa

SEQ ID NO: 15656 - DNA, 201 bp, Homo sapiens
ataagattagtgttatttggtccatagagatgccaaggtatgtcagttgtctcactgagaactagggaattcagccaaaaatggttcctgatcatgttctkccagagcaaatagtactgaagaaaatcaaacttgtcagaatagattttctgagatgtgatgagctagtgttagaatgtgaaccaactagtgcttgaatgt

SEQ ID NO: 15657 - DNA, 201 bp, Homo sapiens
atctaatttatttggtttgtacagaaaaactggtcctatgacctacttgaaaatcaaagctattacattttaatagctctgattagtttttaaaactctaytgacacaaaattgactctcccatattttccattaattggctaaattttgaaacctggaacagtattttaccttcaaccatattgctttttttcatctatt

SEQ ID NO: 15658 - DNA, 201 bp, Homo sapiens
agaaaactgtggtgcctctgtcagcctaggttcctgagtgactatggtccttaaaactaggtgtgtctcccagtacaaatggttgtgtacatatatgacakgaaaaagaaatacatttttgttttaagctatgactttaactagtttttttaaattgtttttgacagtgcagcatagactagcctatcttgactggtagaa

SEQ ID NO: 15659 - DNA, 201 bp, Homo sapiens
gtcacttctgggttaaggtagcaaaaatctcatgtgctgttggcagtttctctttctttaccatgggttcctgtctctctctctctctcttcttctaccayggccagtgaggagtctaggcatcattccagatgatgtagctagaaaactgtggtgcctctgtcagcctaggttcctgagtgactatggtccttaaaacta

SEQ ID NO: 15660 - DNA, 201 bp, Homo sapiens
aaacaatgtcacaaagtgggagaggcactaagaatgagatctggcaccacttactcttgtttctatacaatcgaagtacaacacttctcaattttctaggygtctttggggagagatcttatctctcttaatggtaccaactcagtaacccaaactgttcaccaatacttcttttaagtagttgtgaggtagggagtccaa

SEQ ID NO: 15661 - DNA, 201 bp, Homo sapiens
aaggctacctacacactaggatgcagtgttttccaaatacgctaatcttagaacactatacaaatacaaatacaaatttgcaggacattactggaaaaatmtgattccattgatctgaggtgagatagaagaagttggaatttttttaagagtatctctagtaattcttattttctggcagacttgaagaacatttttata

SEQ ID NO: 15662 - DNA, 201 bp, Homo sapiens
ggtgacggagtctcaccctgtcaccgaggctggagtgcagtggtgcaatctcggctcactgcaacctccgccttccaggttcaagcgattctcctgcctcratcaggagatggtctcgatcttttgacctcatgacctgagatggtcttgatcttttgacctcatgatctgtccacctcagcctcccaaagtgttgggatt

SEQ ID NO: 15663 - DNA, 201 bp, Homo sapiens
tattttcccttggacattttaacagctaataagccaagaaatgctatctaatttccttacacatcttttttcttttttcttttttcttttttttttttggkgacggagtctcaccctgtcaccgaggctggagtgcagtggtgcaatctcggctcactgcaacctccgccttccaggttcaagcgattctcctgcctcgat

SEQ ID NO: 15664 - DNA, 201 bp, Homo sapiens
gacaggagaatcgcttgaacccagtaggcagaggttgcaataagccaagatttcaccactgcactccagcctcagcgacagagcaagactccatcttgctraactaaactaaaataaaataaagtagcaagacctctgtgattaaaaacaatacattgaaaaaactaatcattcatgaggaaatactctgtagtttatagg

SEQ ID NO: 15665 - DNA, 201 bp, Homo sapiens
tgagacaggagaatcgcttgaacccagtaggcagaggttgcaataagccaagatttcaccactgcactccagcctcagcgacagagcaagactccatcttrctaaactaaactaaaataaaataaagtagcaagacctctgtgattaaaaacaatacattgaaaaaactaatcattcatgaggaaatactctgtagtttat

SEQ ID NO: 15666 - DNA, 201 bp, Homo sapiens
ctgagacaggagaatcgcttgaacccagtaggcagaggttgcaataagccaagatttcaccactgcactccagcctcagcgacagagcaagactccatctygctaaactaaactaaaataaaataaagtagcaagacctctgtgattaaaaacaatacattgaaaaaactaatcattcatgaggaaatactctgtagttta

SEQ ID NO: 15667 - DNA, 201 bp, Homo sapiens
cctgaaaagatccattttattctgactcaggtacaatataagacaggaaaatggatgttatatacatagatcatcaatagagaataggaagaaaaagatamcgattattttgtggtatcattgtatcatgactctgaataatatctatcaattactgattactcactatgtaccaagcccagtaggcactatagaaatgta

SEQ ID NO: 15668 - DNA, 201 bp, Homo sapiens
agtagagaaattactggactagacctggagctgtggattctggcctaaacactgtcattggcttgtaatgtaattttgtgcagttttctcatatataaaayggaagtaataagctcagatctcaattaggaaaagtaccaagatactagacgtaaacatgctttggaaaacattggagcacattaacatatatagcattat

SEQ ID NO: 15669 - DNA, 201 bp, Homo sapiens
cagctaagcctaatatgggaaacaagtcaatattttccagcatgctgggtccattttctccccccaatatttttaagcataagacaggtgcagaaatcacrtcaaccaccactggaggggtgtacagcagctgtcacacagccacacagtggcaaaagtctttgctaagatccaaaatgaaaagaatactcattgtaattg

SEQ ID NO: 15670 - DNA, 201 bp, Homo sapiens
gaaattttaagtaatatattgaagatcacagagatagggcatgaaatggaatttgaacccaagtctttcttgctcctgaatccaaattcttaaccacactattggcttttgttcctctccattaatcctgaatgtgatttatttttttcccaaaaaggaaactggattacttgacctgctgtttgttcagaatatttattt

SEQ ID NO: 15671 - DNA, 201 bp, Homo sapiens
catagaaattttaagtaatatattgaagatcacagagatagggcatgaaatggaatttgaacccaagtctttcttgctcctgaatccaaattcttaaccayactattggcttttgttcctctccattaatcctgaatgtgatttatttttttcccaaaaaggaaactggattacttgacctgctgtttgttcagaatattt

SEQ ID NO: 15672 - DNA, 201 bp, Homo sapiens
caagtgatccttccaccttagcctcccaaagtgctgggattataggcataagccaccatgcccaacctgtttgattattttctatgtgtcccacttctctwatcgaattttcttttccttcactttttttagtccaccttttaagtccttgccagttacctgtaatatctggatcatctatgtatctgcttcaaatgtata

SEQ ID NO: 15673 - DNA, 201 bp, Homo sapiens
atatcttttaaatggcttactatgtttgaggcattgcaataatgtgtcccttaacgtatttaattcttacgacaaatctatgagataggtactgtttactcatattccggatagggaaactgggcatagaaattttaagtaatatattgaagatcacagagatagggcatgaaatggaatttgaacccaagtctttcttgc

SEQ ID NO: 15674 - DNA, 201 bp, Homo sapiens
cgattcagggtatgccgtcttgtttttcatttgatgacattaggatatcatacctaatggaaaaattaattgtgtgtgtatttatgtgtgtgtgtgtggakgcacgcacacatgcatgtgcatcatgatgatgtactacttaagcaataatgggccattatagaaggtaaatcaattaattctaagttgacattgtcatag

SEQ ID NO: 15675 - DNA, 201 bp, Homo sapiens
tttattaattatttttttgagacacagtctcattctgttgctcaggttggagtgctgtgcacgatctcagcgcactgcaatctctgcctcccaggttcacktgattctcatgcttcagcctcttgagtagctgggattacagacatgcaccaccaagcccagctaattttttgtatttttagtagagatggctttttgcta

SEQ ID NO: 15676 - DNA, 201 bp, Homo sapiens
gctttttgacaaattatattttataaccaaatttaactcttacataaactattttctgatacaaccaaaagcatttttcttccccattcaactctaattgkatattattattattttacttctatagccattaaaattttctaacttgaattatatttacttatatctataattatcttcctttcagggaaattttacagg

SEQ ID NO: 15677 - DNA, 201 bp, Homo sapiens
gagacagatgtcacttttatactcaatctaagagctactacctttcaacagctcatcaggaggtaaaatcaaatcttcagagacaaaagacataagcaacrcatctgtagcagccagaaagtaaattttttaagctacgaagggccttggagacgattcagggtatgccgtcttgtttttcatttgatgacattaggatat

SEQ ID NO: 15678 - DNA, 201 bp, Homo sapiens
ggtgtacagcagctgtcacacagccacacagtggcaaaagtctttgctaagatccaaaatgaaaagaatactcattgtaattgaaactatgcaggggacaragcttcccagatgcatacaaaagttctgaggctttgaaaagagacagatgtcacttttatactcaatctaagagctactacctttcaacagctcatcagg

SEQ ID NO: 15679 - DNA, 201 bp, Homo sapiens
tgtctgttcgtattagaatcattttatgacaaatggaataattcagtaaccactttaatttaatactgcatgtttaatatttattgagcaataaaccatayactaagcaaaaagttactaaccctcccccaccaaaaatgatttgctcgtattcactttttcccttatctaatgctgcaaagataattactttgtccctat

SEQ ID NO: 15680 - DNA, 201 bp, Homo sapiens
agcatgtcatataataaatcttagcaaactatatggagaaatataccacagaagtgaaacaatttttaagtatgtgtgtatatttatatatttgtctgttygtattagaatcattttatgacaaatggaataattcagtaaccactttaatttaatactgcatgtttaatatttattgagcaataaaccatacactaagca

SEQ ID NO: 15681 - DNA, 201 bp, Homo sapiens
atgcccatgatcctatgacatgaggtaagaaattcaaggcaccatggttccctctgacacctgataaactgtatgtatttattttttcctagaaaaaaagsgtatttgacacatatcgggagacacagtttcaaatcccacgttgaccatacacatgctgtatggccttgggcaactcctttgagtctctgtttcatcatt

SEQ ID NO: 15682 - DNA, 201 bp, Homo sapiens
atatgaggcaagaagaactttcaataaagaaaatgcatgtaactgcccagaccctccttggagttataaaagagccatataatttccacagcttccatatrccaccaacacttatggtcctacatagcaagtcccataaagcctcagtagacatgtgacatcccgaaaacagagcaatgcccatgatcctatgacatgagg

SEQ ID NO: 15683 - DNA, 201 bp, Homo sapiens
gacagtaatttcaatctcacttttacttcacatacattagatgtggtaacttcttttcagtcagagggacagatgaattctctaggaaatttatatgtacrtatttgcaggtacctttaagctagttctgaggagaaaaaagttatatgaggcaagaagaactttcaataaagaaaatgcatgtaactgcccagaccctcc

SEQ ID NO: 15684 - DNA, 201 bp, Homo sapiens
tgacagtaatttcaatctcacttttacttcacatacattagatgtggtaacttcttttcagtcagagggacagatgaattctctaggaaatttatatgtamatatttgcaggtacctttaagctagttctgaggagaaaaaagttatatgaggcaagaagaactttcaataaagaaaatgcatgtaactgcccagaccctc

SEQ ID NO: 15685 - DNA, 201 bp, Homo sapiens
atgttgatttttattcaatggctcatctattctgatatttcagtttcttaaaatatttatgcaaagttttgtttggattacttacatacgtagcacaaatkattctttatttgccatggtgacagcacaaatcacattatttgcagaggttggggagtcccacaaatcagcccccacaacaacaaatatttatttattgaa

SEQ ID NO: 15686 - DNA, 201 bp, Homo sapiens
gcttccagttactgcagcaaaacctaagaccaccttccctctgtagctcgagtgggagacattgttctgctgtctctctaggctctttggtacgctgaggstgatgtgattgcccagactcgtgtcctgcatggaatttaaactacttttgtaacagcaaaaggaatttactgacttcctctcagattgaaagcagaaatg

SEQ ID NO: 15687 - DNA, 201 bp, Homo sapiens
acctgcaggtgtgagggctagctcttgggagatttcatgcctcaaggctcactttctttctttttttttttttttttctgtgcaataagatctgggtccayttccaacttttctccctatagctcacatacttgaagtgtgccaagaacaccagatatggcaacatcccacagatgatgaatggtatgaaaatggcctgag

SEQ ID NO: 15688 - DNA, 201 bp, Homo sapiens
atgtgcatgttaagtgaagggaaacaagctctaatggtgccctttaatgttctgaagacacaggtgttctctgtgaacttgacatttgctcggtctacatstgatcctaagggttccagataagatgaattactgtgtgaaagtcctcaggcattttctcacagataaatagcatgaaattttgtgatggagagagaacaa

SEQ ID NO: 15689 - DNA, 201 bp, Homo sapiens
tgtttagatctacttgcttagtccactgcttcagaaatcagcactgctttgtttaaaagataattattgattgctatgttatataataatcttccaagacmgttacagattaatctgaatacctatgacctcaatctgaatttctatgtcttagaagttttggagatagccaacccaccaatctgtcataaagcatattag

SEQ ID NO: 15690 - DNA, 201 bp, Homo sapiens
ctatttttttccaggaggattttggaaactcgaaattcttaaaagaactattttaacaaaaataaattgaaggaaaccgactgattttaattttagagatyattgctttcaaatatatgatcttcaagtcctcttgaattttgagctattttgaaatcaagttctatttgtataaggctttctctctgaggcaaagtgtta

SEQ ID NO: 15691 - DNA, 201 bp, Homo sapiens
aattactctgttcttagagttctgcaatgtcacaagatcataaaatcctgaatcaagaaggacagatcagaggtcattttgagcagcctcttttattgggmcacaaaacatgcttatccccatgcaataatggcattctaattccagtctttatcaatagtaacaataactttagcaattactttttaatctcagaattct

SEQ ID NO: 15692 - DNA, 201 bp, Homo sapiens
ggcatttgtaacacaatggtatttgtgtagctacgcatatctaaacatagaaaaggtaggataaaaacacaatatcataacttgtgggatcaccatcatayatgtagtccctcattggccacaacattgttattgtagtgcatcactgtatattttagggagagggctcttctcgaaattctcaaattatgcccacttggt

SEQ ID NO: 15693 - DNA, 201 bp, Homo sapiens
tttattcacagtagaacttctttcaaaattgaagtcaatcctctcaaactctgccactgcttcatcaaataagtttataagtttatgaaatattctaaatyatttgttattatttcaacaatattcacaacatcttcaccaggagaagattttatctcaagagacaactttctctgttcatccataagcagcaactcctca

SEQ ID NO: 15694 - DNA, 201 bp, Homo sapiens
ttgccctaccctttcccatgctctaccactggcaggttctcaaagtagcccatgcttcccaatctctgtgcttttgatcaagcaatttcctttgtgagaawtgcccttcctccctcccaagtcctccagtcaatttctgagcttttccagaatagatcaaattctgctcactccagatgtcttattaatcttttccttccc

SEQ ID NO: 15695 - DNA, 201 bp, Homo sapiens
atgattttggatacttaatactaccaataaaatctaaataacaataatttatgattcttttgcatttgagggaaatatcacagccaggcatggtagaataygggccttagaaattaagacctaaattcaagttcctttgacacttgctaatcaagtcatcacaggtacatttcctggcttttctgaatttgaagtttctca

SEQ ID NO: 15696 - DNA, 201 bp, Homo sapiens
agaagttttacaaaacatcagtcctttgagaatttctatacattgtacaagttatttaaaatctgccaaatgttacaatatgaaatgtaaaactaggaaayccaaatgcaacaagtggaaaacatgggctcagctaataccacaacacactgccaagatggaactctccacaaggtctatcttcctgctacttctgtcctg

SEQ ID NO: 15697 - DNA, 201 bp, Homo sapiens
aaattaagtacattcattgtatttcaatatttctctagccattctttttggttgaaagtgtgtgtgtgtctgtgtgtctgcgtgtagatatggggcattamggcaggcaaacttagaacacaaaatataaaaattgggtggggaaacatctggatgacctcaatatttacctaacattcttctttgcaaatgttctgaatt

SEQ ID NO: 15698 - DNA, 201 bp, Homo sapiens
tattcagctgcaactatttaatccttacaaaaacaaaaaagcatgagttcatataagggccacactgtgtgaggggcatagagagagattttagaggcttygcacagtgcagggagtttggtcttaacccattttataggtaaagaaattgaggtgtaatcacatgagacagaatttgaattctgatctgtcggattcagc

SEQ ID NO: 15699 - DNA, 201 bp, Homo sapiens
gagtccactttgaacgcaggaatcttcacctctttcctttcaactgtatggaatttgaatctgacaaacaacctgtctgttgctagaatttataagtgatytgaaaaaaaatcaaaggccataaaagctatttgtcaaataaactgcagaacacgatatcagtctgcagggctcatttgcagaactcatgatgagcatggg

SEQ ID NO: 15700 - DNA, 201 bp, Homo sapiens
gaacacagaatactttgctttaccaaaacagagaagaaatgggatttagtctctaaacttcatgtgagtttttttccatttttattaaccccagtacacayagtgctaccacagcatgtagttaaatagtcccagtgccacagtcttgtaagcaatacttatgcaagatatattgcattgaaatgagtttgtattttccaa

SEQ ID NO: 15701 - DNA, 201 bp, Homo sapiens
tgcctatttggctcagctgtctgtcgatttttctaggttatgagattgctcttggtgacttttgacaatatgagaacacttccctcacctttaatgatgargcaaggggctccatacacataacattagatagacgagaattccacgaaaaaggataagccatccaatatgctagcatagaccaagatcttaaaataaata

SEQ ID NO: 15702 - DNA, 201 bp, Homo sapiens
ttgtgtgcatattctaatatgtatctttgtttctaaatagttgatgcattctagcttaatccttaataagaaaggacagcttcattacaaaacaaattccycattggcagataagcagatgagagggagaatatttaacattactgataaagaatcaagttatgttctagattcatgcagagttttatagaattggtgcaa

SEQ ID NO: 15703 - DNA, 201 bp, Homo sapiens
gctggcaagatccttccttgtccgttttagtgcattcataatactggtcattttcctctcatacataatcaacccattgaaatttaaataccacaatcaaygtgaagcttgaactccggtttaatataatacctattgtataagaccctttactgattccattaatgtcgcatttgttttaagataaaacttctttcataa

SEQ ID NO: 15704 - DNA, 201 bp, Homo sapiens
caaattaagtctgttcgtggaagacttactttgatttcatggtgtaggagggagatcgtagacttcgaatccactagacctgaagttaaataaacctgggstgcagttttggttagcctggtagcacggcatggtatcagtttcctcatctgtaaaatgggaacaatacttcatgtcccagcacaattttgaggataaatt

SEQ ID NO: 15705 - DNA, 201 bp, Homo sapiens
gcaattgtgatgggatgtgaagaacagaaatcctggtgatatgaatgttaaccaataaagttctcaaacttgccatttagcgcattcctgaattctctgayggcataaataccacaaagtagaagtacaactttactctaagctctaagtcctgtattactcaaaagttcttcaaatcttaaactgctaccaagaatgaat

SEQ ID NO: 15706 - DNA, 201 bp, Homo sapiens
tttttctctctcctgcttctctccataccatttggctcttcttatctctgttctgcatctttagctggagtggaggctgcacttcccttgtcccttaacakgcatatcaaaaaatgaatataagggccaataggaaggctacctgtgaattgtagcaatgttttagcagaagagaaaggatgttccacagaagtgattcct

SEQ ID NO: 15707 - DNA, 201 bp, Homo sapiens
tcaggtgcatattgctacaccaatatgtgaactacatgatgacagcactatttacaaaatagaaacgtttggttcatcagcaaagtaatttttagatgtgrtatcagagttcctttattgttaactccccctgtcctgggtttttatttttctctctcctgcttctctccataccatttggctcttcttatctctgttctg

SEQ ID NO: 15708 - DNA, 201 bp, Homo sapiens
cagagcatctacaaaccagaaaatctgagttctaggctgttttctaatgattcttagacacatatcaatttctaagatcataaaatgaagatacttagtaygactacacctgcctatcttctaggcaggcgtcaaggacattgtaagccataaatcaccaaaaaaaggcaagaaattatttttatcatgactaaaaatttt

SEQ ID NO: 15709 - DNA, 201 bp, Homo sapiens
agaagcatctttaccaccgccaccaccactatcacttccagcaagtttctgctcacatatcagtagctgctaggaattttccaatgcttttgtatagccakgcaagaaagaagagtgttagcaagagctttcgactcagccaaccaacaatgtttgccataccccaaatgctgaactcctccacagaaaggatttgagcat

SEQ ID NO: 15710 - DNA, 201 bp, Homo sapiens
tttttacagggtggctattcaatttttttttacttataagaacaataatgtatttgttcataattgtgtgagttagcaaggcaattctcatcggggctggyctggctcatctctgaagtcatctgccagttttgaaggggattgatggtctaggatagccccattcatttgtctggctcttacaagcttgttggatttaga

SEQ ID NO: 15711 - DNA, 201 bp, Homo sapiens
taaaagggaaaacctgaaaacataaggtaaaggcttttttctgaaacccttgccagtgtttccctgtaaatgttacagccttcaaagaccactcaacattwcccaccattttaaaatccataatttattacaaataagtatagtagaaaggttctattccatactgaatatattaataaaaatagtatttttaaaaaaaaa

SEQ ID NO: 15712 - DNA, 201 bp, Homo sapiens
ttgagtaattatgatgccatcagcacactataagatgtaaacattttaatggtgaaatatttaaaataaatatctttgaatgttcaaattctgtttgatayatttgttctctttatttcctcaaaattacagtcttaaattttttttttcttttgagatggagtctcgctctgttgcccaggctggagtgcagtggcaaaa

SEQ ID NO: 15713 - DNA, 201 bp, Homo sapiens
ggtgcatgccactatgcctggctaatttttctatttttagtagaggcagggtatcaccatgttggctaggctggtctcaaactcctgttctcaggtgaccygcctgccttggcctcccaaaatgctgggattacaagcgtgagccatcgcacccaacctactccatgatttttttgattatttattttgaaattattcagc

SEQ ID NO: 15714 - DNA, 201 bp, Homo sapiens
aacaaacatatgcagtcttttagctacaacactcaaacataattacaatgcccctttccattgaaataatctatgcatcccgccacagtgacttcattccytaccaggatgcctgctgaatcagactgccccaattattcaggcacagtgcctatgcttatgactaataatattggggaataaacgaaattaatgtccatg

SEQ ID NO: 15715 - DNA, 201 bp, Homo sapiens
ataagtaattatttcttatctataatattctacttatatatcaaactgccctcgcctttgccaaagccctcagtggacaaataacttcaaataactactawttctcagagcagtgcaagtcatctaggatcattgtttacattctatacatattgaaaggctttctgtaaaagtgagaaatgttttaatttttaatgatag

SEQ ID NO: 15716 - DNA, 201 bp, Homo sapiens
agtcaaacagttcccaaaacttttagatgtgatggcaagaataagagcagaagatgatctgcacatcaaacagctttttcgtctttgcttagtgtcaagcrtttggcaaaacaaccctttgtattatttcagcatttcagaggcctaattttccatagttgtgactcacatatcctattcataggcagaggtcttataaaa

SEQ ID NO: 15717 - DNA, 201 bp, Homo sapiens
gtcatttacttgtataacctgcatcacctcaggaaggtgcatatgaggttacatcaatatcaagtgagagagcaaggattatgtggtggcctgagtgaatytgctcatgctcctgggtgcaaaagagtgggaactgactgagactgattatctttattccttcttgacagcttaattaagttctctaattagtcacagtca

SEQ ID NO: 15718 - DNA, 201 bp, Homo sapiens
acaaacaaaaggagtgggtaaagagatgtgtatatatatacatactgaaagaactttttctatatatgagtgaatagcttacctaacgtaacagtctttayataataagactacttatttaaattttaaaagaatttacctctagatgggtttttgagtgaatttcctcagaaaattcattttcatggcacagaggattat

SEQ ID NO: 15719 - DNA, 201 bp, Homo sapiens
gggacatgaaattatgggaaaaaagttctttctttctcctcactctttgagaatgaatcttctgtaattctcagtatcttctgagcacagatatataattyttgtagatttaataactagtttaccactgtaaattttaaaacgccaactgccagtctcctgctcaaaagttgttgcctcacctccatcccatggtacttt

SEQ ID NO: 15720 - DNA, 201 bp, Homo sapiens
agatattaaaatgacttaattctcaaaacatgaagtgagtttttgtttttatgcccgttttgcagatgagaaaactgaggcatagggaaggtaagtaacgygcttaaggttacatagctggtaaattgtagccaggagttggaatctaggtgccaaaatctatgctgttaatcactaaactacgctgccttagtttttata

SEQ ID NO: 15721 - DNA, 201 bp, Homo sapiens; identical to SEQ ID NO: 3287

SEQ ID NO: 15722 - DNA, 201 bp, Homo sapiens
taccacaaagtagaagtacaactttactctaagctctaagtcctgtattactcaaaagttcttcaaatcttaaactgctaccaagaatgaatagatgcccmaaatatccactttggggctggatattctgctcaaattaatgaatagactcttgttaaacatatatgccatgaaaactgactatgtgcaagttaaagccta

SEQ ID NO: 15723 - DNA, 201 bp, Homo sapiens
cttttctgtttcccaagcaaaaatcagaattgaacaggaaccaaaactattgagaccttccttctgtttcccaagcaaaaatcagaattgaatgggaaccraaactattgagaccttcctacccacctgtgattaaatgagccaaatgagtagcaacgtggcagatggccctacagttaatgagattcttgcaagcccgca

SEQ ID NO: 15724 - DNA, 201 bp, Homo sapiens
tatatatatacacacacacacacacacacacacatgcgatgacgttcctgaaaatatgatcctagataattaagagaatggggagttgctattcaataggyataaaatttcagttatgcaagatgaataagttctagagatctgctgcacaacatagtgcctagagttaacaatattgtattgtgggccaagtgcactggc

SEQ ID NO: 15725 - DNA, 201 bp, Homo sapiens
ttttaagatctcttttacaatttgataggtcaaagctgatatacttcaaacttgattgctggtgagattgaattttttgtttgtttattaactatttgtayttcttttgtgtgagctgcctcacatttgaggagaaaagctgcctctcacaacattcataaggcttcctgaccctagagaccctctatatttccacaacat

SEQ ID NO: 15726 - DNA, 201 bp, Homo sapiens
acacagttgatcacattctccttcttaacctaccatcttcattacattcaagcatgccactcactggtgattttcttccaacctcactgggactctcttgwgaagttctcttttccatttcatcttaccaacctcttaatgttggggtgtcccaggttagcccttggaccttctcttttgtgtgtaaatttactcctttag

SEQ ID NO: 15727 - DNA, 201 bp, Homo sapiens
gtgatttctattgttttgtatagtctctgatctccagttcatctcattctctctcttactcactccaaaattttgctccacaattctaccaaaactgctcyccttaaggccatcaataaactccacattgctcagtctaaagtcagttctccatcctcctcttacttgaactgtcagcactatttgacacagttgatcaca

SEQ ID NO: 15728 - DNA, 201 bp, Homo sapiens
aactttagttttaattccactttgtgactgcccttagaaaaggggggatggtagggttaggaatagtgacagtgttgataaagcataggagaaggaaaggmtctgtagaaatcttgagagtgaccctaaaatgggaatggttcttaagtttttttgctaaggactactagttaatcacaagggatcctttctgagaacaat

SEQ ID NO: 15729 - DNA, 201 bp, Homo sapiens
ctgcatagcacaggggaaaggagcaaagtccacctgcatcataatccacaatcacagagacaaatgtaggaagaccaatacatagctgtgtctccaagaayctatttccaggactccatcagaatgccaagcccttcttcttataaagtaagtcagattcatttgagcacatagagaagcctgacttttaaaatctaaaag

SEQ ID NO: 15730 - DNA, 201 bp, Homo sapiens
ggagtggagtctaaatacatgtacctgaagcaagctctctgtctaatcttgctaacacaaaatccaccaccaaaaccttgcccactggcagggtgccttcttttttttttttttttttgagacagagtctcactctgtcccccaggctggagtgcagtggcacgatctcggctcactgcaaactctgcctcccaggttgac

SEQ ID NO: 15731 - DNA, 201 bp, Homo sapiens
ttcaacaaaatgagtggtaaactaagaaaataaatacatggaatccaggaaatagggatcctgttctggaaaatggtgaagtactaggtacatagctagarttggatattggagccaagaaatggagtgctgcaggcaaataggattatctgaaatgcctgagtgtttggaaagcttcggcatttgacatatatatatata

SEQ ID NO: 15732 - DNA, 201 bp, Homo sapiens
attactagttgacattgcagtgtgtagctatttttattttttaccatctcatcaacaagaatgcaagaagtcctccagtggaaggcactttgtcttattcwctactgtatccccagcacgaagaacagtgtaagagtttaataaatactcattgaataaacaagttaattttatttttattaaggatctgtggcatttgct

SEQ ID NO: 15733 - DNA, 201 bp, Homo sapiens
taaatactcattgaataaacaagttaattttatttttattaaggatctgtggcatttgctacccgggactaagtaaatttttgctcgagttacaatattgscacatgggggctctgctgttagttgcaagagtatcctaagcattccccaacattcttaagggaactgttcaactgggaatggccacagctacagctacca

SEQ ID NO: 15734 - DNA, 201 bp, Homo sapiens
tgttgagtccaaatgtttccttacctagtctttatgcaatctcgcatttagattttcatcaaatcttttggctctactgccctccaaggccatatgcaaaratgttgcctctgtctagttcatttgaatggaaatccatttgctattgtttgggggctaattttgcaaatcatttcataactttctgttcaaaaactacct

SEQ ID NO: 15735 - DNA, 201 bp, Homo sapiens
gtacaatgtattttacaattatactttctaacaacagaacttctataagcaataataatccattttattgaaaaaaaagaaaaacagcttctatcttatcmtttccagcaaatgttgtaatgataattaataactttattaacaattctccatgttttctttttatttttaagggctctcacttctcccaatcaggattct

SEQ ID NO: 15736 - DNA, 201 bp, Homo sapiens
aggagaattgcttgaacccaggaggcggaggttgcagtgagccaagatcgcgccattggactccatcctgggcaacaagagcaaaactccatctcaaaataaaaaaaaaaaaaagtcactatggccaatatgaaaattaggacctgttaggttgaaaacatccagtctgcagtgagtataggattaaacatgattggagta

SEQ ID NO: 15737 - DNA, 201 bp, Homo sapiens
agttacgcttctattcagacatagggagagagagtgtaaatgaattatctcctccccacagcctttctacagacccttctctcttaattatacacatcccyattgcacaggtcctgccaagcgctggtatccacagggtagatgttgaaaaaagttataattactatcttcagtctgctgctattttacaccctcagactc

SEQ ID NO: 15738 - DNA, 201 bp, Homo sapiens
aaacatgctttggaaaacattggagcacattaacatatatagcattatcaaagtctttccaaatttcttatcatataatacatggtaaacaacaaaatagwaggaagacttcctctaacctctgaaaagtcagaaacttttcctaggtgcctttggtattttctaatcttactctgagtattgtttccctgaaaagatcca

SEQ ID NO: 15739 - DNA, 201 bp, Homo sapiens
gcacagatggtattttacatctgcacatgcaatttcctttttctccatttttatataaacctctctctttttttaagaatgatagaatttaccagtaaaakgcagaactacttaattgcctctagaaatgttcacacctccatttcacatttttagcagcaatttaactgcctttaagtatatgtagaaagatgggagggt

SEQ ID NO: 15740 - DNA, 201 bp, Homo sapiens
aggctgaggcaggagaatcacttgaacttgggaggtacaggttgcagctcagatcaccactgaactccactctgggcaacagagcaagacaggaaaaaaawatatatatgtaaaaatatatatgaaagaaacagaaaaagaaaaagaagaagacaaaagaagtggcatgagtttaagaggaaatgggaggtaaactggcaa

SEQ ID NO: 15741 - DNA, 201 bp, Homo sapiens
attttctgatacaaccaaaagcatttttcttccccattcaactctaattgtatattattattattttacttctatagccattaaaattttctaacttgaaktatatttacttatatctataattatcttcctttcagggaaattttacagggaggaaaaaatcttacattttttttgtatcctaaacatgcttaaggcagg

SEQ ID NO: 15742 - DNA, 201 bp, Homo sapiens
cacgcccggctaattttctgtatttttagtagagatggggtttcaccatgttagccaggatggtctcgatctcctgaccttgtaatccacccacctcgggytcccaaagtgctgggattacaggcgtgagccaccgcgcccaacccactttaactcttttcatacaaatttatctagagaaaatgtccttctaagaataga

SEQ ID NO: 15743 - DNA, 201 bp, Homo sapiens
ctttcgagaataaatacttagacacctaatacgtatgaagtcacacagataattggcatgagccaaatgagggttacttgtactctatataaactcttacrtactctcttatcagtagaaatttctattgagaggtggcttggagaagatctctaagttgctgaatcccacaaagactttaaaaaggtagaaaattctaaa

SEQ ID NO: 15744 - DNA, 201 bp, Homo sapiens
ttatagcatataagctcctataaggaaaatcacttactaaaaatgtcttctcttctgtacatgccagcagtgctattcctcaaagcaataatctgcatagktttaaaattagtggtgctaaatgtcagcgatgactcatgctttagcattatctcttaagtatgcaggtgataaactttaaaaattaagtacattcattgt

SEQ ID NO: 15745 - DNA, 201 bp, Homo sapiens
gactcaatgaaattttattttaatacacttgaaataaaaattcattaattctattcaatcaataaaaaaaactaaggctaaaaattaacggtttggggaayagcagaatagtgaaaaataacagagctttgagagagttatcaccttgcttcctctatgatacctggcatattaataactaccaagactcagagaagctga

SEQ ID NO: 15746 - DNA, 201 bp, Homo sapiens
cttccttagtgactcaatgaaattttattttaatacacttgaaataaaaattcattaattctattcaatcaataaaaaaaactaaggctaaaaattaacgrtttggggaatagcagaatagtgaaaaataacagagctttgagagagttatcaccttgcttcctctatgatacctggcatattaataactaccaagactca

SEQ ID NO: 15747 - DNA, 201 bp, Homo sapiens
tctaaaaacacaattattttcccagttagcgaaagcaattttctgactgttccaataaatcttttatcattttcagaaccatgtaggctactacttatccraatcttctagtaaagaattaagcagtttcatcccaggatttaaaactgttgcactgatctcaccatataggaatagggggcattagcgggataatatagg

SEQ ID NO: 15748 - DNA, 201 bp, Homo sapiens
tgcttggcaaataccagcagacttgctagacacaggcagcagcctccaatttcacagggcttgtgttcccaatgcacacctaaaaggatagctttctcacatgttttgtgattctaacaatgtgtgcagagaggaatggatactgtaactatgaaatggaaaagctctagatttctgagtggttcagaatcacgggcctaa

SEQ ID NO: 15749 - DNA, 201 bp, Homo sapiens
gcttggcaaataccagcagacttgctagacacaggcagcagcctccaatttcacagggcttgtgttcccaatgcacacctaaaaggatagctttctcacatgttttgtgattctaacaatgtgtgcagagaggaatggatactgtaactatgaaatggaaaagctctagatttctgagtggttcagaatcacgggcctaaa

SEQ ID NO: 15750 - DNA, 201 bp, Homo sapiens
gaatagatggtatgcttatttaaatacaagacaagtcattttgccttgctgcactgtatttatcacaaggctattgccagctttttctttaacattaaatacacacacacacacacacacacacacaactgtctttttttttttttaagacagagtcttgctctgtcacctggagtgctggagtggcgtgatcttggttca

SEQ ID NO: 15751 - DNA, 201 bp, Homo sapiens
aatagatggtatgcttatttaaatacaagacaagtcattttgccttgctgcactgtatttatcacaaggctattgccagctttttctttaacattaaatacacacacacacacacacacacacacaactgtctttttttttttttaagacagagtcttgctctgtcacctggagtgctggagtggcgtgatcttggttcac

SEQ ID NO: 15752 - DNA, 201 bp, Homo sapiens
atagatggtatgcttatttaaatacaagacaagtcattttgccttgctgcactgtatttatcacaaggctattgccagctttttctttaacattaaatacacacacacacacacacacacacacaactgtctttttttttttttaagacagagtcttgctctgtcacctggagtgctggagtggcgtgatcttggttcact

SEQ ID NO: 15753 - DNA, 201 bp, Homo sapiens
tagatggtatgcttatttaaatacaagacaagtcattttgccttgctgcactgtatttatcacaaggctattgccagctttttctttaacattaaatacacacacacacacacacacacacacaactgtctttttttttttttaagacagagtcttgctctgtcacctggagtgctggagtggcgtgatcttggttcactg

SEQ ID NO: 15754 - DNA, 201 bp, Homo sapiens
caagacaagtcattttgccttgctgcactgtatttatcacaaggctattgccagctttttctttaacattaaatacacacacacacacacacacacacacaactgtctttttttttttttaagacagagtcttgctctgtcacctggagtgctggagtggcgtgatcttggttcactgcaacctctgcctcctgggttcaa

SEQ ID NO: 15755 - DNA, 201 bp, Homo sapiens
agacaagtcattttgccttgctgcactgtatttatcacaaggctattgccagctttttctttaacattaaatacacacacacacacacacacacacacaactgtctttttttttttttaagacagagtcttgctctgtcacctggagtgctggagtggcgtgatcttggttcactgcaacctctgcctcctgggttcaagc

SEQ ID NO: 15756 - DNA, 201 bp, Homo sapiens
gacaagtcattttgccttgctgcactgtatttatcacaaggctattgccagctttttctttaacattaaatacacacacacacacacacacacacacaactgtctttttttttttttaagacagagtcttgctctgtcacctggagtgctggagtggcgtgatcttggttcactgcaacctctgcctcctgggttcaagcg

SEQ ID NO: 15757 - DNA, 201 bp, Homo sapiens
aagaaagcccaacatactcttaaagacgatgggggaaaggcagtttaagaaataaaagtcctctgtttatccagggaggtactttacaaggcagacagctwcaccacagtagagagacaatatttcctcagctgagtcggttaattaaaatgcacagttacaacagactttcttagagcctgcagctgaatgactgaagtc

SEQ ID NO: 15758 - DNA, 201 bp, Homo sapiens
catttctttttctctttctcatctccacttaaaatttctttcaatttttctttctatccaacttttaagtcaatccatacaacttggatatatgccttcaractgagttaaaaggaaaatactaatagttttatctctcatgaaagcaataattaaaatgacaccatctaataatttaatgtaaaaggagggaaaaattct

SEQ ID NO: 15759 - DNA, 201 bp, Homo sapiens
gggaggccagggcaggcagataacaaggtccggagatcgagaccatcttggccaacatggtgaaaccccatctctagtaaaatacagaaaattagctgggyatggtggcgtgtgcctgtcttcccagctgcttgggaggctgaggcaggggaatcacttgaacccgggaggcggaggttgcagggagctgaggtcacgcca

SEQ ID NO: 15760 - DNA, 201 bp, Homo sapiens
tcaatgagatgatgtagataaaatcatttaatacaaaggttggcacataatactttctccttcccttcattagttccaactgctaaaaatctcagtaccayaatgcgctttgaaagtcatattacactacctatttttattttgaataacagactcctggtggactttccggaaatagaatctaaatttccataagctcaa

SEQ ID NO: 15761 - DNA, 201 bp, Homo sapiens
gctaccacagcatgtagttaaatagtcccagtgccacagtcttgtaagcaatacttatgcaagatatattgcattgaaatgagtttgtattttccaaggaygttgacattacatcttttcaaagaatttaaacaattttttacttgatttggtgagtgaactacctaagtagacaggcagtaaattgtctttctatggagc

SEQ ID NO: 15762 - DNA, 201 bp, Homo sapiens
tatttttactaatttttttttattgtttgggggtttttcatatgctgagaggaaaaatctaggcaagtcaccataaaataaaattttaaggatgccagatyattaaaatcatacttttataagcaataaagaaaaagaaatagttaaagtggatttctcaaggtactttgatattgattaaatcttacaatagatgccact

SEQ ID NO: 15763 - DNA, 201 bp, Homo sapiens
gaaagcctgtttggatgtcagctgcttgggttcagcaaatcctgaaatgctcctctgcaatatccaagtcctgccaaagcaggacaaactatttttagatsaggcatgtcaaaaacgtagtctgttttataaagaatgtgaagactacatcaatatagtaaggaagaaaatgccagttggaaagcaagtgggctattagaa

SEQ ID NO: 15764 - DNA, 201 bp, Homo sapiens
tgtttcataaataaataaatgaaacagcattgagaagccagatttctccaccacacctcacattagttagggagttttcagataaggttcgcgaatgggaragcagcttgctacaggcatgtggttgagagcttaccagaatttctctttccagttttttcgaagaccctaatgtagttagtagaatccttagctctgtcc

SEQ ID NO: 15765 - DNA, 201 bp, Homo sapiens; identical to SEQ ID NO: 3286

SEQ ID NO: 15766 - DNA, 201 bp, Homo sapiens
atctgaaatggaaggtgacaaagccaagcagaatttgggctagaaagtggtgttgccccattctcaaggatttgttgttttatcagtgcatagacatcaattttttttttttttttaagatggagtcttgctctgttgccaggctggagtgcagtggcgcaatctcggttcactgaaacctccaactccctggttcaagca

SEQ ID NO: 15767 - DNA, 201 bp, Homo sapiens
aagacagctgggagccacggtggaaggcagacaatgccctggatttaggtactagtctcctccaggttgtgtttaaaaagctgggtttttttggggtttttttgtttgtttgttttttggctcggcatggtggctcatgcctgtaatctcaacactttgggaggctaaggcaggtggatcatgaggtcaagagatccagac

SEQ ID NO: 15768 - DNA, 201 bp, Homo sapiens
agacagctgggagccacggtggaaggcagacaatgccctggatttaggtactagtctcctccaggttgtgtttaaaaagctgggtttttttggggtttttttgtttgtttgttttttggctcggcatggtggctcatgcctgtaatctcaacactttgggaggctaaggcaggtggatcatgaggtcaagagatccagacg

SEQ ID NO: 15769 - DNA, 201 bp, Homo sapiens
gacagctgggagccacggtggaaggcagacaatgccctggatttaggtactagtctcctccaggttgtgtttaaaaagctgggtttttttggggtttttttgtttgtttgttttttggctcggcatggtggctcatgcctgtaatctcaacactttgggaggctaaggcaggtggatcatgaggtcaagagatccagacga

SEQ ID NO: 15770 - DNA, 201 bp, Homo sapiens
acagctgggagccacggtggaaggcagacaatgccctggatttaggtactagtctcctccaggttgtgtttaaaaagctgggtttttttggggtttttttgtttgtttgttttttggctcggcatggtggctcatgcctgtaatctcaacactttgggaggctaaggcaggtggatcatgaggtcaagagatccagacgat

SEQ ID NO: 15771 - DNA, 201 bp, Homo sapiens
cactttgggaggctaaggcaggtggatcatgaggtcaagagatccagacgatcttggccaacatggtgaaaccctgtctctactaaaaatacaaaaattasccgggtgtggtggcaggtgcctatagtcccagctactcaggaggctgaggcaggggaatcgcttgaactggggaggcagaggttgcagtgagccgagatc

SEQ ID NO: 15772 - DNA, 201 bp, Homo sapiens
gcttgaactggggaggcagaggttgcagtgagccgagatcgcaccactgcactccagcctggcgacagagcaagactccgtctcaaaaaagaaagaaaagaaaaaaaaaaaagctgtttttttttttttgtaattaaaccaaactaaatatttcccaggagggcaagacagttcccaaaatgtctaacgaacttccacgta

SEQ ID NO: 15773 - DNA, 201 bp, Homo sapiens
ttttcaagaataccattatttttaaataaaatgcctctacatggcagatgttattatgttctactttggagatgaaaagaatcgaacattattagttatgrtccacagaaccagaagatttattttaaagataaagttcagatgatgaacataaaggaagttatctcatcaaagaaggcaagactgagtaaatctcagaaa

SEQ ID NO: 15774 - DNA, 201 bp, Homo sapiens
aactttttcaagaataccattatttttaaataaaatgcctctacatggcagatgttattatgttctactttggagatgaaaagaatcgaacattattagtyatggtccacagaaccagaagatttattttaaagataaagttcagatgatgaacataaaggaagttatctcatcaaagaaggcaagactgagtaaatctca

SEQ ID NO: 15775 - DNA, 201 bp, Homo sapiens
cagcctcaagtattcagtgtggcttagaatcacattattttgttttggatttctcaactagcctcatggataatcttccctcttcaaacaatttattatcytgaaccagatcagacctggttgtgatgccgacttaaggggtcgtgccaaagtaggggccatacacagttcctggaggctgactcagtccaagagtggcta

SEQ ID NO: 15776 - DNA, 201 bp, Homo sapiens
gttcatgacccttgataacccttaatatatgctcatggccacagaacctatacagaatcaagggaaaattaattttgtcatagatactctgattgcagaamtatctgtaacactttataaatattgtacaatgtacttactcataaatcatgaaaatggttcctaagtaaaaatccttaaaagtttataagtcaggtttta

SEQ ID NO: 15777 - DNA, 201 bp, Homo sapiens
tttttgagacagagtctggctctgtctccaggctggagtgcagtggcgccatcttggctcattacaacctcctcccgagttgaagagatcctccttcctcmgcctcccaagtagctgggactataggcacgtgccaccatgaccagctaatttttgtacttttaatagaaacggggtttcaccatttggccaggatggtct

SEQ ID NO: 15778 - DNA, 201 bp, Homo sapiens
gacgttgccaaattgtaaaacaagacttggaaatcacagaaaatgttgctagttattgatcacggtgaccattcagttcctactgagccacccaaaagaaycattcattttccagcagagagcctgctcatttgcaagataaaagagagacatttctgcacatgcccataatgttcttcaccactgggggcagctttacat

SEQ ID NO: 15779 - DNA, 201 bp, Homo sapiens
tcttgtgacagagaaaataaaataaatattgaaaagtattatgacagaaactagctagcttcccaccacatctgttccatcttcttcctgggcccacaggmagtataagcttcccactctcctttacagttagaaatggcaatatgactgcattctaacatgaaggaagtggtgggatatttccagtcttagccaataaaa

SEQ ID NO: 15780 - DNA, 201 bp, Homo sapiens
aatagtactgtttatatgagtattgtagagcaagcatttcagagcaagttattatatttataaagattatctgaaattcagttggataatcctcctgaatwtaaaatatattgtattattttattgttgttgttgattagccattctaaaaaaatctgtcctcctaaaataaaaatgcattgtaaaattatttccttcagt

SEQ ID NO: 15781 - DNA, 201 bp, Homo sapiens
cataatcagctcaaaatttattatactatatatagcatcaaagaatacatttttttagagatgaaatgaggtctatgttgcccaggcttgcctcaaactamtgggctcaagcagtcctcctgcctcagcctcctgagtagctggacctaaggcacgcaccactgtgccttgcagaatacattttattaacgtaaaaatcat

SEQ ID NO: 15782 - DNA, 201 bp, Homo sapiens
cgaggctgtgcccattcatttgtttatttatgcaataaatattatcttttttcaattctagagatacaacagtgagcagagacaaaagtttcttccctcamaacacatataattctaactctgggaaatgaatattaaagtaggataaaagcaaaatatataaaacattggataaaaattgtgaaaaaaaataataatgca

SEQ ID NO: 15783 - DNA, 201 bp, Homo sapiens
cagaggttgcagtgagccgagatcgcaccactgcactccagcctggcgacagagcaagactccgtctcaaaaaagaaagaaaagaaaaaaaaaaaagctgtttttttttttttgtaattaaaccaaactaaatatttcccaggagggcaagacagttcccaaaatgtctaacgaacttccacgtagagaaaacggttactg

SEQ ID NO: 15784 - DNA, 201 bp, Homo sapiens
tgaaccacatcagctgagtacatcacagaaatgctttcactgtattgagctttaatgttattcttatagcttttatcaacatttgctttaaaaaaaatccrtagctgaagcatgcgtctgcattttacaaagaaactgtccagtacattattctatattccctatttagtagccaacattagaattttaattcaagttatg

SEQ ID NO: 15785 - DNA, 201 bp, Homo sapiens
aatttatttgatgtcattactttttaaaataaccaaatgtcatatatttatcattttaaagaattaatatgcagctgggttaactcggctatgtaatatatttttttttcaggatatacctttcagattattcaaagaaatagctaaaaatgagctatcagattcaaagaagctttttaacatagccaactgtaggtcagt

SEQ ID NO: 15786 - DNA, 201 bp, Homo sapiens
atcctttgcctggttgccagggcaaccgggatcactttctttaaccacactggagcttattctgtgtaatcatttgccaagcaatcatttgccaagcaatmatttattcagtcattcaacaagcacaaatcaagtgccttttatgtgcctcacacttgtaagtgatgaggatacaatgcccaataaaatgttctggttgcc

SEQ ID NO: 15787 - DNA, 201 bp, Homo sapiens
gtaatcccagcactttgggaggccaaggtgggcagattacttgaggtcaggagtttaagacgagcctggccaacatggtgaaaccctgtctctaccaaaamtacaaaaattagctgggtgtggtggcatgtgcctgtaatcctagctgctgggggcgctgaggcaggagaattgcttgaacccaggaagcggaggttccag

SEQ ID NO: 15788 - DNA, 201 bp, Homo sapiens
tcactcagcctccctaatagctgggattacaggcttgcgctaccacacctagctaatttttgtatttttaatagagaccaggtttccccatgttggccagsctggtctcaaatgccttacctcaagagatccgcctgcctcggccttccaacgtgctgagactacaggcgtgagccaccgcgcccggcctatactgcttct

SEQ ID NO: 15789 - DNA, 201 bp, Homo sapiens
acccaggaagcggaggttccagtgagctgagaacacaccactgcactccagcctgggcaacagaatgagactccatctcaaaataaataaataaataaacwaatattatatgtaaatatatatatttactttatgagctatttcttttaaaataacatccattgctttattttctgactgcaaaagcaaatatactcattg

SEQ ID NO: 15790 - DNA, 201 bp, Homo sapiens
ccaataaaatcatatttaacgggttgatttccaaagtatgagtttgttttacaaaatttaagaggaggaaaaaaagaatatgggtgggatttgtggaggtmctgctatagttaatgagaagatatcacaaatcaggtaaaaatactctctacagatttcttttatgtttgcctcacatactgccaggtattaagcatcaga

SEQ ID NO: 15791 - DNA, 201 bp, Homo sapiens
cagctactcaggtggttgaggaaggagaattgcttgaacccgagaggtggaggttgcagtgagccgagattgcatcgctgcactccagcctgggcaacaakagcgaaactccgtctcaaaaaaataaataaataaataaataacttagctgtgtcacacacagcctctgaacacacattttaccccgtcatacttgacttc

SEQ ID NO: 15792 - DNA, 201 bp, Homo sapiens
acacttagtcaaacttttattcctaagtgtggaataatcaaggttgtatatagaaatccatactttagtataacatcatgagtgaaataaatttgcacacactatatatatatacacacacacacacacacacacacatgcgatgacgttcctgaaaatatgatcctagataattaagagaatggggagttgctattcaat

SEQ ID NO: 15793 - DNA, 201 bp, Homo sapiens
agtaaagactttaggcaaatagtcaatgaaatcgagcagacattttgaaaatagaatgtagttatgtcaaacagcatgtgcaatgagaattttccaggccragaaggaagtcagagataactgatacaacaagctagttctacttaaaaaaaaaaaaaaaaagttcttggagtttattttcccttaatatttagcaaacta

SEQ ID NO: 15794 - DNA, 201 bp, Homo sapiens
acttagtcaaacttttattcctaagtgtggaataatcaaggttgtatatagaaatccatactttagtataacatcatgagtgaaataaatttgcacacactatatatatatacacacacacacacacacacacacatgcgatgacgttcctgaaaatatgatcctagataattaagagaatggggagttgctattcaatag

SEQ ID NO: 15795 - DNA, 201 bp, Homo sapiens
gttcagagggaactatccaaggtcacactgctatattcgtttattcttctgatcctgagacattttgcttttctctactgatgagtgtatgctgcactgcrttggacaactttatatggagcccaaccttttcttttcactggagtttcccatccactcttatttcttcagttttgtggtttgtcattgtttgtttgttgt

SEQ ID NO: 15796 - DNA, 201 bp, Homo sapiens
cattttccagcagagagcctgctcatttgcaagataaaagagagacatttctgcacatgcccataatgttcttcaccactgggggcagctttacataagaytgcattcactgaaaccaaagcaacagtccgagcagctttcagaatgacagtctgcagaagtgagctgagcgtgtgcgcggtacggggctctcctgccttc

SEQ ID NO: 15797 - DNA, 201 bp, Homo sapiens
aaaacttttaaaaagtatacaggcaaattactaaaatcttttagaacacagtcttttctttttctcttgagggactactctatgtctttgcagtaacttcygcagcctcaagtattcagtgtggcttagaatcacattattttgttttggatttctcaactagcctcatggataatcttccctcttcaaacaatttattat

SEQ ID NO: 15798 - DNA, 201 bp, Homo sapiens
tagattattctaatcttgtgacagagaaaataaaataaatattgaaaagtattatgacagaaactagctagcttcccaccacatctgttccatcttcttcytgggcccacaggaagtataagcttcccactctcctttacagttagaaatggcaatatgactgcattctaacatgaaggaagtggtgggatatttccagtc

SEQ ID NO: 15799 - DNA, 201 bp, Homo sapiens
acaacaacaacaagtattgttcttagttacattttgaaaatccagacaagttataatgcccattaacatatgttcttaatttttactcaaatactgatgaycgctataaagacacatgcacacgtatgattattgcggcactattcacaatagcaaagacttggaaccaacccaaatgtccaacaatgatagactggatta

SEQ ID NO: 15800 - DNA, 201 bp, Homo sapiens
gtctcatctgtttacactagagcctgtgttcattccatcagtaaatagttattgagcacctaacacatgccaggtactattctaggagtcatccgctaccaaaaaaaacactttttaagtcaagacaatgtatttaccagaaatgaaaatatttcaacgaatgatgacgttctttcagaatatgatttcatttattgtcag

SEQ ID NO: 15801 - DNA, 201 bp, Homo sapiens
tgcagtgtacaaagtcaatatacaaaggtaagtatactattttttaccaaccacaaatgatgaaaaattttaaatatacactgaaggccgggcacggtggytcatgcctttaatcccagcattttgggaggccgaggcgggcagatcatgaggtcaggagatcgagaccatcctgactaacacagtgaaaccctgtctcta

SEQ ID NO: 15802 - DNA, 201 bp, Homo sapiens
acaacaaagccatgaggatagattaaaaaataaactgctacataaacttgatcttcaaaatacttctcaatgcgttcatgattccttttaatattattagrgtaaatagtaaatatagcctgcagaagttttaccctcttaattttcattcctttatgctttttttcttgtatgtacttgatgactaaagtcacacttaaa

SEQ ID NO: 15803 - DNA, 201 bp, Homo sapiens
gatacctcttccaatattaccttgtcacatattaatcattttcattaacatgctttcattatcatagtttataccatttatatgctattctctaatttctraagctgttattttttatccatagatagatttgatgctaaccatcttaaatcagagttcctccattcttgagctactgatgttgactcatcatgtatgtgc

SEQ ID NO: 15804 - DNA, 201 bp, Homo sapiens
caattaggatatggacttcctcagccttatcagatgttgccaaattgctctccaaagaactaatatcaatttacattccagccagcagtgaatgaaagttycagtttctctacctcccagacatatgtattgtcatgctttaatttttatcatctaatggctgtgagatgcaattttattattgatttaatttttatttcc

SEQ ID NO: 15805 - DNA, 201 bp, Homo sapiens
ggtaaggcatcttaccagttcttatgcactgcaatggccactaggtaatattctttaagcaatactgttatacatattattatattacagcaatcctaaaygagataggaaagacatcatctttcattttctacatggagaaattaaggctcagagaagttaggtgaaaagactaaagtcaaaaatgctaatgggtgtaag

SEQ ID NO: 15806 - DNA, 201 bp, Homo sapiens
agaaaatataactagagcttactataatatgttctgcaggtgggaaaaatgttacagctccatgaacataaagcaatcattaattagcagcaaagacacgycattttcaatcttatcttttcatgattttaaaaaaaccaacacttttcccttatattttccaggtaaggcatcttaccagttcttatgcactgcaatggc

SEQ ID NO: 15807 - DNA, 201 bp, Homo sapiens
aaaattatcacaatttatacccaacatacctaaagaaccctgtccattgtgccctcattggttgtcctcttaacttggacaaatgtaatcacgtctttgaygtatttccagcttcacggtggttttggatatacacttctgtaaaatgatcaagatttttgttggaattcacgagtgtttgttaaagttttattaaaagcg

SEQ ID NO: 15808 - DNA, 201 bp, Homo sapiens
ctcataataaccctaggaggtaggtattatcatcaaccatacatacagaagagaaaatggaagcagaacttgaggaagtaatttgcccaaggacctacagrttgcatgtggcagaggtggaattcagtcccagatcatcaggccccagaacctggcttcataaacacctgcccttgaaacccactatggagccccaggagt

SEQ ID NO: 15809 - DNA, 201 bp, Homo sapiens
agggactcggaggttgcagtgagccgagatggagccactgcactccagcctgacgacagagtgagactctgtctaaaaaaaaaaaaaagaaaaaaaaagaraaaaaaattaaataaactaataataaaatcataaaatctgggctgtgagttcacttctagaatgctaggtactcatggaaatttacctaaaaccaaaaag

SEQ ID NO: 15810 - DNA, 201 bp, Homo sapiens
gaaactttcattctattccataacatgtacatgttggtgataatataaatgagtattttttccctaaaatttttagtagaatttcaccctaggctatgtgyaactttaataatgatgatgataatgatgacgatagcaaatatatagagtgcttacatgtaccaggtacttttctaagcactttatatgtatgaactaatt

SEQ ID NO: 15811 - DNA, 201 bp, Homo sapiens
atctcttatttccttttcccaggtcacacctctccatctggagtgagtggctaaaaacatatccttttgcatcagagactttctatgttatggtttgtacrtactgtctcttcttccttcttcactcctcttcatctctggcattctctggttctgaaacttggatctaagcaagaaccctgtcattctagtatagattct

SEQ ID NO: 15812 - DNA, 201 bp, Homo sapiens
ttccctgttaaaatgatgacacatgtaaggacagccccatggcatggtgtctgatacttcatctctgttagctttttcttcccataatgcttcttccctcaaaaaatgctgatcacagaaattttgaaacacaagatatttgtggctttttttttcagtggaaaccatcattattgcctgtaaccttgatccgttctaata

SEQ ID NO: 15813 - DNA, 201 bp, Homo sapiens
gggggctttgataatgactctgccatacttctggccatgcgacctggaagaatttgttaaccattctatccctcaattgccacatcagtaaaatggggagyataaacagaacttagaacatagatgtttgtggggatgaataggattatataggtgagatacagagtactgttgtgcacacattgagtgcccaataaatgt

SEQ ID NO: 15814 - DNA, 201 bp, Homo sapiens
ttctcttgctagacttttttactccattcctctgtcaccaaatctcttatttccttttcccaggtcacacctctccatctggagtgagtggctaaaaacawatccttttgcatcagagactttctatgttatggtttgtacgtactgtctcttcttccttcttcactcctcttcatctctggcattctctggttctgaaac

SEQ ID NO: 15815 - DNA, 201 bp, Homo sapiens
tggttgtagattgagagaaaaaacaggagcagtttgcagtctcttgtttctcttgctagacttttttactccattcctctgtcaccaaatctcttatttcyttttcccaggtcacacctctccatctggagtgagtggctaaaaacatatccttttgcatcagagactttctatgttatggtttgtacgtactgtctcttc

SEQ ID NO: 15816 - DNA, 201 bp, Homo sapiens
aatgtttgctgtttatttcagtgagtagttatttcagtttttaatagatatgttttcctttattaggatttgttaaaactaaaaaaattaataataacttcaaacaatcattgttatcatttccaataagcaaagcagacaatttaaagagacagaattctcagacatgcaatgctatttcaaagtccattcacgtgctgt

SEQ ID NO: 15817 - DNA, 201 bp, Homo sapiens
aaacttagtatcattattattctaaacataccaaggctcaagttttcattacctaaaatatactcttcgtaagacttgtggctgccgaataaaatacattmatcagatgcagtattgctttcacggtaattatgatactatttataatgccatggttatgttcataggccactaacaaacatatgcagtcttttagctaca

SEQ ID NO: 15818 - DNA, 201 bp, Homo sapiens
atgtttgctgtttatttcagtgagtagttatttcagtttttaatagatatgttttcctttattaggatttgttaaaactaaaaaaattaataataacttcaaacaatcattgttatcatttccaataagcaaagcagacaatttaaagagacagaattctcagacatgcaatgctatttcaaagtccattcacgtgctgtg

SEQ ID NO: 15819 - DNA, 201 bp, Homo sapiens
tgtttgctgtttatttcagtgagtagttatttcagtttttaatagatatgttttcctttattaggatttgttaaaactaaaaaaattaataataacttcaaacaatcattgttatcatttccaataagcaaagcagacaatttaaagagacagaattctcagacatgcaatgctatttcaaagtccattcacgtgctgtgc

SEQ ID NO: 15820 - DNA, 201 bp, Homo sapiens
tcccagtcactgctctgtcagctttaatacaatgcatccatttgtcttactaacacttcaatttatgggatagctgtttttcacaattaaaactactgaarctttagtatacatggaaatgatcatgatagcattttctccatatttctaacaactctggaaggctctattgtaaaaatatagggccttccagatgactag

SEQ ID NO: 15821 - DNA, 201 bp, Homo sapiens
gtttgctgtttatttcagtgagtagttatttcagtttttaatagatatgttttcctttattaggatttgttaaaactaaaaaaattaataataacttcaaacaatcattgttatcatttccaataagcaaagcagacaatttaaagagacagaattctcagacatgcaatgctatttcaaagtccattcacgtgctgtgca

SEQ ID NO: 15822 - DNA, 201 bp, Homo sapiens
gcaaaagttaataaaattggaacactatagaaacacagaaaaccctcatatttcaaaattaaagatatttgtactacttttatttatcattttcaattgayggtttgcactcaaatatttcattaagacttcagttatttcaagaatttaaacatgattttatgcattaaaaggtatcagttaaaagacctgtgactgaat

SEQ ID NO: 15823 - DNA, 201 bp, Homo sapiens
ttggagaagatactgttcctatgatctcttttattttgtacttcaattccaaaatttataatgtatttgccaaagactttctttagtagctaatggaaaawaattctaaagaagagatggtggtaaggctgtaattttttaaaagaatgactattctttcattgagatgatatatgtcctatataaaaacttcaagtaata

SEQ ID NO: 15824 - DNA, 201 bp, Homo sapiens
cttctgtgcatataagacaattaaattagaaatgtatttattactattttagttataaagaaaacggaagacagggcaaaagttaataaaattggaacacyatagaaacacagaaaaccctcatatttcaaaattaaagatatttgtactacttttatttatcattttcaattgatggtttgcactcaaatatttcattaa

SEQ ID NO: 15825 - DNA, 201 bp, Homo sapiens
tctgtcacccaggctggaatatagtggcccaatctcggctcactgcaacctccgcctccagggttcaagcgattctcctgcctcagcctcccaagtagccrggactacaggggtgtgccaccacgcccagctaatttttgtattttttaagttgagatggggtttcaccatgttggcaaggctggtctcaaactcctgacc

SEQ ID NO: 15826 - DNA, 201 bp, Homo sapiens
gattgtaggagatacaaataacgcaactaagaagtttgttccaatggctatatgtaaaaccatggaccctacaattagagaacacacattcacttaaatayataataagctttaaaactgaacatatacataaagcaaatctcaatcaacaccaaaaattcagtatcactcagaacttctgtgcatataagacaattaaat

SEQ ID NO: 15827 - DNA, 201 bp, Homo sapiens
ctcatgcctttaatcccagcattttgggaggccgaggcgggcagatcatgaggtcaggagatcgagaccatcctgactaacacagtgaaaccctgtctctrctaaaaatacaaaaaaattagccgggcgtggtggtgcacgcctataatcccagctactcaggaggctgaggcaggagaatagcttgaacccgggtggcgg

SEQ ID NO: 15828 - DNA, 201 bp, Homo sapiens
tgtcacagatcaacaataatgggagatttcaatgcacttttcttataactgatacatcaggcagcagaaggcattagtggattgtaggagatacaaataaygcaactaagaagtttgttccaatggctatatgtaaaaccatggaccctacaattagagaacacacattcacttaaatacataataagctttaaaactgaa

SEQ ID NO: 15829 - DNA, 201 bp, Homo sapiens
attggttcattgatcttgttaatgctcagatattggtaaattatttatttggaaggaccttcagagcctactaaacattctttggcatgtcattgatgttsctttaaatattttaacttgctcaaaagttatttataaccaatattaatgaattttaaaagaaaccacaagaggccgggtggggtgactcacgcctgtaaa

SEQ ID NO: 15830 - DNA, 201 bp, Homo sapiens
gcacacgtatgattattgcggcactattcacaatagcaaagacttggaaccaacccaaatgtccaacaatgatagactggattaagaaaatgtggcacataatacaccatggaatactatgcagccataaaaaatgatgagttcatgtcctttgtagggacatggatgaaattggaaatcatcattctcagtaaactatcg

SEQ ID NO: 15831 - DNA, 201 bp, Homo sapiens
tctaaaattggtattcctggattactttaatgactcagaaaatattaaatacctatatttctgtcaatgataatgacttgccttttttttctttcatgactttttttttttttttttgatacacagtctcgctctgtcacccaggctggagtgcagtggtgtgatctcggctcactgcaacctctgcttcctgggttcaag

SEQ ID NO: 15832 - DNA, 201 bp, Homo sapiens
aaaaacctctagtgtgtgtaataattctgccttaattattttagagattaccttgctctgctctaagactatgaatttatttgcttagtggcatgtttccktgtttaactatttaaaaaaacaaaacactaaagacaattctctttaattacaaagagataatatgtgatgttaagtgttatttagatttaaatttttaaa

SEQ ID NO: 15833 - DNA, 201 bp, Homo sapiens
ctggtatttttgtgggagtaaggcttgggaatttcagacctcagagctaacagtgggcagaggatgaaagatgtacctcaaaggttcttaaaagccataakgatatcaggggtgtcttaaatttccccaacaacctccatatccctaatgataagttgccactgtaaatggctgttgtgtaatccatcatgaatatagatt

SEQ ID NO: 15834 - DNA, 201 bp, Homo sapiens
atttcctggtatttttgtgggagtaaggcttgggaatttcagacctcagagctaacagtgggcagaggatgaaagatgtacctcaaaggttcttaaaagcmataaggatatcaggggtgtcttaaatttccccaacaacctccatatccctaatgataagttgccactgtaaatggctgttgtgtaatccatcatgaatat

SEQ ID NO: 15835 - DNA, 201 bp, Homo sapiens
gtagagaggcaaaaaaggcacattggaaataaagaagtttctacggaacaataaagaaggaatcagcaaaaaatatagtaattccaaactcatatgtgagwaataacattgtccagaatatacaaagtaaaattgagattagaaagagcaattgtcacagatcaacaataatgggagatttcaatgcacttttcttataac

SEQ ID NO: 15836 - DNA, 201 bp, Homo sapiens
aaaagttgaaaataaaaagatgaagaatgacaatgaacagaagaaagtgagacacttgtagagaggcaaaaaaggcacattggaaataaagaagtttctayggaacaataaagaaggaatcagcaaaaaatatagtaattccaaactcatatgtgagtaataacattgtccagaatatacaaagtaaaattgagattagaa

SEQ ID NO: 15837 - DNA, 201 bp, Homo sapiens
agctcattcttctacaacaattgtaattatatttctaaaatgagatggctgatgccattcccctacataaataagatgcaaaccaaattcctaacacggcrttttagcacagcctttgcatatctcaccagatttatgtctcatctaccttcccatatactccagtgctacaattctttttctataagcagaaataagtgc

SEQ ID NO: 15838 - DNA, 201 bp, Homo sapiens
gggaattacacaggatctcatctttttccttttcttcatacccactgccatagccttggttcaagtcctcatcatctcttacatggcccatggtagcagtsagctagcaggaccccctgcttctagatgtacctcttttaatccattctccaaacattcaccaagtgatctttttaaaacacgaagcagataaagttaccc

SEQ ID NO: 15839 - DNA, 201 bp, Homo sapiens
aatctagatctctagcccaagatgtgtcagttgagcaacagacccatgtttccaattcctctgaggtgtcattgcttgaatgtcacagaaataatgcacaytccataatctcaaacataacccatgatttccatactctcctccttttgtatttctctctccgtgaatagaaccaccatccacccaggcctctatgacaga

SEQ ID NO: 15840 - DNA, 201 bp, Homo sapiens
atcattacataaaataaaagtgaaaaagaaatacaacaaatttcagactgccttatgaaatacaatagctaagcttaaatattcacagggctaatcccagaaaaggcagtctggactcggttatccacataactacctctattatccatttcatattagaatgtagaattataacatagttaatggggtttcaatttaaag

SEQ ID NO: 15841 - DNA, 201 bp, Homo sapiens
cctgctacttctgtcctggtatttcccagagttcatgccttctcattccaagtatatgctaaatactcctaaatctagatctctagcccaagatgtgtcasttgagcaacagacccatgtttccaattcctctgaggtgtcattgcttgaatgtcacagaaataatgcacattccataatctcaaacataacccatgattt

SEQ ID NO: 15842 - DNA, 201 bp, Homo sapiens
agccagtacatagataaattccttacatgatgatcaacaccaaggaaacctcttactgttctcagacctaacataaagaatgatgattttcattcactgtsaggtacaaaagcaataatatatgcaaaataggaatacaggaaatattgcacagctcactaatatactgcaagttactaatgggaaaaatatcaaaatacc

SEQ ID NO: 15843 - DNA, 201 bp, Homo sapiens
actacattcaatactatttatagaatacagctgcagggctttgtatatctaataattattgtgaagaagttttacaaaacatcagtcctttgagaatttcyatacattgtacaagttatttaaaatctgccaaatgttacaatatgaaatgtaaaactaggaaacccaaatgcaacaagtggaaaacatgggctcagctaa

SEQ ID NO: 15844 - DNA, 201 bp, Homo sapiens
tcccaaagtgttgggattacaggcgtgagccactgcactcggcccacacatctttatacaagaggagtgaagttatacacattgtagtctatcctacaatttttttttttttgagatggagtctcactctctctcccaggctggagtgcagtggcaccatctcggctcactgcaacctctgcctcaggggttcaagtgatt

SEQ ID NO: 15845 - DNA, 201 bp, Homo sapiens
aaacaaaacagtggaggttttctaaaaaatcattattttccatgattttgtgggcagccacaaaattccgtttcccatggtatcagcccaggcactggacratcatgaggtccaaaatagcctcattcgcatggttgactaccacagtgctagctgacaaatgggagctcagctggggttttcaactaaagcctttgtttt

SEQ ID NO: 15846 - DNA, 201 bp, Homo sapiens
ctcttcctactcagtacagatgatcaaggtgggataacacagaagaatcttcacacccactcatcactctctctctctctctctctctctctctctctctytctctcattaaaagcactaagcggccaatgccttactgtctattccatgggcttcactaggctgtcccttcttaggcctagaacgaaatgggcttcacaa

SEQ ID NO: 15847 - DNA, 201 bp, Homo sapiens
gattagaggcatgcaccagaaaacaaaatattttattcatcattagtaacatttgccagaactctgtgctgtttaaacttcataaagtatatcacatgtakgatattttctagttttctagtctcttctgtatatatgccagaataatatcaaatactttcatttaatcagttatgattattttataccaaagaaatctca

SEQ ID NO: 15848 - DNA, 201 bp, Homo sapiens
gcttagtatccatcgctcctttataattccacatattcacgtaagaaggcaatgataattcaggaggtacttcaagatcagtcagtgcctcctggttattaaaaaaaaaactttataaataaaaaggctgtaccccaataatataaatttgtcaacaatgtggagatataaaaatttaccccagaacatcaggaagaaaca

SEQ ID NO: 15849 - DNA, 201 bp, Homo sapiens
tagttaatttgttttgaatggtgaggcaaacaaagcatcattattcctatgaacatttaacagtttttgagtaatcatgatggcatgtattgaacattttrgtgaaacaaatatctgctaatgatggaaatgtatttgctagtggtacaagtcttacaagacacgctgcagaagaaccttcagaaaataacctctgacctt

SEQ ID NO: 15850 - DNA, 201 bp, Homo sapiens
tacatatatgacatgaaaaagaaatacatttttgttttaagctatgactttaactagtttttttaaattgtttttgacagtgcagcatagactagcctatsttgactggtagaacaaactaaagctgtgtgaatgaagaaaaaggcatccagaagtgacctgtcaaaataacctcaaagagtcatgggaaccttccttagt

SEQ ID NO: 15851 - DNA, 201 bp, Homo sapiens
tatatatatatacattatctcttaggatcatataacaaagtttgaggcaggtggatgatatttgtatccccattttatagataagaacgttaaaacccacrgagtaaattgtttaaagtcactcaagtactaaaccttactcagtgtgatcaaaagcccatattctttattgtaacttatagcatataagctcctataagg

SEQ ID NO: 15852 - DNA, 201 bp, Homo sapiens
ccacagaagtgaaacaatttttaagtatgtgtgtatatttatatatttgtctgttcgtattagaatcattttatgacaaatggaataattcagtaaccactttaatttaatactgcatgtttaatatttattgagcaataaaccatacactaagcaaaaagttactaaccctcccccaccaaaaatgatttgctcgtattc

SEQ ID NO: 15853 - DNA, 201 bp, Homo sapiens
tgttagccttcatatttcctacatgtgggggctgcatctgcccaaagagttcctctttttctaattaacacaaaggtgatggataggccagtggctgtctygtgcaaatctaggatgcgtttcaataagccagacccagcaaatgattctcaagcttagtaaggtttgaaaaccactggtaagagttttgggagcagaggg

SEQ ID NO: 15854 - DNA, 201 bp, Homo sapiens
ttcagttatgaatttctaagtttatatctggcaactcagtttcatattggactaaaatttggcagtattgccaaactgagatttgatttatttacccaatytaaacaaaatatgtttagctatttgaagtcctataagcacaataaaataaaaagtctttagatacatgacactatttttataattgtataaatcattaag

SEQ ID NO: 15855 - DNA, 201 bp, Homo sapiens
tgccttaattattttagagattaccttgctctgctctaagactatgaatttatttgcttagtggcatgtttccttgtttaactatttaaaaaaacaaaacmctaaagacaattctctttaattacaaagagataatatgtgatgttaagtgttatttagatttaaatttttaaaaatgaaaaatatatgcctatttttgct

SEQ ID NO: 15856 - DNA, 201 bp, Homo sapiens
tttaccttatgtttatacaattcttatctcagggccacgttgctaccataaatcaaatatgccaggtttcaagtttcagcatatgagcacagatgtgagcraacagcttttgatcactcagttatctctaccagagtaactgaaacagggattctcaacacatagaacttctaatccaggctgacctcaattaactgcaag

SEQ ID NO: 15857 - DNA, 201 bp, Homo sapiens
agtctaatacccacatttagcattcaaggtaactgagaaataaagaggtcaaatgttgctcaagatgactcagcaagttaggagccagtgtggaccagatmagtgtccttttctctacaccatgtggataatggatgtttatagcaaagttaacattgaacctgttgagattcatgtagataatctggaattttatgtctc

SEQ ID NO: 15858 - DNA, 201 bp, Homo sapiens
atccttgcataaaacagatgagaagctcatctcactatgagatgggttggagaagtcttcattttctttaagagtttatactcaagcttgtcagtagacawcattaagctgttatgagattccttctcttgctcagttgaatctgcttcatgaaccaagtcaggttctcttccatggcaaaagtaatgaggtggggccaat

SEQ ID NO: 15859 - DNA, 201 bp, Homo sapiens
gtttgatacactatgttatgtcagtgcttctgattgccaaaaccaacagttcatgtttaaaacctttcagaacattctgcagtctgattaggtcacctctsaatactaggaactaaaatgagaccacagctaagaagaaaggagacaggtgcaatttttttcctacttattctcatttcctaataataatataatcaatag

SEQ ID NO: 15860 - DNA, 201 bp, Homo sapiens
cacagaagtgaaacaatttttaagtatgtgtgtatatttatatatttgtctgttcgtattagaatcattttatgacaaatggaataattcagtaaccactttaatttaatactgcatgtttaatatttattgagcaataaaccatacactaagcaaaaagttactaaccctcccccaccaaaaatgatttgctcgtattca

SEQ ID NO: 15861 - DNA, 201 bp, Homo sapiens
gagccacgtgcgtaggttttgaaacacggacacagggcaggactaagggagagggaagcagaatatgttgtaaggacttaactttttctctgaatgaaacrggtggccacaaagtggcacatgacatgacctgattgacattgtaacaggggagcaaggcagaattagagagacagttataagagtatcacattgattcag

SEQ ID NO: 15862 - DNA, 201 bp, Homo sapiens
acagaagtgaaacaatttttaagtatgtgtgtatatttatatatttgtctgttcgtattagaatcattttatgacaaatggaataattcagtaaccactttaatttaatactgcatgtttaatatttattgagcaataaaccatacactaagcaaaaagttactaaccctcccccaccaaaaatgatttgctcgtattcac

SEQ ID NO: 15863 - DNA, 201 bp, Homo sapiens
cagaagtgaaacaatttttaagtatgtgtgtatatttatatatttgtctgttcgtattagaatcattttatgacaaatggaataattcagtaaccactttaatttaatactgcatgtttaatatttattgagcaataaaccatacactaagcaaaaagttactaaccctcccccaccaaaaatgatttgctcgtattcact

SEQ ID NO: 15864 - DNA, 201 bp, Homo sapiens
agaagtgaaacaatttttaagtatgtgtgtatatttatatatttgtctgttcgtattagaatcattttatgacaaatggaataattcagtaaccactttaatttaatactgcatgtttaatatttattgagcaataaaccatacactaagcaaaaagttactaaccctcccccaccaaaaatgatttgctcgtattcactt

SEQ ID NO: 15865 - DNA, 201 bp, Homo sapiens
catggtgaaaccccatctctagtaaaatacagaaaattagctgggtatggtggcgtgtgcctgtcttcccagctgcttgggaggctgaggcaggggaatcrcttgaacccgggaggcggaggttgcagggagctgaggtcacgccactgcactccagcctggcaacagagcaagaccccatctcaaaaaaaaaagaaagaa

SEQ ID NO: 15866 - DNA, 201 bp, Homo sapiens
gggtcattcttctacttacaacaattccctttggtattccttttagtgcaggcctcatactgattaattctctgtttttgttttgtttttgtattttgggtttttttttttttttggtcagaaaatgtctttgtttcgatattttcaatagatatatttgtattagttacagaattgtaggtttgcagttatcttctctca

SEQ ID NO: 15867 - DNA, 201 bp, Homo sapiens
tatttttagtagagacagggtttcaccatgttggccaggatggtctcgatctcctgacctcatgatcctctggccttggcctccaaaagtgctgggattayaggcgtgagccaccatgcctggcctcacattccttcttttaattatttgcattgtacttacaattttgatattttctttttagtttgtgcatctgtttaa

SEQ ID NO: 15868 - DNA, 201 bp, Homo sapiens
ggtcattcttctacttacaacaattccctttggtattccttttagtgcaggcctcatactgattaattctctgtttttgttttgtttttgtattttgggtttttttttttttttggtcagaaaatgtctttgtttcgatattttcaatagatatatttgtattagttacagaattgtaggtttgcagttatcttctctcaa

SEQ ID NO: 15869 - DNA, 201 bp, Homo sapiens
gatggtcttgatctctcgacctcatgatctgcccgccttggccccccaaagtgctgagattacaggcatgagccaccgtgcccagctgccactttaactctttttttttttttttttttttttgagacggagtctcgctctgtcgcccaggctgaagtgcagtggcacgatctcggctcactgcaagctccgcctcccggg

SEQ ID NO: 15870 - DNA, 201 bp, Homo sapiens
tcccattgcccctagtcacttcctaccacattctttctgtttgtttatttgtttgtttgtttgttttttgagacagagtctcactctatcaccatgctggrgtgcagtaccatgatctcaggtcactgcaatcttcacctcctgggttcaagcgattctcatgcctcagcctcccaagtaactgggattacaggtgctcgc

SEQ ID NO: 15871 - DNA, 201 bp, Homo sapiens
ctttaactctttttttttttttttttttttttgagacggagtctcgctctgtcgcccaggctgaagtgcagtggcacgatctcggctcactgcaagctccrcctcccgggttcacgccattctcctgcctcagcctcccgagtagctgggactacaggcgcccaccaccacgcccggctaattttctgtatttttagtaga

SEQ ID NO: 15872 - DNA, 201 bp, Homo sapiens
aaaacatcaatatgtctttatatattatgttataataatacatacaaatttagtagaaaggaacaaattaactataaaatccagataacttgtagcatatrtaaaaaatagtcttttgagaagattcatgatagatattaatttttcaggcataatcaagaattggaatccaaacagtagaaaattcgtgttagaaaggac

SEQ ID NO: 15873 - DNA, 201 bp, Homo sapiens
acacttcattcagatgtgtaaagagaacacattccaagacgtgccttccacccacagcctcattgaaaaggacgactttgataacaccttaataaatgtayaaaacgaatcttagaggaaaaaagaccaacactatgacagttctctgttgcttttctattgctgacattacaatgtccctgcgttcatctgtattgtgaa

SEQ ID NO: 15874 - DNA, 201 bp, Homo sapiens
ttttcagaaccatgtaggctactacttatccgaatcttctagtaaagaattaagcagtttcatcccaggatttaaaactgttgcactgatctcaccatatrggaatagggggcattagcgggataatatagggacacctgggccacagggccacagatataaccatggaggttagtcaggtcagcacttcagtctctaaat

SEQ ID NO: 15875 - DNA, 201 bp, Homo sapiens
agtttccatgacgaataaggacaagtatataaaatcctacagatatatgacccataacacattacagagcactgatttcccagaggataatgtaaaactcrtgtacccagtaacagttctatttttgttctcttctataactcaaatctattcatgctgcacatttacttttacataaaaatgtattttagttatctgggc

SEQ ID NO: 15876 - DNA, 201 bp, Homo sapiens
actacctgttaaaaatgtaccattctagggttgaaaaataattaatgttaaaaataatagctaatgttttagcacttgctaggtgataggctctatgctamgtcctttgcatgcactatgtcatttaattcttagaacaacggtaaatggtagatactattattatctcaattttatagttgatgataatcgaggcttagg

SEQ ID NO: 15877 - DNA, 201 bp, Homo sapiens
taaccaaggatataaaatacagaaggactgcatttgtgattgtggttcttaataggtagccactgccattttcttcccaaccatggtaacatctaaactgsagtttttattgagctatttattttgtacaacatcaaacataacaaaattgataaggagattattctgccactcaacccctggcccaatgccaacagcttc

SEQ ID NO: 15878 - DNA, 201 bp, Homo sapiens
cctacagcatgcagaatttaacctgcctcttgctgggatccaaagaggcagggagggcatggcaagaagaaccagaaggggtgacagccccaagtgcttgyatttcgttaaaaaattccctcttctcaagaaagaaaattattccttttacgtgagctactggattgttttgcaggctagagccattttctgctggattgg

SEQ ID NO: 15879 - DNA, 201 bp, Homo sapiens
atacaggtatgaatggagtcttgcctttccagtaagatattatgagaacattagggaccctaagagagaagctgaagtccttcagctgacctggtaggaaraaggggagaagcataagaccccagggacacaatgcaagctacatcttaagcagactgtctgcagagggcttgagccttccagctctgaaggcgccctcgg

SEQ ID NO: 15880 - DNA, 201 bp, Homo sapiens
atttttgttatctggtctttcaaccaagtacttgtcaaccaagaattgcttacaaaattttcctatcaattcctaaggtgaaacaattaacagggttaacwgtccaaaatcattagtcaggtcattggcagaaccaggagttcaatatgagatattttttaaatgtctctctttatattgtctgatacttaaaatctttaa

SEQ ID NO: 15881 - DNA, 201 bp, Homo sapiens
atagcaggctttggcaggaagaggtataaaatattatcttaagaataaaacagtaggtactgaaattagacaaagacaattgaaatagaaaaaaattgttmaccttgtgaggttatataaaatagaataaaagagatcaatgaatagataaggtcagatggcaaaagataagctaagtaataagacaaggaagaataaaag

SEQ ID NO: 15882 - DNA, 201 bp, Homo sapiens
gagttatttggaagaatggcactaaagagaatgagcccctttaagggcagccaagagctagattttgctagttaagcatttaatgtaaaacagaggccaaytggaataatcattttgtactggaaaaaagaaacacaggctttggagtcaaacagaattagtttcaaataccagccttgcccctcagtagtggggtgactc

SEQ ID NO: 15883 - DNA, 201 bp, Homo sapiens
ctgaattctgcatataattcccacttagaatgttaggtcccagcatcgcaatacatctactgacatgagatttttttttctcctcagagaggaaatttatrttttattatttatcattcctatgcttaagcttgcttattggatttattcaataggcatcatcttcatcatcttatagatgtgcatagaaaaggtgaagta

SEQ ID NO: 15884 - DNA, 201 bp, Homo sapiens
tggcctcccaaagtgctgggattacaggcgtgagccaccgcgcccagccacatccagtttttctagtagtttattcctaaatcaatatcctgactacagtyaagcatcctaaaaatgaatgattacatttatagctgttttctttacaccttcatctatatctctaaatattgttctgattagacctcctgctttaaaact

SEQ ID NO: 15885 - DNA, 201 bp, Homo sapiens
catggtgaaaccccgtctctactaaaaacaaaaaattagctgggtgtggtggctggtacctgtagtcccagctactcaggaggctgaggcaggaggattgyttgaacctgggaagcagaggttgcagtgagccaagatcacgccactgcactccagcctggcgatagagtgaaactctgtctcaaaaaaaaaaaaaatgta

SEQ ID NO: 15886 - DNA, 201 bp, Homo sapiens
tttcatacttatgtggatataaatataaattttgaagaaattcatagcaagacctcatccctataaaatgaaactcatctgaaggattttctttaaaaaaygttacttgaactaaaacaggtgcaagatttttatgcaacctggcagatgcatacagaatatcacttcatttagttgggacagaatatcacttcatttagt

SEQ ID NO: 15887 - DNA, 201 bp, Homo sapiens
ttaaattacttattttgtttcaagacggagtctcactgtcaccccagctggagtacagtggtgcgatctcggctcactgcaacctccatctcccaggttcmagtgattctcctgcttcagccttcccagtagctgggattacaggcacccaccaccatgcccagctaattttttgtatttttactgagatggggtttcacc

SEQ ID NO: 15888 - DNA, 201 bp, Homo sapiens
caaaggttcttaaaagccataaggatatcaggggtgtcttaaatttccccaacaacctccatatccctaatgataagttgccactgtaaatggctgttgtrtaatccatcatgaatatagatttagttattgactgggaattctggtcaaggaggaatattttcaggttttatttacactgatgataatgtgtttcctcat

SEQ ID NO: 15889 - DNA, 201 bp, Homo sapiens
cataatctaaaaacagacatataataatatcatgtggaaataccatgataatttaaagagaaagaaagcaagaacaagagtgagagagtaagtgagtgagwgaatgagtgaaaaattgagagatgccaaatggggagataagaaatgcttttcctacatggaatcctctgtcttctgcttgctaggcatgtattggaatgg

SEQ ID NO: 15890 - DNA, 201 bp, Homo sapiens
aggttatgagattgctcttggtgacttttgacaatatgagaacacttccctcacctttaatgatgaggcaaggggctccatacacataacattagatagaygagaattccacgaaaaaggataagccatccaatatgctagcatagaccaagatcttaaaataaatacatttgcattctggcagtttgaacagcagagtta

SEQ ID NO: 15891 - DNA, 201 bp, Homo sapiens
tgtcagtattaaaaactaagtcaaccacaagcagttttacatcatgtttacaaaatatgctataatagtaatacacttgaggagggttaaaaatggttctytttttattgcttctcagccttttggctaagatcaaatgaacagttctttttctaattgttcaaattgatttcatagtcttgtaatctacatatttatgaa

SEQ ID NO: 15892 - DNA, 201 bp, Homo sapiens
atcaagtgtattttttagaaattaaaacatttctttaagtaaattgagaatttaaagacagtgtgatacatacacaaacatacatgcataaatatatacaygtatatatttaaggaatatatgtaaataatatatttaaggatgccaatttcccagaataaagtatactttaaatcccacttctttccaaagacaaagaat

SEQ ID NO: 15893 - DNA, 201 bp, Homo sapiens
cactggccttttctgtttcccaagcaaaaatcagaattgaacaggaaccaaaactattgagaccttccttctgtttcccaagcaaaaatcagaattgaatrggaaccaaaactattgagaccttcctacccacctgtgattaaatgagccaaatgagtagcaacgtggcagatggccctacagttaatgagattcttgcaa

SEQ ID NO: 15894 - DNA, 201 bp, Homo sapiens
ccttctgagtagctggaattacaggcgcctgccaccacgcctggctaattgtctgtatttttagtagagatggggtttcaccatgttgacaagtttcatarattaaaaagtaggataaataaatacagtagagagaaataacatttcagaaatgtcagtattaaaaactaagtcaaccacaagcagttttacatcatgttt

SEQ ID NO: 15895 - DNA, 201 bp, Homo sapiens
aacgaaatgggcttcacaaatagaaattattctaatccaaataatatttccccaagtctcacagtgcaaaacaccacagcagagagcacatggtgatcaakaaagacagcattatcataaatatttgtatttcttatgctaacagatcccattcttccagtctgtggcattgtcccaaactgccccatcaaaggttctaaa

SEQ ID NO: 15896 - DNA, 201 bp, Homo sapiens
ttaatagtccagcatcatataggaacttgtaagacatgtggattccaggacctataccagacctactggatgaaaaacttgggtggcagggggttgactasttaaagaagtgggtggtgatttttgtgaatgctaaagtttgagaatcactcttgttctattgtatcctaaccaaataataggataattaacactaataat

SEQ ID NO: 15897 - DNA, 201 bp, Homo sapiens
tatgaatgggaaaaagaccattagtaattagttatttttaaccatctaactttgtactttttatgtgaaaggtacatagcattgatgttgatacgagacastgatatgagacttggcacatcactggaaaattactgctagggcaaatatcattgatgtcaagacactactagtgtagcagaatcgaaattattcctaagg

SEQ ID NO: 15898 - DNA, 201 bp, Homo sapiens
ggagtgaagttatacacattgtagtctatcctacaatttttttttttttgagatggagtctcactctctctcccaggctggagtgcagtggcaccatctcrgctcactgcaacctctgcctcaggggttcaagtgattctcctgcctcagccacccaaatagctgggactacaggcatgccccactacagccagctaattt

SEQ ID NO: 15899 - DNA, 201 bp, Homo sapiens
agaaactttaaaaaactattcttatcctttataatcacaaactcaaatattacatatgaatgggaaaaagaccattagtaattagttatttttaaccatcyaactttgtactttttatgtgaaaggtacatagcattgatgttgatacgagacagtgatatgagacttggcacatcactggaaaattactgctagggcaaa

SEQ ID NO: 15900 - DNA, 201 bp, Homo sapiens
caatccaattatacttttagttatttttaaatgcacaattaattcattattgactatagtcaccccattgtgctagccaatactaggtcttatttactcaytctaatattttataccctcagttgttagtattaagactaaataaatattaatcataagatccaaagggtaggtgtaaagtcagaactatgcagtaagata

SEQ ID NO: 15901 - DNA, 201 bp, Homo sapiens
aagaatacaaattatatttatattggatcccttttttttcttttccacatctttcatcttcccataataaatgttgtgtttttgtgcatttgaactaaatwttatgggatttttttcaaagcttttctccatatttctaacttggttttcagtcacatttattccacttgttgttattgcttctaatatttttgtctatga

SEQ ID NO: 15902 - DNA, 201 bp, Homo sapiens
cctgttaagaaagaatataccccctcgaaaggttcaattctacaacaatgagtagttaataggttcttagaagggaggaagtcattgtactactgaatagyaataaaatctatgattcagtgtgtttcaaacatttaggaatgctttttgatgaatgggttttttaacagctactgaattggatttgtcctctttatataa

SEQ ID NO: 15903 - DNA, 201 bp, Homo sapiens
caattgtaaatattcataaattagggaccaggattcctatttcctaaggaatgtgctcagcctgggagaaacctcactttagaccagtggggctcttgggmactttcatcatgacatttaaacaataaatgtatctgtcaggtgatggtggattcacttcggaggaactgacacctttgatgaccatcacaggactgagtc

SEQ ID NO: 15904 - DNA, 201 bp, Homo sapiens
ttgacctcatgacctgagatggtcttgatcttttgacctcatgatctgtccacctcagcctcccaaagtgttgggattacaggcgtgagccactgcactcrgcccacacatctttatacaagaggagtgaagttatacacattgtagtctatcctacaatttttttttttttgagatggagtctcactctctctcccaggc

SEQ ID NO: 15905 - DNA, 201 bp, Homo sapiens
taaatgaaacagatagtagaggcatcaaaatgaaaaagaataaagtcatcatcaagtgtattttttagaaattaaaacatttctttaagtaaattgagaayttaaagacagtgtgatacatacacaaacatacatgcataaatatatacatgtatatatttaaggaatatatgtaaataatatatttaaggatgccaattt

SEQ ID NO: 15906 - DNA, 201 bp, Homo sapiens
tcatactttaaaattacatacatttttaaactggcacaaaagtactgtcttgggagaaggcaagaaaatagataaaatgttcatcagatgataacaattgyaaatattcataaattagggaccaggattcctatttcctaaggaatgtgctcagcctgggagaaacctcactttagaccagtggggctcttgggcactttc

SEQ ID NO: 15907 - DNA, 201 bp, Homo sapiens
tgcctcgatcaggagatggtctcgatcttttgacctcatgacctgagatggtcttgatcttttgacctcatgatctgtccacctcagcctcccaaagtgtwgggattacaggcgtgagccactgcactcggcccacacatctttatacaagaggagtgaagttatacacattgtagtctatcctacaattttttttttttt

SEQ ID NO: 15908 - DNA, 201 bp, Homo sapiens
gcactaaacttttctgctgtgttgcacatagtgcatgcagaatgcatgtagaacatgccctgaagaatctgcaatgcagataagaggaaagcattattccyaatttgcatatcacaccacacacagtaactgatttgtcaaatatcaaacaatttacatattctaggcctcctgctctccctttcttgagcgttcggtcta

SEQ ID NO: 15909 - DNA, 201 bp, Homo sapiens
tgttttatcagtgcatagacatcaattttttttttttttttaagatggagtcttgctctgttgccaggctggagtgcagtggcgcaatctcggttcactgmaacctccaactccctggttcaagcaagcaattctcctgtctcagcctcccgagtggctgggtttacaggcatgcaccaccatgcccagctaattttcgta

SEQ ID NO: 15910 - DNA, 201 bp, Homo sapiens
tttcttgcaaaactgaaacaaaatgcttcataaaacacaaaatatattcaaaagtggccacatcatttaaatagttaagattttttattgcaaagataaamggtgcctgcattacataagactctccctgttacttagatggactaggggcattactgaaagacaaatttgcaagacacccataaagctaccaaaattcag

SEQ ID NO: 15911 - DNA, 201 bp, Homo sapiens
actgtggctaggcatgcacaaatttcacataaagatataaagctaatatacatttccttcctctgatttccattgcccggatttcttgcactaaacttttmtgctgtgttgcacatagtgcatgcagaatgcatgtagaacatgccctgaagaatctgcaatgcagataagaggaaagcattattcccaatttgcatatca

SEQ ID NO: 15912 - DNA, 201 bp, Homo sapiens
aatttcatacaatatacattttctcactgaccttatcacccactagcctctctttggcttattacaggaagagaacttcctcatggtctccgtacttacamctccttctgcctataatactcttgccccaaatgtctgcctcctcaactcctctaagtttttttttgttttgttttttgtttttgtttttgtttttttttt

SEQ ID NO: 15913 - DNA, 201 bp, Homo sapiens
tcactggccttttctgtttcccaagcaaaaatcagaattgaacaggaaccaaaactattgagaccttccttctgtttcccaagcaaaaatcagaattgaaygggaaccaaaactattgagaccttcctacccacctgtgattaaatgagccaaatgagtagcaacgtggcagatggccctacagttaatgagattcttgca

SEQ ID NO: 15914 - DNA, 201 bp, Homo sapiens
attctaagcattagtcttagcatatgctgtgtttcacatttagaaatccctaaatgtgttcagaactgagggatgtattattcataacttatctttaaatktattatttaatgcagtatccatttgtaagttagtagatgctgatctcaccaattcattgactgtggctaggcatgcacaaatttcacataaagatataaa

SEQ ID NO: 15915 - DNA, 201 bp, Homo sapiens
aggaagaaaataaatattctaattggcccaactgatttatttgaaacaggaagatttagcaacttagcatttattggttaacaaaccacaggtcttttttycctccacctgctttcttgcaaaaaaaaaaaaaaaaaaaaaaaaaatgcctgtgcctgaaggttatttagaaaaactcttgaaagctattaatagaaagca

SEQ ID NO: 15916 - DNA, 201 bp, Homo sapiens
atagatggatagataaatggatgaaggggtggaagaaacagtatattttttttcatacttatgtggatataaatataaattttgaagaaattcatagcaakacctcatccctataaaatgaaactcatctgaaggattttctttaaaaaacgttacttgaactaaaacaggtgcaagatttttatgcaacctggcagatgc

SEQ ID NO: 15917 - DNA, 201 bp, Homo sapiens
aaggaaagatcaaaaacaagagagaacaatgaaaggatagtgctaagtgtgaaagaaaaacattaaggaaaggagtcggagggaaagtaagagtgttactkcattatatttaaaccagcctgtcacaaggagaaaagaggcagaaacatgtgtgcttcttgtctgaccacttatctaccaaatccagttcttctaccttta

SEQ ID NO: 15918 - DNA, 201 bp, Homo sapiens
ctccttagcaaggaggaggcaagctttgcaggcagctagtaagagttgtcagttccctccagtgaaatgttctctgcaaaaagtcaatagtcaaaaggcayaatgctgtcatttcagagtgaaattaattcctcttattatttttacctgttgctctgttttcctgcagagtaaatctcagtattctgactgtgtttaaaa

SEQ ID NO: 15919 - DNA, 201 bp, Homo sapiens
cactgatctatttactttcttcgtcaatacaattttattctctgaacttagtgctgttttctcattattcatttcatctagagtaagtctttaaatttcaygtaaatgattattttattggtaaaatgtataacaagtcacaggcctcttaggagatacccacgtttttgtttttgctcttgtttttgtctaaagacagtg

SEQ ID NO: 15920 - DNA, 201 bp, Homo sapiens
aatatcaatgaaataacagcaatatataaataagaccaacctggccagcttaaacatgacgttatctatataaagcctcatagcaacagcagaagatcttkccctccactctcatcatatcctacacataattccaccctaggaacatggtgtttaaaatggcttgcttgtaaaatcagggaattggtttcattcacccaa

SEQ ID NO: 15921 - DNA, 201 bp, Homo sapiens
gccttccttttacattgatgacttaaagaagaagaggtacattagtaggtaaagaagaaataattaccaatttagaaagagggtacagagggtagaaaagraatagtctaatgtttgcaatatgtttggaacatatattcagggtccaggagcactgcctgtatctgattccttgcttctgcttatccagagatgagttta

SEQ ID NO: 15922 - DNA, 201 bp, Homo sapiens
ctctaccctatcaataatacatatatgtctcagtttcatgtcccttaataaataattaagaaatcactaaaataaacagccaaggcattcaaaatacattmgttctccccatagacattgggatggttcccattacatactttttaagagtctgatttacttgcaaaagctacacatattttattaaaatgtaagtaatca

SEQ ID NO: 15923 - DNA, 201 bp, Homo sapiens
agtttcttgcctaaatttgtgatctccctttggcttcataaataacggtacatttcatgaagagctggtctcagtctacacaagcctaactgaatggggtrcataggaagggttgcattgtgtgacaaggtttaaatctaattgttttaagtctttgagttatttgctcaccaggctgtgcttgatggttttactttttgt

SEQ ID NO: 15924 - DNA, 201 bp, Homo sapiens
agggaggccaggcatggtggctcatgcctgtaatcccagcactttgggaggtcgaagtgggtggatcctgaggtcaagagatcgagaccattctggccaayatggtgaaactccgtctctactaaaaatataaaaatgagctgggtgtggtggcacgtgcctgtggtccctgctactcgggagggtaaggcgggagaatca

SEQ ID NO: 15925 - DNA, 201 bp, Homo sapiens
atgagcgttttgcttcgtgtactcatttatttctgaaaataatgcagccccttgtagggctttctggctaattgagtggtgccatcattcatgcaattgcrcaattcacacaccaggctgccactttggcccctgcgtcaccttcaccaccacccaatgtgtcctgctcatcactgaggtttgtcatttttactctgagtc

SEQ ID NO: 15926 - DNA, 201 bp, Homo sapiens
ggtggatgagcgttttgcttcgtgtactcatttatttctgaaaataatgcagccccttgtagggctttctggctaattgagtggtgccatcattcatgcarttgcacaattcacacaccaggctgccactttggcccctgcgtcaccttcaccaccacccaatgtgtcctgctcatcactgaggtttgtcatttttactct

SEQ ID NO: 15927 - DNA, 201 bp, Homo sapiens
agggtgcttatgaggaaggtttcctactcctaaaagagatacacaggaagagagaccttctgcttcctctggacactggcgcagcctggactagcagttgscagcttgggtttggacaacctccgaccttagttgaaaatgaccctgtgtaggacagaggagcaagtggaaagaacctgggtgcattgtggcattttagag

SEQ ID NO: 15928 - DNA, 201 bp, Homo sapiens
tccctagtgttggatagctaggccatttataatttggacactattttaaaaaataactcaggcttattttactatttatttttgccttacactttttgtamaagtaatcagagcagtaataatagatgactccccaaaatccttttgcctctaatgattagtctaagcccataatgctgtgttccttgccagtgattggtt

SEQ ID NO: 15929 - DNA, 201 bp, Homo sapiens
gagaatcacttgaacccgagaggcaggggttacagtgagtgcggtggcagctgggacattaaccaagttgtgaaaggagccatgatgttattagctgagtyatgtcactgcacctccagcctgggcaacagagtcagactctgtctcaaaaaaaaaaaaaagtgtactttttgaggaaagttctatttttcattattttcc

SEQ ID NO: 15930 - DNA, 201 bp, Homo sapiens
aagattacaccatgtaaatgaattgtattttatgtaaccattccctagtgttggatagctaggccatttataatttggacactattttaaaaaataactcrggcttattttactatttatttttgccttacactttttgtaaaagtaatcagagcagtaataatagatgactccccaaaatccttttgcctctaatgatta

SEQ ID NO: 15931 - DNA, 201 bp, Homo sapiens
aaaatacaaaaatcagccaggcatggtggcgcatgcttgtagtcccagcgacttgagaggctgagggatgagaatcacttgaacccgagaggcaggggttrcagtgagtgcggtggcagctgggacattaaccaagttgtgaaaggagccatgatgttattagctgagtcatgtcactgcacctccagcctgggcaacaga

SEQ ID NO: 15932 - DNA, 201 bp, Homo sapiens
tcgtaatatataggcacatagatatataattaaaaaaacaagaatttctcatgtcattaaacattgcttgaaaaaacatactagtaatttcctaagattayaccatgtaaatgaattgtattttatgtaaccattccctagtgttggatagctaggccatttataatttggacactattttaaaaaataactcaggcttat

SEQ ID NO: 15933 - DNA, 201 bp, Homo sapiens
cagttcctcctagtgggcagtttgctgctgctgtcttacctcctcatcctcacccctttcacctctcccctggtaactgatttatttttccctcttggagktgcttattcttttcttcttccagttgcatctctccctctacttagatacacatttccattttacttctatttggtagtctcagaacttggcttttattgg

SEQ ID NO: 15934 - DNA, 201 bp, Homo sapiens
acttggtaaagaagcagatatttctttaatacgtgtatatattagactgtgaatttattcatcttccttattcatcatataagtaaattatatgattggayccaggcataaaacgtgatttgactcccccttgcccatcacagttctggagttcacatatcatttgttactttgaaaaatgaacttttgttatttgattat

SEQ ID NO: 15935 - DNA, 201 bp, Homo sapiens
atagtgatagtaaaaagaaccatgtgaactgggcgtggtggctcatgtctgtaaagccagcacttcgggagtccaaggtaggagggtcacttgagcccagsaattggagaccagcctgggcaacatcatgagaccccatctgtatccaaataaaagcaacaaaaaaatgagacatgggggtgcatgtctgtggtcccagct

SEQ ID NO: 15936 - DNA, 201 bp, Homo sapiens
aggttcttctgtgataaaaatagacttggtaaagaagcagatatttctttaatacgtgtatatattagactgtgaatttattcatcttccttattcatcayataagtaaattatatgattggacccaggcataaaacgtgatttgactcccccttgcccatcacagttctggagttcacatatcatttgttactttgaaaa

SEQ ID NO: 15937 - DNA, 201 bp, Homo sapiens
ggtgcagcacctcacacctgtaatttcaacacgtagggaggctgaggcaggaggatctcctgaagcccagaattcaagaccaggctgggcagcatagcackacccatctctactataaatttaaaaattaactgggtgtggtggtgcacatctctagtctcagctgcttgggactactagaaaggtaaggcaagagaatcc

SEQ ID NO: 15938 - DNA, 201 bp, Homo sapiens
agctccctccctaatcttgctagaaggtagggctaatgcattgtcaattcagaaatagggggtgttcctgagtctggggacactctagtgaaattctatgkgtaaaataatttgtacaagtttatatttttagctaaattaaaatactcacattcccattattttttagaggttgtaagctaagtaataacattctagaaa

SEQ ID NO: 15939 - DNA, 201 bp, Homo sapiens
taaatagatgcacaaagcagagggaatcaagtagaataacatggtttatttgtgtgtgtattgttctgtttttggtaaaatcatgcttatcatatcttcartgcatcatttattctgagtccacattgctgcctttgagccggggccctgaggtatctcctatactctggctggggtgagggcggcaggtcctctgggcca

SEQ ID NO: 15940 - DNA, 201 bp, Homo sapiens
ctgcttttgccatcaaatggttattgaaagaactatctgtgttgacagccttttgggtttcatacagtcctttccagcttgggcagtatagataaatagaygcacaaagcagagggaatcaagtagaataacatggtttatttgtgtgtgtattgttctgtttttggtaaaatcatgcttatcatatcttcaatgcatcat

SEQ ID NO: 15941 - DNA, 201 bp, Homo sapiens
ctacgttggcagagctcagtagtcatgacagtaaccatatgcccacaaagcctaaaatatttactatctggctctttgcagaaaatgcgctgaaccttgcrtgttgtgtcacccctggaggtagcaccttgtaattaagcacatgaatatctcacatcagaatgaatgaatattcacactcagtgggacaaacaacttctg

SEQ ID NO: 15942 - DNA, 201 bp, Homo sapiens
gtctcccgtctgcagaagcattggctgacatggaagattttttttttttttaatacttttctttttgccggcatctgcgtagaatttttttttttttttttggtagtttcttaatggtctttagcaaaggaagtaagtgacactgatcggtgaaggcagacagtaagatttataatgtatttgtgctagctgattgccaac

SEQ ID NO: 15943 - DNA, 201 bp, Homo sapiens
gtatgttggtacgttattgaaggtgatgctagctgctataacaaataagcacgcctgtgcacagttgctcaaagatagtagaagtttatttcttgtttatrtaagatccataatgactcttgccaattagcaggctgctctcttccaagtggtaacccagggactcaagctcttttcatcttgtggctcagccgtctgaca

SEQ ID NO: 15944 - DNA, 201 bp, Homo sapiens
cccagcctgggggagggtttgttaaagaactgtctgttttatcacatgaccacaagttaaaatgttgggcaatgtccctgaatgataccttttcattagtractcacatggacccataatctctgaatttaacatgcttttcaggaatgtgttcatattttccacctataaaacctgttttagtaatttactcccttgtaa

SEQ ID NO: 15945 - DNA, 201 bp, Homo sapiens
gatctcatgagatttattcactatcaagggaacagcacaggcagatcccatggctttgactcagttacctcccactgggtccctaccatgacacatgggarttctgggaactacagttcaagatgagatttgggtggggacacagacaaattgtatcatagaatcataaaaattgctatttctaaggcagatgaataatcc

SEQ ID NO: 15946 - DNA, 201 bp, Homo sapiens
aagagaccaatttaaaacattctaatgagcatcatctcataatttggtaatctcatgtaaaatgcttataataggggtgtgtgtatgttatatatattttwaaaataaatttgtaatcatgtatacagtagtccccccttatccgtggtgtttcagtttttttttttttgagtcagagtattactctgttgcccaggctgg

SEQ ID NO: 15947 - DNA, 201 bp, Homo sapiens
gagaccatcctggctaacaaggtgaaaccccgtctctactaaaaatacaaaaaattagccaggcgcagtggcgggcgcctgtagtcccagctactcgggargctgaggcaggagaatggcgtgaacccgggaagtggagcttgcagtgagctgagattgcgccactgcagtccgcagtccggcctgggcgacagagcgaga

SEQ ID NO: 15948 - DNA, 201 bp, Homo sapiens
actgagcaggaagggccaggtgttttacgactctttggagttagcagcttgttggctctgatttggtaaaagcaacggaaatgccttcagcacggtgaacrttacatgcaaatgttgggaagtgttaggaaagggaatttttttaggcgagggaatttcgcattgaggaaggtccctgcttcgtttttagacacagcctat

SEQ ID NO: 15949 - DNA, 201 bp, Homo sapiens
agatcaagaggcccggaaccccgcagtcctgaatgctaaccagtagagacaagggaggaattcatttctgtttgtgttcaacatagactgagcaggaaggrccaggtgttttacgactctttggagttagcagcttgttggctctgatttggtaaaagcaacggaaatgccttcagcacggtgaacgttacatgcaaatgt

SEQ ID NO: 15950 - DNA, 201 bp, Homo sapiens
agaaagtgagagctttcgaagaatctgtggttagaactaagaggatttttctttctcctttttctgctgttattatctcaaggagagagggaaaaaaaaaatcagagcaggacatgaacagtgcttgcaaattttattacctcattataattgatacctgctctctgagccaataaaagaagctatattcagcactggctg

SEQ ID NO: 15951 - DNA, 201 bp, Homo sapiens
agctggtgacaaaactcaaagaagatgtaactagagaaaaggtactcagtgcagcctctgtgagctaccaccactgcctctagttttccagaaaaccaccmctgaccactctctgtacagatgcgctcaagcgaccataaccaccagtgttcctaacaatgcgcctattgacttcttatttcaatagatatccagatttat

SEQ ID NO: 15952 - DNA, 201 bp, Homo sapiens
caccttccgcaggaatggcctttaacactgtcacctcaccccattcccctccactcttgggaagcatacgtctaggtgagtggtgaagatttttattctgmatttttgaaataatatcgtactgcaagttccaggcaatcaaaaactcacaaatcacttgcactctgcagcagtggtatcaggtctgaagaaaggaagagg

SEQ ID NO: 15953 - DNA, 201 bp, Homo sapiens
ggaggcacaggaggtaaaaatacattgttcaagggtcaattattgtgttgtacaaggtgtgaaatctaccaggttgccatccgagtggagaatttttttastgtacttgcctatgaaggtaaagaagcaaatggaaatttttttttaagaattgaaaggattttatttcaaatcaactctcatacctcatcctgggctcca

SEQ ID NO: 15954 - DNA, 201 bp, Homo sapiens
aaatagtcacatcatggagaatggggtatccatcccctcaagaatttatcctttgagtgataaacaattcagttatacccttttagatattttacaatgtrcaattaagttattattaactataatcaacttgttgtgctatcaaatagtaggtcttattctttctttctatcttttttgtacccattaaccatctgcact

SEQ ID NO: 15955 - DNA, 201 bp, Homo sapiens
cccctgtttcaaatgaatacagattcattttgtcacctgtgtgaaattggtgtccgtgtgccttgcttcctaggctgtccaccatgacatcagcctgcccrtgcaatgcttgagatttgccctgtgactcaacccaaatctaaagcccgagtcgtatgaatccaggacacctgcctgcaaatgcatttttcatgtataggt

SEQ ID NO: 15956 - DNA, 201 bp, Homo sapiens
aatacagataatttctctcttaaattccataagctggagacactgcccctgtttcaaatgaatacagattcattttgtcacctgtgtgaaattggtgtccrtgtgccttgcttcctaggctgtccaccatgacatcagcctgcccatgcaatgcttgagatttgccctgtgactcaacccaaatctaaagcccgagtcgta

SEQ ID NO: 15957 - DNA, 201 bp, Homo sapiens
gggtattactctgttgcccaggctggtgttgaactcctggcctcaagcgatcctcctgcctcggcctcccaaagtgctgggattacaggcttgagctactkccccaggctcttcccccgtttgttaatacataccatgaccttggcctttcccacctcttaggttttgcttactttcccttctgtcctttacttatgactc

SEQ ID NO: 15958 - DNA, 201 bp, Homo sapiens
acactgtttaccagattggagtgcagtggtgcaatcctagcttactgcagcctgtaggtcccgggctcaagcgatcttcccacctctgccacttgaatagstgggactacaggtgggtaccaccatacccagctgttgaaaaaaaaatggtggggtattactctgttgcccaggctggtgttgaactcctggcctcaagcg

SEQ ID NO: 15959 - DNA, 201 bp, Homo sapiens
atgccgacccacaagctctggagcagtcaactcagaatggtcaggacttggtcagtaatgcccatttttgctaaattttgtccccacttccaacgcaggaycaaccagagaaagccacatatgctccccaaaccaatcatacaggatgtcctggtctagggagcccacctccggcttccccatgtccacagcctccaatcg

SEQ ID NO: 15960 - DNA, 201 bp, Homo sapiens
cccacacttactcttattcacccagaacaggtgtgtgccaccttggagaagatgaagccagagagaaaatcagtcagacaggaattatgttgaaaggtgamtgaatacattaccacctcccaggagttgaatgaaaaacggctatttctttaggacgtcaaaccacctttttcctctctaattcatgcatatccctataca

SEQ ID NO: 15961 - DNA, 201 bp, Homo sapiens
cactcagtgatgggagtcttccttatgaagctgtcccagctccatctctcaggactgaaatgtgggtaagaccatcacatttttcatcccccgccccccgsccccaacattgactgggcagatattcatacaatggcgattgttttgtctgcctggatggctttaacataataccatagactgggcaggttaaacagcaga

SEQ ID NO: 15962 - DNA, 201 bp, Homo sapiens
tggatgtctgaggtatgctaagcctaatctccatcttctcaaagctccactgccactgtcccgtaagggtgggcagattcctccccattctataaaataayagctaccatttcctgagggcatactgagtgctgacaggcacatcaacatcagaccatcaccttcttatacctcaaaatagtctgcagggtgactcagaag

SEQ ID NO: 15963 - DNA, 201 bp, Homo sapiens
gcagaccattgtttagccctccttccacctgggagactggctgctggttctcattgcttctgtgggtctccaggtttctatcattacacagattagcacayggttccatgatcatggacccgttcagtacacaatgaaatcatttgcaaagcaccttggggtctgttagagaagggaatggatgtctgaggtatgctaagc

SEQ ID NO: 15964 - DNA, 201 bp, Homo sapiens
atttggaaacacggcacaagcaaaggcttgaaacgtgcttttatgttggtgcttgcccacttgctgtgctacgaacccttttacttctgggtgcgaacaarcccaggctagccttctgggcgatgagagacacaagaccatgtttccatattgccccagccaagagccaacctacagacgcaactgccttgctgacagcag

SEQ ID NO: 15965 - DNA, 201 bp, Homo sapiens
ttgaccaatgaggcatttggaaacacggcacaagcaaaggcttgaaacgtgcttttatgttggtgcttgcccacttgctgtgctacgaacccttttacttytgggtgcgaacaagcccaggctagccttctgggcgatgagagacacaagaccatgtttccatattgccccagccaagagccaacctacagacgcaactgc

SEQ ID NO: 15966 - DNA, 201 bp, Homo sapiens
tagtgatctgattcattaatatcccttgttattaagaactgtctgtatttgtgtcctggttggcagatattaagtccacagataccaataattaatatctwtggttgattgtaaaaatggccaccaattcttccctgtcccctgcatatgtacatccttgcactgtgaaattgtagatctcgccctccaaaggtgaagttc

SEQ ID NO: 15967 - DNA, 201 bp, Homo sapiens
ggagtaggaggctgcagtaagctgagatcatgccactgcactccagcctgggttaacagagcaagactctgtctcaaaaaaaaaaaaaaaaaaaaaaaaawtcaaaattgatgcaaaaaatatgataacatttcaaaatttaaatcaagacaaattcaatattatagcaaaggttcaagtaatgaacatgaatttgtaatg

SEQ ID NO: 15968 - DNA, 201 bp, Homo sapiens
cagctactctggatgctgaggcacgagaattgcttgaacctgggagtaggaggctgcagtaagctgagatcatgccactgcactccagcctgggttaacasagcaagactctgtctcaaaaaaaaaaaaaaaaaaaaaaaaaatcaaaattgatgcaaaaaatatgataacatttcaaaatttaaatcaagacaaattcaa

SEQ ID NO: 15969 - DNA, 201 bp, Homo sapiens
gtttcttgtagcaggtcatgaagaggaatgaaatactataatcacagagcttgcagaagctgcctggaggaccagttagtctattttttgtacatgaggayactgaggctcagagaaagtgaggtcattgagtcacttgagttcttgttgagtgttctttcctgctgaggtgtcctaggtgcctcttaatgcctttaacat

SEQ ID NO: 15970 - DNA, 201 bp, Homo sapiens
cctccgagttccactggctgcattctcatcagaacccagctaaaactcacgtctctcaaattccctaaataataaatccaaagttattgaagatattgggwtactaaaagttggcagtgagactggccccactcatttctttgtaacccctgtccctctttttattattgaagcttgggatgcacttggtaaggctaggca

SEQ ID NO: 15971 - DNA, 201 bp, Homo sapiens
aggcaaacatgttgacacaaacgagagaattttaggttctctttgtagctgtggctgggctgggacaaggacgatggacaaagttatgggggtgctaaaaacctcagtaatgaagataaatgatattctaatctaatattttaaaaaatcgaggctaggtgtggtggctcatgcctgtgattccagcattttgggaggcca

SEQ ID NO: 15972 - DNA, 201 bp, Homo sapiens
attgacagacccatgggtgttaagatccttcatggctactggggagaaatgacaggccttttgaaatcgtatcagtggttttccctgggatcactggaaakaatacccctgtttgacaagatatgacacatgctctgttttaattctgcatttgactaacagaaaagattggtgaagatcagactctgctttaaagttatt

SEQ ID NO: 15973 - DNA, 201 bp, Homo sapiens
aaaacctcatttctgctaaaaatacaaaaatcagctggttgtggtggtacacccctgtaatagcagctactcaggagtctgaggcaggagaatcccttgarcccaggaggcagagattgcagtgagcccagatcatgccactgcactccagcgtgggtgacagagcaagactctgtctcagaaagaggaaagaaatggaat

SEQ ID NO: 15974 - DNA, 201 bp, Homo sapiens
catcacaaaacctcatttctgctaaaaatacaaaaatcagctggttgtggtggtacacccctgtaatagcagctactcaggagtctgaggcaggagaatcycttgaacccaggaggcagagattgcagtgagcccagatcatgccactgcactccagcgtgggtgacagagcaagactctgtctcagaaagaggaaagaaa

SEQ ID NO: 15975 - DNA, 201 bp, Homo sapiens
gtggatagcttgaggtcaagagttcgagaccagcctggccaacatcacaaaacctcatttctgctaaaaatacaaaaatcagctggttgtggtggtacacycctgtaatagcagctactcaggagtctgaggcaggagaatcccttgaacccaggaggcagagattgcagtgagcccagatcatgccactgcactccagcg

SEQ ID NO: 15976 - DNA, 201 bp, Homo sapiens
aggcaagtaggggcaccgaaagctttaaagcagggagtaacaggcttgtagtgacttttatcgaagtagaagttgaatagatctagcctggcacagtggcycacgcctgtaatcgcagcactttggttggctgaggcgggtggatagcttgaggtcaagagttcgagaccagcctggccaacatcacaaaacctcatttct

SEQ ID NO: 15977 - DNA, 201 bp, Homo sapiens
gttggaatgttgcagggaggctgggctaaggtgttctgttcctgtctctggttcaaaggaaaggaatagcctagacctaaaggattctgtctggtagctgkttgctcttcgcgcctgtgctttgaatggtgaataccctcggcgggaggcaggcacctgatgccactgcccccgccccacctgcccccgccccgtttctca

SEQ ID NO: 15978 - DNA, 201 bp, Homo sapiens
aaatcagtatgattcatcataaataagtcaggactatgattgacagtctacctagaaagattaggaaagtggggaccaccccccaattattacctttgttyttacaagtgtgtttaaatctctttctgttaatttacaatttgaaaggtgggtgaggagaagagtttgaaaaatagattactgtcttcattaatacaggtt

SEQ ID NO: 15979 - DNA, 201 bp, Homo sapiens
gtgcttgctttgggagttcttgttaaccctgacaattcttgtcaaatatcttactcctgggctgtgctggggatggcagcagagtggggtggttggatggraaggcgggaaagagctagcttggagatgatacgcttttccatccttgaataacttgggaaaaagtcaggagtgtggaatgaagaattggaatataaaggc

SEQ ID NO: 15980 - DNA, 201 bp, Homo sapiens
ttatttaaaaaaatcagtatgattcatcataaataagtcaggactatgattgacagtctacctagaaagattaggaaagtggggaccaccccccaattatwacctttgttcttacaagtgtgtttaaatctctttctgttaatttacaatttgaaaggtgggtgaggagaagagtttgaaaaatagattactgtcttcatt

SEQ ID NO: 15981 - DNA, 201 bp, Homo sapiens
ctgtccttactgtttcccttgggcacgctgttcaccccttaggacatactacagtaaccttttcccaccaccgtgggaggactgtgattttgtaaatgtcytctgatctctcctctttgcaggcgcagtgacatttatgcacactggctttgaggctcattgatcttttgttttatttgcctttgctgaggcaggggcagg

SEQ ID NO: 15982 - DNA, 201 bp, Homo sapiens
ttcactgaaccaagagatgccataagcagtccttgttgtaataatttaatagcgaagccctcagcaatagatcttcaggtaaaatggatgctgactgtctrtctgtcatatgaagattcagacattgatgtaatttaaaatacttgtagtatcatggatacaaacatatgcctttttatttctgaaggaatttccagaatg

SEQ ID NO: 15983 - DNA, 201 bp, Homo sapiens
ggtgacaggcttctttcttctcatcattaaatgacatactggagatcagtcagatgaactgcaatttatatcttgcccccacccagtgttgatttgcccgrggtcatacagataattagtaatgtcttatctcagttttcttatctgcaaaatgagaatacctgatggggttagtgtgggagtttaatgtctgtaaggtgt

SEQ ID NO: 15984 - DNA, 201 bp, Homo sapiens
aatctggagtccaccatcctgggtctagctggggacatccttgaatcagcctctgggaatcactgaaccaacatgagtcacttgctactgtgagatctcaraacacatggatcaggacagagggcagggctgtttccccaaggaaatccaaatgctttacaggaaggggagtggatgctggcccggcccaggcgaggatga

SEQ ID NO: 15985 - DNA, 201 bp, Homo sapiens
taaattttatttttcagtttacttggttttgcctccttctagaactagaacataagctctctgaagtcagggaccatgcctagaatcgccttccttttatytcccatcagccgaaactaactctgctgtgtcacgctgtgttaggctgtgttggctgtgagtaagagaagtctcacccaactagctgaagcgaggtgggtt

SEQ ID NO: 15986 - DNA, 201 bp, Homo sapiens
tgattttgatttggttgtttttggtagagatgatatcttgctctattgccaggctgatctcggactcctgggctccatcaatcctcttgcttcccaaagtrctgggattataggtgtgagccagtacacttggccttttggcaccattattctgcctgccatcctgtcctaactaaagaaagtaaggtccctccatcctcc

SEQ ID NO: 15987 - DNA, 201 bp, Homo sapiens
atctgccatgccaaataacacctttgcaggtttcagggtagagcatggatgccttttgattttgatttggttgtttttggtagagatgatatcttgctctrttgccaggctgatctcggactcctgggctccatcaatcctcttgcttcccaaagtgctgggattataggtgtgagccagtacacttggccttttggcacc

SEQ ID NO: 15988 - DNA, 201 bp, Homo sapiens
ccaggttcaaatgattttcctgcctcagcctcccaagtacctgggattacaggagcctgccaccacgcctggctaattttttgtacttttagtagagatgrggttgcaccatgtttaccaggctggtctggaactcctgaactcaagtgatctgcccgcctttgcctcccaaagtgctgggattacaggcgtgagccactg

SEQ ID NO: 15989 - DNA, 201 bp, Homo sapiens
taccctggaacttaaaagttggtgaaagaaagaaggggccgggcatggtggctcacgcctgtaatcctaacattttgggaggtcgaggcaggcagattgcytgagctcaggagttgaataccagcctgggcaacacggtgaaaccccgactctactaaaatacaaaaaattagccgggcgtggcagtgtgtgcctgtaatc

SEQ ID NO: 15990 - DNA, 201 bp, Homo sapiens
cccaagaggatccgacagctctggaacttgtaatatttgcagcatgtcttgccctcttaatgtctaagaagtcaaaaaaggacacgtatgcctagaaaacrtgaataattatcatctatcaaatttttaccatgtgccaagcatagtcatatttggctaacgaaaacaacaaaatcaaccgtgacaaggttttattagtaa

SEQ ID NO: 15991 - DNA, 201 bp, Homo sapiens
ctggaatcctactgccaaattatggcactcatcctacttggtgtaaaatcctgggatgatagcttataatagtaataataagacctgcttcccggtgattmtctaaggattaaatcagttcatggagatgaaatacttaaactgtgcctggcacaaagtaaatgttagtgctactattatccctgctgctgttaaccccaa

SEQ ID NO: 15992 - DNA, 201 bp, Homo sapiens
ggtgaaagcatgcaagctaggagttaagatctttaactcagggaagaccctgtctatggaagtgctgagctcttcagtgtcatcacagaaaagcatgagcscctccctggtacggagtcatcacatcccatagctgagcgacgtcggagctccacgatggggaggtgacacatagtcagttaattacataaagagaacttg

SEQ ID NO: 15993 - DNA, 201 bp, Homo sapiens
aacatgtaaatcagctcattcattctgctggccctaaataggtagaaggaagggaaacatgaaagggagccttcatctgttttcctgcagatgcccggctygtggttaacccaagcaagaggtagttaaacggccccgcagattgccagtgactccgggaatgcctaggtttatgtatggattaacacagtgatagaccct

SEQ ID NO: 15994 - DNA, 201 bp, Homo sapiens
cttacaagttagattcacactccaggaatgtatctgttcccacatcccctgatgctgagcataccagagttaagggaggcaagcaaggcccctaacctccyaggttcatggaggtacccattctgcacttgttgaccttgagcttgaggactccataaatgtctgcccttggcattgcacgtgcctccctctgggctgacc

SEQ ID NO: 15995 - DNA, 201 bp, Homo sapiens
tacgttgatctgtacagcaaaccaccatggcacacatttacctatgtaacaaacctacacatcctgcacattgtaccctggaacttaaaagttggtgaaaraaagaaggggccgggcatggtggctcacgcctgtaatcctaacattttgggaggtcgaggcaggcagattgcctgagctcaggagttgaataccagcctg

SEQ ID NO: 15996 - DNA, 201 bp, Homo sapiens
ttttcgttgcttacaagttagattcacactccaggaatgtatctgttcccacatcccctgatgctgagcataccagagttaagggaggcaagcaaggcccytaacctcccaggttcatggaggtacccattctgcacttgttgaccttgagcttgaggactccataaatgtctgcccttggcattgcacgtgcctccctct

SEQ ID NO: 15997 - DNA, 201 bp, Homo sapiens
cattttccccagacctaacctcgatttgtgctccaggtctgagcagaaatgttattccctccagaaagccttccctggatgttgagggatgaagttgtagscccctcccgaatgcgtcctcagaactcgctggttctcgtcctcgccctcagcatacttgctcattgtttgtttccatctctatcatctctgtgagccctt

SEQ ID NO: 15998 - DNA, 201 bp, Homo sapiens
ggggttgggggagggagagcatcaggaagaatagctaatggatgttgggcttaatacctaggcgatgggttgataggtgcagcaaaccaccatggcacagrtttacctatgtaacaaacctgcacatcctgcacatgtaccctggaacttaaatttttttaaaaaatgtttttattgtgattttcacaggaaagaaggggc

SEQ ID NO: 15999 - DNA, 201 bp, Homo sapiens
aaggattattcctccccttttatcaagagccgtaagtccttggaaaatgcaaagagggggaaaaagaagaaaaacagcaacgagtttattggagagttaamacttaaatactccagtacattgagtgtgacatgcctgtgtaggagactgtctgtcccccaaataattgacaatttctctccatctaacaagaaaatatat

SEQ ID NO: 16000 - DNA, 201 bp, Homo sapiens
agcctcaaactagaacgtggcttttgaacggtgaacattccacaaacatttaatacagagatggctgtggggtgggggctgggggctgggggcctggaagrggagaaggggcaccagaaggagaaatgggaggaaagggcgagtgagatagcaaagagaactcagaaagtaataaagccctgcagtaatcagagggctgag

SEQ ID NO: 16001 - DNA, 201 bp, Homo sapiens
tttgttccctctgcatatagcactttctcaaaaagtagtttggtgacaggcttctttcttctcatcattaaatgacatactggagatcagtcagatgaacwgcaatttatatcttgcccccacccagtgttgatttgcccggggtcatacagataattagtaatgtcttatctcagttttcttatctgcaaaatgagaata

SEQ ID NO: 16002 - DNA, 201 bp, Homo sapiens
agatggcctctagtgaccctcacttcctgggttttacattgcagtatatttctcttctactctgaacaggattgtcctgtgtaacctacagggggaagtgrtagcgcatgacctctgaagctaggtgacaaaatacatttggacttctgctttgcttctcttggatcactccttgtggcagaagctagacaccatgttgcg

SEQ ID NO: 16003 - DNA, 201 bp, Homo sapiens
tctctgtgagccctttgaggatggatgtgtgtccatcttgttaacagttggctccccagtaaccagtacagtgccagatacagagtagtaaccctacattstagcgtaggcaaatattctagtatttgccaaaactagaggatgaatgagtgatgggtaagagagttctcagaaaaatggatataaacaatattgtaaatc

SEQ ID NO: 16004 - DNA, 201 bp, Homo sapiens
cccactaagagtaggtctttctgttaggtacagactctacaataaccaaattcacagaaactgatgtgtaaacccagggtcataaacaataattttcaacmggagctataattatcacatagtttgaaatgctcttgttaatctgagtaggaagagaggatgagaattttcttataggtggaactacagaaaaagagttta

SEQ ID NO: 16005 - DNA, 201 bp, Homo sapiens
tgtgtgagtgtgtgtgtgtaaaataccaaagagaaaacaataaaaaaatagagaaaataataataactagccaatgtgtcatcactccagacaacagccayggtcagtatttggttaacccattcagattttcccctatgaatgagttttttcgcctccataatattagttataatacattgatactacatcccgagtgtt

SEQ ID NO: 16006 - DNA, 201 bp, Homo sapiens
ctgcgccaccacacctgccacaaaatttctttgttatggctgaataatgtttctgtgtgagtgtgtgtgtgtctgtgtgtgtgtgtgtgtgtgtgtgtgtktttgaataatactcctatgaacattgtaccaatatctattcagatctctgctttcgattcttctgcatatatacctaggagtgaaattgctgcgtcgttt

SEQ ID NO: 16007 - DNA, 201 bp, Homo sapiens
agtaactcaacattaactgtgtacccctcctagtttggccactgttctgcccaaacatacaagagtcaatgtaagtctctgggagcactcacctttgggcrtgttgctacagagtcactcattcctagaaattgcgaagtcacgaagttgtcaaaaaacacaacgacaggccgggcgcggtggctcatgcctgtaatccca

SEQ ID NO: 16008 - DNA, 201 bp, Homo sapiens
aaccgtggaggcagaggctgcagagagctgagatcatgccactgtactctagcctgggtgacagagcgagactgtatctcaaaaaaaaaaaaaaaaaaaaatctttcagggatccaggctgacctcagcaccatctcttacatgtgcctctgttctttccctaatataagggagcatgggggattagtgtctggcttaagc

SEQ ID NO: 16009 - DNA, 201 bp, Homo sapiens
gattcccaaaatagacgggagttacacagagacctttttttttttaacctcctctgagattttttttaacctcctctgagattctgtatttccttaatgasccgaaaaatctatttagcccagtttttatccttgcagataagttagtacgcttctttttctgctggttgtgatcatatttctatttaggggtaaaggtgc

SEQ ID NO: 16010 - DNA, 201 bp, Homo sapiens
gtgttgggaggaaacagggtgcagagtgggaagggcaggagtatctaagtggccaaatttagcctaattaacagatttgcctagggctgaccctgaagcaraaagcaaagcctagatcagtctgctctcctcctaccaacagggtaatgatgaggttgaaccaccagttctcaatgccatacatgagattcccaaaataga

SEQ ID NO: 16011 - DNA, 201 bp, Homo sapiens
tgccgataaacatcatctggacggaatgaagctgagggccaatagtttagaggctcagcacccgactggagagagagagagagagagagagagagtgtgtatgtgtgtgtgtgtgtgtgtgtgtgtgtgcgcgtgcatgtgtatacgctggtgtttaggtgggcttgagaaaagtgctgactttgtgaacgaggaggaggg

SEQ ID NO: 16012 - DNA, 201 bp, Homo sapiens
caccactgctcgcattcccatgttggagttttccctttggggttcttatgccattttaaagactctgaaaacaggaagactttttctcttgggtatttttwtttttttttcctctgcaagggatggggtcataagacattggtgaggttaggccttcctttgtctcccaggagcacacttgatagcaatgtagggtgaatt

SEQ ID NO: 16013 - DNA, 201 bp, Homo sapiens
ctgccgataaacatcatctggacggaatgaagctgagggccaatagtttagaggctcagcacccgactggagagagagagagagagagagagagagtgtgwgtgtgtgtgtgtgtgtgtgtgtgtgtgtgcgcgtgcatgtgtatacgctggtgtttaggtgggcttgagaaaagtgctgactttgtgaacgaggaggagg

SEQ ID NO: 16014 - DNA, 201 bp, Homo sapiens
ttctgccgataaacatcatctggacggaatgaagctgagggccaatagtttagaggctcagcacccgactggagagagagagagagagagagagagagtgwgtgtgtgtgtgtgtgtgtgtgtgtgtgtgtgcgcgtgcatgtgtatacgctggtgtttaggtgggcttgagaaaagtgctgactttgtgaacgaggagga

SEQ ID NO: 16015 - DNA, 201 bp, Homo sapiens
gattctgccgataaacatcatctggacggaatgaagctgagggccaatagtttagaggctcagcacccgactggagagagagagagagagagagagagagwgtgtgtgtgtgtgtgtgtgtgtgtgtgtgtgtgcgcgtgcatgtgtatacgctggtgtttaggtgggcttgagaaaagtgctgactttgtgaacgaggag

SEQ ID NO: 16016 - DNA, 201 bp, Homo sapiens
tgaggcaggagaatcatttgaacccaggaggcggaggttgcagtgagccaagattgcgccactgcactccagcctgggtgacagagcaagactctgtgttwaaaaaaaaaaaaaaaaaagttctaaatcagtggattctgccgataaacatcatctggacggaatgaagctgagggccaatagtttagaggctcagcaccc

SEQ ID NO: 16017 - DNA, 201 bp, Homo sapiens
ggaatgccatagtggtgagctaagagcaggcagttagttaagtgtatgacaagtatctcattataaatggatgctgaaatgtccaagtgtggaaatgataygcttcagctcttatttttaagtcatccttatctctttcacttattccctcattcaggcaccaaaaatgctgtttgactgggagagcaagtggagctgttc

SEQ ID NO: 16018 - DNA, 201 bp, Homo sapiens
gtgtttttttttttttttttagatttctcattgctgagaacagttccagctctgctgaccaaaggctgagtgtccttttattagtctgagcccctagagaraccaaagaggcaaccctcgagccaactgacagccagctgtggggttggaccctgtttttcatacagtgagcactcttgaacccagagaaggtgcaggttg

SEQ ID NO: 16019 - DNA, 201 bp, Homo sapiens
atcgcagacacggaaaaaaggattattcctccccttttatcaagagccgtaagtccttggaaaatgcaaagagggggaaaaagaagaaaaacagcaacgartttattggagagttaacacttaaatactccagtacattgagtgtgacatgcctgtgtaggagactgtctgtcccccaaataattgacaatttctctccat

SEQ ID NO: 16020 - DNA, 201 bp, Homo sapiens
ccacttcctggaggactgtcagtgctagctaatgagactgtaaaagtggactatctgcccaggagacagtgaggaaggaaatcaggggtcacccttacagsgaagggctctttgcagagagagtgcctgatacgtagcagctggtacttctccatcttgaaactgtccttcctggttttgtctaatttgtcatcatgggat

SEQ ID NO: 16021 - DNA, 201 bp, Homo sapiens
ctgcgggggcctaggccaaagatatgcccgagtagaaaatctgacaccagcttcccagttttctcttctgctctctttggctgcaacgcttttaccatggstaaaccattaggccggctctgcagggagggcaagaccacagcagctcagtatttcctgctcagggaaaaaggccaggtcttttgttggtggaaatccact

SEQ ID NO: 16022 - DNA, 201 bp, Homo sapiens
tcccagggtaaagagtcaccgctgattaattacctcaaggacaaggggacggtgactttttctcttgtatccagcagcgccacgcggggcgggcgggagasgcaaggctaagaggtggatgaaaggctagggttaaggcatttcacaatgtcaggcatcttgttagactgcggctttccaggccttcccccgtgactgctg

SEQ ID NO: 16023 - DNA, 201 bp, Homo sapiens
cttccatttgaaaggagctttaaacacctttggtggcagctaagagtgtcaaaatggagggatgtgtaggggacctagggcctgggtaacattgtcccagsccagggcctattgtgttgtgtgtgtctccactttccagcctttgggaacgcagagggggacctctgtaattggtaccagcatcccttccttgcagggtcc

SEQ ID NO: 16024 - DNA, 201 bp, Homo sapiens
cgtccctccgcacctcactgttgggctgatcaatcccattcccactccattatgtgtgtatttctaagtggcagatttgccttaggaaatggaagaagggsatgaaatagtgaccaacacaaattactgggttggcgggagttgagagctggcaaaatcgtcttggagaaggaaatggtgcagatttcagagctggcagac

SEQ ID NO: 16025 - DNA, 201 bp, Homo sapiens
ctggagtcatgtgtttgcttctggaagggaggcaagaggcattcaacctcctgttaatttggttgctccttcagatacgctcttcatggtacagccctgasctgcatcatttaaagaccaattgttaaggaccaatctgagggcctgtgcattagttaaaactccttatctggtcatagagggtggtgtggtttggacgcg

SEQ ID NO: 16026 - DNA, 201 bp, Homo sapiens
atatgatgactagttggtgagttgatcttgtaagacttttacagatacccagaacggctctacttcttcatattccactttttagttttaaaagtttaagkagatctctgtgatccctgaagaattgtgtgcaaagcagcattaagacgaaaatcttttatatttgtgttgtagcttggaaaactagcgcgtggtctgttt

SEQ ID NO: 16027 - DNA, 201 bp, Homo sapiens
atcatctccgtccacatcaatgtcgtcatcgtccttatgaaaagccctgggcatcattttgcccttgagctggatgtccatgttggaaaaacagctagtgraaggcgtgcccaaatctcagaagttggcgtttccttgcagatatcattggtggccattggaggggaaaaagatgctttggaaaccaggacacagagaaaa

SEQ ID NO: 16028 - DNA, 201 bp, Homo sapiens
ttgccacttcctggaggactgtcagtgctagctaatgagactgtaaaagtggactatctgcccaggagacagtgaggaaggaaatcaggggtcacccttayagggaagggctctttgcagagagagtgcctgatacgtagcagctggtacttctccatcttgaaactgtccttcctggttttgtctaatttgtcatcatgg

SEQ ID NO: 16029 - DNA, 201 bp, Homo sapiens
ctcagacagataagaagctggcccacccttgccacttcctggaggactgtcagtgctagctaatgagactgtaaaagtggactatctgcccaggagacagygaggaaggaaatcaggggtcacccttacagggaagggctctttgcagagagagtgcctgatacgtagcagctggtacttctccatcttgaaactgtcctt

SEQ ID NO: 16030 - DNA, 201 bp, Homo sapiens
ctgtggaactatgagccaattaaacctcttttctttataaattacccagtctcaggtaattctttatagcaatgcaagaatggcctaatacatggtctctsagcaggattattgtagaggggactgatgttgaagaatggaaaagaaggcagtgtcagagaatgctgaagagtgtggatcttaaagtccaacctcaaggcc

SEQ ID NO: 16031 - DNA, 201 bp, Homo sapiens
gagtgtttatcagctcacaccaaggaagagagagctcaggagcgactgggcatgaggtggagtgagcactgtgaatgctggggaatggaaagtcctttatstggtgttgcctaagggtacggggaacctggcctggtgttgggaggaaacagggtgcagagtgggaagggcaggagtatctaagtggccaaatttagccta

SEQ ID NO: 16032 - DNA, 201 bp, Homo sapiens
atggaaaggatctattcctagaaaggatccattcctagaagaggaattctgtacaatatggccaactttctctctgttgaggttgaaccatttgacacatytcgctagcattgggaaaatccccattttcctcactatccatttttcttcctctctttccttcctcttttcccttcttcctcttttttttcttttctttcc

SEQ ID NO: 16033 - DNA, 201 bp, Homo sapiens
gaaaacaagtaagagtaactttgtacaccgtgggctcccaatcagtgctgcttttcgttgttgatgttgttgttaatgttgaaaaaaatcttcaagtcatrtttgcccccacagaccttcccagacagtctaactaaatgcactgtatttgctaactgttggaacttggcttttggactagaccagcacctcgagaaagaa

SEQ ID NO: 16034 - DNA, 201 bp, Homo sapiens
ttttcaaaacaataccaagaagctggtcttatttagatctagtcttatatcattgaaatatcattagaattcttatggaaaatatgttttggctgtttagrggatgctaggggctggaagtgagaaggtttcaacaccatatgggtatgtgagtatagatgcttacaagaagaagggtagacttagccaaaactaatttgg

SEQ ID NO: 16035 - DNA, 201 bp, Homo sapiens
ttctccatttatattggtatggatacgtgaatatttagtttattctgtaggtcataatacgacagtattgtgatatattttggtgctcaaattgttccggstttggcccataggaggtctttcgggcaggttcctgcacccttttgacatgccccgttcttttttgagcactttcttattttttggcactgtaagaggctt

SEQ ID NO: 16036 - DNA, 201 bp, Homo sapiens
ggttaacgtggtatctgccagatttctccactgtaaaggatcatttttttcctttgtaattaataaatatattgggggaggtactttgggactacttctcwaattttcatccattaattttagcatccctctggggatcttgcctgcaatgattaatactgtggtattctcatgactgatattgtctttctgtcatgcctt

SEQ ID NO: 16037 - DNA, 201 bp, Homo sapiens
agatgggtttatgcctaattgtgccaccagtttttcccataaaataattcatttggaaggggtggcctaatccagtctgaaccaattctaagatggtagcrtggatgcgggaggcactgcacaggatggaaagcatggagtttggaatctggcacaagtggatttgaattcagacttagtcatcaggagctgtgggacctt

SEQ ID NO: 16038 - DNA, 201 bp, Homo sapiens
aagacatggagctgagagtgaatatgagagtgaatattctgcacgtccattttaatgaccttgtgcctcattttccccatttaaggtagatgggtttatgyctaattgtgccaccagtttttcccataaaataattcatttggaaggggtggcctaatccagtctgaaccaattctaagatggtagcgtggatgcgggagg

SEQ ID NO: 16039 - DNA, 201 bp, Homo sapiens
tgaaaggctgtctccaaccatgcggacacagcgcagtgaagcggttggaaaagctacagacaaatggaaaaccttcattccaaagggtcgttgtctcctcytatttaatagccctgcattcatgcacttttttttatcttgctgtctttttttttttttttaatcaaataccaaagtacttctatggactggtcttaaaaa

SEQ ID NO: 16040 - DNA, 201 bp, Homo sapiens
ttactttttgggctggtaaagccacctaggtcagtgccatgtccaacccaatctggaaaacgattattgtggtgcctgttttgttgacttaacaaagccartcgcccattcctatgctgctaagatgcgaatgcccagctcaggggatgagattactgtcagctttgcctaagctttgggcattagcaccctccatatgca

SEQ ID NO: 16041 - DNA, 201 bp, Homo sapiens
cgacttctgattttcacgtgactcactgcttagttgtctgggtttgttttaattcctttccccctgctgacagttctttaagtggatgtctataaaggttggggcattcgctcttacaacaataggaaaagaaaggaggaaggaataaaaaagagagaaaaggaataaaaaaaagtttggtttagatgtctgatttctctg

SEQ ID NO: 16042 - DNA, 201 bp, Homo sapiens
aattccagttctctcatattaagtgacaagttgcagaatgcccctgtctttctgagctgtttttatatctgtacaatggggttaatactactagtatttgmttccagggattgttttggaggggagtgaggaataaatgatataattcactaaaacacgtagaatagtatttgacacagagtaggtcagcatgcccaaagt

SEQ ID NO: 16043 - DNA, 201 bp, Homo sapiens
ctgaaccacacttgttatctttcattttatgatgagaaccaccttaagaggtgtgaggtgacatctcactgtggtttcaatttgcattttcctgagaattwgtgacagtgagccccttttcatacacttggctatttgtatgttttctttggagaattgtctatttggttcctttgcttgtttttaaaatctgtggttttt

SEQ ID NO: 16044 - DNA, 201 bp, Homo sapiens
caaaccaccaaacctgggttggcgtttcagtgcctgacacagttgtattcctaagacatagttgggaccagacctcaagaaaatagccaacaaatactggstgaatgaacgaaagaggccatatgcagtcagcccccctctctctgggttctacatatgtagatttaactaatgacagattaaaagcattcgaacaaacgg

SEQ ID NO: 16045 - DNA, 201 bp, Homo sapiens
ctcatttctgggggactaattaaatgcatcctgtgtgaccccactggaagaggacatttggaatcttgtacctggttttctccagacttcgcctcattcascatttccctgtgctcattttgccttgcatccttttgctgtgataaatctcagccatgagtgtgaccgtatgctgagtcttatgagtcttccttgcaaacc

SEQ ID NO: 16046 - DNA, 201 bp, Homo sapiens
agaaatagaaaattaattgagttttagtttttagaaaattatctaagaagtagatttttagaaatagaaaattaacgtagatcacagaaaattatccaaastcagttaattttcccttttccagcaactgtatttgtcctccccacttctcttccctgccttctttttttctccttagcacttacaatgtctcactcatgt

SEQ ID NO: 16047 - DNA, 201 bp, Homo sapiens
aactatattttcttcctttttttgtatgcctccccatgcaaggataattacacagaataagcactgagatgcctgttgatggatttattccagcaattttwtttttttagctctctttgtctggaactttgcaaaataaacaccatggtcactccgtgctttgtgagtgacgtgctagaatggaatttcactgttttaaat

SEQ ID NO: 16048 - DNA, 201 bp, Homo sapiens
agacagtgttagtcaacatcaaatgtctggatcaagagaggcaagaatcccgtggatttggcgttggccagaacttgtctggaatcttgttttctgccttsagtgtcacctgttgagagctctgttgacaaactggcatttgtccttgggagagtagcctcaggaccaggggtgaagagttcagtaaactgtgtttaaccc

SEQ ID NO: 16049 - DNA, 201 bp, Homo sapiens
tttgttttaaataaaaatcatactagagcagtaggcagtgtgggtgagttctcccactttacattttactttgcataatttaggcccctttcaggccactyttccccctgtgccccaggtgtgtttgctaccatacctccccaggggatagccctccaaacctgattggccacctagtctggtcttaaagtcccaaaggga

SEQ ID NO: 16050 - DNA, 201 bp, Homo sapiens
atgttagttattattttaatattacagcatctgtggaaacagtgggtttatatttcagcgtcctgagaaacactcatcctgaacaacgggaacattggccrcatccgccattgtcaattttaaataaaagatatgatgactagttggtgagttgatcttgtaagacttttacagatacccagaacggctctacttcttcat

SEQ ID NO: 16051 - DNA, 201 bp, Homo sapiens
tgtgtcttctcccccatttatttatttaatcatttatttatatcacggtacactcatggacatttattttatgctttatgttataatcctatactactttrtttattttgttgcttaaatttttccagatggaacaatttggtcttcaaaagttgctgctgttggctcctgtgttcttgtgatgtacacacatcatggtgt

SEQ ID NO: 16052 - DNA, 201 bp, Homo sapiens
aaaatagagtcagcagcatctaaagagttgttttactacctctggagctgagaggtgaacatagtcgtttttcaggaagccgtttctggctcagacagatmagaagctggcccacccttgccacttcctggaggactgtcagtgctagctaatgagactgtaaaagtggactatctgcccaggagacagtgaggaaggaaa

SEQ ID NO: 16053 - DNA, 201 bp, Homo sapiens
aatgtcaatattttaatgtactagtaagggaaaattctattaagacataattgtttggctttgtcagtttgtcaacttgaaaatagagtcagcagcatctraagagttgttttactacctctggagctgagaggtgaacatagtcgtttttcaggaagccgtttctggctcagacagataagaagctggcccacccttgcc

SEQ ID NO: 16054 - DNA, 201 bp, Homo sapiens
cgggtggggagggcagacaagttgctcatcctctctgcgcctcagtttcttcatctacaaaatgaagatgttggttatttctttattcaagggttgttgaraggatgaagtgctaaaaatgcttgaccagcattcacacaggcactaagacggtgagtactcactacttagcgctgtcaacatcatctccgtccacatcaa

SEQ ID NO: 16055 - DNA, 201 bp, Homo sapiens
ctgcagctgtcgcagttggaacatgtgacgaaagccagttgatgtgacaactgctgggtgggagggacaggcttgggggcggggctgggagggctccttcycttcctgacccagggatggtctttacttctccctggcacctgtagacctgtctttcttgtgtttcagatttgccatacggatgggaacaagaaactgatg

SEQ ID NO: 16056 - DNA, 201 bp, Homo sapiens
agtgcactccagcctgggtgacagagcaagaccctgtttcagaaaacaaaaacccaaaaagcaaaacccccacagtatatatagaaatacaagatttgtgrggggcgggggtccccctacaaagcaagtgttactgtccacagagcaaatgtcaatattttaatgtactagtaagggaaaattctattaagacataattgt

SEQ ID NO: 16057 - DNA, 201 bp, Homo sapiens
tgggcaagaagggaaggagaattgtgaaacatgcacaattagaagtcgtgcacctgggttcatatcctggctgggccacttactttctggcgggtggggarggcagacaagttgctcatcctctctgcgcctcagtttcttcatctacaaaatgaagatgttggttatttctttattcaagggttgttgagaggatgaagt

SEQ ID NO: 16058 - DNA, 201 bp, Homo sapiens
ttgggcgattcagttttacctgtgtcctctctataccatagtttatgacaaggggttttctgtggctggtctccaaggcctcttccaatcttgacattctrtgatcctgtaagtctttgaataatggcccaggatgccaacaagaagtcaccaatgagagttcaggtgttctgttggaaatctttgtaaaatcacagagaa

SEQ ID NO: 16059 - DNA, 201 bp, Homo sapiens
tgtgtatctgtaatcttagcagaagtgactacttttaacatcgctggaacttttaacatcgctagatttattcttctattttccccgcacacgcatccttaaaaaaaaaaagtagggaggccaggcatggtggctcatgcctgtaatcccagcactttgggaggtcgaagtgggtggatcctgaggtcaagagatcgagac

SEQ ID NO: 16060 - DNA, 201 bp, Homo sapiens
gaatacaaggggggataaagatagacttaaaatacgctctctagaaaaaagtaagaaatatggaaagaaatctaatttagaaaaatgcacgcacccacagrcacgcttcacaggactggcaggtggagaggatgtttgttaacagggctggctattttactttaagtgctgcaaacattgcactaatgtttgggtctttgc

SEQ ID NO: 16061 - DNA, 201 bp, Homo sapiens
gagtgagaccctatctcaaataaaaataaaaatagaatacaaggggggataaagatagacttaaaatacgctctctagaaaaaagtaagaaatatggaaakaaatctaatttagaaaaatgcacgcacccacaggcacgcttcacaggactggcaggtggagaggatgtttgttaacagggctggctattttactttaagt

SEQ ID NO: 16062 - DNA, 201 bp, Homo sapiens
gtaaaaaaaatcatctcacacctgtagccgcagctactcaggaggctgaggcagtagattcatttgagcccaggaggcggaggttgcagtcaaccaagatyacgccactgcacaccagccgggggtgacagagtgagaccctatctcaaataaaaataaaaatagaatacaaggggggataaagatagacttaaaatacgc

SEQ ID NO: 16063 - DNA, 201 bp, Homo sapiens
aaacaaacagcttgtttgtggttcgtcctgaaatcctccctgctcacaaaacagccagctacttggttttctaaaagacgtaattttgcaggcagacttcrtagagccattctgtgcagaagaagggaagggagaagctgtttgttttacctgtagtatgaagatattctttgcgctgttagaactgagctcattaattct

SEQ ID NO: 16064 - DNA, 201 bp, Homo sapiens
tttgggaggtcaaggcggatggattgctggagctcaggagtttgagaacatccagggaaacatagtgtgaccccatttctacaagaagtaaaaaaaatcawctcacacctgtagccgcagctactcaggaggctgaggcagtagattcatttgagcccaggaggcggaggttgcagtcaaccaagatcacgccactgcaca

SEQ ID NO: 16065 - DNA, 201 bp, Homo sapiens
ggaaaggatctaagatgattggaaacagtgtacatagaatacaagaggagttgggcatgctggctcatgcctgtaatcccagcactttgggaggtcaaggyggatggattgctggagctcaggagtttgagaacatccagggaaacatagtgtgaccccatttctacaagaagtaaaaaaaatcatctcacacctgtagcc

SEQ ID NO: 16066 - DNA, 201 bp, Homo sapiens
gaatggaaggagtgtgtttaaaatgtgggtggttttgtcaattcctattgggaatgcttgtatttgaatgtatatacatatgcatatttatgtgtaatgtctatttcatgctaaatagggagtgatcaagttgaaaaataagaaatgctgtttgaatttttaaaataggttataaattataacatgaaaatcaaatacaat

SEQ ID NO: 16067 - DNA, 201 bp, Homo sapiens
gcttgaggccaagaatttgagaccagtctgggcaacataggcagaccccatctctaaaaaaaaaaaaaaaaaaattaaattagctgggcttggtggtgcayacctgtaggctgagctgctcgggaggccaagatgggagaattgcttgaggctggatgtgtgtggctatggtgagctaggatcacgctactttacttcaac

SEQ ID NO: 16068 - DNA, 201 bp, Homo sapiens
ctgggtgggtggaggttcagggatatctgggaaggactaagaatagctttttcttttagtagatcaggagtttcctcttacacacaaaaagctccaaattyaaactagcttaagaggaaagggtcattactggctgacaaaatgcgaagttttgtgcaagagtcagcaaagtttctctgtgatgggatatttaataaatat

SEQ ID NO: 16069 - DNA, 201 bp, Homo sapiens
attttatttcaggaccttggtaaggggttatacaatatttcttttgaaacgagggtctcgattattgggcttgagtatcctgatctaattaatgcactggrcagagctggcagacgtgtgggacacccagctattctctggaagggaagggggatataagagacacactataaaggtgaatggtaatcggcatctcccctt

SEQ ID NO: 16070 - DNA, 201 bp, Homo sapiens
atgctggaaggcaaagtaaaagccaacctcttgagaaagacatggaacacaggatggaacttgaactgcttaaaatggcttttctcaggccagctgcactggagtgtgctgctgtaacaaacacgcccggatctcagtggcttagcatggtgaattcatttcccattcgtgatatctgaccacagatgggaggtaaggggc

SEQ ID NO: 16071 - DNA, 201 bp, Homo sapiens
aagaacatcatggcccccttcatatcctggttaatgtccccgctgaccctgagttctgcctccatcactggaacaagagcctgtctttgggaagaggtgtsttccctggcactcgtttgatttgtagccgccacacatggcaggtcccaagctgtctgaagtcttggctgccattcctaagctactaaaactttgctggag

SEQ ID NO: 16072 - DNA, 201 bp, Homo sapiens
gatttggacggtttgctttagagtgcattaacttctttatcacattaatactgactcatatcttatttcccacttgcaataagaaaaccattcaaatcttkccctcacaggacaatatctttaatagcttctgtgtgtttcctatttttggctgtttctgtataaacagactaatctaatagcatactgaacccatctaac

SEQ ID NO: 16073 - DNA, 201 bp, Homo sapiens
tttagtgagctctgctggcaagtgtgtcaaatttataaatatcactactataaagacatacttttggatatggatttcttcctcagtttatttcttctttsattttttcatgtccaggtcactacgtattgcgtatatttggttggaattttatttttgagcaattcatttacccagattgtgtttctggagattaaagca

SEQ ID NO: 16074 - DNA, 201 bp, Homo sapiens
cagtaagtattcttggggcaaatgggaaaagggttaaaatgaccagatctccagagatctcactcactatggtgaagacagcgccaagccatgagggctcygccccagtgattcaaatacctcccattacggacatgtttcaacatgagatttgagcggggacaaatatccaaactatatcaggatcccagcagactgggt

SEQ ID NO: 16075 - DNA, 201 bp, Homo sapiens
tacctgaactgtctcttaaaaggctctgtctccaaacacagtcacattgtgaggtactgggggtttgggcttccacatacaaagtctgggacacagtacgytctcataagagacctcttctcaacaggatccatgtttgatccgggggaataaagctagagttgctttcttccttgtaatatgtataatgactcatgagag

SEQ ID NO: 16076 - DNA, 201 bp, Homo sapiens
aggaatgtagttcctcacagttctggaggttgggagtcctagatcaaggtgtcagcagggttggtttctctctgtaccattgtccctggcttggagatgaycatcttctctgtcttcacatggtcttccctctgtgtgcgtttgcatccttatggcctcttcttgtgagggcactggtcatattggattagggtccaccat

SEQ ID NO: 16077 - DNA, 201 bp, Homo sapiens
atgttgcctccagcatcccaggaactccgttaatgtttatttgaatgatggaatgaaggtgtcttgctatattttgacatttctgtcaaaatatgaatctrtctttgcctagcatcttttcatgtgcacattgcccatctttataacaaagtgtgagtgggaaaggacttttaatcttcattatattatcattcatatgaa

SEQ ID NO: 16078 - DNA, 201 bp, Homo sapiens
tattccagtgggccccgctgcattcttcccagtcccaggaaatctttgtgcatggctgtcttttctgtgccatcttgggcatctcacgcattggccctatmcacatgttgcctccagcatcccaggaactccgttaatgtttatttgaatgatggaatgaaggtgtcttgctatattttgacatttctgtcaaaatatgaa

SEQ ID NO: 16079 - DNA, 201 bp, Homo sapiens
tttaacaagagacacatgtcagatagtagacatgatctgagaagacacaaaacccagcgtggtgattttggcagccttgccatgcatctctaacatgcacrtggccagaaaaatagcttggacattctgttcaaccctccacatcaactggtcagtttagtctttaaaaggtgataggcctgttgtggtggctcacgcctg

SEQ ID NO: 16080 - DNA, 201 bp, Homo sapiens
aaagtccgcacttcctaatgttaccactctggaggttagaatttcaacatataaattttggggggacacattcagaccacaataatgttttataatgttcmttttgctttaacaagagacacatgtcagatagtagacatgatctgagaagacacaaaacccagcgtggtgattttggcagccttgccatgcatctctaac

SEQ ID NO: 16081 - DNA, 201 bp, Homo sapiens
tatttgttaaaaggctttttgcctaacttgtgaaagttttttttcctcaactaattaagggtatcaacgcattggttgtatgttgaaaatgttgaaaatgttttttttttttttccaagttttctttctttttttttttttatactgggtcttgctcttcttatccagggctgaggtgcagtgacacagtcacagctcgct

SEQ ID NO: 16082 - DNA, 201 bp, Homo sapiens
gcataatttaggcccctttcaggccactcttccccctgtgccccaggtgtgtttgctaccatacctccccaggggatagccctccaaacctgattggccamctagtctggtcttaaagtcccaaagggaggccatcacaaactactcagtatggagaagacctgaatcctaattttggcttaaccccaaacttgggcgatt

SEQ ID NO: 16083 - DNA, 201 bp, Homo sapiens
tagaggatggatgggagcatgaagtgtcctccgtcatgttgctaatgttctgttgcttgttcaagctactgggtgtgttcagtttatgaaaattcatttartgacacatgtatgttttgtgaatttttttgcatgtatattttactctaacaaaaagttcatggacaaatacaaaatcatatctgacagttgttgagagaa

SEQ ID NO: 16084 - DNA, 201 bp, Homo sapiens
cattttactttgcataatttaggcccctttcaggccactcttccccctgtgccccaggtgtgtttgctaccatacctccccaggggatagccctccaaacytgattggccacctagtctggtcttaaagtcccaaagggaggccatcacaaactactcagtatggagaagacctgaatcctaattttggcttaaccccaaa

SEQ ID NO: 16085 - DNA, 201 bp, Homo sapiens
tgcaacttgtcaaacacttacatttgtgaataagaaaactggggtctatttggtggtttatttcagagatgttggatcaaatcagacatcagaaaagacamcagtaccaaacgaagatatctttgctgtatttgcagttttctctcttattaacatgaaaacaccttacatagatggaaacatctaaaggctattttttat

SEQ ID NO: 16086 - DNA, 201 bp, Homo sapiens
taggtgagtggtgaagatttttattctgaatttttgaaataatatcgtactgcaagttccaggcaatcaaaaactcacaaatcacttgcactctgcagcagtggtatcaggtctgaagaaaggaagaggctgcagataggcacatggctttgctaagttagcttttatatcctgcgtggctgccttagaaagtgtccttgc

SEQ ID NO: 16087 - DNA, 201 bp, Homo sapiens
caataaaaacatagatatctaatttgccttacaaaggccgatttgcaaatctagtatttccagtggttctttctttctttctttctttctttttttttttaaatgccccatatgacgctgctttgttggaattgccattggtgaggatctcactgataaagaaggggacatccctcccttgatagactttagggttgcact

SEQ ID NO: 16088 - DNA, 201 bp, Homo sapiens
acagcttagatgaaatttaggcaaatggaacgccccaggccccaggaagactgtggcagcacattgtatgtaactgttggggatgttgcctgaaacccccsccttttttttaggcagctgcaaggattagaatgttgcctcctcagaaactaacactcttctctccttgacctttgtttaaccagctttctgaacctgaag

SEQ ID NO: 16089 - DNA, 201 bp, Homo sapiens
taaaaacagaaacagagcagtccctttgcttccgaatgcagccctcccattggaatcactttggaagaatctggatctgcgtgttacccagtcttactttkcaggcagtcccaggcaggaaggcccattagtgaaaagagccctgcatatgctgtgggtcatcacagctgctgctttgcacatttaggagatatttgtgga

SEQ ID NO: 16090 - DNA, 201 bp, Homo sapiens
ttctttaaaaaaaatttatgacatattacttttgctaattatgtgtgtgggtagattatgttattcatgaattttatttcaggaccttggtaaggggttayacaatatttcttttgaaacgagggtctcgattattgggcttgagtatcctgatctaattaatgcactggacagagctggcagacgtgtgggacacccagc

SEQ ID NO: 16091 - DNA, 201 bp, Homo sapiens
ttttcagagttggtttaccaatatgatgtctgtattaaaatatatgtaatgctgctttcaaaatgttaagtattatgagaatacattaacaaaactctggygaattttttgtcttatgtttcttgaatccaaacctataagtaggtgcaaacattagacgatttcattttgggcttctgatacactcctgtccgagaagtt

SEQ ID NO: 16092 - DNA, 201 bp, Homo sapiens
atgagagcagattttgcctgtttcttccaaaatctggattcagtgacatcgtgttggtagcttgaaactgaccgtggtgagaatatttacaccatggaaaktggcaaatgctactaataaggatgattgttttagttttcattttgtaattttcagagttggtttaccaatatgatgtctgtattaaaatatatgtaatgc

SEQ ID NO: 16093 - DNA, 201 bp, Homo sapiens
cggtaaaaaacttgtttccattgatctgaccccagaattccctgtgcttatacagatacacaacgtgcactgggtcttccagaaatgcaggggccttctamatcaagggaagattgtgtggtgttttgttccagtcttttaccaaggtctcaataccatcttgaaacatcatgcagcactgctcataatatttgagtcacc

SEQ ID NO: 16094 - DNA, 201 bp, Homo sapiens
gggcattttggaaatttggaaaggcattttggtggcctttggcacttagcaggtggggtccacgggtccatcctgtgatgccataggcagtccaatataasaaagaactgccctcgtcccggtaacatacacctgtgcccccagacattcatttcggtaaaaaacttgtttccattgatctgaccccagaattccctgtgc

SEQ ID NO: 16095 - DNA, 201 bp, Homo sapiens
agaatctaattttactgtgcattttcttgattattagtgaagctaaacattattttttattgatgtgttaacaatttctttcttttgcaaatgatctattmatgttctgtgactgatttctatcttggtgtctttacgtttgtgaatggtaagaatttttatgtgttcaggaactatttaaatgttcaagacattaacctg

SEQ ID NO: 16096 - DNA, 201 bp, Homo sapiens
tattttgcattgtttatgtcagcattaagcagtattcttacacagtttgtaagtcttaaaactcagtatctactctagtagttgctccaaatgtgatgtcstcataaatcaccgagggatcttgttaaatttggattctgattcagtaggtctaggtggggcccgagcttctttgtttccttttcttatttaatttttgtg

SEQ ID NO: 16097 - DNA, 201 bp, Homo sapiens
acttgtggaataattttttaatataaaataattaccatcactaatcctaactgtgcacattcttgactctgtgacactgagcaaaatcctgaacctctctrtgccttgatttctttcacgtcttgttctagttttgaagagcgattcttgtgtgaattcagggagaggaggcatgaggcatggtaaggccaccgtacgtct

SEQ ID NO: 16098 - DNA, 201 bp, Homo sapiens
ggaagccttcactctaatgacataattacctcccaaagtccgcacttcctaatgttaccactctggaggttagaatttcaacatataaattttggggggasacattcagaccacaataatgttttataatgttccttttgctttaacaagagacacatgtcagatagtagacatgatctgagaagacacaaaacccagcgt

SEQ ID NO: 16099 - DNA, 201 bp, Homo sapiens
tggtgcccatcaccccgatcacatgaacgtctatgcccaggtcccatttcctgacattcccaacatctctaccttctccgggcctagggcagggatcactstttcagaaacatgagcgtatggaagccccagtgtgttccttgaagtcccgatgcgtgatttgtccccatgctgtgtcgcacttggtcatctggaccctgg

SEQ ID NO: 16100 - DNA, 201 bp, Homo sapiens
aaagaggtgtaaatggacaagaatgaaaagcaattgcaagggcccttgaaggtttgtgaaggatggcaaagtgacttggatgttgatttctaaaggaggtraaacttgaaggtagacaagctctttgtgtccatacatttgatgggtcatcctatgaaggagggcccatctcttacggcaggcagcgtggcgtaggcctca

SEQ ID NO: 16101 - DNA, 201 bp, Homo sapiens
cagcacagtgaggaggtattctttggagagcactgtttcccaagagtgattctaacaaagaggtgtaaatggacaagaatgaaaagcaattgcaagggccyttgaaggtttgtgaaggatggcaaagtgacttggatgttgatttctaaaggaggtaaaacttgaaggtagacaagctctttgtgtccatacatttgatgg

SEQ ID NO: 16102 - DNA, 201 bp, Homo sapiens
actctacttaaaattaaggcataaagtaggaaaatgtgtttcctctgtatagtcttattactttgcctgttaagttaactggttcctatttctgctggttygaagaggtccaggacatttaaatagctcttctagaaacaaattcttttccttacaagccctgccaggtcagtgggttcagtaaggaagaaggttttgtat

SEQ ID NO: 16103 - DNA, 201 bp, Homo sapiens
acccagtggaacgctctttctagtttggggcataaaataagataacactctgaattcctacaggaaatcttgtaactctacttaaaattaaggcataaagyaggaaaatgtgtttcctctgtatagtcttattactttgcctgttaagttaactggttcctatttctgctggttcgaagaggtccaggacatttaaatagc

SEQ ID NO: 16104 - DNA, 201 bp, Homo sapiens
gcttagatgaaatttaggcaaatggaacgccccaggccccaggaagactgtggcagcacattgtatgtaactgttggggatgttgcctgaaaccccccccytttttttaggcagctgcaaggattagaatgttgcctcctcagaaactaacactcttctctccttgacctttgtttaaccagctttctgaacctgaagaac

SEQ ID NO: 16105 - DNA, 201 bp, Homo sapiens
tctgccctcctcggcctcccaaagtgctgggattagaggcctgagccaccgcgccagctctatttgctgatttttgaacagcagcttttttttttttttttaacaaaactttaaaatgggttatgtgttttattttcttagtgaagtaatggcttctcaaatttacactccattattttatttaaaaaaatcagtatgatt

SEQ ID NO: 16106 - DNA, 201 bp, Homo sapiens
ggtcaaggtagtgttcattaggtttctccactgcacacttagtctttccctctactttccacactgctgcctttggaggagtgttgctgtgcccagctcaygcttgtggagtggggatttaatgttctcactcttcgagggtagagtatctgcataaactacttggaattctacatggaatatttgtgtcttctcccccat

SEQ ID NO: 16107 - DNA, 201 bp, Homo sapiens
gtctccttagcatcttcttggctgtgacagtttctcagaattgtctttgtgatgaccttgacagctttgaggagtgctggttgggtattctgtaggatgcycctgtgttgggatttttatgatgtttttctcatgagtttactggagttaatgaatttcagggaggaagaccccagaggtctgttttcatcacatcgtatc

SEQ ID NO: 16108 - DNA, 201 bp, Homo sapiens
ttttttttttttttggctgactgtcatgacttagtaaggccatcacaggttgccagaacatctactcaactgttccaagcataacctcctacacaggcctkctacataggagtatatttggccaagactcaccactagaagtgatttccactggactttcctacagcaagtggtaaatgatccctcagataggcccaagag

SEQ ID NO: 16109 - DNA, 201 bp, Homo sapiens
gagatcgtgccactgtactccagcctgggtgacaagagtgaaactccatcttaaaaaaaaaaaaagtgaacccttgtagtttcttcctctgtttgacagayggaccctaagacggccccagtgataccccacctcctggtgtccaaggcctgatgtgatcacccttcccccaccttgaatgtaggtgggacatgggactta

SEQ ID NO: 16110 - DNA, 201 bp, Homo sapiens
gtttcaccacttttggccaggctggtgttgaacccccgacctcaggtgatctgccctcctcggcctcccaaagtgctgggattagaggcctgagccaccgygccagctctatttgctgatttttgaacagcagcttttttttttttttttaacaaaactttaaaatgggttatgtgttttattttcttagtgaagtaatgg

SEQ ID NO: 16111 - DNA, 201 bp, Homo sapiens
gaaaaggaaagacaacagataagtgattgccagggactggagaggagtggggggtgagtgggaaccagagtggatataaaacagcaactggaggatcctgrtatagatggaaatgttctgcatcttgactgtctcaatgtcaatttcctggttgtgaaatcgtactagagttttgtgagatatcacctatgggggaaactg

SEQ ID NO: 16112 - DNA, 201 bp, Homo sapiens
catctcaaaagagaagaaaagagaagaaaaggaaagacaacagataagtgattgccagggactggagaggagtggggggtgagtgggaaccagagtggatwtaaaacagcaactggaggatcctggtatagatggaaatgttctgcatcttgactgtctcaatgtcaatttcctggttgtgaaatcgtactagagttttgt

SEQ ID NO: 16113 - DNA, 201 bp, Homo sapiens
catcctgtgtagaaatatcaataaatataaaggtaagtattattgtccccattttacagatgagaaaatggagtcccagggacctacctgctcaagggcasagaaagcttgaatgagtaaatttactttgtgttgttccaaaggtttctccaaaggtctttgcacctcccaaggctattctcattttgagaaagactggca

SEQ ID NO: 16114 - DNA, 201 bp, Homo sapiens
tgtttagtaagtcatctatgttgtttgggaggaaagagaatgagcattcctcagttcctgcactgcaccaggccttgccaatacagtacctcatttaattmttgctaccatccttgaggtggctggcattaggccatttgcggggtgtagaaaatgacatgcagaaatactgtagcagctcacttaatatcaggcagatgg

SEQ ID NO: 16115 - DNA, 201 bp, Homo sapiens
tgaggtctcctgaaacttattcccgcaaggacatactactgtggacccacctgaagggtggcatccactcttctagtaggatctcacattggtattttcasacacttctgccccttgccatgtttagtaagtcatctatgttgtttgggaggaaagagaatgagcattcctcagttcctgcactgcaccaggccttgccaa

SEQ ID NO: 16116 - DNA, 201 bp, Homo sapiens
ccagggacggctccttggcaagttgtactgctgtggcctagggagggacaactggcagggccacacaaggaggtaaaaccttatgctccatttgcaaagcyagtggccccagcagagataggaggccctctctgtgatttcggcagtggtttccctgggattgaggtctcctgaaacttattcccgcaaggacatactact

SEQ ID NO: 16117 - DNA, 201 bp, Homo sapiens
tttttttaacagttagatttactcttcctttgcacagactaatagcacactgaggtaggatccagggacggctccttggcaagttgtactgctgtggcctrgggagggacaactggcagggccacacaaggaggtaaaaccttatgctccatttgcaaagccagtggccccagcagagataggaggccctctctgtgattt

SEQ ID NO: 16118 - DNA, 201 bp, Homo sapiens
agtgtgcccattttacagaggtggaggaggaagctccaaaaatgaagcccaaggatcttaaggtaatatatgggcttgaatccagtgtatcttgctccgamagccttgcttttgtcattatccaacattagctgtctttattatagtggccttcttaccacctacaaaacaagtgccagcattctagtaaaatttattcac

SEQ ID NO: 16119 - DNA, 201 bp, Homo sapiens
acattgtaccctggaacttaaaagttggtgaaagaaagaaggggccgggcatggtggctcacgcctgtaatcctaacattttgggaggtcgaggcaggcarattgcctgagctcaggagttgaataccagcctgggcaacacggtgaaaccccgactctactaaaatacaaaaaattagccgggcgtggcagtgtgtgcct

SEQ ID NO: 16120 - DNA, 201 bp, Homo sapiens
agggagtaaatatttattaatttttaagatgcttcattttggagtaatttgctacacaccaatattaatacagagcccatatgcgctgcctacaggataaataatgtaatagcttaataacaattaaaatggaagaaaatgtaggagttcctcaatggttccacctgtttcttgaggttaaaaatgtacacatttgtgggc

SEQ ID NO: 16121 - DNA, 201 bp, Homo sapiens
ttttagacaactggacacaggtttgtctttgaaattgtcctggtttttcttgatgttttagtgctcctggatgtccaatgtcattcttgggctagttgaargaaagttttggctacccagttgttagctgctgaagtttaactgtgcattctaagcacaccagtattttattacatcatacctgggcagcagataatttta

SEQ ID NO: 16122 - DNA, 201 bp, Homo sapiens
aatcacttgaacccgggaggtggaggttgcagcgagtcaaggtcacgccagtgtactccagcctgggtgacagagcgagactccgtctcaaaaaaaaaaaraaaaagaaaaagaaaaagaaaaaggtgtttggaagccatgtcccatgaattccaaatacaattgaggactctataaaggactataaaaaaagttgtaata

SEQ ID NO: 16123 - DNA, 201 bp, Homo sapiens
ttcaagatgacttttcattctctcatctcattcattttgaggtcattttgttgttgaaatgttagagttcaaccttaaatacttaagagcatggcactgtstagagaaagggagatgagcttctgtggtagccagaggtcaagatggcctctagtgaccctcacttcctgggttttacattgcagtatatttctcttctac

SEQ ID NO: 16124 - DNA, 201 bp, Homo sapiens
agggattcgtaagcttaggactgatagagatttggcttttctgctgttggattgatagctccttgactgctgaagccattgcccatctgttcaactgttgkattcacgaggaggttagacccctgacccaaggcccaggtacctggctttcctcagttgggatcagaaggccacaaagttttcttatattttaagcatcaa

SEQ ID NO: 16125 - DNA, 201 bp, Homo sapiens
tatggagcctgttaagaccagtgatgctgtggcctgaataacaacaggataggaacattcccttcttctcataaatcttgtaaatttgcattgtttgtgcygaacagggcccgtgtgttctgatagcaaacatggagaggcccaaaaggctgatctgggaccatgtccccattgaacactgctctgtgctgagtctgcaga

SEQ ID NO: 16126 - DNA, 201 bp, Homo sapiens
tcatgcactgtcaagcaccgtaactttagctacattctattgattagaagaatactagtaaagaccatagttaggagaggggaacctggctccaccattgsaagggaggtctatcaaagaacttgtgggcatattctaagaccaccacactctgccactccacacaccctgactctcctaacacctgctcgcttcactggt

SEQ ID NO: 16127 - DNA, 201 bp, Homo sapiens
aaaataatgattataactatgacctccagaagcttttgctgagcatctatctgtagcactgcatgtcaagccaagctagagtacagtctcttaggagacayaggggaggaaaacatccttggcaggttcgcatattggtgatctcgtcgtaattttctcaaatacccttcctctttcctcacttttggtgataactacctg

SEQ ID NO: 16128 - DNA, 201 bp, Homo sapiens
taatttatgtaaagcacaaagcataatccctggtattcaataagtactcagtaaatactagtgaaaataatgattataactatgacctccagaagcttttrctgagcatctatctgtagcactgcatgtcaagccaagctagagtacagtctcttaggagacacaggggaggaaaacatccttggcaggttcgcatattgg

SEQ ID NO: 16129 - DNA, 201 bp, Homo sapiens
gttctgtgccaaggattttagaaagtcatgtctcattcagttcccctaacaggtctaggagtcattatcctccccaacctaaggaaactgagacccagagrttcagagtatcccaagatcctacaggaattgcagattgtagccaaaattggaactcctaattccagagctcctccctcctgctagcatttttctttgagt

SEQ ID NO: 16130 - DNA, 201 bp, Homo sapiens
atcatcacacctttcccttagcctgtactaggttctgtgccaaggattttagaaagtcatgtctcattcagttcccctaacaggtctaggagtcattatcytccccaacctaaggaaactgagacccagaggttcagagtatcccaagatcctacaggaattgcagattgtagccaaaattggaactcctaattccagagc

SEQ ID NO: 16131 - DNA, 201 bp, Homo sapiens
ttatatataataataatttaatttataactatatcatttattaaggtcctactatataccaaattctattggacacatgtcctaataataaacgtgatatmatctatcattatttacaaaacttcacactctgacctttattaattatgtgtgtgccaattatgtgcagggaactgtattaatcgtagttagcaatatcgt

SEQ ID NO: 16132 - DNA, 201 bp, Homo sapiens
tgggcatttttaaattatcattagtatataattatatataataataatttaatttataactatatcatttattaaggtcctactatataccaaattctatyggacacatgtcctaataataaacgtgatataatctatcattatttacaaaacttcacactctgacctttattaattatgtgtgtgccaattatgtgcagg

SEQ ID NO: 16133 - DNA, 201 bp, Homo sapiens
gagatggcgccactgcactctagcctgggcggcaagcaagacaccatttcagagaaaaacaacaacaacaaaacatatggccagcagccagtgttgttatytcaggatgggaaccaggcactgcacctcctcattaggagtcagagtaagggggctaagctggttgacatgactggggacagagttgctgttgaaattgtc

SEQ ID NO: 16134 - DNA, 201 bp, Homo sapiens
ctctactaaaaataaaaaaaaaaaaaaaattagccaggcatggtggtgcatgtctgttatcccagctacttgggaggctaaggcaggagaatcacttgaayctgggaggcagcggttgcagtgagccgagatggcgccactgcactctagcctgggcggcaagcaagacaccatttcagagaaaaacaacaacaacaaaac

SEQ ID NO: 16135 - DNA, 201 bp, Homo sapiens
gcggaggttgcagtgagctgagatcgtgccactgccctccagtctgggtgacagagtgaaacccatcccccaaaaaaataaataaataaaaattaaaaaayctaacactggtacgagaagaaattatgctctaaatccttctttgagcagtggcttacagacctaaatttatcaaaggtggtggcagtaatagtaataatt

SEQ ID NO: 16136 - DNA, 201 bp, Homo sapiens
gtaatatttaagtattaatacctctgtttaaggttcattttgaacgccttggtgaccctatgtttttttctttgttttttgttttgttttttttttttttkttttttttttttgtttttttgagatgaagtcttcctctgttgcccaggctggagtgcagtggcgcattcttggctcactgcaaccttcgcctcccaggtt

SEQ ID NO: 16137 - DNA, 201 bp, Homo sapiens
attaatacctctgtttaaggttcattttgaacgccttggtgaccctatgtttttttctttgttttttgttttgttttttttttttttgttttttttttttktttttttgagatgaagtcttcctctgttgcccaggctggagtgcagtggcgcattcttggctcactgcaaccttcgcctcccaggttgaagcaattcttc

SEQ ID NO: 16138 - DNA, 201 bp, Homo sapiens
gacttcataataaataagatgctgacagttgaaacccccttgaccgttgcctgtttggtatgacacagaccttcttggacttttgtagcctatacatgagyagatatgaatcctcagccttctccaaaataaggttggggtcactaggaggccttcttggaaagatgtcttaaattaaggcaccagtagatggatcaaaaa

SEQ ID NO: 16139 - DNA, 201 bp, Homo sapiens
aaaaaaaatgttttctggtcaagtcacatgcctctgaggtttttttttttctttctttcttttctttttttttctttttcccagactcctcatacccctcytaggagacagtgattccctggcttcaccaggcaggctcttgggggcttcctggtccctgtcactcttaaaatgcagcctgtctttggacatctactccaa

SEQ ID NO: 16140 - DNA, 201 bp, Homo sapiens
ggcggagcttgcagtgagcggagatcgtgacactgcactccggcctgggtgacagagcctgaatccctctcaaaaaaaaaaaaaaaagaaagaaaacaacyacaaccacattttgagataggccttccttggcaaactttgatttcgtttctgtatttgaggacaaaacacagtatggttgtttccctccctagactagat

SEQ ID NO: 16141 - DNA, 201 bp, Homo sapiens
cgtgaacccgggaggcggagcttgcagtgagcggagatcgtgacactgcactccggcctgggtgacagagcctgaatccctctcaaaaaaaaaaaaaaaaraaagaaaacaaccacaaccacattttgagataggccttccttggcaaactttgatttcgtttctgtatttgaggacaaaacacagtatggttgtttccct

SEQ ID NO: 16142 - DNA, 201 bp, Homo sapiens
cggggaggacgcgcactccagcgcagcgcgtgcggtgcaaagtgaaagtaactgttaaggagcttcagggaaaagggtccagggttcccagtaggggccgscccccttggtgggcctcgggtccagcgggggtcacctggtggcttcccggcgcgccctctgctgttcaggatgcagcactgcgcggcgcggcgagggcaa

SEQ ID NO: 16143 - DNA, 201 bp, Homo sapiens
cagagggattcgtaagcttaggactgatagagatttggcttttctgctgttggattgatagctccttgactgctgaagccattgcccatctgttcaactgktgtattcacgaggaggttagacccctgacccaaggcccaggtacctggctttcctcagttgggatcagaaggccacaaagttttcttatattttaagcat

SEQ ID NO: 16144 - DNA, 201 bp, Homo sapiens
ggaatagagaaaaggtggcttggctgtttggtttatgtcctaaaaccttatcgtaatgtgattctccttaacagagggattcgtaagcttaggactgataragatttggcttttctgctgttggattgatagctccttgactgctgaagccattgcccatctgttcaactgttgtattcacgaggaggttagacccctgac

SEQ ID NO: 16145 - DNA, 201 bp, Homo sapiens
ggaaatggaatagagaaaaggtggcttggctgtttggtttatgtcctaaaaccttatcgtaatgtgattctccttaacagagggattcgtaagcttaggamtgatagagatttggcttttctgctgttggattgatagctccttgactgctgaagccattgcccatctgttcaactgttgtattcacgaggaggttagacc

SEQ ID NO: 16146 - DNA, 201 bp, Homo sapiens
gagttgacatacggaaaacaagtaagagtaactttgtacaccgtgggctcccaatcagtgctgcttttcgttgttgatgttgttgttaatgttgaaaaaaatcttcaagtcatgtttgcccccacagaccttcccagacagtctaactaaatgcactgtatttgctaactgttggaacttggcttttggactagaccagca

SEQ ID NO: 16147 - DNA, 201 bp, Homo sapiens
ttcccagtaggggccggcccccttggtgggcctcgggtccagcgggggtcacctggtggcttcccggcgcgccctctgctgttcaggatgcagcactgcgyggcgcggcgagggcaaagcggcctcatccccgccaaaaaataaagatgttttaaaaagcgcacatgctcagctccctcctgcaggctctgggttgcaggg

SEQ ID NO: 16148 - DNA, 201 bp, Homo sapiens
ctacttccttcttatatctggctatctgggagagaaaaaatttaatacaattgattactttttagaagagttaatttttacttattactgtggattttttkttttttaacagtcacaccgaggagaagactcagtgggaacatccaaaaactggaaaaagaaaacgagtggcaggaggtttgtatgttgttgtctaaggat

SEQ ID NO: 16149 - DNA, 201 bp, Homo sapiens
tcatatggtcctctgcagccttgcaaagtcgattcctgacatttccgtagactgttttttttgttttcagcaatactctccagcagcaaaacccaatccgytcatattcttgcatttgctgcagcaaaacctgacctctctttgtgttacctgagtcttgacgaagaagactgaggaaaggcccccccccccccccaccaa

SEQ ID NO: 16150 - DNA, 201 bp, Homo sapiens
tggtagctcatgcctgtaatcccagcactttgggaggccaaggtgggtgggtcacctgaggtcaggacttcgagaccagcctggccaacatggtgaaaccscatctctactaaaaataaaaaaaaaaaaaaaattagccaggcatggtggtgcatgtctgttatcccagctacttgggaggctaaggcaggagaatcactt

SEQ ID NO: 16151 - DNA, 201 bp, Homo sapiens
cacagaggaagtggagctggagtctctgtggctccagggtcaggtgtgtagtctcgaaggctgttttctgttctgcaagtttctccttaacacatttccarccccattttctggcagggagaccccaggactgaaaggagctggaagagtgaggtctaagagaaaaaggggctgggtgtggtagctcatgcctgtaatccc

SEQ ID NO: 16152 - DNA, 201 bp, Homo sapiens
tctgtatttctcagggcagcgtgggacctcagggtttgtcatggaccacacctttctcctttgtccctttttataactcataggctacctccaacttgacrcttatttaagtttttatttattttatttagcattcagaaaactctatagcctcagtctctcgggatgtaaattaaagcaatttcattttcatagtttctc

SEQ ID NO: 16153 - DNA, 201 bp, Homo sapiens
attacattttttgaatatgtttcttctttgcctcttgaggactaaccagccgggtttagattatttcctccccgtgtcgctttcctgcccccacatgttawagatggtgcaagggaaccagagagctttgatccctggtttctctggtcacaaacctgctctcctctccagaactccaggctgcctttctgtgggggctaa

SEQ ID NO: 16154 - DNA, 201 bp, Homo sapiens
ctgcctccatctccctttctctgtaagtggaagtggtattcattgatcacacactacatgccggacaccaagctattacattttttgaatatgtttcttcyttgcctcttgaggactaaccagccgggtttagattatttcctccccgtgtcgctttcctgcccccacatgttaaagatggtgcaagggaaccagagagct

SEQ ID NO: 16155 - DNA, 201 bp, Homo sapiens
tttgaggggtggtatgaggtcacagtcacagccacccctctcaccagctgtgtgacaattctggatttccttagctgtcctctgcctccatctccctttcyctgtaagtggaagtggtattcattgatcacacactacatgccggacaccaagctattacattttttgaatatgtttcttctttgcctcttgaggactaac

SEQ ID NO: 16156 - DNA, 201 bp, Homo sapiens
ggggccataggctgccaagctgtggtttctaggagactctgaggacagagggtcaaatccatgagtttgtggatggcctgatgatccccagcggagaccaygttaactagtacattgatgctgttgtgtgccatgtgctgctcagatagggttttctgggcatcaaggtgaaggtcatgctgccctgggaccccgctggta

SEQ ID NO: 16157 - DNA, 201 bp, Homo sapiens
gctacaaaacctggcattttacttctctcattttccccaaatgatctaggtgtcttttgctcactggtgataaggggtgacattggtatcacaggtaaaartgagtaaatttgagattattgtcgtcttgctttaaaggttggagatacagcttcaaaaaccttttactacccacacacccaaggggagtcaaatggattt

SEQ ID NO: 16158 - DNA, 201 bp, Homo sapiens
gtacaaactcctaggagggcttactgtgcggagggcctgcgatggtgggctgtggttcatcatgaataggggggccataggctgccaagctgtggtttctrggagactctgaggacagagggtcaaatccatgagtttgtggatggcctgatgatccccagcggagaccacgttaactagtacattgatgctgttgtgtgc

SEQ ID NO: 16159 - DNA, 201 bp, Homo sapiens
cattcagccctcgggttaccattggtagcacatctaggagcaagttttaattttttagtcatagtgactgtgctggatttggtaggtcgtacgaattgggkaagaggcataggacaccaaggattttgcaaaaagcaggcaactaacatttgttttccacctactatgattatgttaggctctcaatatatgtttaccact

SEQ ID NO: 16160 - DNA, 201 bp, Homo sapiens
gagaggcacaatctgctttccttttgatggtgtgcagcagcatgatggccgcgcgaatttccaagaagaggatgttggtcgctgatggcatcttcaaagcygaacggaatcagtttcttactccggagctggctaaagacgcttctctgaagctcaggttcaagttacacccatcacgacagtaacaaatatcttagccaa

SEQ ID NO: 16161 - DNA, 201 bp, Homo sapiens
ctgggactacaggtgggtaccaccatacccagctgttgaaaaaaaaatggtggggtattactctgttgcccaggctggtgttgaactcctggcctcaagcratcctcctgcctcggcctcccaaagtgctgggattacaggcttgagctactgccccaggctcttcccccgtttgttaatacataccatgaccttggcctt

SEQ ID NO: 16162 - DNA, 201 bp, Homo sapiens
aaaagagtgtttggctaacttgcataaaaaggatctcatttttctttgtaacacattactacatacagtgaccatagtgtttctctaatttcttcaggacktactttgaagatgaagaagtatgtgtatccgctttttgtctttcagaataacatactgctgtctgtaaaaatacagataatttctctcttaaattccata

SEQ ID NO: 16163 - DNA, 201 bp, Homo sapiens
caccactgtacagcatctttacttaatctgccctctttcacgtgtgtgcatccctggcatgcttaaacaagaaaggcaaatgagagagagcgagtgagtgygagcgagagagccctgaggtgccagaaggctgtggttcctttgtgtctacagaaaagatataacgattgaattagactcttaaatatctgtggatgtcag

SEQ ID NO: 16164 - DNA, 201 bp, Homo sapiens
tgtttacctgtttatgataaaggatattacaaagagtacagatgaagcggtacatagggccaggcatgcggaggggatgtggagcttccataccccctccyggcatgcccctctccaggcaccacatgctcagcaatctggaagctctccaaaccctatcgtttaggtttttgttgttgttgttttgagatagggtctcgc

SEQ ID NO: 16165 - DNA, 201 bp, Homo sapiens
atataattcaagttgagatttcggtggggcgcagccaaaccatatcagacacaaacattcaattcacagcattctaccccagccctccaaaattcatgttyttctgacatgctaaatacatttattacatccaaatatccccaaaatcttaactcattccggcatcagctgtaaagtctatgtctttttaatttttttaaa

SEQ ID NO: 16166 - DNA, 201 bp, Homo sapiens
gcagaaaggtgcctatcatgtcttcagtgtcagtgccctggtatggagctagctggccttccacaggttctggagttaatgctggagagaagtaggggtgkcagagcctaccctgtgttcctaggggggttcatctggagctagtccctgacccttaggtggaagatgcagctatgcccaaggttctgaagaccctgtaaa

SEQ ID NO: 16167 - DNA, 201 bp, Homo sapiens
ttaaggaaactcggctcaaactagcttcggggactcgctgtggccataggtgccctaggctgcagtctgagagtgaaactgaggtctcactcccttcatastctgctctccgtctctgcctcatctggcttctcagggtggtggggcgtgggcactaatttgatttgatcacttagagacaacagcttacaaaatgctacc

SEQ ID NO: 16168 - DNA, 201 bp, Homo sapiens
atgtttacatggggctgtggaccattttgtatcattggaggagaagccagggcacttggcaggggtgttcatgatgataatcaggtggctgggtggagtcrccatttgtggcatcctcaaagacttgccaacatagacatttttggggagacagaaacacagaaataattctgcagtgctttaaagaatctgttaaaaatc

SEQ ID NO: 16169 - DNA, 201 bp, Homo sapiens
ttgatgtaaaggactacctgaggctggctaatgtataaagaaaagaggtttaattggctcatggttccgcaggccatacaggaagcccagttagggaggcstaaggaaacttaaaatcatggcagaagatgaaagggaagcaggcatgttctgcatggctggagtaggaggcaaggagcgaaggaggaggtactacccact

SEQ ID NO: 16170 - DNA, 201 bp, Homo sapiens
caccgctcccgacggcctctagatattttgagtgattcagcaaacctcctaaagttgaccccgtagctggggtcacagtcctctttctccttcttcccccyacttccttcttatatctggctatctgggagagaaaaaatttaatacaattgattactttttagaagagttaatttttacttattactgtggattttttgt

SEQ ID NO: 16171 - DNA, 201 bp, Homo sapiens
attggaaatggaatagagaaaaggtggcttggctgtttggtttatgtcctaaaaccttatcgtaatgtgattctccttaacagagggattcgtaagcttargactgatagagatttggcttttctgctgttggattgatagctccttgactgctgaagccattgcccatctgttcaactgttgtattcacgaggaggttag

SEQ ID NO: 16172 - DNA, 201 bp, Homo sapiens
tttcggatttatattattgcttacttggcacatcttccattggaaatggaatagagaaaaggtggcttggctgtttggtttatgtcctaaaaccttatcgkaatgtgattctccttaacagagggattcgtaagcttaggactgatagagatttggcttttctgctgttggattgatagctccttgactgctgaagccatt

SEQ ID NO: 16173 - DNA, 201 bp, Homo sapiens
tccacctcctttgagcctctgccaaacacaactgatggtggctgactgcctggctgcaggaagttctgaataagtgacctctatttgttattatttgggtyccctttgtttatttttacactagctttgcactaggttaattttttcccacatggcttttcctgtttgtttctttgattgtttttaattaataattagttt

SEQ ID NO: 16174 - DNA, 201 bp, Homo sapiens
ttattttcaaatgcatgtctttagaaccagaatgtgtgtagctgttttctggcctgaatttgggctgagatgatgagaagtttagttgccactttcagctwagtggaagtgttttccccatttggactccgggtcattgacaaacgtcatcactgtttttagttgaaatgtgcttccatgtggctgttcatcagcacaccc

SEQ ID NO: 16175 - DNA, 201 bp, Homo sapiens
tttatactcctctttgcacgttgcagaagatcaggaatttgcacattatagccacaaccatacccagaaccagattgtctaacactgaatctcgaatccamattcctggatttggatggactcaatctggacccagtatctacatttggtccagtcatctgtatccggcatcggggtcttgttgaaaaaccatggcttagc

SEQ ID NO: 16176 - DNA, 201 bp, Homo sapiens
agatccagtggagtgtggggtgctgagagaacaagtctatgttttcttgagacaaagtcttgatctgttgcccaggctcgagtgcagtggcagcatcttgrctcactgcaacttctgcctcccgtgttcaagtgattctcctgtctcagcctcctagggagctgggattacaggtgtgcaccactatgcccagctaatttt

SEQ ID NO: 16177 - DNA, 201 bp, Homo sapiens
caaatggaaaaccttcattccaaagggtcgttgtctcctcctatttaatagccctgcattcatgcacttttttttatcttgctgtctttttttttttttttaatcaaataccaaagtacttctatggactggtcttaaaaaaaaaaaagaatccattcataactgtgaaaaaatactgcctattagtctgctattgtggct

SEQ ID NO: 16178 - DNA, 201 bp, Homo sapiens
cctacttggacccaagactggcgtttactgtggatgataatccgaccaagccaaccacccggcaaagatacgacggcagcaccactgccatggaaattctscagggccgggatttcactggcaaagtggttgtggtcactggagctaattcaggaataggtaggctcttcacttagttatttatctttgggactgctataa

SEQ ID NO: 16179 - DNA, 201 bp, Homo sapiens
aatatagtttgctgtgtgctgggtgggtgggagggagcgtccacattagtgaacagccaggcagtcgctgcctcaaatttctttagggttatcctttcatkccagcaattgaatttgatttgcactgtttcacttctctacaagggtgtaaaaagtagaggttcctcttgaaagaatttcctccccatctaattaggaata

SEQ ID NO: 16180 - DNA, 201 bp, Homo sapiens
ttcattgctgtgggttcactgctttctcttttgggcagccatataaataaaagaaccacctacttggacccaagactggcgtttactgtggatgataatcygaccaagccaaccacccggcaaagatacgacggcagcaccactgccatggaaattctccagggccgggatttcactggcaaagtggttgtggtcactgga

SEQ ID NO: 16181 - DNA, 201 bp, Homo sapiens
taagcatatttatatatatatacacataaaacatatatgtacatattatcataatgcctacctgctcttgagaaagtagtgccgtatggctgggggtttckctcactggtttctatggctctcccctcccccactttttctaagaagtggtagtacctatctgactattttcttggctgcctgaagaggcctcaaaattag

SEQ ID NO: 16182 - DNA, 201 bp, Homo sapiens
cacagggcagctgtattccaggtacttggtgactcttggttgcgatctgatgactggctcacagtaggaccatgacgtgagcagatttgtagtcctgcatraatgaaggaaagaaagaaatctgacaactcattgattcagattcacagactctgcattttgaaccagaatacacccgagcaattacctagcacaaaatct

SEQ ID NO: 16183 - DNA, 201 bp, Homo sapiens
tcaagagtctttctcttccttttgagcccagctctccctttgtgacccagcaacttccttccccgatgatggccaagccttgaggatgtgaaactgcccartgccccaatctggagtccaccatcctgggtctagctggggacatccttgaatcagcctctgggaatcactgaaccaacatgagtcacttgctactgtgag

SEQ ID NO: 16184 - DNA, 201 bp, Homo sapiens
tgaaaaaaaataaacaaaatacttctgcaacagcagcagcaagagctgccgcaatgaaagaagaaagaaaaggagggacaggatgaaggaaagaagcagtrttaacattctagtaatatttgcatctgaatgatatttatatggggttattgtcctccctttgtgtatgtttaaaattttcataataagcatatttatata

SEQ ID NO: 16185 - DNA, 201 bp, Homo sapiens
agtcatgtccctagtccctgtctccgtatattttctccttctcttattagtttatcttttccaaaatgggctgtttcgtctctgatcctgatttatttttrttttaattaaataatttatttttctgagacagactgtcgctctgtcgccaaggtggagtgcagcggtgtgatcttggctcactgcaacccccgcctcccg

SEQ ID NO: 16186 - DNA, 201 bp, Homo sapiens
ctgaaggaaaggattcgatgactatctttttttggcacaaatgtgatccttctggaggccagaagatagattcagtgggccccagttctttcaggtttaakgaataagcattttggtctatgaaaaatggggttttcctaaagtataagattgtcttatatttataaatgcctgtgttcattgctgtgggttcactgcttt

SEQ ID NO: 16187 - DNA, 201 bp, Homo sapiens
aaggtcatagagcaaccaagtggcagggctgactcccacccaggtgtgttccatgggcagcgtcttcttactgcactgtcctgacttgctctagtgagatmtaagagaggcacaatctgctttccttttgatggtgtgcagcagcatgatggccgcgcgaatttccaagaagaggatgttggtcgctgatggcatcttcaa

SEQ ID NO: 16188 - DNA, 201 bp, Homo sapiens
ttattcactatcacgaggatagcgcaggaaagaccggcccacatgattgagttacctcgccctgggtccctcccacaacatgtgggaattctgggagatayaattcaagttgagatttgggtggagacacacccaaagcatatcagggtcctaggcaactttgtgtgagaacagaacagagaggaagcgacacacctttcc

SEQ ID NO: 16189 - DNA, 201 bp, Homo sapiens
gcaaagtacttcagggcctgtattagtttgtttttcacgctgctgataaagacacacccgagactgggaagaaaaagaggtttaattggacttacagttcygcacggctggggaggcctcagaatcatggcaggaggtgaaaggcacttcttacacggcagcggcaagagaaaatgaggaagaagcgaacgtgagaacccc

SEQ ID NO: 16190 - DNA, 201 bp, Homo sapiens
gaagagaggagttgatgatcacattattgtgtcagccgcctgtgtgaataaggaaggacagactcccaccccatcccatcattccaggttcaataagaggyaggtgcttcctaaagcagaaaaatgtaagggaagtcatcatcgcttatcatcacctgaatgttcaccatggtgacccacatctcaggatgctgcaaaacg

SEQ ID NO: 16191 - DNA, 201 bp, Homo sapiens
ttttattgcatgctttgaagtttgaatacactttcagtagctcttcgttatctcaaattaaatcttaaattgagcttgtggttctgtgaattaatactccrgcctttcagccctgctgctgaggtcattcaaatctaatggtggaaacggtcacagggtcaggccttggatggtgctgtatagaaatgccttaatgatgct

SEQ ID NO: 16192 - DNA, 201 bp, Homo sapiens
tatttaggttggaatgcaagggaactaaaggtaggggagattcttaaggaagtctactttctcttcaagaatgctatcaaattgaaaggtaattcctaaasaagagtcatttgtaaattagggaggaagagctaaaaaagattcctagcaagaaacatcataaaggggcttgataaagccaaaaaactaaaagaaaaaaaa

SEQ ID NO: 16193 - DNA, 201 bp, Homo sapiens
ccaagcgccccccagcccccaccccacaacaggtgtatgtggcctctggtttatccttctttccccctgctcaccacatggcttctcattttgaaaacccrgtggctaataaagtagatgagtttcaggattgcaaaatattgtgatcctggcctttgtccattgtgtaatcttcacagtgaccagagtgtttgcagttcc

SEQ ID NO: 16194 - DNA, 201 bp, Homo sapiens
gccacaggactatagcctgggcagttttgagtgctgcctctaccatgtaactagcttgccagtcaagtcattaactattcggggccttagtttcgtctttyctgaattggagccagtatacgtaattccaaaggttgcttttaagcgtaagtgagaatattggcagaaattcgttagcactgagagagggaatgtaaagtg

SEQ ID NO: 16195 - DNA, 201 bp, Homo sapiens
gcagtgaactaagatgccacaggactatagcctgggcagttttgagtgctgcctctaccatgtaactagcttgccagtcaagtcattaactattcggggcmttagtttcgtcttttctgaattggagccagtatacgtaattccaaaggttgcttttaagcgtaagtgagaatattggcagaaattcgttagcactgagag

SEQ ID NO: 16196 - DNA, 201 bp, Homo sapiens
gaaaagaggtttaattggctcatggttccgcaggccatacaggaagcccagttagggaggcctaaggaaacttaaaatcatggcagaagatgaaagggaarcaggcatgttctgcatggctggagtaggaggcaaggagcgaaggaggaggtactacccacttttaaacaaccagatctggtgagaactcactcactgtca

SEQ ID NO: 16197 - DNA, 201 bp, Homo sapiens
agtgcaagtttgttgtgaagaacacgtgccttggaattaacacctatggaagggaagaaaacgaagatggagtgggcagagggagaagctgactgagatgsagtccagcaagggtctcagtcaaccttatgaagctaaaagggcccatcagagctaatccctattgggctaatgtggccaggcttttataaacctgccttg

SEQ ID NO: 16198 - DNA, 201 bp, Homo sapiens
aattgcacaattcacacaccaggctgccactttggcccctgcgtcaccttcaccaccacccaatgtgtcctgctcatcactgaggtttgtcatttttactytgagtctgtccattgtcatcatctccaccatcaccccttttgttttcattgccacccttgcctggggtgagtgaagacgctcttctctggcttccaccct

SEQ ID NO: 16199 - DNA, 201 bp, Homo sapiens
agaagtggtggaacaaaggcactgtgtacacctttgaaacaattaacttcaccaaaattactaaactgtcctctagaatggttaaaccaatttcctctctwccattcacacgtgagaatgcctgtggccccccagaaattatctccagcagcagcaacagagaggactggaatgccattgacaggtcccacaagtcagcaa

SEQ ID NO: 16200 - DNA, 201 bp, Homo sapiens
cacgcccggctcaaatccttcttacttttcctcaagaactcacttcccacccaaacctttcctattgtggcagctgttatcttgtccagcacatgtgtccrcacttggtattaatagctccatcttaggaactatgaaagtgaggggggtggtggtaatttgcatgaactggtttgggccagttatggtctgttacatcct

SEQ ID NO: 16201 - DNA, 201 bp, Homo sapiens
tggtagtagtagtagtgaatgccctgactttggggtttgcagtaagctaggattaagtgcttcacagtgaggcacagtggggagctactctgaggatgaawtgcctagtaaataagtgaggtttgtataaccgaggccagatcttagaacctcctgctatctgtacatagaagaatgttttagtcagaggcaaggcaaggt

SEQ ID NO: 16202 - DNA, 201 bp, Homo sapiens
agacagtaagaaaggtgacgtcaatctgagatgagagagagagcaaaacagttcttttgaccaccttgaccccgaccttgaaataaggtggaactaataamtcccgctttgtgctggagcaagttttggctgagtttctgtcacttgcaaccaaatcagtcctatccagtatacctagtgactctctggtctccaaaggct

SEQ ID NO: 16203 - DNA, 201 bp, Homo sapiens
tgaatgccctgactttggggtttgcagtaagctaggattaagtgcttcacagtgaggcacagtggggagctactctgaggatgaattgcctagtaaataartgaggtttgtataaccgaggccagatcttagaacctcctgctatctgtacatagaagaatgttttagtcagaggcaaggcaaggtcaccaggattcactg

SEQ ID NO: 16204 - DNA, 201 bp, Homo sapiens
gaatgccctgactttggggtttgcagtaagctaggattaagtgcttcacagtgaggcacagtggggagctactctgaggatgaattgcctagtaaataagkgaggtttgtataaccgaggccagatcttagaacctcctgctatctgtacatagaagaatgttttagtcagaggcaaggcaaggtcaccaggattcactga

SEQ ID NO: 16205 - DNA, 201 bp, Homo sapiens
aagaatgttttagtcagaggcaaggcaaggtcaccaggattcactgagagtgttggtcagcatttcatctgcatatacaggactggaaaataagagagcgyaatgagacatctagtttttttctctttcgtttgttctgtttcccactgagagaattttctagctttatgtggagaaaacagtattggaaattattactca

SEQ ID NO: 16206 - DNA, 201 bp, Homo sapiens
gtaagaaaggtgacgtcaatctgagatgagagagagagcaaaacagttcttttgaccaccttgaccccgaccttgaaataaggtggaactaataaatcccsctttgtgctggagcaagttttggctgagtttctgtcacttgcaaccaaatcagtcctatccagtatacctagtgactctctggtctccaaaggctatgcc

SEQ ID NO: 16207 - DNA, 201 bp, Homo sapiens
attatagtgtctggcatacaataaatactttgtaatgttactggtgttttcttaccgttattgtctcactggtgaccgtttgaaatgttgaagctttattrttacagataatggtggatatagtctcttccttgtttattttttgacagaatctttttttaaaaaagtttttatttgtttggtgagaatttacttgttaca

SEQ ID NO: 16208 - DNA, 201 bp, Homo sapiens
aaagggggttaaaagggtttaggggaagtttagttgtcttccttttatctctaactctaaaacccaactgctggctgaattaaaagtctcttacataatgrtcagaggagttttgagtatcggatctttgtgtacttgctttttaaattcagtcacgtcttaaatagtacttttcactctcctcctctccacaccacttta

SEQ ID NO: 16209 - DNA, 201 bp, Homo sapiens
ctctctagaaaaaagtaagaaatatggaaagaaatctaatttagaaaaatgcacgcacccacaggcacgcttcacaggactggcaggtggagaggatgtttgttaacagggctggctattttactttaagtgctgcaaacattgcactaatgtttgggtctttgcttttggcaatcacttctcttgttaatttttttttgg

SEQ ID NO: 16210 - DNA, 201 bp, Homo sapiens
ctccttctagaactagaacataagctctctgaagtcagggaccatgcctagaatcgccttccttttatctcccatcagccgaaactaactctgctgtgtcrcgctgtgttaggctgtgttggctgtgagtaagagaagtctcacccaactagctgaagcgaggtgggttggaggggggatgccttgtggaagtgacaactc

SEQ ID NO: 16211 - DNA, 201 bp, Homo sapiens
tttgcctccttctagaactagaacataagctctctgaagtcagggaccatgcctagaatcgccttccttttatctcccatcagccgaaactaactctgctrtgtcacgctgtgttaggctgtgttggctgtgagtaagagaagtctcacccaactagctgaagcgaggtgggttggaggggggatgccttgtggaagtgac

SEQ ID NO: 16212 - DNA, 201 bp, Homo sapiens
caggcagcttctactcatggtggaaagtgaaggggagccagcatgttcagagaacatatagggagaaagggagcaagagaggggaggggaggtgccagagmctttaaaagaaccaactctctgggaacaaatagagggagaacattaatctagccatgagggatccacccccgtaacctagactcctgtcatcagccacgg

SEQ ID NO: 16213 - DNA, 201 bp, Homo sapiens
ctccgagctagagtacaatggtatgatcatagctcactacaacctccaatgcctgggtttaagtgatcctgccacctcagcctcccaagtagctaggactrcaggcgagagccaccatactgggctaatttttgttttttattgagatggggtcttcctatgttgcccagcctggtctcaaacttctggcctcaaagcaat

SEQ ID NO: 16214 - DNA, 201 bp, Homo sapiens
ttgcattgcatagttaaagttctttaaattcttctctaaaccccaaggctaagcaatatacaatctagttacaatggtctgcttgctgttaccagaatctrtcaagctctttcctatctaagggttttttccatgtactggtttctctcctgcgtggtcttgttctacccttgaggagggtaccacttcctcattgcttag

SEQ ID NO: 16215 - DNA, 201 bp, Homo sapiens
ttagttatttatctttgggactgctataatgagatccacttagatctagctataatggaattttgtttagtggttctctgatttaaacatgacttttatcyttttcagatatcgtttcattaacatcactacctctttttaaatcctaatgttgtcatggaagcctgtgtaggggctgaccttgaagtctctgaaagctga

SEQ ID NO: 16216 - DNA, 201 bp, Homo sapiens
tacaaaattagccagacatggtggtgcatgcctgtaatcccagctactcagaaggctgaggcgggagaatcatttgaacctgggaggtggaggttgtggtragctgagatcacgccattgcactccagcctgggcaacgagcgaaactctgtctcaaaaatgaatgaatgaatgaatgaatgaatgaaatactacttctcc

SEQ ID NO: 16217 - DNA, 201 bp, Homo sapiens
gaagcagtgtcacgcattttagaagaatgggtaagcgcttgactgttgttgttttttttaattgtcaaatacacatgccgggctaaccatatggagatttyagtggagtgtgtaaagtttattgctcttggaatcatgtctttatttttaaagtcatcttcactttgtttgtcttatgaatgaaagcatgagcaagtccat

SEQ ID NO: 16218 - DNA, 201 bp, Homo sapiens
atggattatccttggttgtagtgtttatgtccacatcacatgggatattttatttttcaggcctcttcatgtgcttgtgtgcaacgcagcaacttttgctstaccctggagtctcaccaaagatggcctggagaccacctttcaagtgaatcatctggggcacttctaccttgtccagctcctccaggatgttttgtgccg

SEQ ID NO: 16219 - DNA, 201 bp, Homo sapiens
ccacaggacactactgtgcatttgcctgtgatttgccattgggttggagtacttctcctgagtttctgcagtgttctaggtatggtcttaggccctggaawaagacagtgtaggaaacacagaaggtgcctgatttcctgggcctagctaaggggaaaaagcgagacaatggggtcagaggaagctcagctgaacagatga

SEQ ID NO: 16220 - DNA, 201 bp, Homo sapiens
gggtattggggatgagtctttgtgtggtggcaaacgggccctgtcttcgcttggcttcctcctaaaattcccaggacctcttcgggtcccagccctttctsttcccctgagattgcgcctcctcaccctctgtcttggatggaaagagttccaaggcagtccagtcaccccagtgaaaagttttctgatgaggtcaagcct

SEQ ID NO: 16221 - DNA, 201 bp, Homo sapiens
caagtgtgtttaatgtgaaaatagaaatggagggcttttaaaagagcttactcaaaatcctgccaattactgaaatctaccagacaagaaggagccactcyttttttttttttttttttttttttttttgatacaatgaggggaaatgtttcttccacaaaagcctggccgtttgtctttaaaaattttcatcttttgggt

SEQ ID NO: 16222 - DNA, 201 bp, Homo sapiens
cagtgcaggacagtgtgtcattgcaggagaagacagaacccggccagatcctcccgctgccggcaagcggagtcagttactgggaagccataataattctktcttctagagaattttggcaaaaatgtgcctccatcttacatcaacaatttttcatctttctggaatttttatttccccttcccctcttgttccttttta

SEQ ID NO: 16223 - DNA, 201 bp, Homo sapiens
agatatataatgatgcctatctgattctgtggtggtctggctttgatgtatgtatatgtgggcaggaatgtgtgtgcgtgtgtgtgtgcatgtgtgagctyctgtgtgtgtgttcatcacgtatccattgtgtctccaaggtcttatcaacagcaacaaaaggcctcctttgagatcaatcacattcattcgatgtttgtt

SEQ ID NO: 16224 - DNA, 201 bp, Homo sapiens
ctaatttctggggacacatattttgtcctggttagagagatatataatgatgcctatctgattctgtggtggtctggctttgatgtatgtatatgtgggcrggaatgtgtgtgcgtgtgtgtgtgcatgtgtgagctcctgtgtgtgtgttcatcacgtatccattgtgtctccaaggtcttatcaacagcaacaaaaggc

SEQ ID NO: 16225 - DNA, 201 bp, Homo sapiens
cgtctagttataggaaaatactgagatacttgtgagatgttttctttttttttttttccaacttgtatacacgttgttctataagtggttgattgtttttyaggaaaaaaaaattcagcatctcaaatgtacctttaatattgcttctgatttttgttgttttgctatcatagcgttacctacctcacagagatgttttag

SEQ ID NO: 16226 - DNA, 201 bp, Homo sapiens
acatatgaatgaggggtagagggacacaaacattcagtccctaacacttggtcaagttacttaagcttggtaagcctctctcttcttactgagtcatgagsataataagatatacctgttagggttcttttgaggaataaatggaatttttaaagaattgtgccagacatgtaataattacttgataaactatagctatta

SEQ ID NO: 16227 - DNA, 201 bp, Homo sapiens
ttttgtgacattcttagttgtgatctaccttatgttgtatacacatggtcactcacatacataggtatattattctgcaattgctgagtaattgatgatcsttcattctctctgtgattcataggctctctgggttggataaatcacttcggggaattatatctactagtatatttatgtcactagaattcctttgagaag

SEQ ID NO: 16228 - DNA, 201 bp, Homo sapiens
ttccttttatctctaactctaaaacccaactgctggctgaattaaaagtctcttacataatggtcagaggagttttgagtatcggatctttgtgtacttgytttttaaattcagtcacgtcttaaatagtacttttcactctcctcctctccacaccactttatgtgtttgctagtagcttccatgaaactctatgggtga

SEQ ID NO: 16229 - DNA, 201 bp, Homo sapiens
ctttggtaattcagtatccgaaaaacaatcagtgttttgtgacattcttagttgtgatctaccttatgttgtatacacatggtcactcacatacataggtrtattattctgcaattgctgagtaattgatgatccttcattctctctgtgattcataggctctctgggttggataaatcacttcggggaattatatctact

SEQ ID NO: 16230 - DNA, 201 bp, Homo sapiens
atcagtggttaccaggcagtgttgcattttttccatcccatacctctgtgtgtgttccttatctgtttctaggatgtgccctctgccccgtcacatcacaytctgtgctgctctcagccaaagctcttcttaaatacactagccatcaaaaccatacaacttggctgggtgcggtggctcacacctgtaatcttagcattt

SEQ ID NO: 16231 - DNA, 201 bp, Homo sapiens
atatgaaaacaggaaaacacatggagtcttggagggtagggaagtcttgatgagtaagattgggtctgagataaacctaaaagagggtcaagattttgacrgagggctggaagggaggaacgataggaaactgaccttttttcagatctcttcttgtgcgtggcctggggttaagtgctttacatgcatcccctcattgac

SEQ ID NO: 16232 - DNA, 201 bp, Homo sapiens
tttgtaagagcctttttctgggccccacttccagagggtttttcttttttttttttcttttgagacggagtcttgctctgtcgcccaggctggagtgcagyggcgcgatctcggctcactgcaacctccgcctcccgggttcacgccattctcctgcctcagcctcccgagtagctgggactacaggcgcccgccaccacg

SEQ ID NO: 16233 - DNA, 201 bp, Homo sapiens
gaggctgaggcaggagaatggcgtgaacctgggaggcggagcttgcagtgagccgagattgcgccactgcactccagcctgggcgacagagcaagactccrtctcaaaaaaaaaaaaaaaaaaaaaaaaaaagtgccatgtatattttgattacaaaaaatttcatgcggtgttactttctttttattggtagagggtctt

SEQ ID NO: 16234 - DNA, 201 bp, Homo sapiens
aacacggtgaaaccccgtctctactaaaaatacaaaaaattagccgggtgtggtggcgggcgcctgtagtcccagctactcgggaggctgaggcaggagartggcgtgaacccgggaggcggagcttgaagtgagccgagatcgcgccactgcactccagcctgggcgacagagcgagactccgtctcaagagaaaaaaaa

SEQ ID NO: 16235 - DNA, 201 bp, Homo sapiens
gaaactgttttctctggccaggagacaggcttcgttttcgaaactcacccaggaaggcagtgttcttcttttcaaaaggcatttttctgttgactgtgcaygaagccacatagtaataaacagtttccatatccaagcagctaaggcttgtgccttgcaagttaagtggaacatcacgatctatatctcagttttccttat

SEQ ID NO: 16236 - DNA, 201 bp, Homo sapiens
aaaacttaacaattgtggaagcaatgaattgaaggactagggtcaccagtggagtcccataaataggttgtttatgatccctgtgaaacaagaagaccctyttaatttcatgcttcttaaactggggtatgagtggccccaggtttccctgttgggggtactgataccagagttcatttgaagtcattggaaaccaaggca

SEQ ID NO: 16237 - DNA, 201 bp, Homo sapiens
gccacaggacactactgtgcatttgcctgtgatttgccattgggttggagtacttctcctgagtttctgcagtgttctaggtatggtcttaggccctggartaagacagtgtaggaaacacagaaggtgcctgatttcctgggcctagctaaggggaaaaagcgagacaatggggtcagaggaagctcagctgaacagatg

SEQ ID NO: 16238 - DNA, 201 bp, Homo sapiens
ccttttagaagctgaggcaggaggattgcttgaggccaagaatttgagaccagtctgggcaacataggcagaccccatctctaaaaaaaaaaaaaaaaaaattaaattagctgggcttggtggtgcacacctgtaggctgagctgctcgggaggccaagatgggagaattgcttgaggctggatgtgtgtggctatggtga

SEQ ID NO: 16239 - DNA, 201 bp, Homo sapiens
tcagttggcatgcgatatgcttctcaggcagtaatttagagactgtcaattcctgagagccgctggggaactgagcaatcgtctgcatttcgtcgctttarcccgagctgggtctttgagctggcagagaccaagatctttttctgggaagggatggtcctatttaaggaaggccctggattttgtcaagtttgaaaggtt

SEQ ID NO: 16240 - DNA, 201 bp, Homo sapiens
ggagttcattttcaaccgattcagcagtggaacacttgaagaggaggaagtcaaaattcaaaatgggttgggtgcagtggctctctcctgtaatctcagcscttttagaagctgaggcaggaggattgcttgaggccaagaatttgagaccagtctgggcaacataggcagaccccatctctaaaaaaaaaaaaaaaaaaa

SEQ ID NO: 16241 - DNA, 201 bp, Homo sapiens
aaaatatttgtatctccccacaataaaagtctgtaccaattaagcagctactacccattcctcttccctaccattctaccttctgtctcagtaggtttgcytatttgggatattttatttaagtgggatcatacaatagcatcatgtgttcaaggttgacccacattgtggcatgtatcagtacttcattcccttttatca

SEQ ID NO: 16242 - DNA, 201 bp, Homo sapiens
atattgcttctgatttttgttgttttgctatcatagcgttacctacctcacagagatgttttaggtcataagtatttttcatttaattttttttccccttmatttcctttttttccctcctaagctataaatatacagccttaaaaaaaacactcagaaatttaagtccaagaagcctgcttttcttgatacctttcaagt

SEQ ID NO: 16243 - DNA, 201 bp, Homo sapiens
aaattcagcatctcaaatgtacctttaatattgcttctgatttttgttgttttgctatcatagcgttacctacctcacagagatgttttaggtcataagtrtttttcatttaattttttttccccttaatttcctttttttccctcctaagctataaatatacagccttaaaaaaaacactcagaaatttaagtccaagaa

SEQ ID NO: 16244 - DNA, 201 bp, Homo sapiens
atggattatccttggttgtagtgtttatgtccacatcacgtggattcccgaaggagcatggattatccttggttgtagtgtttatgtccacatcacatggratattttatttttcaggcctcttcatgtgcttgtgtgcaacgcagcaacttttgctctaccctggagtctcaccaaagatggcctggagaccacctttca

SEQ ID NO: 16245 - DNA, 201 bp, Homo sapiens
gaggagagtcaaatgggagtttctaccgatgctcttgaaaggatcttgttactcagatgtctctaagacaatgatcagtacccatctctcagagcctgtgyagccgtccatgcttgaggcatgagatgctgaagataaaggtccccagtggtccaggtttttccttctcagcttggaaagcagcaggaaaactgcactgca

SEQ ID NO: 16246 - DNA, 201 bp, Homo sapiens
catggtgggaatctagaagacggagaaagaatttctcattcccgaaggagcatggattatccttggttgtagtgtttatgtccacatcacgtggattcccraaggagcatggattatccttggttgtagtgtttatgtccacatcacatgggatattttatttttcaggcctcttcatgtgcttgtgtgcaacgcagcaac

SEQ ID NO: 16247 - DNA, 201 bp, Homo sapiens
gaagctgaggcaggagaatcacttgaactcagaaggccaaggttgtagtaagctgagattgcaccactgcactgcagccttggcaacagagcgagactccmtctcaaatcaatcaaccagtcaatgtgtgcccccttttcctccaactcccaccccaaatccttgctgaatcatacctatccttcacctttataagcatct

SEQ ID NO: 16248 - DNA, 201 bp, Homo sapiens
tggagtacagtggcgcgatctgagctcactgcaacctctgcctcccaggttcaagcaattctcctgcctcagcctcccaatagctgggattacaggtgcaygctaccatgcccggctgatttttgtatttttagtagaggtggggttttgctgtattggccaggccagtctcaaactcctgacctcaagaaatccgcccac

SEQ ID NO: 16249 - DNA, 201 bp, Homo sapiens
tcctaataagcctctcatcctcagcaacggaggacagttgcccactcaaagccttgtgacattctagggtatcctatttctacatggtgggaatctagaaracggagaaagaatttctcattcccgaaggagcatggattatccttggttgtagtgtttatgtccacatcacgtggattcccgaaggagcatggattatcc

SEQ ID NO: 16250 - DNA, 201 bp, Homo sapiens
ctgagtttcttgtggaagtgggcttgtgttttgcttttgtagactgacactgagaatagcatccaaacatctttttcccaccaaggcatcaaactccatcrttaggaattccttcatagaatcaaagaatcagaaagagctgaaacatagaccacggacactcaaattgtttatcctgaaatgaatgggaaaacctaagct

SEQ ID NO: 16251 - DNA, 201 bp, Homo sapiens
aacacacacaagccactgttagattttacaaaactttaaaaagtaattatcttaaagatatctaagatagtgatctggttacatagattatcagagatacttttttttttgattatcagagatacttttaaaaaagcaactacaaggtaaggattatccgttaatttagtgtttttctattaaactcaatttgctttaaag

SEQ ID NO: 16252 - DNA, 201 bp, Homo sapiens
tttatgcatttagagctcccctcttgtgtttcagaaaggaggagttgttgttttcttttcacttgagtttaataaatgaaaaaggggaagggagagggaargaagaggaaaaagcacaaatgtgcttgtttttggatcagcccctgtactgggcacatggatgcagtcagtcctcagtgtaccccaggaaagaggaaactg

SEQ ID NO: 16253 - DNA, 201 bp, Homo sapiens
cccaacctctgctttggaaggcctaactcagttaaacattacaagttcatgcagcacggtgtgatggctcacgcctgtgatcctagcacttttggaggctyatgtgggtggatcgcttgagctgaggagtttgagactgggcaacatggtgaagccgtgtttctacaaaaaatacaaaaaaaaaaaaaaattagccaggcg

SEQ ID NO: 16254 - DNA, 201 bp, Homo sapiens
gagggggacatttgggaatggcatttttagtactcacaaggtaactggggcactcttggtcttggggaggggaggtggctggggacgcagagggtcctgcrgtgggtggatacttacaacatagaaatgtcctggctcttgatgctggctacaccctcagtaagagatactgtcctagggtcatttttttcaacccacact

SEQ ID NO: 16255 - DNA, 201 bp, Homo sapiens
ggactgtcttagtcagtccaggctgctataacagaataccgttgactgggtggcttgatttttttttttttctcccagttctggaggctggaagtcagatrtcagggcaccagcatggttggtttctggtgagtgctcttttctgcatttgtggacagctgccttcttgctgtgtcctcacttagtagacagagagagaga

SEQ ID NO: 16256 - DNA, 201 bp, Homo sapiens
gcaacagagtgagatgctgttttgtttttgtttttttttgtttgtttgtttggttttttttggaaaaagaaagaatcaccataaaaaagatgggtaactcrgaaatttcaaatgcttgaatttcttgggttgggaagaatatcccaaaatgtgtttccaactacctcactgattttgacttcacagggagaatattttgat

SEQ ID NO: 16257 - DNA, 201 bp, Homo sapiens
ccaacacccgacaggcatcttagaaagtggagggtgtaagttataaagagagattacttccaacacgtttctttaaagcctgctggctaaattaggtgggrccttctttgtgtcctctctgttcttgctagtctggcctttgtataatagggaagcagatatatctggaagcctctaagtgtgcatcatggaaattgtttg

SEQ ID NO: 16258 - DNA, 201 bp, Homo sapiens
acccgacaggcatcttagaaagtggagggtgtaagttataaagagagattacttccaacacgtttctttaaagcctgctggctaaattaggtgggaccttmtttgtgtcctctctgttcttgctagtctggcctttgtataatagggaagcagatatatctggaagcctctaagtgtgcatcatggaaattgtttgaaatg

SEQ ID NO: 16259 - DNA, 201 bp, Homo sapiens
ctacctgtggtcccagctgcttgggaggttgaggcaggaggattgcctgagcctggtagaggtggaggctgcagtgagctgtgattgtgccactgcacttyagcctgggtgacaaagtgagactctgtctcaaaaaaaaaaaaaaaaaaaaaaaaaaaagctagtagcacaccccaaaacttctagacagggcatggtgtg

SEQ ID NO: 16260 - DNA, 201 bp, Homo sapiens
gtgacaaagtgagactctgtctcaaaaaaaaaaaaaaaaaaaaaaaaaaaagctagtagcacaccccaaaacttctagacagggcatggtgtgagctggartagacaactagttcatggtaacaggaccagcagagctccgtcttgatgctgttattatttggtatctgttaggagctgaattatgtgtccccaaaattca

SEQ ID NO: 16261 - DNA, 201 bp, Homo sapiens
tatttggtatctgttaggagctgaattatgtgtccccaaaattcatgtgatgaagccctaattcacagtacctcataatgttactctatttggagatacarccttttaaaggatggttaagttaaaatgaggttgcttggatggtccctaattcagtttaatttgggtccttataaaaagaggaaatttggatgcacagag

SEQ ID NO: 16262 - DNA, 201 bp, Homo sapiens
cctccggagaagccaaacctgctgacaccttgaccttgaatgtgcagccttcagaactgtgagaaaatcaatttctgttgtttaagccacctagtctgtcrcattttcttatggcaacccctgtagataatacagtcccattctctggggaaacagatacctccgccagggtcctgatctgaatatgatttggggtgatgg

SEQ ID NO: 16263 - DNA, 201 bp, Homo sapiens
caacgctttgggaggctgaagcaggaggatcacttgagcctaggagttcgagacctgggcaacatggtgagacccccatctctacaaacaacaacaacaamaaaaaaaattagccaggcgtgggggtgcatgcctgtgctcccagccactcaggaggctgaggtgggaggatggctcgagcccaggaggccaaggctgcag

SEQ ID NO: 16264 - DNA, 201 bp, Homo sapiens
tcattttgggcttctgatacactcctgtccgagaagttacctttgaaaatgtgtactattttattgtcaattatgttttctttaaaaaaaatttatgacakattacttttgctaattatgtgtgtgggtagattatgttattcatgaattttatttcaggaccttggtaaggggttatacaatatttcttttgaaacgagg

SEQ ID NO: 16265 - DNA, 201 bp, Homo sapiens
cagggacagcaaaagcacacacaatgatggccagagacactgctcagtgtactgtcttccaccgggacagcccactcaccaagggttaggtcctgtgctgmctgggtcccgggtctcctcggaggtcggtttgcatcacgtggatacactaatctacccaagttgacttggagaaccaatctgaaatcagatgggagctcc

SEQ ID NO: 16266 - DNA, 201 bp, Homo sapiens
aagactttagtcttttcaagaggcaaagtaatataccacttttcgcttttttaatggtgagagccaaggtcaatctgaatttttctttttctttcttcctttttttttttttttttttttttaaaaaaaaaaaggtgcttgaattagaaaggtagcacattgtccacatggacagtgcaggatggggctggctttttcatt

SEQ ID NO: 16267 - DNA, 201 bp, Homo sapiens
atctgccagcaggctgtgctggggagtggtgagtagtacagggatgtgtctgaccccaggagaactgccccgatccctatcttgtctctgctcagttctgrtaactcttttatcttccctggagttatttttttcccttctttctttctctttttctgtgtgctcttctaagagtaaaacgcatgtccccccatgaagtca

SEQ ID NO: 16268 - DNA, 201 bp, Homo sapiens
tgtggcacatacccctgtacatgtttgccaagactgctatatggtagagcttggaattcttaggagctttatcaggtaattgcaagtcccccacctccaasaaagcactctctaggtcaagaatcagcaaatgttttctatagaggcccgtaaaattaatattttatactttgtgggtcatatagtctctgtttcaattac

SEQ ID NO: 16269 - DNA, 201 bp, Homo sapiens
ttgatcttggacttcccagcttccagaaccatgagcaataaatttctttttttcaaagctccccaggagtctctctcggtctgttctggctcaggaagctkccttatttgtaacaaacaaataaacaaaaaacaaaataaataaaagctacccagcttagattattttgtcataaaagccccaaaagactatgacaaatcc

SEQ ID NO: 16270 - DNA, 201 bp, Homo sapiens
aagttagtttcttcccagagagaaagaccggtggctgtagtctgtgccccactcccagcctgtcctttctcagccgtggcttgtgtgcatccctggggccrgcatgttgctgcgagccccaatcgatcagtggagaaacgagctctggtgggcagtcaggcaaagcagatacacgtgcttcttttcagctttgttggaagg

SEQ ID NO: 16271 - DNA, 201 bp, Homo sapiens
aagaagaatatccatgaatctatgaggaggcgggactctggccagacattgaatttgctgcttccttgatcttggacttcccagcttccagaaccatgagmaataaatttctttttttcaaagctccccaggagtctctctcggtctgttctggctcaggaagctgccttatttgtaacaaacaaataaacaaaaaacaaa

SEQ ID NO: 16272 - DNA, 201 bp, Homo sapiens
ttcactgagggactaagagaaatagaaacagaggggattggccacacctgaagtcattctgtgttcaaatcttggctctaccacctatgatctgggagctsttagaggagttaatcgatgtagttaagactcaatttcttagtatatacaataggtgtaatagtaaaaattagatgactttgatgtgtgtaggtaagcggc

SEQ ID NO: 16273 - DNA, 201 bp, Homo sapiens
catagctcactgcagcctccaacttctgggctcaagtgatcctcccacctcagcctcttgagtaactgggactgcaggtgcatggcactgtgctccacaattttttttttttttttagagatgggatctcactgtgttgtccaggctggtctcaaacccttgggtttaagtgatcctcttgcctcagcttcccaatgtgct

SEQ ID NO: 16274 - DNA, 201 bp, Homo sapiens
agaagaggatgtagggcaggtagggctcagaaggacccatgccatatagcaaagttcttagtaacacaggctttgggttacagcaggctagattcaaatcytgctgtggtcagaatgtctgtgtcaccccagcattcatttgttaggagatggggtcttttgggagatgatttggacatgaagacagagcctgcataattg

SEQ ID NO: 16275 - DNA, 201 bp, Homo sapiens
gagttcaagacctcctcatctctacaaaaaataaaatatttgaaaaaaaaaagtgaaatttttgatatagaagaggatgtagggcaggtagggctcagaargacccatgccatatagcaaagttcttagtaacacaggctttgggttacagcaggctagattcaaatcctgctgtggtcagaatgtctgtgtcaccccagc

SEQ ID NO: 16276 - DNA, 201 bp, Homo sapiens
ttttttttttttgccaagcaccctgcctttttgcttgtctgtttcgtctttatctctccttccagtaaagttcttggcccagaggttctgctgccactcartgacatttgtgaaatgcaagggagcttgcaccatgggttcaagctcctgcagatccctgagcctgctacccttgtgcttctctgtccacgcaaagccaag

SEQ ID NO: 16277 - DNA, 201 bp, Homo sapiens
tttagtaaaacgcagtatcttcttccccagctgaaatagcgaaagggtctcttcaggctcctgggataaaaaccaggatccttcatgtgtctgagcaggcytcccaccatttgactgctgctcctttgtccagacacatttaacaccatctccctgcaccccttcactgggctccgaagctgcgttcacacggcacgtcat

SEQ ID NO: 16278 - DNA, 201 bp, Homo sapiens
tctagaataagtccgtctcacgttacagtgcttaggaagtgttagatgtactgtcatttcttcaacatatatgtcctatattagtctattctcacactgcwagtgaagacatacctgagatggggtaatttgtaaaagaaagaagtttaacggactcatagttgcacatggctggggaggccacacgatcatggcggaagg

SEQ ID NO: 16279 - DNA, 201 bp, Homo sapiens
tttaatttttgtgggtacctagtaggtgtgtatgtacatatatatgtatatatatatgtggttttttcaaaaaaattgtgggcacttagtaggtatatatttttgtggtctgtgtttcttataaattggtgatcccccaggggatgcctgccttgttggtccaggtaacacacttggagtagcaaacatctagacgtagtt

SEQ ID NO: 16280 - DNA, 201 bp, Homo sapiens
cacggcacgtcattggcagctcatctcagaaggttccagctttgcctggcaaattctcctccttcctttagatcccatctctggtagacagagtaatgagycccgaagatgtccaggccctactcctaattccatggaacctataaatatgggaggttacatggcagatggggaattaaggttgcagatggagttaaggtt

SEQ ID NO: 16281 - DNA, 201 bp, Homo sapiens
ttagatcccatctctggtagacagagtaatgagccccgaagatgtccaggccctactcctaattccatggaacctataaatatgggaggttacatggcagwtggggaattaaggttgcagatggagttaaggttgctattcactcatcttcagattgaaagatcatcctggattatctgggtaggcccagtcgaatcagag

SEQ ID NO: 16282 - DNA, 201 bp, Homo sapiens
tacagatacacactcacatatatatttctgtttgcggctcacacagacataaatatatatatatatatacaaacgtacatttctgcttgtagcttgcacayatatatatacacacacacacatacatgtagacacacacatttatacatatacatgtcaacacatacacatacatatttctgcttatggctcaggatactt

SEQ ID NO: 16283 - DNA, 201 bp, Homo sapiens
cactcacatatatatttctgtttgcggctcacacagacataaatatatatatatatatacaaacgtacatttctgcttgtagcttgcacatatatatatayacacacacacatacatgtagacacacacatttatacatatacatgtcaacacatacacatacatatttctgcttatggctcaggatacttctttttttgg

SEQ ID NO: 16284 - DNA, 201 bp, Homo sapiens
tcttacacagtttgtaagtcttaaaactcagtatctactctagtagttgctccaaatgtgatgtcctcataaatcaccgagggatcttgttaaatttggaytctgattcagtaggtctaggtggggcccgagcttctttgtttccttttcttatttaatttttgtgggtacctagtaggtgtgtatgtacatatatatgta

SEQ ID NO: 16285 - DNA, 201 bp, Homo sapiens
gttacatggcagatggggaattaaggttgcagatggagttaaggttgctattcactcatcttcagattgaaagatcatcctggattatctgggtaggcccmgtcgaatcagagatggggaaaagagaggcagatgggtcataatcagagaggtggctgagtaaagaggacttggcctgatgttaccagctttaaagaggga

SEQ ID NO: 16286 - DNA, 201 bp, Homo sapiens
cacatatcccacatccaggtgccagtcagggagctgcgatttaatttgctgctgaatgcacttttgaataaagggcctagaagatgcagtctcgaggaacsgaggccggttagagacaggctggcagctttgcctcctctcccaagacaaaggcctccccgcccccctaaatccagcacacaatcagctgctctccctccc

SEQ ID NO: 16287 - DNA, 201 bp, Homo sapiens
tgccccttatacattaaggtgcatgcaataaatcacttatgtaataaactactctatattatgtgggaaaaaaaaaaggagctggtggcagggggagagayttcaaattgagccagacctcaggcatgaagggaggggagagagggggaaatgtggaggaagggggcgtttgtgcagtgggaagttggagaaagtacaaat

SEQ ID NO: 16288 - DNA, 201 bp, Homo sapiens
tggaaagttactctctaagtcagggcttcttttcttcaactttggtgtgagactccgctggagagctggttagaaaaacacaagtctcgggccccaccccscagagcccctcattctctagttctgggttggggcccaggagtctgcttttctagcaagcgcccagatgtcactgatgcttacagctctcagaccacagtt

SEQ ID NO: 16289 - DNA, 201 bp, Homo sapiens
tccatgctccaaatgactgtgacgactgagaaaatgcatgtatgtaaagtctgcagctggtgacattgtagacactcagcaaatggcctttggtgttactrttattttatttttactaattattttttacacctacaaatcaggatctgctacaatcgcttgatatttgaaaattgggcctaacccactatgccactcttc

SEQ ID NO: 16290 - DNA, 201 bp, Homo sapiens
agtggggcactcgattccggcaagagaaggcaaacaaaagaagccacaacagtctaggaagaaatctttaatttctattcagctttaaagagtttgagagmgttttttcccctctgttaacaaacgagttcaagtacatgccttcatattataaaagtacctgaaattgcctagaatagcagcatgcatagcttgttagta

SEQ ID NO: 16291 - DNA, 201 bp, Homo sapiens
gtctgcgtggttcttacctagaaactgtttattggtgaaccaaatattttgtatcttataccaagaaagaggggctgacaaagattgagtgattagaaatycaagtgaatttctatttattattttgacttggtaatttgtaataacaatagccaccatctatctatacttcctagatttgggcatggtgttaggagtctt

SEQ ID NO: 16292 - DNA, 201 bp, Homo sapiens
ttaaggtgcatgcaataaatcacttatgtaataaactactctatattatgtgggaaaaaaaaaaggagctggtggcagggggagagacttcaaattgagcyagacctcaggcatgaagggaggggagagagggggaaatgtggaggaagggggcgtttgtgcagtgggaagttggagaaagtacaaatgaaagcctctctg

SEQ ID NO: 16293 - DNA, 201 bp, Homo sapiens
aaggcagagggtgtcacttccactgcatctttggggaaggcagtcaccactgtatagtcctgagctcactgggattaaggggaagggacacagactccacytctcgatgagaggagaagcgaattgatgggcagattttatcactgtcctggggcctttgctctttgcccttccctttgccaagaaagttccctgtactct

SEQ ID NO: 16294 - DNA, 201 bp, Homo sapiens
cctggggcctttgctctttgcccttccctttgccaagaaagttccctgtactctgcaatgctgagtacttctcatccttcaggtctactgcaagtgtcacytggccaacacaccatgccttcccagtctctggtgttactgtctgcatactgtagaccatcatcttgtttgcatacttgtctgttatctctttatcatccg

SEQ ID NO: 16295 - DNA, 201 bp, Homo sapiens
ctggccaacacaccatgccttcccagtctctggtgttactgtctgcatactgtagaccatcatcttgtttgcatacttgtctgttatctctttatcatccktctacccacatcaggcaattccaagagagaagaccactggttttgtttgatctagtccctgttgagtccctgtgcaccttcagaaccacatctagcaata

SEQ ID NO: 16296 - DNA, 201 bp, Homo sapiens
tattcacagttgccgcccacactcaagagaggggattctataggaaatggaagtcttgggggccatcttgaatcctgactaccatagtctgtgaaatcccyatttcacagatgttgaaactgagacttagaagcattatgcaccatgccaaaggccatggaaggacagagcttgggcatgctcccgacaccaggtcatact

SEQ ID NO: 16297 - DNA, 201 bp, Homo sapiens
ccatagtctgtgaaatccccatttcacagatgttgaaactgagacttagaagcattatgcaccatgccaaaggccatggaaggacagagcttgggcatgcycccgacaccaggtcatactgatgtcactctccctactcccttcactccctccagcacctggccttcacctgaaggtgctgaccttgctgtttgttggttt

SEQ ID NO: 16298 - DNA, 201 bp, Homo sapiens
gttttgtttgtaagaatcagttgaggacagatgggactatttgcatggattggtgtcatgtttgaagtcagttaccagagggtttctttcaacagagtatmccaaaaaaaaaaaaaaaaaaaaaaaaaaaaaagtaaattgcacagaccccagcttaggacctggacttaatcttcatgatgtttgtaaagtaatacttct

SEQ ID NO: 16299 - DNA, 201 bp, Homo sapiens
agagaataaaacgttagttaatccctttgtctgtcaatcacagtctcagttctcttgctttcacattgtacttaaacctcctgctgtgcctcgcatcctaygcttaataaaagaacatgcttgaatatcatcacctgaagtttgtattgtttctttaaatgtttgtttcagtttgtttttgtttttcattttttagaaaag

SEQ ID NO: 16300 - DNA, 201 bp, Homo sapiens; identical to SEQ ID NO: 3301

SEQ ID NO: 16301 - DNA, 201 bp, Homo sapiens
cagtaccctttgctatgccaagatccagctgaaactgaaccaggtgggggaggcctgctaatgcccaggcagtcgaaatgacgccatctcatcactccttytcttaaaatttttttttgtctttcttcttggatttccagcaacagggagctgccaccaccgtgtactgtgctgctgtcccagaactggagggtctgggag

SEQ ID NO: 16302 - DNA, 201 bp, Homo sapiens
atgttataggcagttctgaaggaaaggattcgatgactatctttttttggcacaaatgtgatccttctggaggccagaagatagattcagtgggccccagwtctttcaggtttaaggaataagcattttggtctatgaaaaatggggttttcctaaagtataagattgtcttatatttataaatgcctgtgttcattgctg

SEQ ID NO: 16303 - DNA, 201 bp, Homo sapiens
gggttttctacctgatggaccacaattaagagtggttggtttgtcagacagaaggttctacaaacgatttggtatcgaattacattatacatggagaagtygaggggttggatgaatttgttcttgcacgttcagaaggataccatctttttctctgtgtggaagaggcgcctgccacgacgtattgatatgtgtatttat

SEQ ID NO: 16304 - DNA, 201 bp, Homo sapiens
agcaaagtgatttcttgccctctttatagcatccctgacagtattctgtcagtttggatgatatgatgcctcatcactgcacacgtccctagccacagccscaactgttactcaaaaggtgaatgaaagtgatcagctgcactctttgcaacttacattttgaagtgggctgggaggaaatgtacccccttacctgtggtc

SEQ ID NO: 16305 - DNA, 201 bp, Homo sapiens
accttgtatgcacacatgagaatttagagatctatatataccgcctggcctcttctttgtaagggtataacagcagtggttaacatgcattttttttttttaacagttagatttactcttcctttgcacagactaatagcacactgaggtaggatccagggacggctccttggcaagttgtactgctgtggcctagggagg

SEQ ID NO: 16306 - DNA, 201 bp, Homo sapiens
gttactaaactgtcatcacatctgatcatattaagatgtcactcagaggttgccattggtacggctgaaaattctccaagagaccaaaggtgtggtgtgtrtgggaccaacaagatattgttactgcttaattgtccagcaagggaggaaagtagagtgagtacccatgagcaccaagcatgaatctgagaaggagaattt

SEQ ID NO: 16307 - DNA, 201 bp, Homo sapiens
aacaacaaaaaatgtattgccaaaaaattgctagcagacatctagaaaaatgtcttcaacttcttttggtaggaaaagaggaaaaattcaaatctgaattyaacatatttatttttttgtttctgactttttacgtaaacagagctctgagttgtatcctcagatatatttgagactaacaacaaggaaatataaaattat

SEQ ID NO: 16308 - DNA, 201 bp, Homo sapiens
ttttataacggagttgttaacattatttcctttagatggctccttcatcttttctgcattatgaactgatgccccaaaaggtggtatgaatgaaagtcatstgatggtgattaaagtgctctttaaatttttttttttaatcagtttaagaatgctttctcttttattggcagtacctgcttgtttactattgagatttca

SEQ ID NO: 16309 - DNA, 201 bp, Homo sapiens
caaattttcaaaggaagaaatggaatggtgcaaccatggtacatgggaaggaggagggggacacacaagactgtacctatcatgggggcttcgacctcatstgggaaggtggttggagagagtgagtcctgacctgagctttggaacttatcaagttgagagagaaatttgataatttgtctattaacgtgtgaccttggg

SEQ ID NO: 16310 - DNA, 201 bp, Homo sapiens
atttatcacaatggatcagtaagcattgatgacaactggcaaggtattgcttcagatattttataacggagttgttaacattatttcctttagatggctcyttcatcttttctgcattatgaactgatgccccaaaaggtggtatgaatgaaagtcatctgatggtgattaaagtgctctttaaatttttttttttaatca

SEQ ID NO: 16311 - DNA, 201 bp, Homo sapiens
caagtcattgaccttctctgaacctcagtatcctaggacttcagaagcgaaaggaagaataatgggtcttgagtatgcctagaattgagcaagctgctatscttgcaaaggccttggccagctgctcacccaccatgtccctctgttcccactccaccttactcatgcctagacttcttgctttttaaaaataatccaccc

SEQ ID NO: 16312 - DNA, 201 bp, Homo sapiens
gttttgttttgttttgcttgttgagcaagggaatgcggttcccctgtgtcggacttgtttcagaaagacaatgtcactgaggctggggcagggagattagstgagaggctcttgcagttatctgggaaggagctgtccataaaggcctgagttaagacagtagccctttgggttcgatttagtggtggctccccaaaagat

SEQ ID NO: 16313 - DNA, 201 bp, Homo sapiens
tgtggactgtagtttgctgacatccaggctagatccttaatatacaatgaagtagtaaaacacatgtaaaagtaaaaagcaggcgaaatagaataaaatasacatttgcacaccacagtatccaaaaaggttatgtactggggctaaagatttggcttggagtttcctggtagtcaaggcaaaaaagggaaacaaaactag

SEQ ID NO: 16314 - DNA, 201 bp, Homo sapiens
atagccttaaagtttctcctgctctttgcagatgaatgaaggggcgctttctggaatctttgtggctggggctgctgctctgcactgctgtggctcttttycacaaatgcttatggagctctaactgggggcaaggaactgtgctacggttgggaagagaggagtgggcaaaaggagacactggggcttctgtgactttag

SEQ ID NO: 16315 - DNA, 201 bp, Homo sapiens
aaatcagccatcagccttattagagtggttgattttttttttaatctaagagctttcttggttattttctgttcttaatcattgttgtatatccttaatgygcaggacatgacaccgtataacaagtgttttaaaaatatttacaattctgatcttataaaggaaaaagttacatatggtcctttgaactaattgctaaaa

SEQ ID NO: 16316 - DNA, 201 bp, Homo sapiens
ccatctcattgtctttatagtttaaccctttgaagttgtgactgccaacgtgctagtcttgtcgtcttacacgttaatggtaatgatctttttagatttaytgtgaacctctaggaatgttttttttaaccagtaaatgcactgaaacatggaatcaaagtctctttcccgtgggccccttttcattgggaataaatgcta

SEQ ID NO: 16317 - DNA, 201 bp, Homo sapiens
gaatgactgtgttaggaatcattggaggagagggagtcagagggatggatcagtattttctctgcaaacctgatgaaacactccagagcccgcacctacaygcgtgggaactgataagatgggggttgtgtccacttcacttgtatgggatgtcggtgctttgaaaaaattctatcatcaaagagtaggtttcttagttct

SEQ ID NO: 16318 - DNA, 201 bp, Homo sapiens
actcatgtcttttgtcagggagaatggcatggcctttgtatgacacttccttctagccagactcggatttgggggcatcatatttgggatggctgcaccgyaaacaggaaaggccacaggacagctcacaggttctctctgaacagaagcctgtgagcacgtgcctgtcatttaaaagctgcatggcactcttccccctgc

SEQ ID NO: 16319 - DNA, 201 bp, Homo sapiens
gaattctttccagctttccatcctgaacctgctggtctccaggctcgttcctgcaaatatttcacagaggagtaagagccacattcttgctggctttccarttcattctcctctcttcgagtccacctcttaaaacttcttagtgctcttgcaagaaactcatgtcttttgtcagggagaatggcatggcctttgtatgac

SEQ ID NO: 16320 - DNA, 201 bp, Homo sapiens
tgcatgatagaatgcaaactttgaaaaagacatacctttgtaactttctatgctaaggtgttgcataatcaaggttaatttttgtttgtttctagtctatkggcatcaagtgctttaaaatgctcactaacaccgaggcagaattatttacccgggcaattaaagcaacagcacacacgatcatttcctactaactagcaa

SEQ ID NO: 16321 - DNA, 201 bp, Homo sapiens
ggaagagaaaggcagcctaattgtatttcctaaaatacagtagatgagtagtcagcacatgcatatttagataatatttgcatgatagaatgcaaactttraaaaagacatacctttgtaactttctatgctaaggtgttgcataatcaaggttaatttttgtttgtttctagtctatgggcatcaagtgctttaaaatgc

SEQ ID NO: 16322 - DNA, 201 bp, Homo sapiens
aaaggcattaatctttttggtatccaacatcttgaatgcttctgtgtcattttcctttctttttttttttcaaagcacttaattatttaaaaacaaaaatmcttctctgatcagagcatacctgccgtgctcaaagcacttgcttacttggaatgccataaattacatgaaggaattattcattgtatcacgaaacatacc

SEQ ID NO: 16323 - DNA, 201 bp, Homo sapiens
ttgacaatgtaatttgtcagaggaaggcagcctgttttataagctcaggtgatttcatttttgttcacctgtttatttcatgacacttgcaggaaaaagargaattttcatttgatcaaatcatttccatgatccatcaaacacacaagttaaaaagggaaatgctctcagtctttaataacagtcttaatcgtgtgtaga

SEQ ID NO: 16324 - DNA, 201 bp, Homo sapiens
atgagcagttgggagagtgcaggatccagttcaaaaggatctgtccccccgtgaaccccaggacagggtgagaggccacctgcacactttttttttgtcasctcacaccctgttggccctttgcaaatatttgtctttcctcatgcacgtggttattcccagaaagatccagtgaattgtctcctgaagataaaatacata

SEQ ID NO: 16325 - DNA, 201 bp, Homo sapiens
ccttccaagaaccacatgaaggttatattattatgtcgactttccagatgaggagactgaggctcagtggcttgtcataggtgtcaaagacaggagtccartgtaaggacttctggcttcagcacaggggattttcctaccatcccatattgccaccccatctgcaaaaatacctggatctatcttcctcctgctgattct

SEQ ID NO: 16326 - DNA, 201 bp, Homo sapiens
tgaaccccaggacagggtgagaggccacctgcacactttttttttgtcagctcacaccctgttggccctttgcaaatatttgtctttcctcatgcacgtgkttattcccagaaagatccagtgaattgtctcctgaagataaaatacataaaagggcgtttcaaagtataaacagtgattttaatgaaaaataagaagaaa

SEQ ID NO: 16327 - DNA, 201 bp, Homo sapiens
cccaggaaatggccaaatgttatcactcatccttccaagaaccacatgaaggttatattattatgtcgactttccagatgaggagactgaggctcagtggyttgtcataggtgtcaaagacaggagtccagtgtaaggacttctggcttcagcacaggggattttcctaccatcccatattgccaccccatctgcaaaaat

SEQ ID NO: 16328 - DNA, 201 bp, Homo sapiens
tttgagttattattttcccatgggcaattaaagccctggcctccactgcagttttcacatcaaacctaagagtctcaggtgccccttggtggagcaacctmactagagacattaatcatactacgggataattgacaaatgcattgtgagtgtctgatttctgtggctcaggatgcttagtagcagtggggtcaagggcac

SEQ ID NO: 16329 - DNA, 201 bp, Homo sapiens
tgttaagatatttaacgggtgtttcattttcccagcaatgctataggacacagaaaggaacataaattgttacagagagaaagagggtaggtctgtgaatrgaattgaacaggtaggttgaacaagataaatgccgaggaagcaagtgtatttaaataaacagtagtttatggaaggctttggaaatccactatattaatc

SEQ ID NO: 16330 - DNA, 201 bp, Homo sapiens
ttttttgtcagctcacaccctgttggccctttgcaaatatttgtctttcctcatgcacgtggttattcccagaaagatccagtgaattgtctcctgaagawaaaatacataaaagggcgtttcaaagtataaacagtgattttaatgaaaaataagaagaaaatgcttatgatacaacattaggtggaaaacgaaggaaga

SEQ ID NO: 16331 - DNA, 201 bp, Homo sapiens
aacatggataaactgaacttgatttcctgcattaaaaaaaattaaagaaatgaaagttctgactgttttattgtagctggggaattctttttgcaggtgaygctcatgttacggttttgaacccaggactttgcgttgcagttttgttcaggggttgcagaataccgatctgactttgcaggaatgactgtcttggtgcat

SEQ ID NO: 16332 - DNA, 201 bp, Homo sapiens
aggcccaagcgatcctcctgcctcagcctcatgagcagctgggaccacaggatgcaccaccatggccagataattgttttgcatctttggtagagacaagscttcactatgttgcccaggctggtctcgaactcctgagctcaggtgatctacctaccttggccccacaaagtgctgggcttacaggtatcagccactggg

SEQ ID NO: 16333 - DNA, 201 bp, Homo sapiens
cttggtaatgtagattttggaggacttgaaaggttcctgctacctttggctggggatggagggaacatggaagatgggtctttgtttagaggaagctcttyatcctggtacgctggaagttggcatagtcttagcagttagtccagatgtgaatttcaggattattctgtgagtcttccaagtcctgtctcagcagtgaaa

SEQ ID NO: 16334 - DNA, 201 bp, Homo sapiens
agaaatggggcttctaaaataagtggaactgggacctcttctctctcaggctgttacttgttgtggttccagcctattttctgagctgtggagcagggagrgatctcacaggaaacttggtaatgtagattttggaggacttgaaaggttcctgctacctttggctggggatggagggaacatggaagatgggtctttgtt

SEQ ID NO: 16335 - DNA, 201 bp, Homo sapiens
agaggcatggctcccctgttatgtatttgggacttactgcagatgcttcctctggttcagggtgttgaggcttcgtgctgttaatattggaaggtgggtcrtttgtactgggcatctgtcctgtatcttggagatgtttagtaacatccctgacctctagccattagataccatctctcccagtagggataataaaaacat

SEQ ID NO: 16336 - DNA, 201 bp, Homo sapiens
agctactcgggaggctgaggcaggagaatcgcttgaacctgggaggcggaggttgatgtaagccgagattgcgccactgtactccagcctgagtgagagasagactgtctcaaaaaaagagaaaagtaaagaaaagaaaagagtaagattaaaaacaagtaaagaaaataaatcctcccgctttttttgctccttcatggg

SEQ ID NO: 16337 - DNA, 201 bp, Homo sapiens
gagcatctttcaattccttgaacttcagtctcctcatctctgaaatggggttattatctacctgcagaggtgctgcagtattaactgaggcaacgttgcamcgtttctagaatgatatttagggctcatattgacccagtaggaagtatagttaccttgggccaggggagctacctgagtggagtcaacttttaggttata

SEQ ID NO: 16338 - DNA, 201 bp, Homo sapiens
tgcgtcactgtttttcttatttggagatgctgttcctctcaagtgggaaaaatttggttatctcaggtggtaaagatgcctttgtttaaaatattcttctsttagtggggacaataatactactaatttctagtactgacgcttctcatgcaatttaatcagtaggaacctgtttgcatgttcatttgaggaagtaccaaa

SEQ ID NO: 16339 - DNA, 201 bp, Homo sapiens
tgttgtaggttgggtaccccaggaagtagattctgcaactgagattggcatgtaggaagattactggggagtgttctaggatccacacctgtaggggaacrtagcaagcaggatggggtggagggaggattgagctgtgctgtgggagatgcgaatgctccagtcaatcccaaggaaactctgaagctggattattcttca

SEQ ID NO: 16340 - DNA, 201 bp, Homo sapiens
actgagttggattgatatatttttcctttggccttcaaaggaaatttgagcattcattcattcatccttttagagaaatattctctaagcacctaccgtgygccaagctttgggttggatacctggaacccctctcagtgagatcacagtctaacagcacacacccaactatgaaatatagatggactgtgaagatgaaga

SEQ ID NO: 16341 - DNA, 201 bp, Homo sapiens
cagtgctttctgaagacagaggtgggacctggtgctggagacaatccattcctttcacaaagactgtaagccttacccaagcattaattttgctgcatagrcggcctgttctcccacaaagcactgagtaagaagaaaaggggcccggataaaccagcagggcctggcagacaacttctggctcccttgccatttaaggtc

SEQ ID NO: 16342 - DNA, 201 bp, Homo sapiens
ttatgaagattctgtgtgtgtgtgtctgtgtgtgtgtatgtgtacaaagaaagtttagagcagcgtgtggcacgtaatgcatattatgtaagtgtagctcyaatgtgagttgttacttgtagagaacagctatgtcaaaaccacaccaaaaacgatttggaaaggaaataatttgactggtcattttgtttatccatcaac

SEQ ID NO: 16343 - DNA, 201 bp, Homo sapiens
caccccttccctcttatcagcttcttgctaccatgcagaaaagtgctgaaggtggcctgccctaaggcagtagcactagagcagggatggggaggacttgstggccagatgcatgtggacatgatggaaagggaagagaagaactgtcaagattttcactatcagtggtataagccccgtagtaatatgcctagtgttcca

SEQ ID NO: 16344 - DNA, 201 bp, Homo sapiens
gctctgccacttagtaattgtgtagatttgcacatgttgctggacctctctttgtctcagttttctgtaaactggggaaaatcttagtaaatctagctaaygtggttgttatgaagattctgtgtgtgtgtgtctgtgtgtgtgtatgtgtacaaagaaagtttagagcagcgtgtggcacgtaatgcatattatgtaagt

SEQ ID NO: 16345 - DNA, 201 bp, Homo sapiens
tagagacaaggcttcactatgttgcccaggctggtctcgaactcctgagctcaggtgatctacctaccttggccccacaaagtgctgggcttacaggtatsagccactgggcctggcctgagttgataatttttgtcatttctttctcacttttctcaggaaaatcatgactgtaaaacagatcagttttgctttagttcc

SEQ ID NO: 16346 - DNA, 201 bp, Homo sapiens
ggtgagatcccactggtttggaggaaggagaggaaagtccccacttgggcaaaaacaatttaggatacctgaagattgcaaagcccagctcctcacaaagrgggtggcagctggggagaagctgaatcagtagacagacaagattgtggtttaacgagttcagggacaagagaaggccccagtaacctacagaagcaacta

SEQ ID NO: 16347 - DNA, 201 bp, Homo sapiens
tctcgaactcctgagctcaggtgatctacctaccttggccccacaaagtgctgggcttacaggtatcagccactgggcctggcctgagttgataatttttrtcatttctttctcacttttctcaggaaaatcatgactgtaaaacagatcagttttgctttagttcccaccctcatcatcaacccctccccagctaccctg

SEQ ID NO: 16348 - DNA, 201 bp, Homo sapiens
caaaaagcggctggaggaaaaagagctttgccaccgggcagtactgctgggtcttgcgtcacagagatgccttctgctcccttcttcagggagacctcagrgtatgaaagtgctgcttacccagcagatgagatttagtccagtcatccatctgcgtggtctctgtggataaagtaagcgtttcattcaacttttaaaaat

SEQ ID NO: 16349 - DNA, 201 bp, Homo sapiens
ctcctgagctcaggtgatctacctaccttggccccacaaagtgctgggcttacaggtatcagccactgggcctggcctgagttgataatttttgtcatttmtttctcacttttctcaggaaaatcatgactgtaaaacagatcagttttgctttagttcccaccctcatcatcaacccctccccagctaccctgcaaaaga

SEQ ID NO: 16350 - DNA, 201 bp, Homo sapiens
agctcaggtgatctacctaccttggccccacaaagtgctgggcttacaggtatcagccactgggcctggcctgagttgataatttttgtcatttctttctyacttttctcaggaaaatcatgactgtaaaacagatcagttttgctttagttcccaccctcatcatcaacccctccccagctaccctgcaaaagagtcaca

SEQ ID NO: 16351 - DNA, 201 bp, Homo sapiens
gaaactggaggagcccgggaactgctttctcctctctaagagtcttggtggtttcttgtgtggaaatgaatgggaagttcaccctggttctgcaaaatggktgcgaaatgtaaaatgtatataccttctatcctactctttatgttccacaaattttggagggaaactgattaactctctagctaccatgttccaggtgcc

SEQ ID NO: 16352 - DNA, 201 bp, Homo sapiens
tgcaaatgataccatcacgaaagtgtacagatgacctacagaatgggggaaatacttacaaattaaatattaaataagggatttgtatctagaataaagamcttttacaattcaataatgaaaactcatttaaaaaatgagcataagatctaaatagatattcctccaaatatgatacacaaattgccaatgaatacataa

SEQ ID NO: 16353 - DNA, 201 bp, Homo sapiens
ctgggtttaaggaattctctgccttagcctcccgcgtagctgggattacaggtgcatgccaccatgcccagctgatttttgtattttcagttgagataagsgtttactgtcttggccaggctggtcttgaactcctgacttcgtgatccactcgcctcggcctcccaaagtgctgggattacaggcatgagccaccgcccc

SEQ ID NO: 16354 - DNA, 201 bp, Homo sapiens
caaaccctgttttgtagtatttgctgattactgtggtgtaaatactcacaccttggctgatttcaagttgcagcttggaacttggagttagaaagagatgygtagtcccataccattttatgtatgtaaagtatttgcactatgccgactaatagacataaataacctcatgagcatagataatagtcacatctactaaga

SEQ ID NO: 16355 - DNA, 201 bp, Homo sapiens
aatttccttgtgaatgctgttaccatattcctggtgtctatgtgagggggtgtgtggtggtatgccggtaagtgttgaacaacctgctctgttggcgggarctaggggaaacaaaccctgttttgtagtatttgctgattactgtggtgtaaatactcacaccttggctgatttcaagttgcagcttggaacttggagtta

SEQ ID NO: 16356 - DNA, 201 bp, Homo sapiens
cctcaagtgatccgcccaccttggcctcccaaagcgctgggattacaggtgtgagcccccaggccctaccctgggcccctcctttctggcccctcaacctrttttcttccagccatgccctagggagagcttggctgtggccttgcagaccctctcagatgccactcaacaagggccaactggagagaaatctctagtcta

SEQ ID NO: 16357 - DNA, 201 bp, Homo sapiens
tatacacttgagcttggcatttttcttaacgcagggctattttaggtgcactgcgcatgttggaggtgcccttgcaggtataggtaggcattgtccatccrtggtaaaaagcaatagaagaaattcttacccgatgcttaatgaattgccaggctggttaaaaaggataacccttgaaacctagggtgtccaactgctaat

SEQ ID NO: 16358 - DNA, 201 bp, Homo sapiens
gttttccgggctgtttgtgtactacacagcctgtgtacctggcaaggcacgctctgctctgccctgccttctgatgagctgactaacaccttatagatgargttcccttagaaccaaagatgccccatgaaactccctaggatgaatgttggaagtccttccaactgggattcccagccggaaaggaaacagttcatctga

SEQ ID NO: 16359 - DNA, 201 bp, Homo sapiens
gtgtccaactgctaatttatatagactggagatatttccatgcctcgcagcaaaatttttctttaaattcacagaagcagcagctatccagcattgtccarttgtgctgagtagctgtcattattgataaacatgtaactggtcatttgtattgttttgagtaggatatggcttatcaggatgcatagtagagaaaaatga

SEQ ID NO: 16360 - DNA, 201 bp, Homo sapiens
gtgagccaccacacccagcctgggggagggtttgttaaagaactgtctgttttatcacatgaccacaagttaaaatgttgggcaatgtccctgaatgataycttttcattagtaactcacatggacccataatctctgaatttaacatgcttttcaggaatgtgttcatattttccacctataaaacctgttttagtaatt

SEQ ID NO: 16361 - DNA, 201 bp, Homo sapiens
tttttgtacttttattgaccattcacatttcttcttttctgaactgcctttccatattctcggtccagctttctataagattgctctcatttactggtgakagctctgtgtaaattaaggaaaccatcaccaccttcgaatggctgactattgtaaatattttaatgtttgtcgtttgtttgcaaccttgtaattttttcc

SEQ ID NO: 16362 - DNA, 201 bp, Homo sapiens
ggccttactcgttttcaaatactcaaatgccattgagtcagatttcagaggcaaatggtgatacctcaggtttgaagttgcaagaagtcaccacatgcttrttatggaaatcgtcagggatatttattccctctcctgagaagcataattgagcctccaaaccacccatcaagatatccacctgtaaaatatttaagaact

SEQ ID NO: 16363 - DNA, 201 bp, Homo sapiens
atttaagaactggtactatgaagacatttcccttatgcaatttgttttccatctaagagcagaacaaggaaaatatagctgactataagttacaaaggcasactcttaagctacaaaatacatctcttcacaggagcacttggagaagggctgaaggcaaaccaaaagtgagcaacaaggagactagtgttctgaaacaga

SEQ ID NO: 16364 - DNA, 201 bp, Homo sapiens
ttacacgtttatggattgaaatggttctgctgaaattttaagtgttaacattgttcaaattttcattactaacacctctcacattgttagaaaacagtttyatgtttgacattttgatcatactaacctgggacattttatgctaaagttctcatttcatgccttaggaatcccctgcttattttgatttcagcacctttc

SEQ ID NO: 16365 - DNA, 201 bp, Homo sapiens
tgtttatgtaagatccataatgactcttgccaattagcaggctgctctcttccaagtggtaacccagggactcaagctcttttcatcttgtggctcagccrtctgacacatgtggcttccagcactgccctgctgttgtctgcacaaagctggtggaagaagtaggaatttgcaggaccatgtgtggagcattttaaggat

SEQ ID NO: 16366 - DNA, 201 bp, Homo sapiens
tctaaaccgatcatcacagaagatattttgtagtgatgaagaaagcttaaatgtctcatttgtcagattggtttaggtagaaaataaggatttccaccccytcatcgtggttcccttttagattttcttgtttgcttttctttaaagctgctgttactcaaacgacagtccgtaaactgcactttattttttataacagct

SEQ ID NO: 16367 - DNA, 201 bp, Homo sapiens
aagggaaggatggaaggaagagagggagagacggagggagatggaggatgacagggagatggagggaggcaaaaagaaaaagggagaaggaaagagaggaragaggggaagggaggaaggaaagaagagagagaaggaggaagagagggaaggaggcacagaggtagagaggcagggagataatggagatcctggccaaaa

SEQ ID NO: 16368 - DNA, 201 bp, Homo sapiens
gtggattacagaattgtgctgggtcctatggagtgtcagaaatagtgaagcttctggagcttcactgtccaatatggtagccacgtgtgactattaaaatrtaaattaattaaaattaaaagttcaattgctctgaaatagcagccacatttcaaatcttcagtagccagatgtggttattggctaccatattgggtagca

SEQ ID NO: 16369 - DNA, 201 bp, Homo sapiens
gactattaaaatgtaaattaattaaaattaaaagttcaattgctctgaaatagcagccacatttcaaatcttcagtagccagatgtggttattggctaccwtattgggtagcaccgatatagaacatttctaccatagtagaatgctcttttggatacatctgctttaaagcattagtccccaaagtgtgaaggatgaacc

SEQ ID NO: 16370 - DNA, 201 bp, Homo sapiens
agtacaagttggtaatgggtaacaggctaaaccatgtggcaccccttccctcttatcagcttcttgctaccatgcagaaaagtgctgaaggtggcctgccytaaggcagtagcactagagcagggatggggaggacttggtggccagatgcatgtggacatgatggaaagggaagagaagaactgtcaagattttcactat

SEQ ID NO: 16371 - DNA, 201 bp, Homo sapiens
gtcccgtacttttcaatgtaagcatattggctctcaatttaaaaatgttattttttacagatagtacacagatgcactgacacaggtaccctctccagtcytctgatggtcaggaattgtgtgcagtatgcagtacattccaaagtcaggctggccatttccccagggagagggtccatgttggaacctttgctccttgtg

SEQ ID NO: 16372 - DNA, 201 bp, Homo sapiens
tgcctataaacataaaattaaaagcctgctgtctgcttagttcaggtattgggtcagcgtcttgtgactatggacaagaggtgtttgactctaggactcasctacctcatctgttaaatgggcaaactgggagggtgtttatctgcatgcaacatctccttccatttgaaaacttttatgaatgtatggaatattattgag

SEQ ID NO: 16373 - DNA, 201 bp, Homo sapiens
tgcttttataaaaaaagtcacagaaacaattatattgtacacagtcctatataatctgctttcttttgtttatagaatactgtgaatgtctttttgttttktttttttttgtttgcgagacagggtctcactctgtcactcaggctggagtgcagtagtgcaatcttggctcactgcaacctccatctcctggatgccagc

SEQ ID NO: 16374 - DNA, 201 bp, Homo sapiens
acttgtttcctgtgagggtgccaggaaactttacaatgaacttcgtgaattaaacctctaccagatgaatagaggtggtggcatggtagcagaaattaggrttaaaaaaatggtttttgatttatgaaaaatttttctgcaggaaattttgatttgttctttgtggattctgaggataaaattaagaccaacattgaggat

SEQ ID NO: 16375 - DNA, 201 bp, Homo sapiens
tggaagggatatttaatttccattaaaacatgaatttcattctgcccttgccatgcttttcttggtcttagcccaacctgagctgctgatattaaggaatrataggataattccataattttcattttaccttttgctttttgttttccatagcagttatctagaggattcccattatgcttcttcattacccggtgccca

SEQ ID NO: 16376 - DNA, 201 bp, Homo sapiens
tgaagttgtttagataaatgtgccaggtgctaagctcagggttattaggaataataattcagtgaaaggaaatttggatgacatgaactcatttccattakacttgagccacacaaatcaatgggaaaagaaacagctgaatccaggataatatctggctatttggagtgggcatgataatggagggagattggggaggta

SEQ ID NO: 16377 - DNA, 201 bp, Homo sapiens
ggcagtgtgcactgtggctgggagttgacacagatccttgtctcccagacccccagtttctatcgagctactgtaactttaaaaagatttaacaaagactmcctccactagctaagctgaaataagaatgtctccggagtttaatggatcaagtagcggtgataggttttatggctcttttttactttagggcatagggaa

SEQ ID NO: 16378 - DNA, 201 bp, Homo sapiens
acagcttctggcgccgcaaacaccttgggtcctagagaaacctgcacacttgtgtctccacctttttacctcttgcgggcatgagtctggtctcagtaatmacattgtccagcccatcataaagggctcttgaacacattttcatcaactttaggttaagtctgtttgggtaaatgcgtcttggagggctgggtagaagat

SEQ ID NO: 16379 - DNA, 201 bp, Homo sapiens
ttacatatactctcaagattgattgcacagttctcctctggcagctcacaaatgtttgactagatcggaaatggcattcgggcatgattaaaaagattctwctgggcttcccagaaattctcagtcctgtgtcgtcaacaacctaactcattgccattgctgcgggatagacacctcccccgtttcccatgattagcaacc

SEQ ID NO: 16380 - DNA, 201 bp, Homo sapiens
tggagcacttgaaaactgctgttttgtgtcagtaggtaaacaacaaacattggtgactactgaattttcagcagatgtgattcctttgtttcacagaaaawctgtatcttttgttctaaatttttttcttctaatgggtataatcctctgttggagagtcctttgatagctaggagtgtgttttcttctttactttcccaa

SEQ ID NO: 16381 - DNA, 201 bp, Homo sapiens
caatgcattacaaatatcaatatgtgggtgcttttttttttctttaccatatattgtttatcagaaacctctgtaccctttcctttaaaggagtcaatatkcatttgtattctgtgctgacaactataaattgatggctagcagttatcaaatgaatgttgatgaaaagcagctacttaacattttcatcccaacaccgag

SEQ ID NO: 16382 - DNA, 201 bp, Homo sapiens
tgaaaactgctgttttgtgtcagtaggtaaacaacaaacattggtgactactgaattttcagcagatgtgattcctttgtttcacagaaaaactgtatctkttgttctaaatttttttcttctaatgggtataatcctctgttggagagtcctttgatagctaggagtgtgttttcttctttactttcccaaagacaattt

SEQ ID NO: 16383 - DNA, 201 bp, Homo sapiens
cactgaaaaagccgggcagtttgcagggctgaggactttggagtagacatctctgttctcgtctgctgcttcccatcattttggtggaagttggtgtgttsgttggttagcacttattccaaattgaattgtataatttcattatagaagtatcacggtggaagaagagggtgacttactggtgtggtcacctagccaggg

SEQ ID NO: 16384 - DNA, 201 bp, Homo sapiens
ggctgttggtggcaagaaaagaagggtgatgggttgggcttatattgtttagtggagcaaaagagatgtgaaacatttgtgtcttaaagtgttttggtcargagaaactaaattggttagaaagtgtgcaattttgcaagctttataaaaatataaaccaatgagtctggactctgttccctaaaggggatgaggaatgaa

SEQ ID NO: 16385 - DNA, 201 bp, Homo sapiens
ggatcttaaagtccaacctcaaggcccagcgctgccacttaacagctctgtgaccctgtaaagtcactcagcctcattgagtcccccatcctcccctgtgyagaatgaggctaatgctagtgctcatttcatagagttgctacaataatcaatgagataatgtgcataaagatttacatacataataactgctcaataaag

SEQ ID NO: 16386 - DNA, 201 bp, Homo sapiens
gaaaactgctgttttgtgtcagtaggtaaacaacaaacattggtgactactgaattttcagcagatgtgattcctttgtttcacagaaaaactgtatcttwtgttctaaatttttttcttctaatgggtataatcctctgttggagagtcctttgatagctaggagtgtgttttcttctttactttcccaaagacaatttt

SEQ ID NO: 16387 - DNA, 201 bp, Homo sapiens
ggtaggcttctctctaaataaatggaaatactaactgtccctggctcatagagctctgtgagggttaggcaacaatgcttacaaagctctccatgcagagmctggcaaatcgtaacctctcaataaatgctagtcattgatgtcacttgaatagtactcgttggctacaactcactgaaaaagccgggcagtttgcagggc

SEQ ID NO: 16388 - DNA, 201 bp, Homo sapiens
tccctaaaggggatgaggaatgaaaatgaaggtttgcaaagacatcttgccagacccttacatattttaatttaaggtggtattactgtcctcattttcargctgaagaaccaagctctgagagagttaatgattttctccagatcattcacattcatttctgttacacagctgggattataatccatgcctgtctgactc

SEQ ID NO: 16389 - DNA, 201 bp, Homo sapiens
aagtatatgtagcaaccaaacagtttcttctttcctaaaactcaaagtgagtcagacttcttaggcttgtagatgttgaggactaagctttgctctttatmttctctttatggatttccctttggaagcagggataagaagagggaaggtctcccagatgtaaatttctcataaatatttgagctccatttcagtaattct

SEQ ID NO: 16390 - DNA, 201 bp, Homo sapiens
tactgtggttacatttggaagtgtttacaaaggtgataagatgtttttatagtttggtgttcatttatcgaccatattaagaaccttcttctatgaaatgsttttagtaggaagtattttgaatgaagaaagcgtattttccacaatatatttggtagattatttttcaaaaccaaaggacttcaaaaatgtcttcctatt

SEQ ID NO: 16391 - DNA, 201 bp, Homo sapiens
taattatctgtatggctttggacgagttgcttttgatctctgatatcaggtaggcttctctctaaataaatggaaatactaactgtccctggctcatagarctctgtgagggttaggcaacaatgcttacaaagctctccatgcagagcctggcaaatcgtaacctctcaataaatgctagtcattgatgtcacttgaata

SEQ ID NO: 16392 - DNA, 201 bp, Homo sapiens
gtagggagtcccaactttttgaatccatccgtgtggcaaatgtagctggacccttgggatgaagacccttcctgcatcctcccaaggagacaagttctggrccataactctagagcaaccccaacccccaggccatggaccaagtgtcaacaatgttgacattgtgaatccctgatctggaggaacatagctttggggcag

SEQ ID NO: 16393 - DNA, 201 bp, Homo sapiens
aaagtgagtcagacttcttaggcttgtagatgttgaggactaagctttgctctttatcttctctttatggatttccctttggaagcagggataagaagagrgaaggtctcccagatgtaaatttctcataaatatttgagctccatttcagtaattctttcattctctgatctgttgcctaatcttctatttagcaagtac

SEQ ID NO: 16394 - DNA, 201 bp, Homo sapiens
ggaagtgtttacaaaggtgataagatgtttttatagtttggtgttcatttatcgaccatattaagaaccttcttctatgaaatggttttagtaggaagtaytttgaatgaagaaagcgtattttccacaatatatttggtagattatttttcaaaaccaaaggacttcaaaaatgtcttcctattagtggacaccagtatt

SEQ ID NO: 16395 - DNA, 201 bp, Homo sapiens
tctacctttgtgaacctgttgctagcaaagaaatatttttccttgtggcaaaagatcaacatctaaacacattgtccacgtctaatttgttagggagggcrtgttctcttctggagggctaagagttggcatgggatctaaatggattctccagaacactttctcacacttctaaagcctgaaaacaaatatttgctttcc

SEQ ID NO: 16396 - DNA, 201 bp, Homo sapiens
acagagcctcccttctacctgctcttacccgggcaccacagttgatgagttattttttggaccatcagcaacacacccaatcattgtacatggaatacttyggggatgcttttttctatattgattttacttcattaaactgagctccagaggagcagaaactttggctaatacatcttggtcttagcttgtaatatctgt

SEQ ID NO: 16397 - DNA, 201 bp, Homo sapiens
gttgtggtctgtgcttgaacctgttgcatttatggtgatggactggcactttactctctctgagccacggccatcaagcccctgtcatagacactgtcccyagtgtcacctggggaatgacactcttcacctgtcatgggagaggcaactgaaaaggagcctgaggtttttctacctttgtgaacctgttgctagcaaaga

SEQ ID NO: 16398 - DNA, 201 bp, Homo sapiens
cctgcccttccctaactggtttcctatgctgtcatgcccacctttgagtgttgccttcactttaaccttctgtgcatgctcacaaagtaattagcatgtaycctccattctgagttaatataaggccccagacccagccacatggggcaactttactgccttcaggtaggggaaccacccccaccacattccctctccact

SEQ ID NO: 16399 - DNA, 201 bp, Homo sapiens
ctcatctctttagattagtgattctatattggtgagggagtggaagagaaatgtgggtgtgttgactatattctccacagaaactttttgaagtagcatcstcactcagcacagaacattttgacaatacacttccagggcaggtggtttcttactatgtccctccctacccccacatactttgggactcagaatgtaggg

SEQ ID NO: 16400 - DNA, 201 bp, Homo sapiens
tggcatggcctttgtatgacacttccttctagccagactcggatttgggggcatcatatttgggatggctgcaccgcaaacaggaaaggccacaggacagytcacaggttctctctgaacagaagcctgtgagcacgtgcctgtcatttaaaagctgcatggcactcttccccctgcatgcgtttctctcaaggtgtccct

SEQ ID NO: 16401 - DNA, 201 bp, Homo sapiens
ccccccatggcttcgtccttattcttataacctgtatgcactgctgaacctgctgaataaccatgtcacagtggcaggagagggactgggtgaacttgagyctcgatgcctggattaaagccttgtaatgatgtttgcaaagcaccagggtgataactgaatggttggcacaggcttcgatgaagcttgtgtccaccacag

SEQ ID NO: 16402 - DNA, 201 bp, Homo sapiens
tgacaatacacttccagggcaggtggtttcttactatgtccctccctacccccacatactttgggactcagaatgtagggagtgtactctcgagggatgcrgcccatacgtgaatgcatggaggcagcatataaggttgcaaagcactgaccttctctttttatgattcccatttattccatagactgtgaagtctgcctg

SEQ ID NO: 16403 - DNA, 201 bp, Homo sapiens
ctgctgatagcccaagttaacatcctcccatgccttggccttcccagaacaaacatggctttggacgcctttgggtggttgggactggctgcctatttttytctaaaacttaagttttaggaaagaattctttccagctttccatcctgaacctgctggtctccaggctcgttcctgcaaatatttcacagaggagtaaga

SEQ ID NO: 16404 - DNA, 201 bp, Homo sapiens
gaccctcaataaggagaatcagagaaagaagaaataaaacatattactccattcccatacttctgtgaagaaatacccgagactgggtaatttataaagaraaagagatttactgaactcagtcgtttcacctggctggggaggcctcaaaattatggcagaaggcaaaggaggagcaaaggcacatcttacatggcagca

SEQ ID NO: 16405 - DNA, 201 bp, Homo sapiens
cacctcccggtttcaagcgattctcatgcctcagactcctgagtagctgggattacaggcatgcgccaccatgcccagctaattgtgtatttttagtagaracgggatttctgcatgttggtcaggctggcctcaaactcccgacctgagatgattcacttggccttggcctcccaaagtgctgggattacaggtgtgagc

SEQ ID NO: 16406 - DNA, 201 bp, Homo sapiens
gagatttactgaactcagtcgtttcacctggctggggaggcctcaaaattatggcagaaggcaaaggaggagcaaaggcacatcttacatggcagcagacmagaaagcgtgtgcaggggaactgccctttataaaatcaccagatctcatgagatttattcactatcaagggaacagcacaggcagatcccatggctttga

SEQ ID NO: 16407 - DNA, 201 bp, Homo sapiens
ttaactgattgcagcaggttagagcacagcatgaagagctgacaatattgaccgactggccctctcagacaaagtttgccaacacccaggtgagcagatayacttatctgtgagcagacgtgattcaggggagattgttgtccctcctttcctaagaaaatgtggaaagatgagaatgttgccaccagtgctgatatggag

SEQ ID NO: 16408 - DNA, 201 bp, Homo sapiens
atatgtcccacaattggcaagtgccataaatatattataggccattatactttctacagtatctttaattgatatgccccatgtctaagaaaaaaagtagyttttcatgatgaaggtgatgaactacttctttccattattctatttcccccttttcttcttcaggctttaaagatatcataataccatttacatttactg

SEQ ID NO: 16409 - DNA, 201 bp, Homo sapiens
atcaaggctgggaggaggtctttccactggttttccgggctgtttgtgtactacacagcctgtgtacctggcaaggcacgctctgctctgccctgccttcygatgagctgactaacaccttatagatgaggttcccttagaaccaaagatgccccatgaaactccctaggatgaatgttggaagtccttccaactgggatt

SEQ ID NO: 16410 - DNA, 201 bp, Homo sapiens
ccccaactccttactcatgcttcctctgtaaaatgatcactccccagtttgacaggaattgcccctggaatcccatctggtgttctaattgttaccaaatycaggcaaatcttgcctgtgatacaggtggtgaagctactggatagaactggagcatctaactggtgtgagatggtatctcattgtggttttgatttgcat

SEQ ID NO: 16411 - DNA, 201 bp, Homo sapiens
ttgtctccatttctgtcccagttacatcaaggctgggaggaggtctttccactggttttccgggctgtttgtgtactacacagcctgtgtacctggcaagrcacgctctgctctgccctgccttctgatgagctgactaacaccttatagatgaggttcccttagaaccaaagatgccccatgaaactccctaggatgaat

SEQ ID NO: 16412 - DNA, 201 bp, Homo sapiens
catgtaccctagaactgaaaatataataaaaaatacatattaaaaaaaaaagaactggagcatcgactttcgttttcatttcaagacccgtcccccatgaycacagaggatgaaaagtctgcttaaattataagctagctaattgcttcttcagttgaagacctaaatgagttttaaagtgaaatgcatatctctaagggc

SEQ ID NO: 16413 - DNA, 201 bp, Homo sapiens
tggggcagcacctttgcttgaacgctggctccagatgaaagaacagattgccgcggagccgcttttccaaggatccctctccccagcatggggcttcatayattattgagagcaaacctactttccaccgccactcctggatgcacttattttgcgagccttattcagaatgtcagcatggatcacttggcaacaaaggcc

SEQ ID NO: 16414 - DNA, 201 bp, Homo sapiens
ggttgtctcgaactcctgagcttaggcagtctgcccacctcagcttcccaaagtgctaggattataggcatgagccaccatgcccggcctaatctaatcarttcctttaaatctgaaactgtccgcctgattctggtttaccacaaccaccagagtcttaagtgtcccaatagccagggtctcatagactctgcttatggt

SEQ ID NO: 16415 - DNA, 201 bp, Homo sapiens
agtgagctgagatggcaccactgcactccagcctgggcaatggagcaagactctatctaccccccaccctgcaaaaaaagaaaagaaaggaaaaaaaatcytggtgcttgtaggagaggcatttatttcttttaggactggacggggcttggagggtttccaggaaacagcctcaacctaaaaatagtagacacagttcat

SEQ ID NO: 16416 - DNA, 201 bp, Homo sapiens
ggctccgagaagctcacccatcaccatttgctctactgcaaaacaggactcattagcaggagctcataaaatgaaactggcagtgagctcatatggaagargcatcacgggcaactcggcttggctcaccagcccctgagctgcccccgagtgaccgctccagccttctttccttccacctctccctcttggccaacttca

SEQ ID NO: 16417 - DNA, 201 bp, Homo sapiens
acctgccatcatggggataaccggaattgatacaatgtcttgattcaagattcagagctcattttttctgtgtcagattaaaaaaaaaacaaaaaaccctyactgatcttttaaatatgtaattcttcctcctcttctccccttgtctctcttctcacccctaccaatgtaatcagttctttttttcttttttggagacgg

SEQ ID NO: 16418 - DNA, 201 bp, Homo sapiens
accacaagcattatcttctttaatcatctcacaatcttatgaaggagatactaatattttgcttgcaaagatgagggaagtgagtttccgaagttgctaartgcgtaaaggaggtggtggtgtcagaatgttatcctgctcagatggttgcatgggacagtgtccagaggaaggcctctgattccttccccagcattaggc

SEQ ID NO: 16419 - DNA, 201 bp, Homo sapiens
taagtctccattccgcttgccaagattaaattgaattattcccgctgccattcagttttactctgcacaaaatacagccaacatttttgcatttctttctyccttcctccttttcttctttctttccttccttccttcctttctcccttcatctatctttgttccgcttttgtttgtttttttttagatcgctgcatgctg

SEQ ID NO: 16420 - DNA, 201 bp, Homo sapiens
gagattcacatatgtagattacattgttatgaaccaacatttataagcaagcttgatctctcagaatgcgtttgtctatctcagattttcaagaatcctcrtacaaattgtccagggtttccacctcgcagttttcttccagggttgctatggcatggaaagtacattgctattttgttatgtaaatgctcaacagactgg

SEQ ID NO: 16421 - DNA, 201 bp, Homo sapiens
gcagaatggaagggaaggatggaaggaagagagggagagacggagggagatggaggatgacagggagatggagggaggcaaaaagaaaaagggagaaggawagagaggaaagaggggaagggaggaaggaaagaagagagagaaggaggaagagagggaaggaggcacagaggtagagaggcagggagataatggagatcc

SEQ ID NO: 16422 - DNA, 201 bp, Homo sapiens
ttccagtttctcaattgcaaaagtgaggctggtcatggggcttggaaccacgccacggacgcatgaagcctccccgtttacatgccaaatccagagcttakgcatccatgctcagggctctctgtggtaggcaacagctggattatttactttctagaatatctcgagttcttaatctgagcagtttcgaaaccaagccca

SEQ ID NO: 16423 - DNA, 201 bp, Homo sapiens
atggcttaccttactttttagacataatttttgttttctgttaaagggtcagttatagataagtatgctcccttgcaatgaaatgaacccactttatcaaytttgaaggaatcaaaattaacttgaatacattgtctttttgcatatgtatgtagtgctttgtataaacatatgaatttgtaggagctgctcttaatgatt

SEQ ID NO: 16424 - DNA, 201 bp, Homo sapiens
ttatactgtgggctgcatcgcttaccaatatttcatctgtttcacttagctgctgttacttactcaataatgtgtggccaatctcacaagatactaattcwttttttcaaatgcagcatcgcttgaagctgtgataaaatatcacacctttggaaatcaaggctcttcttgtttatttatttaactcacattaattagcct

SEQ ID NO: 16425 - DNA, 201 bp, Homo sapiens
tggggcactgagatctatgcatgttgtgggcccactttaagaaaaggagtcaaacatttagtgtggaatactggaaggggtccctagacatgaagggcctyttcaacctaccttttgttggcttcaaggttatgccatattttgcaaagtcaagttggagatggctctcgatatgcatgagtgtgttagactgcttttctt

SEQ ID NO: 16426 - DNA, 201 bp, Homo sapiens
tcttttttttttctaaccactttcccagtgagacttcagttttcattctccccttagcagctttcaaatatgtacgtaacacaaatgttacatgtttgagmatttaaactgaatttggacagggcttctatttccagaaccttctaactctatttctttgtgacctgatagtcttgctctccagggtaaaagaagaggatg

SEQ ID NO: 16427 - DNA, 201 bp, Homo sapiens
ctcctaacatgtcatctgaaatctgggaccacagttccggctggaacacttgtcactaaagctgctgataagcaaagggtgtatcactggtatgggtaacwgttgtgggaggaggaggggtctgacagatagccggatgattttaatgtttatattccactggggtaagctctaacaaagacccatcatttcccagataac

SEQ ID NO: 16428 - DNA, 201 bp, Homo sapiens
ataattaaccctctggggagactaatattagtttattagagacaatttctagttctgtttatttttaacactaaacgatttgttcagattggggaaaaaawttttttttttttttttggttgtggtggcgttggcttttacttggggttgacctttccttatcaaggacatacaaggtgaatagctgggtgataatatatg

SEQ ID NO: 16429 - DNA, 201 bp, Homo sapiens
ggctctccatccttcaaaatccagctcttggcctcatatcttccacaaagccttcccagacctttactcacctgggccattaatcaccttccctctcagtyagctcctacaccatgagtgcttttgtatggtgactgtctggttacaaggtcatcttttcccctggatgagacgccccttggggaaaggaccaagttttat

SEQ ID NO: 16430 - DNA, 201 bp, Homo sapiens
tccatccttcaaaatccagctcttggcctcatatcttccacaaagccttcccagacctttactcacctgggccattaatcaccttccctctcagtcagctsctacaccatgagtgcttttgtatggtgactgtctggttacaaggtcatcttttcccctggatgagacgccccttggggaaaggaccaagttttattccct

SEQ ID NO: 16431 - DNA, 201 bp, Homo sapiens
ctgtatcatgatatcggagtgttagctgttttgggagtacgtgtgctcaggacttgggctgagtggaaaaccagagtatggggttagaaatggaggcagarggactaccatgtcggggaggatgcacaatgaattggacgaaggttgcaactcagtgagcaccgtacctgtagtgtgtcttagtaatagcagatgcccaac

SEQ ID NO: 16432 - DNA, 201 bp, Homo sapiens
ggcctcatatcttccacaaagccttcccagacctttactcacctgggccattaatcaccttccctctcagtcagctcctacaccatgagtgcttttgtatsgtgactgtctggttacaaggtcatcttttcccctggatgagacgccccttggggaaaggaccaagttttattccctgtttaaccttggcctgacaaccta

SEQ ID NO: 16433 - DNA, 201 bp, Homo sapiens
ggtggtgtttttactctaacacctctttcagtacatacatacagtaggtgcttagtagatgtttactgaatgaatggataaacatgtacaaaattatgatmccttgtgttaaatatggtagggaagcaacataatgtgccctggagtttcacagaagaaggggctttcttccagcttggggatggaggtgagctgtcattc

SEQ ID NO: 16434 - DNA, 201 bp, Homo sapiens
aagcaggaggctttgaggtctttttttccctcctgattcggagggaaaaaaaatgttgtttgtgttcatttatggaaattagatctatcacatactcttakgcaatttatgaaatgttaagcaatacccctgaatgtcctagtcccaggaaagttgagagttgagtgcaagacggggacacccaggagccagtaaatcaac

SEQ ID NO: 16435 - DNA, 201 bp, Homo sapiens
acagtggacctcacagctctcctgctaatggtgctgatggctaagctcagctcttacccttgaccactggaacaacttagacatgtcaccagctttctgascctgtctcattacgatgaaaattgtgatacaggttagtgtaaggaccgacaataatgcatataacatcaataatgatggatatagaatttctgcagttat

SEQ ID NO: 16436 - DNA, 201 bp, Homo sapiens
acatacttcttcctgccctggattaacattaccattggttttagtagtcttacgtcattatgtccaaagcttttaagtttacagtgcttgcttagtccagygaccaatggatgtaagtaagttggaaaagggcaaaggatttagaatcatgagggttgtattcaaactgcagcctctactcccttttagttacataatttt

SEQ ID NO: 16437 - DNA, 201 bp, Homo sapiens
gccacaacagcctcttcttttctcttaaatcttccagcaattcttcaactttgcctgtatatttatcatacaacataatcctagtatttagtaaatgcttrgtctttgatttcttattttcaaatgcatgtctttagaaccagaatgtgtgtagctgttttctggcctgaatttgggctgagatgatgagaagtttagttg

SEQ ID NO: 16438 - DNA, 201 bp, Homo sapiens
ccattggttttagtagtcttacgtcattatgtccaaagcttttaagtttacagtgcttgcttagtccagtgaccaatggatgtaagtaagttggaaaaggrcaaaggatttagaatcatgagggttgtattcaaactgcagcctctactcccttttagttacataattttgaaatcatttgacatttctgaggttaatttt

SEQ ID NO: 16439 - DNA, 201 bp, Homo sapiens
attctggaacacgaaggaggtatgaaaagggcttcactcgtttcatggaaaagctcagaacagtttgtcgacttggaaacacaggccctgacagcgtaccmaggtcaccctgcccttcaatcctgctgatagcccaagttaacatcctcccatgccttggccttcccagaacaaacatggctttggacgcctttgggtggt

SEQ ID NO: 16440 - DNA, 201 bp, Homo sapiens
gcaagaattctggaacacgaaggaggtatgaaaagggcttcactcgtttcatggaaaagctcagaacagtttgtcgacttggaaacacaggccctgacagygtaccaaggtcaccctgcccttcaatcctgctgatagcccaagttaacatcctcccatgccttggccttcccagaacaaacatggctttggacgcctttg

SEQ ID NO: 16441 - DNA, 201 bp, Homo sapiens
tttacagtgcttgcttagtccagtgaccaatggatgtaagtaagttggaaaagggcaaaggatttagaatcatgagggttgtattcaaactgcagcctctrctcccttttagttacataattttgaaatcatttgacatttctgaggttaattttctacatcagtttagctgctttaggccgcaagttattaacacccact

SEQ ID NO: 16442 - DNA, 201 bp, Homo sapiens
tgagagaacaagtctatgttttcttgagacaaagtcttgatctgttgcccaggctcgagtgcagtggcagcatcttggctcactgcaacttctgcctcccrtgttcaagtgattctcctgtctcagcctcctagggagctgggattacaggtgtgcaccactatgcccagctaatttttatattttcagtagagatggggt

SEQ ID NO: 16443 - DNA, 201 bp, Homo sapiens
attttttcctgtgcagcaattttaactttctatattcaaatatactctgaatgcacagtgaatttggcagaataccatttaagtcttgtattttccaaagytagtcaacgtccaactgccaatgttgcctgaacaggaaatatttatacctgaaagcgtccaggtgagagtcaggaaagccatgaaggtgcaactggcata

SEQ ID NO: 16444 - DNA, 201 bp, Homo sapiens
atggcaagaattctggaacacgaaggaggtatgaaaagggcttcactcgtttcatggaaaagctcagaacagtttgtcgacttggaaacacaggccctgasagcgtaccaaggtcaccctgcccttcaatcctgctgatagcccaagttaacatcctcccatgccttggccttcccagaacaaacatggctttggacgcct

SEQ ID NO: 16445 - DNA, 201 bp, Homo sapiens
ggatagggtaatggtgttgacacaggcactgttgaatacgtatgtacatattttaatagttttctcattaatcaaatggaaatgctatcgattttataggrtcgttgtgagaagaagtgagaattgaaatgaaaggcatctagtcttccccggtccccatccacttgacccaccatacctcaagccacttctggctccatg

SEQ ID NO: 16446 - DNA, 201 bp, Homo sapiens
aaggcccagatttagttctcattgtaggaaaaagggccagaataccttgcccatttttgccttgggaagtgagctcaatgaaatacatcttcatatgcccrttttacagaagcagcaactgagggctgttgtactgaggcttgcaatggccacctcaacttttaggtctctgaggcagcaatgggacccttgccggggcct

SEQ ID NO: 16447 - DNA, 201 bp, Homo sapiens
tgtgcagcaattttaactttctatattcaaatatactctgaatgcacagtgaatttggcagaataccatttaagtcttgtattttccaaagctagtcaacrtccaactgccaatgttgcctgaacaggaaatatttatacctgaaagcgtccaggtgagagtcaggaaagccatgaaggtgcaactggcatactgatgtca

SEQ ID NO: 16448 - DNA, 201 bp, Homo sapiens
tgacccacatggattgccttgaagccgtttctttttccttccctcgttaggagtaccctcaccctaaccccagcaaagcatgtctagggtctcacaataayagcaggtctcagaaagataaaataattctgaatgttacaactcgtcccatttaaggctagacataaatctatcacagatcctttggaacatcgatggcaa

SEQ ID NO: 16449 - DNA, 201 bp, Homo sapiens
ctcccaggttcaagcgattctcctgtgtcagcctcctgagtagctgagattacaggtgtgcaccaccacgcacggctgatgtttgtatttttagtagagaygggatttcaacatgttggccaagctcgtctcaaacctgcctcagcctcccaaagtgctgggattacagatgtgagccactgcacccagcctgtagtttct

SEQ ID NO: 16450 - DNA, 201 bp, Homo sapiens
ttcaaaagttgctgccttccaaggggaaaaggtctggtcttgtaatttctggtctgtgcgtgctgtataaggaagaaggtttgggtagggaagcaacagastacccactagtgagagggaggacaccgctggtctgtgctcaacagccaggccagcaccacatgaataaagcatgatggcaattgcctgactctgtcctcg

SEQ ID NO: 16451 - DNA, 201 bp, Homo sapiens
ctgtttgtaacatgatttaagcactaagctattgaattttggagtgcattaaaaaaaatatcgagtggaaaaaggaatatttcttagggaggaaaaaccckacttttgactttataatattaagttcgttcatatctctcttagattcttatataaattttattgacctaatgttctgtacagtagtccttatttacagtt

SEQ ID NO: 16452 - DNA, 201 bp, Homo sapiens
cttcagtgctttttcaggactatgttatagaatacttatggggcatacgtgtaaatgaactgtcaaccttaaaatctaaacaaacagcttgtttgtggttygtcctgaaatcctccctgctcacaaaacagccagctacttggttttctaaaagacgtaattttgcaggcagacttcgtagagccattctgtgcagaagaa

SEQ ID NO: 16453 - DNA, 201 bp, Homo sapiens
agacgggatttcaacatgttggccaagctcgtctcaaacctgcctcagcctcccaaagtgctgggattacagatgtgagccactgcacccagcctgtagtktcttatttaatgtctgtccccccttctcttgacagtggtgtttttgccttcacactactgtatccctggtccataccgtaaatgttctgtaaatgtttgt

SEQ ID NO: 16454 - DNA, 201 bp, Homo sapiens
tacagagaataggagagaaaatagagctccaaggtggaggaaaagacaactgagaggaggctattgtgatgttttattaccataaactgccaagggttagycgtagccctccatctgccagctaattccggtttcattaatatgaatattctcacgcttccagaaggaaattcttggaatgttatggatctctgtagcagg

SEQ ID NO: 16455 - DNA, 201 bp, Homo sapiens
aaaaaccctacttttgactttataatattaagttcgttcatatctctcttagattcttatataaattttattgacctaatgttctgtacagtagtccttawttacagttttggtttccaaggtttcagttatacattgtcaactgtggtacaaatatattacttacaatacgatattttgagagagagagaccacatttat

SEQ ID NO: 16456 - DNA, 201 bp, Homo sapiens
ttttttttttttttttcttcagtgctttttcaggactatgttatagaatacttatggggcatacgtgtaaatgaactgtcaaccttaaaatctaaacaaamagcttgtttgtggttcgtcctgaaatcctccctgctcacaaaacagccagctacttggttttctaaaagacgtaattttgcaggcagacttcgtagagcc

SEQ ID NO: 16457 - DNA, 201 bp, Homo sapiens
acgggatttcaacatgttggccaagctcgtctcaaacctgcctcagcctcccaaagtgctgggattacagatgtgagccactgcacccagcctgtagtttsttatttaatgtctgtccccccttctcttgacagtggtgtttttgccttcacactactgtatccctggtccataccgtaaatgttctgtaaatgtttgtaa

SEQ ID NO: 16458 - DNA, 201 bp, Homo sapiens
gatctctgtagcaggcacatgcaacgtccagtgcttccctgctggtaatgtggcggttttattatgcatgccatacccatgctctctatttcctcgatagrccttatagaaatcaccatgcttccttttagaagaaaatgatggtatcacatggagaacgagctgaggagcttgacaatcttggcaaggcttatcaaaaga

SEQ ID NO: 16459 - DNA, 201 bp, Homo sapiens
tgattctagatgttttttaggaaacccaaagaaagtatgaaaaagcccaagccaagtccttccactgttgttcccgggcctgtgtgtgctgtgtgtctttsctgggagaaggtcagagctggagtggggcactcgattccggcaagagaaggcaaacaaaagaagccacaacagtctaggaagaaatctttaatttctatt

SEQ ID NO: 16460 - DNA, 201 bp, Homo sapiens
agccactgcacccagcctgtagtttcttatttaatgtctgtccccccttctcttgacagtggtgtttttgccttcacactactgtatccctggtccatacmgtaaatgttctgtaaatgtttgtaaatgaatacatgaaagatgaccaggtgctgaatcagtgagagtccttaatgtacttcttatcatttatccctctga

SEQ ID NO: 16461 - DNA, 201 bp, Homo sapiens
gaagcacacacagctgttatcttccagaaacactgcttacagaggtaattgctcacagattttagggtttacagcaggtatcacaggatttcaaatttaaraggggggtgggggcctgtgttcaaagtcttaagaatatccaagggatgtatgatgtatgcataattacctgaaattgaaactactgtagtttaaacactt

SEQ ID NO: 16462 - DNA, 201 bp, Homo sapiens
ggaaatgctctcagtctttaataacagtcttaatcgtgtgtagagcagagattgacaaactatggcctgccggctaaatctggcccagtgccttttttttwataaataaagttttattggaatacagacacgttcatttgggtagacgttgtcgatggccgctttcacaacaatagcagagttgagtgatcgtgccagaca

SEQ ID NO: 16463 - DNA, 201 bp, Homo sapiens
aacatgatcccacttaatcctccacttcacaattctgaaaagtcaacaaatttggcccatggtagagaggaggaaaccaagacttgaaacattaaataacrtgtccaaagtctcccatttcagagacaggggcatttggctccaggtttttctgactctagacagtagtttgtttttagcacatcaaatgtctgagacttg

SEQ ID NO: 16464 - DNA, 201 bp, Homo sapiens
ttactgtaaggtatctaagacttctgggtgtgggttttaaatatattttggatgagctttgttcatgtttacacatggccaccaggtcggccacaaagctrtggctctggtcagtctgactctctttagcaggaatcacgtgacaatctgtgtctgtgattagctccgtggatattactaggtagatttctcacttgtcct

SEQ ID NO: 16465 - DNA, 201 bp, Homo sapiens
tactctcctgatagccactaaagggggaattggatattgtctatcaattggttggtctctgaactaaggctgtatctaattacaaggcattgtatcggttstgatttattaaccatttacttggctttggagaaggcagcatttttagtagtactgttgagcctgcatgtagcttttccaggagggcagggtgcctggata

SEQ ID NO: 16466 - DNA, 201 bp, Homo sapiens
gagcctcacactccctggacaaagacatgaaaaactctggatgatttggaagggagatctagaaatggtgaaaggactggcaagtgcctctgtgctgataytgtacctgggctcagtggtctggctaaaggagaggtgctggggccaggtgacaggcgagtctctatacggcaggcccaaaaaatggaggtgcaggcttca

SEQ ID NO: 16467 - DNA, 201 bp, Homo sapiens
cggttgtgatttattaaccatttacttggctttggagaaggcagcatttttagtagtactgttgagcctgcatgtagcttttccaggagggcagggtgccyggatatctgatcttacagttattactttgtgtcatatataattttgttttctccctgcaacaaataaatctttgggactccggaagaaaaaaaaatggga

SEQ ID NO: 16468 - DNA, 201 bp, Homo sapiens
ttctcaattgcaaaagtgaggctggtcatggggcttggaaccacgccacggacgcatgaagcctccccgtttacatgccaaatccagagcttaggcatccrtgctcagggctctctgtggtaggcaacagctggattatttactttctagaatatctcgagttcttaatctgagcagtttcgaaaccaagcccacattaat

SEQ ID NO: 16469 - DNA, 201 bp, Homo sapiens
gagaaggacccggttggctctgcaaaccgcatttccttggctgaacgccagaggagagaaatgatccggcaagaagacacaccattccccgtcagcccctwcccgacccttgcacccctggatcttctgctgagtatcggattggtctgcgtccaagagctcctcgcttggccagcaggggctgcctggagaaggggagga

SEQ ID NO: 16470 - DNA, 201 bp, Homo sapiens
ttctgctgagtatcggattggtctgcgtccaagagctcctcgcttggccagcaggggctgcctggagaaggggaggacaggcttcgagttttttgggtagkgacttctgtggacgtgaaaagactgcaccagaaatcggaggcagccctccaaacataacttggcctcttcgttctccctgtggacacacaggctgtgttc

SEQ ID NO: 16471 - DNA, 201 bp, Homo sapiens
aaaaataatgataaagattgtgtgatcaagtatagcagccctgtggtgtttcctcagaatggtgtattacagaaaaggaaaaagccatatacatggagaaraaactcccgatatttaatattatcaattgctggttcctgtaaatttgcatttatggatcacattataaaagcaattactcttatggattgttcatgcaga

SEQ ID NO: 16472 - DNA, 201 bp, Homo sapiens
tgaagatgctgaggttgagggaagaaataaatgttaatgcaaagtgcccagtttagtgcctgccaagagtaactggtgggtctgtgtcaccttctgacatkatcagtgtgattgtctccaacgcatccatggaagtgaaaccgttggaggaagctaatgccgtgagccagctgttggttatgtttttgttttgtttttctt

SEQ ID NO: 16473 - DNA, 201 bp, Homo sapiens
cccccttcacatacttatactgtgggctgcatcgcttaccaatatttcatctgtttcacttagctgctgttacttactcaataatgtgtggccaatctcamaagatactaattctttttttcaaatgcagcatcgcttgaagctgtgataaaatatcacacctttggaaatcaaggctcttcttgtttatttatttaactc

SEQ ID NO: 16474 - DNA, 201 bp, Homo sapiens
gtaagaggtttgagggaaaaataatactgagttttgagtgtttctgattttaaaaatgtgttcagtagaattaaacgtgttcaccaaaacccattttatcmctttaaattattgggcaattaattgtatttacttagcattgaatgcatgattagaaatggaatttttaaaaaagcaatactcaagtggagtgagttcatt

SEQ ID NO: 16475 - DNA, 201 bp, Homo sapiens
taaatgttaatgcaaagtgcccagtttagtgcctgccaagagtaactggtgggtctgtgtcaccttctgacatgatcagtgtgattgtctccaacgcatcyatggaagtgaaaccgttggaggaagctaatgccgtgagccagctgttggttatgtttttgttttgtttttcttttttacttgctggatagtgggttctgt

SEQ ID NO: 16476 - DNA, 201 bp, Homo sapiens
agtggtggcctacttacagtgcatcgcccactctgatttagatgagcaagagctgctgagttgtagatttctagtttctaaacaacaataagtcttgcccscagatagcctcttagcagagccaaaagccagcagagagaagactcagcatttgctttggagtaagtttgtgtgtgtatgtttatctcccttttactcatg

SEQ ID NO: 16477 - DNA, 201 bp, Homo sapiens
tatccactgccctggtgggggaatcagtgaggctaggaatcactggaaaatgacattccttgagactccttcaatgggtagagtttgctttagcttttcawgtatcttactgtatgatggttgcttttgggttgaattccaccttgggttcaattcaacatgaaagttaaccttttggtgaaggaatgatccacgggaaat

SEQ ID NO: 16478 - DNA, 201 bp, Homo sapiens
atgccgtgagccagctgttggttatgtttttgttttgtttttcttttttacttgctggatagtgggttctgtttattgagaaatatttacatccgtctaawtcaggtgcttgctagggttcttggcacacagagcatcccaccaataaactgtggttcccaacaaggcttgcaactgaatctgggcaacaatgaacatgac

SEQ ID NO: 16479 - DNA, 201 bp, Homo sapiens
ggagtggtggcctacttacagtgcatcgcccactctgatttagatgagcaagagctgctgagttgtagatttctagtttctaaacaacaataagtcttgcycccagatagcctcttagcagagccaaaagccagcagagagaagactcagcatttgctttggagtaagtttgtgtgtgtatgtttatctcccttttactca

SEQ ID NO: 16480 - DNA, 201 bp, Homo sapiens
ttgtcagttcaggagggtagaggataggggggaaaaggtgctactggcatctagtgggcaaaggccagggatagtgctaaggatcctgcagtgcaaaggascatgcccaccacaaaatatcagcagtgccgaggttgggaagctctgtgccattgtgcaaagattcaaggtggctatgtcacaggactggtacatgtcctt

SEQ ID NO: 16481 - DNA, 201 bp, Homo sapiens
ccttgtatctactgctgtcgtttagattaggaacagattgccagatgtggaagaaatagcctcattagtaacttttctgtaagcaatctccttatttcttkttttttgttcttttgttttttgtgtgtgcttctgcgtgcacctcctctatggctccccccaccaaatttctgtgtcttcatttgcaactctcttttctcc

SEQ ID NO: 16482 - DNA, 201 bp, Homo sapiens
tagtttagaatgaaattttaaatacactagtatatgtaattaaaattgtatatacgttttagtcaaccatcagctgacttattcatgttctgtggactctrtggtgggtggggtccaagcctccctgaagcagatctctatcctgtcaccctgctggaaatgaaacacttaggggttagaaggggatcaaggaaagtccga

SEQ ID NO: 16483 - DNA, 201 bp, Homo sapiens
tggatttggcagctggttttgtctggatttgaaagggaggtaatcaggggtgtgctgggagggccagaacgatccacccacgtgttggtgccacccggcartggaaaagcctctggcctcggccttctccggaaggttgtccgcggtgccagtgagagctgcttttcaccttacagcagccccggcctatctctcaggagg

SEQ ID NO: 16484 - DNA, 201 bp, Homo sapiens
tcattatatgcctccaaagactttgtgtttcctgtgtttgacatcgagatagaatttttcataaccctttactagtaataaatttgattgttaagggaccrggttaatcttatttctaataccagcatctgattttaaaaccctgatttaggagcattttctttctgctaccttcctaaaacgcatgggtggaaatgtata

SEQ ID NO: 16485 - DNA, 201 bp, Homo sapiens
gatatccagtatattccatgaaacaaatatcatgaatttattccatgaaacaaatatcgtgaatatattccatgaaacaaaatactgtgaaatcataccastgatttttgaagaaacctaatgaaaacagcatgctcctatatcttttttctgggtgatctttagatatctcgtcttccaaacttttgtgtagcattgtct

SEQ ID NO: 16486 - DNA, 201 bp, Homo sapiens
aagcagaatggaagggaaggatggaaggaagagagggagagacggagggagatggaggatgacagggagatggagggaggcaaaaagaaaaagggagaagkaaagagaggaaagaggggaagggaggaaggaaagaagagagagaaggaggaagagagggaaggaggcacagaggtagagaggcagggagataatggagat

SEQ ID NO: 16487 - DNA, 201 bp, Homo sapiens
aaggggtccctagacatgaagggcctcttcaacctaccttttgttggcttcaaggttatgccatattttgcaaagtcaagttggagatggctctcgatatkcatgagtgtgttagactgcttttcttctattttttaaaaatgcacccaaatgtaaaagacacttttacctttttgatttgatgttgaaggtcatttgaaa

SEQ ID NO: 16488 - DNA, 201 bp, Homo sapiens
cgatgtgttgttttctttgttcttttttttgagacagggttttgctgtcacccaggctggagtgcagtggcagagtctctgtgcactgcagcctccgcctyccaggttcaagtgatcctcctacctcagcctcctgagtagctgggactacagttgtgcgctaccacacctggctaccgtgtcttgttttcaatgcagtat

SEQ ID NO: 16489 - DNA, 201 bp, Homo sapiens
gacaggcgtgagctgccttgcctagccaaataactccattatttaagaaaaattaaccagtatttattgaatacttactgggccctgtgctaagtgctttscatgtgatttctaatttcctgaccattctatgaagtggctactataattatcctgatttcccaggcagagaaactgaggcttagagagttgaagtaatca

SEQ ID NO: 16490 - DNA, 201 bp, Homo sapiens
aaagtcatatcttacatggttggcagcaggcaaagagtgagcttgtgcagggaaactcccccttataaaaccatccgatctcgtgagacttgttcactatsacgagtaaagcacaggaaagacttgccctcatgattcagttacgttccaccggggccctcccacaacacatgggaattgtgggagcgacagttcaagatg

SEQ ID NO: 16491 - DNA, 201 bp, Homo sapiens
ttttttttattattttttgagacagagtcttgctcttttggccaggctagagtgcagtggcgcgatcttggctcactgcaacctctgtcgattctccttcmtcggcctccgtagtagtcaggactacaggcatgcaccaccatagctggctaatttttgtatttttagttagacaccaggtttcaccatgttagccatgct

SEQ ID NO: 16492 - DNA, 201 bp, Homo sapiens
cctcttcattgtccccttcatacaaatagatagcttttagtgagcagctactctgcctggcactgttctaaacacatgacaccaatagctcactcagattsccgcctctcaacagggaaactgaagcacaggaagtttcagtgatgcacttaggcaaccagtaagtggcagggtcggcattgaggtcaagactggttggac

SEQ ID NO: 16493 - DNA, 201 bp, Homo sapiens
aaacccctaaattgtggtgcctcagtgatcttctataacataagttgatagtcaataattgcttaatgggaatcataaatatgagtttatttatatgtgtrtatatatatatatataaaatatatttccatgaatatactgaatgctaagccctccccactttttttttcttttttaaattcagaaatttctagttgtgtt

SEQ ID NO: 16494 - DNA, 201 bp, Homo sapiens
attctacggtggctctttacccattgccatcattttgtaggcagtgagtgcccgcatcagtgggcgttttatgttgcaccattttctgagcaatgtctttsgtccaccattaagcatttgtggccgcccaccccacaatatgctttgctttctgctttcagaaacaatactggtgacctgttttaagaaaagctgaaaagc

SEQ ID NO: 16495 - DNA, 201 bp, Homo sapiens
ccaaagcctgtgtttttcttgctcacatgtgagtcttctccttgcttcaaccctccccgctgacagccacaagactctgcctccctgcagcctgtggaacrtaatattcgttgggatcatacattgaccaaagatccgccatgtctttgcaactaacatactcactcatgacttcacgtggctatgtacaagaccacatct

SEQ ID NO: 16496 - DNA, 201 bp, Homo sapiens
agatttggagtcagatgtcatattcctgccagcaggtttagcagtcgtgggactagggaagtggcaatggcaggagcaactggaaatgtcttttttttttyctcctttttcctgaatatggaaccaaagcctgtgtttttcttgctcacatgtgagtcttctccttgcttcaaccctccccgctgacagccacaagactct

SEQ ID NO: 16497 - DNA, 201 bp, Homo sapiens
atctctcttagattcttatataaattttattgacctaatgttctgtacagtagtccttatttacagttttggtttccaaggtttcagttatacattgtcamctgtggtacaaatatattacttacaatacgatattttgagagagagagaccacatttatgtaacttttattacaatttattgttataattgttctattat

SEQ ID NO: 16498 - DNA, 201 bp, Homo sapiens
tcctttcacaataaccctatccttactgttgaagacttgtggaaaagggacatggcccagggaaccagagtggtttgggaaagcactttgtcaagaggctkggggaccccagggtggaagctgccatgcgcatgaggctgtgttagcagaggcagtggcagaagaagacattgcaaacctgcaaaagcaacctctgaggat

SEQ ID NO: 16499 - DNA, 201 bp, Homo sapiens
ttgacctaatgttctgtacagtagtccttatttacagttttggtttccaaggtttcagttatacattgtcaactgtggtacaaatatattacttacaataygatattttgagagagagagaccacatttatgtaacttttattacaatttattgttataattgttctattattgttgctcatctcttactgtgcctaattt

SEQ ID NO: 16500 - DNA, 201 bp, Homo sapiens
gcacccagcctgtagtttcttatttaatgtctgtccccccttctcttgacagtggtgtttttgccttcacactactgtatccctggtccataccgtaaatkttctgtaaatgtttgtaaatgaatacatgaaagatgaccaggtgctgaatcagtgagagtccttaatgtacttcttatcatttatccctctgaggtaggc

SEQ ID NO: 16501 - DNA, 201 bp, Homo sapiens
taatttataagtatactttattgtaggtatgtatgtataggaagaaatgaaatatatgtagggtttggaaccatctgaggctttaggcatctactgggggwcttggagtatatcccctgtgcagaagcggaggctactgtacatacatttgcctgtaagtgagcgcgttcttggattttgttgaatggtgccactgattat

SEQ ID NO: 16502 - DNA, 201 bp, Homo sapiens
tccctctgaggtaggcaagggattatagtttagaatgtgtaaatacgtaaaagataaggcaaggagacctgctgagagtcacacagcaagcccccaaggtyccccaggctcatggtcaaatgacatgtaagggacgtatccagcggtgtgggtatgtttggagggaatgaatgtaaggagagagaggtgaggcacaggaga

SEQ ID NO: 16503 - DNA, 201 bp, Homo sapiens
aagaaatgaaatatatgtagggtttggaaccatctgaggctttaggcatctactgggggtcttggagtatatcccctgtgcagaagcggaggctactgtayatacatttgcctgtaagtgagcgcgttcttggattttgttgaatggtgccactgattatgggtcagagcttgttgaaagggtattaatccattatttact

SEQ ID NO: 16504 - DNA, 201 bp, Homo sapiens
tacgtaaaagataaggcaaggagacctgctgagagtcacacagcaagcccccaaggtcccccaggctcatggtcaaatgacatgtaagggacgtatccagyggtgtgggtatgtttggagggaatgaatgtaaggagagagaggtgaggcacaggagagacaggatgagctttagaggtagacagctctcgggtccagccc

SEQ ID NO: 16505 - DNA, 201 bp, Homo sapiens
gtccctttttcttggaatgtcagcctgaccctgaaggtattctcctaccagcagagccttctttgatgccccgtcttcaacctgccatgttttcccatctstgaggcttctattttagagacttttcctccagaactggcttatatcatcctgtgttgctgcatccgatcacaggtctgtggctgacctgggcagcgtagt

SEQ ID NO: 16506 - DNA, 201 bp, Homo sapiens
aaccctccctaagcagctattgagcctcacactccctggacaaagacatgaaaaactctggatgatttggaagggagatctagaaatggtgaaaggactgscaagtgcctctgtgctgatattgtacctgggctcagtggtctggctaaaggagaggtgctggggccaggtgacaggcgagtctctatacggcaggcccaa

SEQ ID NO: 16507 - DNA, 201 bp, Homo sapiens
ctagatgcttaagaaatgttaactactattgttattggcttgcagtagaaattaaagattatgaatgttcagcattcagaatatactagatactcaataascattattgctgtcattattaacattattttccccagctttactgaggtatgagtgacaaaaatttcatatatgcgcatgagtgtgtgtgtgtgtgtgtgt

SEQ ID NO: 16508 - DNA, 201 bp, Homo sapiens
cctaagagactctcagtaaccagcagtcatcaccaccgtcgtcgtctttttttttggccattacagttgggattagactaaccctccctaagcagctattragcctcacactccctggacaaagacatgaaaaactctggatgatttggaagggagatctagaaatggtgaaaggactggcaagtgcctctgtgctgatat

SEQ ID NO: 16509 - DNA, 201 bp, Homo sapiens
cgaatcacgaggtcaggagattgagaccatcctagctaacatggtgaaaccctgtctctaccaaaaatacaaaaaaattagccaggcgtggtggtggggcscggtcgtgggtgcctgtagtcccagctactcaggaggctaaggcaggagaatggcgtgaacccgggaggtggaggttgcagtgagccaagatcgcaccac

SEQ ID NO: 16510 - DNA, 201 bp, Homo sapiens
cattacacgtcaacaagaatatgggttttgaacccagacctcagtttgaatctgagttccagcactgccccgttgcttggccgtgagttacttcacctccwttagcctctgtctcccctccactacaataacacctgcctggtggggagtgaggatattgtgcgaatcagaagtaataacaggtcgttggcacctaagaga

SEQ ID NO: 16511 - DNA, 201 bp, Homo sapiens
gcaccactgcactccagcctgcgtgacagagcgagactccatctcaaaaaaaaaaaaaaaaaaaaaaggctgtgtgtggtgactcgtgtctattgtcccasctacttgggaggctgagacatgaaaatcacatgaacctgggaggtggaggttgcagtgagctgacatcgcatcactgcactccagcctgggtgacagagt

SEQ ID NO: 16512 - DNA, 201 bp, Homo sapiens
ccacgcctggctaatttttgtatttttagtagagatgaggtttcaccatgttggccaggctggtctcgaactcctgacctcaagtgatccacctgccttgscctcccaaagtgttgagatcacaggtgtgagccatggtgccaggcctctcctgtctttaactggggataatgtgtgcagaattccccctaaaggatctat

SEQ ID NO: 16513 - DNA, 201 bp, Homo sapiens
cgagactccatctcaaaaaaaaaaaaaaaaaaaaaaggctgtgtgtggtgactcgtgtctattgtcccagctacttgggaggctgagacatgaaaatcacwtgaacctgggaggtggaggttgcagtgagctgacatcgcatcactgcactccagcctgggtgacagagtgagactgaaaaacaaaaaaacaaaaaaaaac

SEQ ID NO: 16514 - DNA, 201 bp, Homo sapiens
aagttatgcttcccagcctctaggaaagcataggagttaaggagaactgaaatctggggcagttataaatcttcccttatgtgtacaacagtttaaatcarttggtcatctaccaaaatctgaggaacaagagcagctttagaaaatgggctgggcatggtggctcatgcctataatcccagcacttggggaggccaagac

SEQ ID NO: 16515 - DNA, 201 bp, Homo sapiens
gcacctcatcaatgtattttttctgccttgctttatagtgttttaaatccgcctcggcctttgttcctgaatgagcacccgagaaggggagaaagtgactmtctggccttagtatgtgtaacaaattatttaatgaacatttaaccaagatttgcaattcccctagttttatcttcccggtttccttttcttctgtgtgcc

SEQ ID NO: 16516 - DNA, 201 bp, Homo sapiens
gcagacactgtgaatcaaacccaccccctgcactgcccccctccagtgagcgagttcttgaacacttactggtacaccactgtcaccaaccctgctttttrtagacatgtcctttaagcaaagcaattcatgggaaagtaaatttaattatcagaccatttcattagattcctcactgccacaaacaggtggttgtggtga

SEQ ID NO: 16517 - DNA, 201 bp, Homo sapiens
agaacagtttaacttgaaaggaaataaaaaaaggagactaacatgggcccacagacattgtatttcataaattttggatgaaaactgaacctaccatcatktattaagagaatggatattttcatgtcagaaattataggaaggatacagttatgggatgaggagcaattcttttttttttttttttgaggtggagtctca

SEQ ID NO: 16518 - DNA, 201 bp, Homo sapiens
ttcttatttggagatgctgttcctctcaagtgggaaaaatttggttatctcaggtggtaaagatgcctttgtttaaaatattcttctgttagtggggacawtaatactactaatttctagtactgacgcttctcatgcaatttaatcagtaggaacctgtttgcatgttcatttgaggaagtaccaaagccaaaagtagct

SEQ ID NO: 16519 - DNA, 201 bp, Homo sapiens
ccctggacctcgctctgctccgtagcgtgcagcattttgctgaagcattcaaggccaagaatgtgtgagtgttccagtggagggttatagatcataatttyttgctattgtaatatctttatcagatgaacacaattgggagaatgcaaggctgttgtgttgtcttggcgtccaaacaggaggctcatttatattggccct

SEQ ID NO: 16520 - DNA, 201 bp, Homo sapiens
attgtgagccacacatgcaagggatctaggctgcatgctccttacgaaaatctaatgcctgatgatctgtcactgcctcccatcaccttcaagatgggatygtctagttctaggaaaacaagctcagggctcccaccgattgtacattatggtgagttggataactatttcattatatattacaacgtaataataatagaa

SEQ ID NO: 16521 - DNA, 201 bp, Homo sapiens
ccataacacatttactgtaacttgataccatgaactacacttgctgttatttatcatttctttttattttctctcattgcagcataaagccaaggtagaarcaatgaccctggacctcgctctgctccgtagcgtgcagcattttgctgaagcattcaaggccaagaatgtgtgagtgttccagtggagggttatagatca

SEQ ID NO: 16522 - DNA, 201 bp, Homo sapiens
tgcaaatgtgtgaggaattatagttgaaaggggaaagaacatttcagtttttcatttcctgcgtcactgtttttcttatttggagatgctgttcctctcamgtgggaaaaatttggttatctcaggtggtaaagatgcctttgtttaaaatattcttctgttagtggggacaataatactactaatttctagtactgacgc

SEQ ID NO: 16523 - DNA, 201 bp, Homo sapiens
cacacatgcaagggatctaggctgcatgctccttacgaaaatctaatgcctgatgatctgtcactgcctcccatcaccttcaagatgggattgtctagttstaggaaaacaagctcagggctcccaccgattgtacattatggtgagttggataactatttcattatatattacaacgtaataataatagaaataaagtgc

SEQ ID NO: 16524 - DNA, 201 bp, Homo sapiens
aaattagttatctctgccctttgggaggctgaggcaggtggatcacttgaggtcaggagtttgaacctagcctgggcaacatggtgaaaccccgtctgtascaaacatacaaaaattagctgggtgtggtggcgtgcctgtaatcccagctattggggaggctgaggcaggagaatcactcgaacccgggaggtggaggtt

SEQ ID NO: 16525 - DNA, 201 bp, Homo sapiens
caagaagtgtgttttggggaaacactccaggtagtggtacatagaatcctagcacaagatcagtgactgggtgagtttgacattgtagatgcaaatgtgtsaggaattatagttgaaaggggaaagaacatttcagtttttcatttcctgcgtcactgtttttcttatttggagatgctgttcctctcaagtgggaaaaat

SEQ ID NO: 16526 - DNA, 201 bp, Homo sapiens
cctgtaggtttagcagaatcccagcctcacatcctccccgaacttggcagtaaaagccctgttcttccattcattccgatgatttatattctctctgggcrtcttatattaaacaggggaattccgacatgttccataacacatttactgtaacttgataccatgaactacacttgctgttatttatcatttctttttatt

SEQ ID NO: 16527 - DNA, 201 bp, Homo sapiens
caaaaattagctgggtgtggtggcgtgcctgtaatcccagctattggggaggctgaggcaggagaatcactcgaacccgggaggtggaggttgcagtgagycgagatcacaccactgcactccagcttgggaaacagagtaagactccatctcaaaaaaaaaaaaaaaaaaaagttattgattaaaatttaaatataaatt

SEQ ID NO: 16528 - DNA, 201 bp, Homo sapiens
aggagggactcataggacagcctagcatctgaggaaatgagtgcctcctggcccagaatgggggatctcagcagcacactacaatatccactacagtttcytgggcttgctctgaagccatgcctctctaacttcagggtatattcatgtaagtgaggtgcagggatgggggaaagggagaaggtaaagctacaaaggtaa

SEQ ID NO: 16529 - DNA, 201 bp, Homo sapiens
aatggtgaataccctcggcgggaggcaggcacctgatgccactgcccccgccccacctgcccccgccccgtttctcagatcacacaggcaggctgaggagygcttaacaccccagcctcccatgaagcatcctgaaaaagcagactttgtcttcctccatcagctttgtttgtcctctgccgagactccagggacatgatt

SEQ ID NO: 16530 - DNA, 201 bp, Homo sapiens
tgggagatgagttaagaggttttattcttatacatgcggaagaattatgccttcttgagccatgctcaggagatgtcagccttttccattgtctccccgcycccaccgccagccctgcttaaattatcccctctttttaaacagaatatcctaatcttgcaagtggcatatcatgttccttcttttttaagagagaaggag

SEQ ID NO: 16531 - DNA, 201 bp, Homo sapiens
aaacagaaaccactttcagctttcccgttccagggttaagtgcccaagcaggtgttgtttctgttatgtggtttgcagtgagcaaaaccaccccctcttamctgtggcagcaaaggcagggagactttgagacctggggagggctctctgctgtgttaacagaactggctcttggttggggggtggggggcacccattctt

SEQ ID NO: 16532 - DNA, 201 bp, Homo sapiens
attatgccttcttgagccatgctcaggagatgtcagccttttccattgtctccccgcccccaccgccagccctgcttaaattatcccctctttttaaacaraatatcctaatcttgcaagtggcatatcatgttccttcttttttaagagagaaggagaaattcctgcagatcatcagggactgaggctaactgaaacttt

SEQ ID NO: 16533 - DNA, 201 bp, Homo sapiens
gttgtcacattcttctgcctagagtatgccttttccttcaccaaaccaagtggctctttcggaagacttgcctgaatcctagaccccttctctctacaacmttcagtctgagttgggtaccttgcatcctcctttgttcccatactaacccctacaaccatggtcattttgtggttatctgtttaattctctgctggctat

SEQ ID NO: 16534 - DNA, 201 bp, Homo sapiens
gatcttaccctgacagtcacagaaagcactgggagcgtttatgaatgttgtggtatctcacataataaggggaccatgcatgtattttagaaagagccctytggcttcagggaagaacgatggatttgtgagggtcaggactggtagcaggtgggctcctagaatagtcccggcaagagatcatggaggccagagccaggg

SEQ ID NO: 16535 - DNA, 201 bp, Homo sapiens
ccgggaggattttcttttctttttctttttaatcctcctcctcaagggaaacattcttctcacaatagcttcctggtagaaagttctaactaatgactttratcgtgtgaatgtattgcagaaatggacaggacaattctcagcccattcatcttacagacctcaagtgaacaggcacaaaacaacaggctccaccctcct

SEQ ID NO: 16536 - DNA, 201 bp, Homo sapiens
ttttcttttctttttctttttaatcctcctcctcaagggaaacattcttctcacaatagcttcctggtagaaagttctaactaatgactttaatcgtgtgmatgtattgcagaaatggacaggacaattctcagcccattcatcttacagacctcaagtgaacaggcacaaaacaacaggctccaccctccttcccccctc

SEQ ID NO: 16537 - DNA, 201 bp, Homo sapiens
tcctcctcctcaagggaaacattcttctcacaatagcttcctggtagaaagttctaactaatgactttaatcgtgtgaatgtattgcagaaatggacaggrcaattctcagcccattcatcttacagacctcaagtgaacaggcacaaaacaacaggctccaccctccttcccccctctatctcatactttacctcaattt

SEQ ID NO: 16538 - DNA, 201 bp, Homo sapiens
tgtgaaaactgtgaagacataacacatatctatgaaccttttctattaatcttcttggggctggagctttaaaataaaataaataacttttctgcagagasagaacctttccttacccaaagatttcgtaactttctcacatccttggttaaggctgagctgcctagctgtctgcatttctgataggttttgctttcatac

SEQ ID NO: 16539 - DNA, 201 bp, Homo sapiens
gaaggatatcctttcaatagaggtgaaaatcctgaaataaaaggtttcataaatggggaaaaaagtcattgattgaaagagtcatggcatagatgctgaasttttgatgggaactttgcaggatgttcgtttgtttatcattagccctgggagagtcatccctcgcctcccaccaccccttaatttaaagggatttaaaat

SEQ ID NO: 16540 - DNA, 201 bp, Homo sapiens
gcaagtaaagaattataattaagagaaccagaagggcctgtctctcaggaaagcagtgatttcctttcacaataaccctatccttactgttgaagacttgyggaaaagggacatggcccagggaaccagagtggtttgggaaagcactttgtcaagaggcttggggaccccagggtggaagctgccatgcgcatgaggctg

SEQ ID NO: 16541 - DNA, 201 bp, Homo sapiens
cacatttcaaatcttcagtagccagatgtggttattggctaccatattgggtagcaccgatatagaacatttctaccatagtagaatgctcttttggatasatctgctttaaagcattagtccccaaagtgtgaaggatgaaccacttgggttccgagaggaaacattataacttctgtttatccattaaactctttcatt

SEQ ID NO: 16542 - DNA, 201 bp, Homo sapiens
ccaaagtgctgggattataggcttgaaccaccatccctggccttgatactgatattttattgtcctaactgacagttttgtctgcccagcattttcccccrtcacccttgtactatcccattttcctttgccatgcacctgtcttcctcttcaggattgatcacaaaatcaaaaccattcctaccagccagaggtgggcac

SEQ ID NO: 16543 - DNA, 201 bp, Homo sapiens
caaaccaggtgtcattgccctccccaccctaccttgctcccctggagtgtatcctgattcttttgaggatcacttgatcctgattttttttttatgtgtawagatgggatttcattatattgcccagactggtcttaaactcctggcctcaagcaatccagccacctcggcctcccaaagtgctgggattataggcttgaa

SEQ ID NO: 16544 - DNA, 201 bp, Homo sapiens
cgaatatttgggacccactgggagtttgtgccaaaccaggtgtcattgccctccccaccctaccttgctcccctggagtgtatcctgattcttttgaggawcacttgatcctgattttttttttatgtgtatagatgggatttcattatattgcccagactggtcttaaactcctggcctcaagcaatccagccacctcgg

SEQ ID NO: 16545 - DNA, 201 bp, Homo sapiens
ctttagccaaggaagaaatgacaacgaatatttgggacccactgggagtttgtgccaaaccaggtgtcattgccctccccaccctaccttgctcccctggrgtgtatcctgattcttttgaggatcacttgatcctgattttttttttatgtgtatagatgggatttcattatattgcccagactggtcttaaactcctgg

SEQ ID NO: 16546 - DNA, 201 bp, Homo sapiens
cagttgtaacagtggtatgtgtatatctcaacatatctaaacatagaaatagtacagtaaaaatatgatattataatctttgggaccgccatcatatatgyagtctgtcattgactgaaagttgtcatgtagcccatgactgtcgtctcttttaggggaaaaaacaaaagcagaaagcaagcaagctggtatcctgcgtat

SEQ ID NO: 16547 - DNA, 201 bp, Homo sapiens
tgagtctcagctgaccaagctctaaaatgagcataaccatatcagtttgtgtttcctgttacagggagaaaagactgagataactaaagtacctgattgastaactgctctctgaaggtggaggctggactgcttcactggacagggtggcctggggttattctagtgcagtggtagctggtgacaaaactcaaagaagat

SEQ ID NO: 16548 - DNA, 201 bp, Homo sapiens
caagggaacctttccccaaagcccctcaacacacttaggctgacatctccttgaccagaactgtatcaaatttacatagcctcaaatgaagcatctgggamcaccaggattgggtgtttaggccatggaagagtaacagcccagtacacaactgtctccagtggccagcacgtagaccttccctcacactttccactctct

SEQ ID NO: 16549 - DNA, 201 bp, Homo sapiens
taaggcagatggaaatgtcttgtaactcagtaaaacagtttagaaatttaaagcctttggagagagtaagtattgagaaggcacatctctacgttgttgaygtgaaggagttgcaaggtcgggtagatgggatcagtgccaggtctaatgggcttcatttgcaagacctaatttctagcagatcatggtgtaagcctcaaa

SEQ ID NO: 16550 - DNA, 201 bp, Homo sapiens
gtctcccatttcagagacaggggcatttggctccaggtttttctgactctagacagtagtttgtttttagcacatcaaatgtctgagacttgtgatgtgtyagaaagcacaaaggactttgatcacaagatcaagccccagagggccatgactgcataaaccacaacaactgcgtggctgcctgtcacgtcttcatctgca

SEQ ID NO: 16551 - DNA, 201 bp, Homo sapiens
tgcttcttacgtgtcacgcactgtgataagtcctaggattatagaagtcaataagctatgatgcctatccttaaggagagaaacacatataggataggaamatagcttgccatgtctgatagatattaggcattcagtctctctctctctctctctctctctgtttattatagatagaaataaaaaaattataaatagaaa

SEQ ID NO: 16552 - DNA, 201 bp, Homo sapiens
ccatcatttattaagagaatggatattttcatgtcagaaattataggaaggatacagttatgggatgaggagcaattcttttttttttttttttgaggtgsagtctcactctgtcaccaggctagagtgcagtggggcgatctcggctcactgcaaacctctgcctcccgggttcaagcaattctcctgcctcagactccc

SEQ ID NO: 16553 - DNA, 201 bp, Homo sapiens
tattaagagaatggatattttcatgtcagaaattataggaaggatacagttatgggatgaggagcaattcttttttttttttttttgaggtggagtctcaytctgtcaccaggctagagtgcagtggggcgatctcggctcactgcaaacctctgcctcccgggttcaagcaattctcctgcctcagactcccgagtagct

SEQ ID NO: 16554 - DNA, 201 bp, Homo sapiens
cgatctcggctcactgcaaacctctgcctcccgggttcaagcaattctcctgcctcagactcccgagtagctaggactacaggcgcgtgccaccacacccrgctaattttttgtattcttagtagagacgaggtttcacggtgttagccaggatggtctcgatctcctgacctcatgatccacccgcctcggcctcccaaa

SEQ ID NO: 16555 - DNA, 201 bp, Homo sapiens
aggaggtcaggaagtcattgatgtgggctccctcctggagtgcgtgttgctttggtagggagctcgctttggctgtgggcagttcctgaggagggactcayaggacagcctagcatctgaggaaatgagtgcctcctggcccagaatgggggatctcagcagcacactacaatatccactacagtttcttgggcttgctct

SEQ ID NO: 16556 - DNA, 201 bp, Homo sapiens
ccaccagccttggcctcccaaagtgctgggattacaggcattagccaccacacccggcccaaattttcttataaagtcaaatgggagatacttgtttgcargaaatagttcttttggttcttacttttccataaggattgagtctcaaaatgtctggtagcatccactgcattttgtaggggacaataacaaagaagatgc

SEQ ID NO: 16557 - DNA, 201 bp, Homo sapiens
ctgcgtactgtaggcagttgtaacagtggtatgtgtatatctcaacatatctaaacatagaaatagtacagtaaaaatatgatattataatctttgggacmgccatcatatatgtagtctgtcattgactgaaagttgtcatgtagcccatgactgtcgtctcttttaggggaaaaaacaaaagcagaaagcaagcaagct

SEQ ID NO: 16558 - DNA, 201 bp, Homo sapiens
ctgtgctgtgggagatgcgaatgctccagtcaatcccaaggaaactctgaagctggattattcttcagagatgcaaggaggtcaggaagtcattgatgtgsgctccctcctggagtgcgtgttgctttggtagggagctcgctttggctgtgggcagttcctgaggagggactcataggacagcctagcatctgaggaaat

SEQ ID NO: 16559 - DNA, 201 bp, Homo sapiens
tgcagtttgctgatccctgttttattaattagttaatattattgattgagatagggtctcactgtgtcacccaggctggagtgcagtggtgcggtcacagstcactacagcttcaacctcctgggatcaagcagtcttcttgccttagccacccgagtagctggatgacaggtgagcaccaccatgcctggctaattttct

SEQ ID NO: 16560 - DNA, 201 bp, Homo sapiens
atgctaaccaggatggtctcgatctcctgacctcgtgatccaccagccttggcctcccaaagtgctgggattacaggcattagccaccacacccggcccarattttcttataaagtcaaatgggagatacttgtttgcaagaaatagttcttttggttcttacttttccataaggattgagtctcaaaatgtctggtagca

SEQ ID NO: 16561 - DNA, 201 bp, Homo sapiens
ttggagccaaagccaaatagtgctctgtaaacattatgatttgtcagtaatcaatgtgatttgtataatttgtgagcaatcagatactttatccaaaagcrgattattgacctctgtgcccatcttgggagaaattgccacttggtctgtgtctacacagacccaagaggagaagggatttgacaatggtctgattaattg

SEQ ID NO: 16562 - DNA, 201 bp, Homo sapiens
gtgcggtcacagctcactacagcttcaacctcctgggatcaagcagtcttcttgccttagccacccgagtagctggatgacaggtgagcaccaccatgccyggctaattttctaaattttttgtagagacaaggtctcactgtgttgtccaggctggtctcaaactcctgagctcaagtgatcctcccgcctcgacctctc

SEQ ID NO: 16563 - DNA, 201 bp, Homo sapiens
gggctggatttgtcctgtggactgtagtttgctgacatccaggctagatccttaatatacaatgaagtagtaaaacacatgtaaaagtaaaaagcaggcgwaatagaataaaatacacatttgcacaccacagtatccaaaaaggttatgtactggggctaaagatttggcttggagtttcctggtagtcaaggcaaaaaa

SEQ ID NO: 16564 - DNA, 201 bp, Homo sapiens
actttttatttcctttgtggagtccagcccctttgcttattctcagcacaaaagaggcagtagagtgagaagaacgtgaacttcagagcccacgcatcccktttcacatttgaatcgcaactctgtcattcaccagctgtgcatccttgggaaagtcacttagcctctctgagctctaatttcctcacagggccgcaggac

SEQ ID NO: 16565 - DNA, 201 bp, Homo sapiens
tgcggtcacagctcactacagcttcaacctcctgggatcaagcagtcttcttgccttagccacccgagtagctggatgacaggtgagcaccaccatgcctrgctaattttctaaattttttgtagagacaaggtctcactgtgttgtccaggctggtctcaaactcctgagctcaagtgatcctcccgcctcgacctctca

SEQ ID NO: 16566 - DNA, 201 bp, Homo sapiens
gcctctcactttttatttcctttgtggagtccagcccctttgcttattctcagcacaaaagaggcagtagagtgagaagaacgtgaacttcagagcccacscatcccttttcacatttgaatcgcaactctgtcattcaccagctgtgcatccttgggaaagtcacttagcctctctgagctctaatttcctcacagggcc

SEQ ID NO: 16567 - DNA, 201 bp, Homo sapiens
gattcctgttttacatattaaaaatttcatctctccaatcttcgaagaatccgtagtccatttttaagtagctcttgtcttccaaaggtatgggatgtgcmtacctaatgctcttcctggatgggagaatattaccaaaaacgtttggtcgactaattttatgacagtttccaactacaatttttttcctctttgctttct

SEQ ID NO: 16568 - DNA, 201 bp, Homo sapiens
atggccgctggaaaagaagccaactcccagggggcacgaggggctaagctgtctcctgggaagtttgagggaggccaagtgttttccagttcatttccaaygcgtatttcttcagggccaagggcccagctgtgcctcattaggggtgagagtttggctgtgacacgacttaatagaaaaaaaaaaaaaaaaaggagaagt

SEQ ID NO: 16569 - DNA, 201 bp, Homo sapiens
tgcttctagctggtcgaaggtcctgtgggagctcacgtttttctcaatcactgatgaccatttgagacataatttggagaaggtttctatcaaatcctagytggactgcagtgaaatgttttcaaactagagaagcaccaaataggccatgataaagaataaataccacctaccccaacctggcaaatgtgtgctcaccca

SEQ ID NO: 16570 - DNA, 201 bp, Homo sapiens
tcttctccctctccgttaaaatgcaacttaattggtaaagtttagttgactagagatttcatttatttatttatttatttatttatttatttatttgtttrtttgtttgtttgagatgagtcttgctcttttgcccaagctggagtgcagtggcatgatctcggctcactgcagcctctgcctcccgtgtccaagtgattc

SEQ ID NO: 16571 - DNA, 201 bp, Homo sapiens
ggctggagtacagtggcacgatctcagctcactacatctctgcctcccgggttcacgccattctcctgcctcagcctcctgagtaggtgggactacaggcmcccgccaccatgcccggctaatttttttatttttagtagaaacggggtttcaccatgttagccaggatggtctcgatctcctgacctcatgatctgtcag

SEQ ID NO: 16572 - DNA, 201 bp, Homo sapiens
tctcccgtctctgcagttcaggagattatattagaaaatattctatacaaaaaatatgcatagtagggcttttctccagctagtagctcagaataagtcaktactactgaaacaggtaccttttgtggaattgattctgaaatctgtttggatctgaaatctttctttcttgcctttgagtaagatacggcagagaaaaac

SEQ ID NO: 16573 - DNA, 201 bp, Homo sapiens
tggactattttgccaaatgcatttttattggtagaacgtaagcaaatttaaaaaagcaacaaaagcagtttttatgaatacctagcgtactttttttttttaatgaaccatgagctgtttttgcattcaaattctcgtaggcattatattgcatctacacataaggacacagtgtttacagaccccaaagcttgctgtccc

SEQ ID NO: 16574 - DNA, 201 bp, Homo sapiens
cccgtctctgcagttcaggagattatattagaaaatattctatacaaaaaatatgcatagtagggcttttctccagctagtagctcagaataagtcagtaytactgaaacaggtaccttttgtggaattgattctgaaatctgtttggatctgaaatctttctttcttgcctttgagtaagatacggcagagaaaaacaat

SEQ ID NO: 16575 - DNA, 201 bp, Homo sapiens
ttttgttcctgcattgccctccattcagatcttgtcacttaggccttggtagcatgagctattaacagccctccatatttactatttttttttttttttttaactctgggagttcctgttgcagaaattggatcacttacctaaaaagctccccacccccacctttggtgactggtgggtttcatcaccaggaaagcacat

SEQ ID NO: 16576 - DNA, 201 bp, Homo sapiens
gactgcaactgaaaagaggagtaatggaaggacatgtactcttcccatatatttttaaacaattactgtatctgatttttcatttttcattttttttttttctggaagaaagagcagatctggataaagtcagtatacaatgtggtctttggtgacagacccaagttcaagaccaaggtgtatgcatgggtttgttcaagt

SEQ ID NO: 16577 - DNA, 201 bp, Homo sapiens
gctcagaataagtcagtactactgaaacaggtaccttttgtggaattgattctgaaatctgtttggatctgaaatctttctttcttgcctttgagtaagayacggcagagaaaaacaattacactagctgctggtctgtatttactggttagaatagaatattattaccatcaagaataacattagtggccaggtgcggtg

SEQ ID NO: 16578 - DNA, 201 bp, Homo sapiens
acttagcagttcacattcacatcttgtttattaactacaattctctagatcagaagcctagacacaatgtgactggcttctctgctcagggtctcttgggkacaaaataaaggtgtccgctggaggaacatcctttcctgcatgctctgtggaagaatccactgccaagctcattcaggatgctggcaggattcagatcct

SEQ ID NO: 16579 - DNA, 201 bp, Homo sapiens
tggcaacctttggtgtttggggcatgttgtcacctcattgccatctctgcctctgtcttctcaccaccatcttccttgtccatgtctctctatgtcttcartgttcttcttataaggacaccagtccttggatttagagtccaccctaattcactgtaatcacatcttacctaagtccatctgcaaagaccctatttccaa

SEQ ID NO: 16580 - DNA, 201 bp, Homo sapiens
cacttgtgacagagggaggaacatagggtgcataagagagatgtggggaagcactccccatccaactcgttccaaccagttcatcttttttttttttttttcttttttcgagaaagagttttgctcttttccccaggctggagtgcagtggtgcgatcttggctcactgcaacctctcccttccaagttcaagcaattgtc

SEQ ID NO: 16581 - DNA, 201 bp, Homo sapiens
actgccaagctcattcaggatgctggcaggattcagatccttgaagttgtaagactagggcccctgtttcctactgacttctgctggtggctgccctcagytcccagaggcaacccacattccttgacttttggccccctgcatctcaaagccagcaacagaaactctcttgtgcatggagtcccctcctgctttgaatct

SEQ ID NO: 16582 - DNA, 201 bp, Homo sapiens
cactagggggatggtgattagaaagcacctcatgatcccgtctacttcctgcagagaacagactagccccctatgcagcacacacctttgtgaggtccctyctccaacacagggattacaattcaacctgagacgtgggtggggacacagagccaaaccacactggaaggtaaaaaagttggcaaccagaggcttagagga

SEQ ID NO: 16583 - DNA, 201 bp, Homo sapiens
cttcaagtcagttacttaatggaataatacatgtttcctgcttccattgtcttcctggacctgacactcactctttaaccataagcagaagacacatacamaaatgtcctatgttaagaatctttatttaagacaggtggctagcattatttgggtccagaagcttccctggaaagaaaggattcactgcaagatcgacag

SEQ ID NO: 16584 - DNA, 201 bp, Homo sapiens
aaaatggaaaactccaggggaagagggtctttacttagggagttggcatttgttggaatttcccaagaacatttcatgattagtgacaggttatcttctastttacctgaaggctatggtcactcaacaaattttgtgttgcttcttacgtgtcacgcactgtgataagtcctaggattatagaagtcaataagctatgat

SEQ ID NO: 16585 - DNA, 201 bp, Homo sapiens
aaataaagacttgtgaaggtaaaactgtagcttacagtgtgcgactgtttaccttcttttggtttcttctcatttaataggttggtcatctctctgctggstttttcccccttttttctcccttctgtagaataacatgtggaccattaactatgatgctacttcttagctgcaaggggggaaaaatggaaaactccaggg

SEQ ID NO: 16586 - DNA, 201 bp, Homo sapiens
agaggaggaggaggaacttctcaggaagaagtggcagttccctcctttgtttcttatctctactgtttagcagccactctccaaagcctcttgctgggaaygtggccatcatagaagtaaatgagacatctctttcatctgcaccaacctccttattaagaccttatcagttacctgtagattctcccactgttgtacttg

SEQ ID NO: 16587 - DNA, 201 bp, Homo sapiens
gaaacaattcagcaactctcttacagatttttatcatcatcccattcataattgattccaaacgtgcatgaatctttcaagataagtgtcttattgattaycctgaaaacaagcgatcacttggtgtcctgagattcgctcactgccctcccctgattaccgtaaacagagatgttgatgagaagaaatgtcactttcttt

SEQ ID NO: 16588 - DNA, 201 bp, Homo sapiens
ccttttttagagataaagcctcaccctgttgcccaggctggagtgcagtggcgtgatcacagcccactgtagccttgacctcccaggctcaacctatcctyttacctcagcctcttgagtggctggaaccacaagcagatgccaccatgcctggctaactttttttttttttttttttttttgtagaaacagagtctctct

SEQ ID NO: 16589 - DNA, 201 bp, Homo sapiens
tatagcatctgaatttgaaaacctctactaattcatgaggcaatctatttgataatggcatgatttagttagtgttccttttttagagataaagcctcacyctgttgcccaggctggagtgcagtggcgtgatcacagcccactgtagccttgacctcccaggctcaacctatcctcttacctcagcctcttgagtggctg

SEQ ID NO: 16590 - DNA, 201 bp, Homo sapiens
aaccttacctactcaagtgtaagatgagatgccactgtggtatcttcaaaggaatttagaatcatgtcttaatggctccattaagaagaattctttttctsttttctctgaaaagcatcccaggtcataaaatgtaatgtgggattgtaggttttgtgggaagatgcacttggcagcaattccttgagaggaggccttgaa

SEQ ID NO: 16591 - DNA, 201 bp, Homo sapiens
tcaaatgcgcgtttaatcttcttaagctcaacttcatgcaagagacctaggaattcacagagtgaagatgatttctccattcccttctccgagcagagctsttgaagaagatgggagttaggagaagtgaatcttttgttttcgaagcctttgtccttgtgagtctcttaattggggtgtcttgtaatgcaaagtctttaa

SEQ ID NO: 16592 - DNA, 201 bp, Homo sapiens
ataagtctaatttagtagccagctaaaggatatctgtgaacccttcgcaaagagtaatctattgaaaaggaacaacaaaaaagtatatctgtgaacttatkaaatgactttaatcatatgaaaatcagccatcagccttattagagtggttgattttttttttaatctaagagctttcttggttattttctgttcttaatc

SEQ ID NO: 16593 - DNA, 201 bp, Homo sapiens
tgcttacttgacttggaccagggtggtgaatgaacataaaaaccgattacaacatttttccatttttatgtttcctctgaaaccagccatgagaggtactsttagcaaatcacgccttattcctaggcagacttcttgggtacactttccaccctccccagcagtaatgcctgaccaactaatggaatcctaactaatgca

SEQ ID NO: 16594 - DNA, 201 bp, Homo sapiens
gaacaaattgccaaatgcaaggcctgagcaaaagacacagaaaggatttctttatcgtaagcacacttctctacattacctttataatccaacaactctgstattagtaaattatagaaacaacttttgtaacactatcttgtttgcagagtatatgaaaaatttgaagttaaaattcagctccacgaatactgcagtggt

SEQ ID NO: 16595 - DNA, 201 bp, Homo sapiens
tactgttagcaaatcacgccttattcctaggcagacttcttgggtacactttccaccctccccagcagtaatgcctgaccaactaatggaatcctaactawtgcagtatgtgacgcctggcagctccagtccgaaccaagggaaaacctgcaaacatgcaatccttcatgcttttgtttttgtttttccttcagcctagct

SEQ ID NO: 16596 - DNA, 201 bp, Homo sapiens
ctattgtgcacttttgcccagttcaacaagaaagaatctttgctatgttagaagagactctggggaatccagagtcttggtcacgggtacatcaaaacgaygctggtgcctaacttctagttccagacaaagaaggagagagagagagatcagtaatttataggctgacattttccttgggtccttataatacttgtttat

SEQ ID NO: 16597 - DNA, 201 bp, Homo sapiens
tagaagagactctggggaatccagagtcttggtcacgggtacatcaaaacgacgctggtgcctaacttctagttccagacaaagaaggagagagagagagrtcagtaatttataggctgacattttccttgggtccttataatacttgtttattacagataatttgcttaagtgtgcacaaggtggaaggtcacgcaagga

SEQ ID NO: 16598 - DNA, 201 bp, Homo sapiens
atttccacccccattatttgcataacaaattacagattatccagaacaggtgggctgtacataaacaggctggtgggctggatttgtcctgtggactgtastttgctgacatccaggctagatccttaatatacaatgaagtagtaaaacacatgtaaaagtaaaaagcaggcgaaatagaataaaatacacatttgcaca

SEQ ID NO: 16599 - DNA, 201 bp, Homo sapiens
ctcttccccacttgcccacgagcagcaactcctgtttcttgtttttttccttttctttttcttttcttttgagacagagtctcgctccgtcgcctgggctrgagtgcagtggtgcaatctcagctcactgcaacctctgcctcctgggttcaagcgattctcatgcctcagactcctgagtagctggtattataggcgcac

SEQ ID NO: 16600 - DNA, 201 bp, Homo sapiens
atccagtgttataggagacaaaccatagcaagcaatggcctctcacccttcccttcacaccctccactctgtccacttgtttgttccttcaataaatactratggagaatgggctctatgccagtgtttctctggatgttggctgcagggatgaacaaaggcaacttctaggagaaatttctgtttttgatgctctcgtgg

SEQ ID NO: 16601 - DNA, 201 bp, Homo sapiens
ttttgctctcctccttttgtcagttggcatgcgatatgcttctcaggcagtaatttagagactgtcaattcctgagagccgctggggaactgagcaatcgyctgcatttcgtcgctttagcccgagctgggtctttgagctggcagagaccaagatctttttctgggaagggatggtcctatttaaggaaggccctggatt

SEQ ID NO: 16602 - DNA, 201 bp, Homo sapiens
gtatggggtggggaaggggggggggataaagatattaatttggaagcatttgattgctccattattttatcatcttcccatggaaatgttttcataacgcsttgttttttaattattattattattttttgagacagagtctcactgagtcgcccagggcggcggtgtgatctcggctcactgcaacctcagtctcccagg

SEQ ID NO: 16603 - DNA, 201 bp, Homo sapiens
ttacagcaaatttgtagttatggtggagcaaagggcagttttcactcctcttccctaaaactgtagtttaactaaaaagtggccactgtctcctggtagcrgttggtaagccatccagtctctgcaggcatctacgctccaggtctccagtctgaggagtctggctcctggggcaggtgcctctgggggtctctgccaggc

SEQ ID NO: 16604 - DNA, 201 bp, Homo sapiens
gagctgagtgattttagtaggtagtttaactccttaaaaacttccagtggtttcatattctacctagttttaggtgacagctggtatggggtggggaaggrgggggggataaagatattaatttggaagcatttgattgctccattattttatcatcttcccatggaaatgttttcataacgccttgttttttaattatta

SEQ ID NO: 16605 - DNA, 201 bp, Homo sapiens
tcccgctttgtgctggagcaagttttggctgagtttctgtcacttgcaaccaaatcagtcctatccagtatacctagtgactctctggtctccaaaggctrtgcctgctgggtactgagtgtctccccgaccgaccccatgatggctacagtgcacatcccttccagccaactctattgtgcacacatattcgtagggtga

SEQ ID NO: 16606 - DNA, 201 bp, Homo sapiens
ggagctgagtgattttagtaggtagtttaactccttaaaaacttccagtggtttcatattctacctagttttaggtgacagctggtatggggtggggaagsggggggggataaagatattaatttggaagcatttgattgctccattattttatcatcttcccatggaaatgttttcataacgccttgttttttaattatt

SEQ ID NO: 16607 - DNA, 201 bp, Homo sapiens
tttgacaatagatgttagctaggagagataagaaatggagcaagggaggggtttcatcccgccgtgttcatttgcttggctgtcctgaaattgcgaatacrcagttgttacctgctcccggtgggaggggggggatatttatttggcatcttgcaattgataggagctgagtgattttagtaggtagtttaactccttaaa

SEQ ID NO: 16608 - DNA, 201 bp, Homo sapiens
tggaagagttgacagagatttgcaggtgaaaaagaaaagaaaaaaaatacagatacgtgtatatatagagaaagacaaaaacttgtctgctagaaacctasggagagagatggtattgcccctgggacattggactttctgtttccagcatggtctgtcgtcttccataatggcatttaattttggaaaaattgcctgagc

SEQ ID NO: 16609 - DNA, 201 bp, Homo sapiens
cagtcacagaaatgaggtagctgtagccaaggatgatggcatagcacattcgtttcttaggcgtgccacgtactaggtggcttcagtcagcagaactgtaytttcccacagttttggaggctcaaatttgcaagtcgaggtttcggcaaggccatcctctctctgaaaactctatgggggcgtcctctttgcctcttcccg

SEQ ID NO: 16610 - DNA, 201 bp, Homo sapiens
ttttggattctgtgtggaagagttgacagagatttgcaggtgaaaaagaaaagaaaaaaaatacagatacgtgtatatatagagaaagacaaaaacttgtstgctagaaacctagggagagagatggtattgcccctgggacattggactttctgtttccagcatggtctgtcgtcttccataatggcatttaattttgga

SEQ ID NO: 16611 - DNA, 201 bp, Homo sapiens
aggctaggtagagcatattgctccctggcagcaaacatgtacagcatgtttctgtcctgaatactgtaggcaattttaatacaatgctaagtatttgcatwtacaaacatagaaaaggtacagttaaaatatggtattacaatcttctgggatcaccattgcatatgtggttcattgttgatcaaaatgtcattatgcagt

SEQ ID NO: 16612 - DNA, 201 bp, Homo sapiens
atgggagttaggagaagtgaatcttttgttttcgaagcctttgtccttgtgagtctcttaattggggtgtcttgtaatgcaaagtctttaaagatgtgtgytcctgaaactcaggaggctgctctatcccatggttcaaccaaagaaccagggccaaagcagtgctgaaggaacaactgattctcttggccctccttagag

SEQ ID NO: 16613 - DNA, 201 bp, Homo sapiens
ccttgctgaaatggttggtgctaagatgagcacttggcttaggccagaccagtccctagcctgtggagaaggggcaatctcttatctgaaggcctaggagstgcagggatgtttatatgggctgctagcgcttagtttcctgccacagggagacagtaagaaaggtgacgtcaatctgagatgagagagagagcaaaacag

SEQ ID NO: 16614 - DNA, 201 bp, Homo sapiens
cacctttcctttgggagcaatttttgggttgcttttgtttttatttgttgttttcattcctggtagtaatagtaacagtagaaaatggcagcgttatagcyataaacaaagtgctctgtggtttctctctcaccatcccctaaaccctacaaggctaggggaaaatggtaatactcatgaacaactccacttcataaatga

SEQ ID NO: 16615 - DNA, 201 bp, Homo sapiens
agtggccctaggatggctcctcagatagctgctggcagaaacctgcactcagtacatctatacatggtgtaatgattgactcaagataattagcatagccrtcatctcaaacctttattatttgtgatgagaagattcaaaacccgctttttgaactgttctgaaatatgcaataccttgttgttaactgtattcaccttt

SEQ ID NO: 16616 - DNA, 201 bp, Homo sapiens
aaaatgaggaagaagcgaacgtgagaacccctggtaaacccatcagatcttgtgacacttattcactatcacgaggatagcgcaggaaagaccggcccacrtgattgagttacctcgccctgggtccctcccacaacatgtgggaattctgggagatataattcaagttgagatttgggtggagacacacccaaagcatat

SEQ ID NO: 16617 - DNA, 201 bp, Homo sapiens
acacaggctgctgtggcaacccacagcaggaatagccagtcctgccccagcagggcgtatcaggggtgctaaggtgacttccaagattgaggttggcgagwtcgtgacaggtgtgcaagatggggtgttccaagactggggacaggacaggtgtgcaaggaccagccagctgaggtagaggaaacctagacctatggaaca

SEQ ID NO: 16618 - DNA, 201 bp, Homo sapiens
ggacaattcattggcttatcgtatagtcacaaacttgtgcagacatcaccactatctaatttcagaacatttttatcacccctaaaagaaaccctgtacccttcagccagcattccctattttatacccccgatctcttgacaactactcattgactttgtttctatgactttacctatttcgggtaattgatataaatgg

SEQ ID NO: 16619 - DNA, 201 bp, Homo sapiens
tagccccctgtacagcacacaactcggggaattttaggtctggtgatttactgctgttggagcctggccttcttcctgggagaaggctggaaaaacttcawgtcagttacttaatggaataatacatgtttcctgcttccattgtcttcctggacctgacactcactctttaaccataagcagaagacacatacaaaaatg

SEQ ID NO: 16620 - DNA, 201 bp, Homo sapiens
cagagaacagactagccccctgtacagcacacaactcggggaattttaggtctggtgatttactgctgttggagcctggccttcttcctgggagaaggctsgaaaaacttcaagtcagttacttaatggaataatacatgtttcctgcttccattgtcttcctggacctgacactcactctttaaccataagcagaagaca

SEQ ID NO: 16621 - DNA, 201 bp, Homo sapiens
accatcccggtaaagtgacgttttgatgaaaacagcatggatcttcctgcagagaacagactagccccctgtacagcacacaactcggggaattttaggtytggtgatttactgctgttggagcctggccttcttcctgggagaaggctggaaaaacttcaagtcagttacttaatggaataatacatgtttcctgcttcc

SEQ ID NO: 16622 - DNA, 201 bp, Homo sapiens
ttgtgagaaatgaggagataatatctttaaatctcctacggtgatacctggaacatgatggtgcttgggaaatgtctcttcttctgaaatgaggctgcctsgaagactcactggaacccaagcaaagtgtctctgcatttcactccgagccatcgacttctgttctgaatgttaaaatgcaggtggctgtgagggagtctt

SEQ ID NO: 16623 - DNA, 201 bp, Homo sapiens
gaaggatcatgggaggggaggagcgtgagttcctcttaagtgaatataaaccagggggtaggaaacaacatgagatgaggctggcgagagagaaggatgcyaggtgaggtgctgtggtgcgccagagactgcggaagtggctttctaattaagaaacagaagccaggaaactcctgtacttcaaggttttggagtgggaaa

SEQ ID NO: 16624 - DNA, 201 bp, Homo sapiens
gtagctttgttgattgttgatattacttatgaactttcttgcttttcagaaaccaccaccacaaaagaggcagtaacattagtattacattatacatcttmggcatttttttcctttgcccttttcgtaggtttttgtttgtttgttttttcttgtcagccacttcatcatgtttggtctctcgtctttggctgtgttttt

SEQ ID NO: 16625 - DNA, 201 bp, Homo sapiens
aattatatattatacacacaaacatacacacacgcacacaccaaatttaaaaagacagatacataggcagttgttatgcagtgtttgaaataaatttattkccagctatgggtcatttggaaaaagatcaatatgatgcatcaacataacaagtaaatggaaatgaatacaaccgcatggttttctgaaagcacggtttcc

SEQ ID NO: 16626 - DNA, 201 bp, Homo sapiens
ggtgagaaggagctggcagtgtgaatagccaggggaaaagtgttttgggtagaaggaacagaaagtgaaacggtgccctggcaaggcaaagattattcatkgctgaagagactatgttgcccagatgacttgttcatgtaatctgtgatttttaaatttagaattgaggtttgaagggaagtattgctcctttctttatct

SEQ ID NO: 16627 - DNA, 201 bp, Homo sapiens
gaaggcgggcggggcaagctttggaaagcacgggcaggtaaggacagggtttcaaaggtgagaaggagctggcagtgtgaatagccaggggaaaagtgttktgggtagaaggaacagaaagtgaaacggtgccctggcaaggcaaagattattcattgctgaagagactatgttgcccagatgacttgttcatgtaatctg

SEQ ID NO: 16628 - DNA, 201 bp, Homo sapiens
actgattaatcacagttatagagtagacataacatttttattaaactctcagtgagcaggaaaattagcacttcctgcaataacgatactaatttcattastgaacgttttcatttataaagtgcttcttccttatcttgaaccttttatcctcttcttattgaccaaagagagggcatatctttgggagctgctaataaa

SEQ ID NO: 16629 - DNA, 201 bp, Homo sapiens
gttggagaaaagggggaaaaagttaaatgttaatgattcttttcgtaactgcaattttatcggctcctttttgtacatatatgattatgaagcaatttgtrtgaaatttacaccttttcaaattttgaaaattgccttgttgaaaaagaatcgctgtacttctcaatactacactgattaatcacagttatagagtagaca

SEQ ID NO: 16630 - DNA, 201 bp, Homo sapiens
agttggagaaaagggggaaaaagttaaatgttaatgattcttttcgtaactgcaattttatcggctcctttttgtacatatatgattatgaagcaatttgygtgaaatttacaccttttcaaattttgaaaattgccttgttgaaaaagaatcgctgtacttctcaatactacactgattaatcacagttatagagtagac

SEQ ID NO: 16631 - DNA, 201 bp, Homo sapiens
atgtgtctgaccccaggagaactgccccgatccctatcttgtctctgctcagttctggtaactcttttatcttccctggagttatttttttcccttctttstttctctttttctgtgtgctcttctaagagtaaaacgcatgtccccccatgaagtcactcaaagctcaggcgtgtgcaacagggacagcaaaagcacaca

SEQ ID NO: 16632 - DNA, 201 bp, Homo sapiens
gattacagacaagagccactgcgcagacggacatatgaatttttaatttgatatcattgtgatcaatttgaagatccacatatggctgagggctactctawtgagtggtgcagctccaaggcagagagatggctgtgattaaccaatgaatgagggaacaaatatccaggcagaatgaatagtctatggaaagggctggaa

SEQ ID NO: 16633 - DNA, 201 bp, Homo sapiens
gcggcgtgatctctgctgactgcattctccatttcccaggttcaagcgattctcctgcctcagcctcccaagtagctgggactacaggcccctccacaccscacaccgccaccacgcccagctgatttttagtggagacagggtttcaccatgttggccaggctggtcttgaactcctgacctcaagtgatcggcctgcct

SEQ ID NO: 16634 - DNA, 201 bp, Homo sapiens
cagcggcgtgatctctgctgactgcattctccatttcccaggttcaagcgattctcctgcctcagcctcccaagtagctgggactacaggcccctccacascgcacaccgccaccacgcccagctgatttttagtggagacagggtttcaccatgttggccaggctggtcttgaactcctgacctcaagtgatcggcctgc

SEQ ID NO: 16635 - DNA, 201 bp, Homo sapiens
ttttaaggcagcaggactaagaaggtaaagacatgtactaggcgggtcagcatagtggtggccctcgtctgacacacatatttcaggaggggtcacccctsccgtcttccatgttggggtgctcttctctggcaacccactatgggtactccactgctggccttcatgcaggtggaaccacaccgggaagacccaagccga

SEQ ID NO: 16636 - DNA, 201 bp, Homo sapiens
ggcacagaacgagcactgtgtgtgtgttacagaaatatatgtgggtgggtgtgtttctgttttccgtaattccagctaggcaaagacatatttaacaaaarccttctgggctgatgagcatcctcagaaagtaggctgagggagctcttttaaggcagcaggactaagaaggtaaagacatgtactaggcgggtcagcata

SEQ ID NO: 16637 - DNA, 201 bp, Homo sapiens
agcatctggggctgtacacgtctttgtactgcacactgtagggtatccaggattcctggccctgccccatgatataccagcgccatgttgtcatcaaaacraccggaaatgccttttgtgtctccctacttccctttttaacatgtcagcccttggtctcgatattcacatctatatttttccttatcccgttaatatatg

SEQ ID NO: 16638 - DNA, 201 bp, Homo sapiens
tcatgccctgtgtcacctgactcaggcaccattagcatctggggctgtacacgtctttgtactgcacactgtagggtatccaggattcctggccctgcccsatgatataccagcgccatgttgtcatcaaaacgaccggaaatgccttttgtgtctccctacttccctttttaacatgtcagcccttggtctcgatattca

SEQ ID NO: 16639 - DNA, 201 bp, Homo sapiens
ttaacactatgcagaacgatttcctcgtattgttgaaaactcttggtaggggttttttttttaattggctggaagcacttcatcatatagttgtaccaaartttgcttaacatcccccttattactcagcctttgggtggtatccagttctttgctttgataaataatgctgagatgaacatctttctgcatggctctttt

SEQ ID NO: 16640 - DNA, 201 bp, Homo sapiens
atgctctacctcttccctttgctaagtggcaattttggaccttctgtgaccgtgcaaacatgcagattatacatgcactataggagtggaatgtatgtgayttaatagcgtaatattttgtccattattttaaaacttgctttatttggtcaagacatacggaacacgtatagatcaaacaaaaatttttaaaaatgcttg

SEQ ID NO: 16641 - DNA, 201 bp, Homo sapiens
tccccaggctaagcacagtcacagaaatgaggtagctgtagccaaggatgatggcatagcacattcgtttcttaggcgtgccacgtactaggtggcttcastcagcagaactgtattttcccacagttttggaggctcaaatttgcaagtcgaggtttcggcaaggccatcctctctctgaaaactctatgggggcgtcct

SEQ ID NO: 16642 - DNA, 201 bp, Homo sapiens
aattcttaaagttctggagcctgggaagtccaagagcaaagcaacggcagattcagcttctgttgagggctcgttccctggctcatagatgatgacttctygctgtgtcaacttagtgggaggggataaagcagctctctggggcttcttttagaaaggcacaaatccactcttgtgatctaatcacctttcaaaggccct

SEQ ID NO: 16643 - DNA, 201 bp, Homo sapiens
aacagcacacgtcaaggaagcagttttggtctctcagattatatgaagctctccaatatgttctttcagaacagccagtgcctagaatactgcctgactcstagtagcactccttatgtgttgaatgagtaaatgaagagtccctggaatttcttcttcataacattgaacacaactgcagtttgaaaacataatttctgt

SEQ ID NO: 16644 - DNA, 201 bp, Homo sapiens
aatggcatctatgatcttagatttagtaaaacgcagtatcttcttccccagctgaaatagcgaaagggtctcttcaggctcctgggataaaaaccaggatscttcatgtgtctgagcaggcttcccaccatttgactgctgctcctttgtccagacacatttaacaccatctccctgcaccccttcactgggctccgaagc

SEQ ID NO: 16645 - DNA, 201 bp, Homo sapiens
cagaaatgtaattcttaaagttctggagcctgggaagtccaagagcaaagcaacggcagattcagcttctgttgagggctcgttccctggctcatagatgrtgacttcttgctgtgtcaacttagtgggaggggataaagcagctctctggggcttcttttagaaaggcacaaatccactcttgtgatctaatcacctttc

SEQ ID NO: 16646 - DNA, 201 bp, Homo sapiens
ccctggaagatggatcttgccttgtggatgtttttctaccgtgacagaagatagaaaggatgaaatagaaagagtgtgagtgaattctgcacccacccccrccccccagcttccccacctgtaaaatgatttgctcaaagtttgcaaagaatggaggcatattcaaagtgctcagcactgggccggacccatgggtatgaa

SEQ ID NO: 16647 - DNA, 201 bp, Homo sapiens
tatgagcacggcatctaccgggctgttccacatcctccctgtgggactaggggccagggcaatgggaatcagtgcagaaataaagctcatgctgtttgctstgccatgagtaacgaagtcctctgtatctgatcctgggtctcctgttttctgctagcttcctcaaaacttggtagctaactcattaacttacaaggaaga

SEQ ID NO: 16648 - DNA, 201 bp, Homo sapiens
attctcagattcccagccaactggtttcacatgacaagtaaatgagcaacctggaagatgagtggcgtttccacacacagggaagcagatagttccattasgtgacagtgtgtgcacagtttatggaggatgaagcggaaaacctgagccacaaggcagtagaggttggacgagacactcattccgaaggcgggtgtgtat

SEQ ID NO: 16649 - DNA, 201 bp, Homo sapiens
cctgactttctccctggtccaggtgcattttaagcatggaaggtgacacttgccattctcaatggacaaagggagtggggagtgtgggggtgtgctttggrgttagtctctgggttttcgaaacttagcattctcagattcccagccaactggtttcacatgacaagtaaatgagcaacctggaagatgagtggcgtttcc

SEQ ID NO: 16650 - DNA, 201 bp, Homo sapiens
actgcattgactcctgttttctacacagtggtcttcagctacaccttaccaagcaccccttacccagcaaacgtggcttctcttccccaggcagagcagtycgttacttagactaggaaatggctccgagaagctcacccatcaccatttgctctactgcaaaacaggactcattagcaggagctcataaaatgaaactgg

SEQ ID NO: 16651 - DNA, 201 bp, Homo sapiens
ctgtagcaaagatgtactgtttcccactgagaagaatcaaaaatagaaaagtgcttccttgtctctctatattgttattaaaacaagtagatgcattttcrttgaatcaaggcagttttcctttataaaatgtcctatttcatatcactgttcaaacttgacatccacatttgagttggtttaaaatatcactgttttgtt

SEQ ID NO: 16652 - DNA, 201 bp, Homo sapiens
agttccagctcatccaccctgcctctgtggctgagtcggggagaaaaggacaaagtttttctcccgcaactgggccaccaaaccagcagagcctccagccrgggtggtctcgaggaggcccattaccggctggagtgacagagtgtgtcaagcctgcagctcgtcccgtgtctaatggaacagaaacaagcaccctgctgc

SEQ ID NO: 16653 - DNA, 201 bp, Homo sapiens
tgtaatcatagcagaaactcacatgtgtgtgctttctatgtgccaggcatgaggctgaagtcatacattcattatttgttaatcccaccctaagtgatagktgtattcatcattctcagtatcagaagaagaaactgaggttcagaatgacccagtaaagatcacaagcccaaccctggtgaagggcgtgattggcagaag

SEQ ID NO: 16654 - DNA, 201 bp, Homo sapiens; identical to SEQ ID NO: 3305

SEQ ID NO: 16655 - DNA, 201 bp, Homo sapiens
caagttcaaaatcagtctcacctggtcaagatgtcagtagggcttgttccttctggaggctctaggggagaatctgtttccttgcgtttttcatcttctasaggcctcctgcattccttggctcttggccccttcctctggcttcaaaccagcagtttaatatcatcacatctcctttactgattcctcttccgttgtccc

SEQ ID NO: 16656 - DNA, 201 bp, Homo sapiens
caccgaggtatctggagatgacctctgcactgttctgggagagtggttatagcctctcctgggggagtgttactgggagacagggaaagacagggcgtgtrgacggccatctattccacctgtgacatgagggctcaccccctcatctccaccgcagcagctctctgataaatgtagctctctgataaatgattctgttcc

SEQ ID NO: 16657 - DNA, 201 bp, Homo sapiens
gatagctgatttgttataaacaaattaccaaaaacgtactggctttaaacaacacatgcttatcatgttgcagttctggggagtcacaagttcaaaatcastctcacctggtcaagatgtcagtagggcttgttccttctggaggctctaggggagaatctgtttccttgcgtttttcatcttctagaggcctcctgcatt

SEQ ID NO: 16658 - DNA, 201 bp, Homo sapiens
tttattgtgtgaaatgagcctggtcatatgactgccctgcctccctggaggcctccctgccctcctccttcccacagacacttatgggaggtactggccarctctgtatggccagtactgccctaagcaagaccaagaagcttagtctcaatttcagagagttattttggcaacatatttgggaaaatgatagttagatgc

SEQ ID NO: 16659 - DNA, 201 bp, Homo sapiens
tgcctctaagtttgaagtctaactccatcactgtgtttctttcctcttgctgatagctgatttgttataaacaaattaccaaaaacgtactggctttaaasaacacatgcttatcatgttgcagttctggggagtcacaagttcaaaatcagtctcacctggtcaagatgtcagtagggcttgttccttctggaggctcta

SEQ ID NO: 16660 - DNA, 201 bp, Homo sapiens
tccctccctttattttttctagcctttatagaaatgacaaagggtcaggtggtcttaaattccaaatctgggcacatgaatggtctgacctcggaaacttmctatatgctcgaaacgatttaactagcagcaataaaatctctactctttttatgacaaataatctagcatgtctggggagcatatttgattcttcatatt

SEQ ID NO: 16661 - DNA, 201 bp, Homo sapiens
tctccctcacaaggatcaggtggcaggatctaatgggaggggtagagagtgagtgttaacacacagagaacccaggagacctttctcagaggtctcatatsaagaaaagatcatttctcctaagcaatcaatttctttttaaatctgaacctcatatctgagaatattcccttcttttatctggccactcgggagctcaaa

SEQ ID NO: 16662 - DNA, 201 bp, Homo sapiens
actgtggaagggtcaagtgcagggtcaccaacccgttccatcttcctgtcagttggcgtccacccttggtttcaaagggaacaggcattactgacatgacsggacctttacagttcccagctgctcatttggagtactgcggacccaggacaactaaagccggggtcgcctgccctccaggggttcctgggttgaagtatc

SEQ ID NO: 16663 - DNA, 201 bp, Homo sapiens
atttgtgtcctggttggcagatattaagtccacagataccaataattaatatctatggttgattgtaaaaatggccaccaattcttccctgtcccctgcayatgtacatccttgcactgtgaaattgtagatctcgccctccaaaggtgaagttcgtttgtccactccttgaaccaggatggcatgaaacttgatttgacc

SEQ ID NO: 16664 - DNA, 201 bp, Homo sapiens
cttactctgtgctcttgccccaggcagagtggaagttgccttataaagctgcgacttggccacagtgttttccctttcagcagggaaaccggagttctccstgctgttgggaggttcaagagccactctgtgcagaaatgcccagaaagagttaagtgaggtaagttcgtcagacttctgcagacccatactgtggaaggg

SEQ ID NO: 16665 - DNA, 201 bp, Homo sapiens
tatccaggaggaatgattagtgatctgattcattaatatcccttgttattaagaactgtctgtatttgtgtcctggttggcagatattaagtccacagatdccaataattaatatctatggttgattgtaaaaatggccaccaattcttccctgtcccctgcatatgtacatccttgcactgtgaaattgtagatctcgcc

SEQ ID NO: 16666 - DNA, 201 bp, Homo sapiens
gactctgcagatccctactcggagtttttcagccctgttttaagtgccgagctgggttttgcctcatgatccaattgttttattagcgaaatcatcatctrtttcattttgctttggtaatagtgcagtgtctgtctaacaataaattatagagtcaggcaaacaatggtttcgtattagggatataatgaaatatcttat

SEQ ID NO: 16667 - DNA, 201 bp, Homo sapiens
gttcaggaacagaactgacaggtattgaagccaaaaattgaacaataacaacgtaggagggagaatccaaagatagtatgtgttcaggatacgggcactcrtgtgggtgaacacacacacacacacacacacacgcttttttttttttttctttttttttttctcctattgcaatagaacgtaaaggtagatttttagaac

SEQ ID NO: 16668 - DNA, 201 bp, Homo sapiens
tcctttcttcttcagtgccacctgccttattttactcacccagaaggaagccgggtccctctttgcccctttgggtgtttgtgaaaagcaagttgtaaacwctgaattctataaactgttggagacagattctggagagacactcaggcttagctctagaaagaaacgggtaagacagaggaggttcagggcaactgtgtt

SEQ ID NO: 16669 - DNA, 201 bp, Homo sapiens
caaaagtactaaatgttaccattttccttactttgttcaggctgctataacagataccataaactaggtagcttataaataacagaaatgtaattcttaamgttctggagcctgggaagtccaagagcaaagcaacggcagattcagcttctgttgagggctcgttccctggctcatagatgatgacttcttgctgtgtca

SEQ ID NO: 16670 - DNA, 201 bp, Homo sapiens
aagattcctttcttcttcagtgccacctgccttattttactcacccagaaggaagccgggtccctctttgcccctttgggtgtttgtgaaaagcaagttgyaaacactgaattctataaactgttggagacagattctggagagacactcaggcttagctctagaaagaaacgggtaagacagaggaggttcagggcaact

SEQ ID NO: 16671 - DNA, 201 bp, Homo sapiens
tcaggcactttatatccctcatccaggaggatgcaaaaacctggtgtttttcttttttttttttttgcattttccagacgagccaagggatggctcagaarggtgaaggaactcacccgaattgcacagctggtgagctcagagtcaggctccttgcttggtccatctggcttccaaactccaagtctgtctgctccaccc

SEQ ID NO: 16672 - DNA, 201 bp, Homo sapiens
cttgttcttttacaaaaagggtcagcagactttctgaaaagggacagatagtaaatattttaggctttgtggaccatagggcctgtgtcaaaagtactaawtgttaccattttccttactttgttcaggctgctataacagataccataaactaggtagcttataaataacagaaatgtaattcttaaagttctggagcct

SEQ ID NO: 16673 - DNA, 201 bp, Homo sapiens
tacttgttcttttacaaaaagggtcagcagactttctgaaaagggacagatagtaaatattttaggctttgtggaccatagggcctgtgtcaaaagtactmaatgttaccattttccttactttgttcaggctgctataacagataccataaactaggtagcttataaataacagaaatgtaattcttaaagttctggagc

SEQ ID NO: 16674 - DNA, 201 bp, Homo sapiens
acaaaacaccgagggctttaaggaggcatagtggtatgttcagctgtattttctcataatatagagtcataggaaacctgagccttggcatttgtaaggcraaaagacccctggaaaagagtaatatagtaattcatctttatttgaaaagtatatcatcatccatttatttccccactggcataatccaggccgactttg

SEQ ID NO: 16675 - DNA, 201 bp, Homo sapiens
aagttaaactgatgtctgtgtgtcttcatgtcattaaactttgaatctacggacatgtctttttctttctggcatagtttggaggtcttcattttgtgatwgaatacaaaacaccgagggctttaaggaggcatagtggtatgttcagctgtattttctcataatatagagtcataggaaacctgagccttggcatttgta

SEQ ID NO: 16676 - DNA, 201 bp, Homo sapiens
tgagaaagttaaactgatgtctgtgtgtcttcatgtcattaaactttgaatctacggacatgtctttttctttctggcatagtttggaggtcttcattttrtgattgaatacaaaacaccgagggctttaaggaggcatagtggtatgttcagctgtattttctcataatatagagtcataggaaacctgagccttggcat

SEQ ID NO: 16677 - DNA, 201 bp, Homo sapiens
cccccaaagggggatttctaacacagaaagcaacataagtgggtagtcctggccaatggcagctacgttccacaaagtgactcagggatccaggctgcagmcacttagtggttccattctccctgctgatatctgcatccagtcatctggtatttcttaccagccttaacctcattctattggtaagcactagtcacatgg

SEQ ID NO: 16678 - DNA, 201 bp, Homo sapiens
tgtttgcacacctgtgttgcaaatgtattagttaggataggctgagctacagtaagaaatagcccccaaaatgcattatagctgaaacccccaaagggggrtttctaacacagaaagcaacataagtgggtagtcctggccaatggcagctacgttccacaaagtgactcagggatccaggctgcagccacttagtggttc

SEQ ID NO: 16679 - DNA, 201 bp, Homo sapiens
ttccttagcttcatgcctttgaattttagcagaaatgttacctgctctatgaaactggattttccctttgtctccattccctaagctgcacattagagcasctgttacagtttgaagtgacccctatatggattgtttgcacacctgtgttgcaaatgtattagttaggataggctgagctacagtaagaaatagccccca

SEQ ID NO: 16680 - DNA, 201 bp, Homo sapiens
cccatgggagctccaactctgtttggtcccaatgtgccctttttgtctcactccttcctcccacacatcctgctccccactcccctaattactcatgattscactaacagccacatcctttcacacctctgagcttttggtcatgctgtaatctctacctgagttccattcctgcctccacccttgcctgtcaaattcctt

SEQ ID NO: 16681 - DNA, 201 bp, Homo sapiens
taaatattttaatgtttgtcgtttgtttgcaaccttgtaattttttcctgtgcagcaattttaactttctatattcaaatatactctgaatgcacagtgartttggcagaataccatttaagtcttgtattttccaaagctagtcaacgtccaactgccaatgttgcctgaacaggaaatatttatacctgaaagcgtcca

SEQ ID NO: 16682 - DNA, 201 bp, Homo sapiens
gtttggggcatgttgtcacctcattgccatctctgcctctgtcttctcaccaccatcttccttgtccatgtctctctatgtcttcaatgttcttcttatarggacaccagtccttggatttagagtccaccctaattcactgtaatcacatcttacctaagtccatctgcaaagaccctatttccaaataaggtcacattc

SEQ ID NO: 16683 - DNA, 201 bp, Homo sapiens
ttatctttgggactgctataatgagatccacttagatctagctataatggaattttgtttagtggttctctgatttaaacatgacttttatccttttcagmtatcgtttcattaacatcactacctctttttaaatcctaatgttgtcatggaagcctgtgtaggggctgaccttgaagtctctgaaagctgaacactcag

SEQ ID NO: 16684 - DNA, 201 bp, Homo sapiens
ggcagcaccactgccatggaaattctccagggccgggatttcactggcaaagtggttgtggtcactggagctaattcaggaataggtaggctcttcacttmgttatttatctttgggactgctataatgagatccacttagatctagctataatggaattttgtttagtggttctctgatttaaacatgacttttatcctt

SEQ ID NO: 16685 - DNA, 201 bp, Homo sapiens
tcagtgggccccagttctttcaggtttaaggaataagcattttggtctatgaaaaatggggttttcctaaagtataagattgtcttatatttataaatgcytgtgttcattgctgtgggttcactgctttctcttttgggcagccatataaataaaagaaccacctacttggacccaagactggcgtttactgtggatgat

SEQ ID NO: 16686 - DNA, 201 bp, Homo sapiens
gcattaatatcacctgggaattcaataaaaatgtacattcccaggcccccaccccagacctactgaatcagcactggggtggggcttgcaatctgcgctckaatagtcatccaggggatcctgatgttccctagcttgagagcctcccgtctagagcaggggctgtctcctttgcctgtaaagggctagataatatgtttt

SEQ ID NO: 16687 - DNA, 201 bp, Homo sapiens
tgtagttcccgcaaatctatttacggttttcacaaggaggtcacgaacatgcgttgttttcaatgctgggctagtttcagacttctggcttgttgtgggayggaggagaaagaagacagggcattttgatgtggcccagagaccaaatgaaacaaacgatcctctgattgctcagatgtcctctttgacttggaaagcacc

SEQ ID NO: 16688 - DNA, 201 bp, Homo sapiens
actaaacgatttgttcagattggggaaaaaaattttttttttttttttggttgtggtggcgttggcttttacttggggttgacctttccttatcaaggacrtacaaggtgaatagctgggtgataatatatggtcccatgatcatcaaccaagcaccaacggaagccttttggaagtgcacagtattgtttaacacacaaa

SEQ ID NO: 16689 - DNA, 201 bp, Homo sapiens
aaaaaatatgagaaggttcctgcccttaagaggtttaggatccagctgaagaatcaacatgtgcacatgaaaaaaaatggccgtgccctctaatgtcatakgaggtcagcgtatgaatgacgttgggtgcctgccctgcatatacatatgttctttgagctcattcaagggagaattcccatggattggcacaaccagtat

SEQ ID NO: 16690 - DNA, 201 bp, Homo sapiens
ttgaacccgggaggtggaggttgcagcgagtcaaggtcacgccagtgtactccagcctgggtgacagagcgagactccgtctcaaaaaaaaaaaaaaaaaraaaaagaaaaagaaaaaggtgtttggaagccatgtcccatgaattccaaatacaattgaggactctataaaggactataaaaaaagttgtaataaattat

SEQ ID NO: 16691 - DNA, 201 bp, Homo sapiens
gcccctgagaccagtgctaggattatttccattttgcagatgaggggatggagattaaggagtggggtcacttgaccaaaggtgcacagcgcacagctagrtgccctatgggaaggtcttactgcatctcttaactacctcttgggaccagttaggaaccagtgcttaatgaaacactttgaagttacatctgtggaaaga

SEQ ID NO: 16692 - DNA, 201 bp, Homo sapiens
cattcttcttaaaatacggagcgacataattaaccctctggggagactaatattagtttattagagacaatttctagttctgtttatttttaacactaaaygatttgttcagattggggaaaaaaattttttttttttttttggttgtggtggcgttggcttttacttggggttgacctttccttatcaaggacatacaag

SEQ ID NO: 16693 - DNA, 201 bp, Homo sapiens
acttgaacccgggaggtggaggttgcagcgagtcaaggtcacgccagtgtactccagcctgggtgacagagcgagactccgtctcaaaaaaaaaaaaaaaragaaaaagaaaaagaaaaaggtgtttggaagccatgtcccatgaattccaaatacaattgaggactctataaaggactataaaaaaagttgtaataaatt

SEQ ID NO: 16694 - DNA, 201 bp, Homo sapiens
tattgacctatgtttttaattataactttgggtggtggtctgaaatgaaatgttaagtttgacgcaaaaataggactagtttgtgtaactgatttgttcaraataacagcttacatttctcagagctttttgtatgccaagtgctatgcgaaaccctggatgtacaatattcttatagtagcccctgagaccagtgctagg

SEQ ID NO: 16695 - DNA, 201 bp, Homo sapiens
tgctttaaacttgtaaaaatcagagttatagctgcttttgaactagtacttgttgtgtgcccaggaaatggccaaatgttatcactcatccttccaagaamcacatgaaggttatattattatgtcgactttccagatgaggagactgaggctcagtggcttgtcataggtgtcaaagacaggagtccagtgtaaggactt

SEQ ID NO: 16696 - DNA, 201 bp, Homo sapiens
ttatttcttttcaatactctgaatatcactggagcagctgcagattcagggcagtatggggtggttcaggaacagaactgacaggtattgaagccaaaaaytgaacaataacaacgtaggagggagaatccaaagatagtatgtgttcaggatacgggcactcgtgtgggtgaacacacacacacacacacacacacgctt

SEQ ID NO: 16697 - DNA, 201 bp, Homo sapiens
ttgacaatactttcctttcagtctattttcctgtgtatggggtaagtgttgcccttctgcaactttccttttattttatttatttatttcttttcaatackctgaatatcactggagcagctgcagattcagggcagtatggggtggttcaggaacagaactgacaggtattgaagccaaaaattgaacaataacaacgta

SEQ ID NO: 16698 - DNA, 201 bp, Homo sapiens
catttgcaaaacactttgacaatactttcctttcagtctattttcctgtgtatggggtaagtgttgcccttctgcaactttccttttattttatttatttmtttcttttcaatactctgaatatcactggagcagctgcagattcagggcagtatggggtggttcaggaacagaactgacaggtattgaagccaaaaattg

SEQ ID NO: 16699 - DNA, 201 bp, Homo sapiens
tttatattgctgaaaatgtcatttgcaaaacactttgacaatactttcctttcagtctattttcctgtgtatggggtaagtgttgcccttctgcaactttmcttttattttatttatttatttcttttcaatactctgaatatcactggagcagctgcagattcagggcagtatggggtggttcaggaacagaactgacag

SEQ ID NO: 16700 - DNA, 201 bp, Homo sapiens
ttggagaggcctgtttccatacatagctctttgtcagttgctcacactcggtcaatacttgccttcctttgaggccatctgcactcactgacaatctgatygctcccctgaatggaggtgaaagcatgcaagctaggagttaagatctttaactcagggaagaccctgtctatggaagtgctgagctcttcagtgtcatca

SEQ ID NO: 16701 - DNA, 201 bp, Homo sapiens
ttatatgcctgttccatatgagaacattatgcatatggtgtgatttggtcattccggatggctaaagtgtgagcatacccgtatctcagatttacagaggwgaaaacagaggctcagactggttatgtatatttctctaagtcccccagctattgtttgttgtaggttgggtaccccaggaagtagattctgcaactgaga

SEQ ID NO: 16702 - DNA, 201 bp, Homo sapiens
tctctggaaatctctagcttctcaaactgtttcgtggtggagtgccttttgggcacaggagaaggaaataagagcctcgcgaggtttgggaatgctgcctstagctctcacactgcatgcagaattcctactctgagagctcactttatctcaaaaacccatgcatattctgcatctactctgaattccgcagtgttgtgt

SEQ ID NO: 16703 - DNA, 201 bp, Homo sapiens
attatatgcctgttccatatgagaacattatgcatatggtgtgatttggtcattccggatggctaaagtgtgagcatacccgtatctcagatttacagagragaaaacagaggctcagactggttatgtatatttctctaagtcccccagctattgtttgttgtaggttgggtaccccaggaagtagattctgcaactgag

SEQ ID NO: 16704 - DNA, 201 bp, Homo sapiens
tctgactttccttgactttgatgtctaggtctggatttcaagggctcagaaactctctcatgcatgtagttccctcctgctttgaatctctctgactttcmttgattttgatgtctaggtctggatttcaagggctcacgtgatgaggatagtttctttatcttaagggcaactgatgtggagtcttaattaacactggca

SEQ ID NO: 16705 - DNA, 201 bp, Homo sapiens
ccaagctcattcaggatgctggcaggattcagatccttgaagttgtaagactagggcccctgtttcctactgacttctgctggtggctgccctcagctccsagaggcaacccacattccttgacttttggccccctgcatctcaaagccagcaacagaaactctcttgtgcatggagtcccctcctgctttgaatctctct

SEQ ID NO: 16706 - DNA, 201 bp, Homo sapiens
tcccttgaacctgggaggtggaggttgcagtgagctgagatcacgccattatactccagtctaggcaacaagagtgaaactctgtctcaaaaaaattaatrataataatgttacaataataataatgttagtgatacatatcattttgaaaccagttcttaagcaattaaaaaaaagcagctatggtgattgagtttttgt

SEQ ID NO: 16707 - DNA, 201 bp, Homo sapiens
aagtgctgggattacaggcatgagccaccatgcccggcccccttttttaaaaaacaaaaaaacaaaaaactcttttgtgttttagaaatggggtctcactmtgttcttcaggctagtcttgaactcatggcctccagtgatcctcccgcctcagcctcctgagtcactggaatttcaggcatgagccactgtgcctggcct

SEQ ID NO: 16708 - DNA, 201 bp, Homo sapiens
gatcctttcagagttactcatacgacttacacattcccatgggagctccaactctgtttggtcccaatgtgccctttttgtctcactccttcctcccacayatcctgctccccactcccctaattactcatgattgcactaacagccacatcctttcacacctctgagcttttggtcatgctgtaatctctacctgagttc

SEQ ID NO: 16709 - DNA, 201 bp, Homo sapiens
aaattgctgaagtgcttctcagtgatgaaatgttacagatcagtttgaaatccaactttattcaacataagaaagcctatatactctggagcttaaagacwgaccttttcacttactgtaaggtatctaagacttctgggtgtgggttttaaatatattttggatgagctttgttcatgtttacacatggccaccaggtcg

SEQ ID NO: 16710 - DNA, 201 bp, Homo sapiens
taaaagttgaacaactctgccttaatggcgctaatttttaatatgcctcattctagttgcttgaattgaacgaaggcatttgaaaattgctgaagtgcttstcagtgatgaaatgttacagatcagtttgaaatccaactttattcaacataagaaagcctatatactctggagcttaaagactgaccttttcacttactg

SEQ ID NO: 16711 - DNA, 201 bp, Homo sapiens
atcccagctctttgggaggctgaggcaggtggatcacctgaggtcaggagtttgagattagcttgaccaacatagtgaaaccccgtctctactaaaaatamaaaaattagccaggcgtggtggcgcatgcctataatcccagctactctgggcctgaggcaggaaaatcacttgaacctgggagacagaggtttcagtgag

SEQ ID NO: 16712 - DNA, 201 bp, Homo sapiens
cttcaagattaagaagggactagccgggtgtggtggctcacgcctgtaatcccagctctttgggaggctgaggcaggtggatcacctgaggtcaggagttygagattagcttgaccaacatagtgaaaccccgtctctactaaaaatacaaaaattagccaggcgtggtggcgcatgcctataatcccagctactctgggc

SEQ ID NO: 16713 - DNA, 201 bp, Homo sapiens
gtcatatgctgtgtcaggcactttatatccctcatccaggaggatgcaaaaacctggtgtttttcttttttttttttttgcattttccagacgagccaagrgatggctcagaagggtgaaggaactcacccgaattgcacagctggtgagctcagagtcaggctccttgcttggtccatctggcttccaaactccaagtct

SEQ ID NO: 16714 - DNA, 201 bp, Homo sapiens
cttattacctggtgacacgtgtttctagttattgacctatgtttttaattataactttgggtggtggtctgaaatgaaatgttaagtttgacgcaaaaatmggactagtttgtgtaactgatttgttcagaataacagcttacatttctcagagctttttgtatgccaagtgctatgcgaaaccctggatgtacaatattc

SEQ ID NO: 16715 - DNA, 201 bp, Homo sapiens
ttctcctgcctcagcttcccgagtagctgggattacaggcatgtgccaccacgccaggctaattttgtatttttagtagagacagggtttctccatgttgktcaggctggtcgcgaactcctgacctcaggtaatccgcctgccttgccctcctgaagtactgggattacagacatgagccaccgcgcccggccacagagc

SEQ ID NO: 16716 - DNA, 201 bp, Homo sapiens
gtgaagtctagatctccctgctaacttacactgtgctcaaaacacacacacacacacacacacacacacacacacacacacacacactggctgtcctcacygtcaactctagatctccctgctaacttacactgtgctcaaaaaacacacgcacgcacgcacgcatgcacgcacatacacacacacacacacacccatagg

SEQ ID NO: 16717 - DNA, 201 bp, Homo sapiens
aattatgtagtgtctacagagccagtggtttattttgcattgtttatgtcagcattaagcagtattcttacacagtttgtaagtcttaaaactcagtatckactctagtagttgctccaaatgtgatgtcctcataaatcaccgagggatcttgttaaatttggattctgattcagtaggtctaggtggggcccgagcttc

SEQ ID NO: 16718 - DNA, 201 bp, Homo sapiens
ccttgtttgcccttccccgtgcctcttatgaagctcaggccttttggcagtcagaggcctcaatggtgcctgtgtccacagggctggctgtcctcaccgtsaagtctagatctccctgctaacttacactgtgctcaaaacacacacacacacacacacacacacacacacacacacacacacactggctgtcctcactgt

SEQ ID NO: 16719 - DNA, 201 bp, Homo sapiens
ggatcacctgaggtcaggagttcaaaaccagcctggccaacatggtgaaacccccgtctctactaaaaatacaaaaattagccgggtgtggcggtgcatgmctgtaatcccagctacttgggaggctgaggcaggagaatcccttgaacctgggaggtggaggttgcagtgagctgagatcacgccattatactccagtct

SEQ ID NO: 16720 - DNA, 201 bp, Homo sapiens
cgtgtgaatgtattgcagaaatggacaggacaattctcagcccattcatcttacagacctcaagtgaacaggcacaaaacaacaggctccaccctccttcycccctctatctcatactttacctcaatttatgacttggcttacaatccgttgcagaaagcctagctccccagcttctcctgaatctacgtttttctattt

SEQ ID NO: 16721 - DNA, 201 bp, Homo sapiens
tgggtaccttgcatcctcctttgttcccatactaacccctacaaccatggtcattttgtggttatctgtttaattctctgctggctattccaggctgtcasctccctgactacaaggactttgttgctcacaatcatatccacggcatccacacaagatctggccgctacgtggaaggacacatagttccgtctggcttgg

SEQ ID NO: 16722 - DNA, 201 bp, Homo sapiens
gtgtttcaccaggttggccaggctgctctcgaactcctgacctcaggtgatctgcccaccttggcctcccaaagtgcagagcaggaatttcattggatttstacactgctgctttttcagagcctggaacagtgccaagcacatagtcggccctcagtgagcatttgttgactaacttaggtcacagatgtggggctgtga

SEQ ID NO: 16723 - DNA, 201 bp, Homo sapiens
tttgagacaggagtctcactctgttgtccaagctggagtgcagtggcgcgatgtcagctcactgcaacctccgcctcctgggttcaaacaattctcctacstcagcctcctgagtagctgggattatagtcacctaccaccatacccagctaatttttgtattttttagtagaaacagtgtttcaccaggttggccaggct

SEQ ID NO: 16724 - DNA, 201 bp, Homo sapiens
tgattgtgagaagtccacattgctccatttggacttcctttttgtagtgggctattagattttgcctctgcttgtttctgaatacccaagcttgctaacamagggaaagaccaattatcatgattattattatttaccttaagacctgattctacctatctatgatcacatagacatttggaagcaaagagaaatgctttt

SEQ ID NO: 16725 - DNA, 201 bp, Homo sapiens
cagcctcccaaagtgcagggattaaggcgtgagccaccgagcccagccggcaaacttactttaaaacacattgcaataaaataaaaagaaaagggattgtsctaagtgagaagcagagatgaaaatgtggaaggatgattgtgagaagtccacattgctccatttggacttcctttttgtagtgggctattagattttgcc

SEQ ID NO: 16726 - DNA, 201 bp, Homo sapiens
gcacgatctggcttacgatgatttctaacatctcaccatctttacttctgtatataaatatatgataagtatacctttatatatgtgacatgtatctttayatatgatatgtatggttacatatctactcactcacacatccacacacacacacacacacacacacacacacacacaccttttttggaaccattgaaaagt

SEQ ID NO: 16727 - DNA, 201 bp, Homo sapiens
aggctggtcttgaactcttgacctcaggtgattcacccacctcagcctcccaaagtgcagggattaaggcgtgagccaccgagcccagccggcaaacttaytttaaaacacattgcaataaaataaaaagaaaagggattgtcctaagtgagaagcagagatgaaaatgtggaaggatgattgtgagaagtccacattgct

SEQ ID NO: 16728 - DNA, 201 bp, Homo sapiens
gagaagacagtggattgtttctctgggtggtcaaggaaggcttccaggcagaggaggtttggccatgggtaccaaggggtagagatgggaaccttccaggkacatggacccgatgctgccagcagaggggaaaccatggccctaagggcagagcacactggggcgggggtgggggttcagtgacagtctggtggcctgtgt

SEQ ID NO: 16729 - DNA, 201 bp, Homo sapiens
ctacccccgcccccgggttcaagcaattgtcgcacctcagcctcccaagtaactgggattacaggtgcccaccaccaagcccggctaatttttctattttmaatagagatgaggttttgccatattggtcaggctggtcttgaactcttgacctcaggtgattcacccacctcagcctcccaaagtgcagggattaaggcg

SEQ ID NO: 16730 - DNA, 201 bp, Homo sapiens
tcaggctctcaggccctatccacagatgacctcacaacatgactgttggcttcttcaagactgaaggaggctcccccatgctctgagtcactctcttcagygagggcccagccccttttaagggcctagcgattagatcagtcccacttaggattgaatcccttttgattaatgcaaaaccaactgcgttcaggcctccat

SEQ ID NO: 16731 - DNA, 201 bp, Homo sapiens
caataaaaataaaaagctgtgtgggaagtcagaacttggttgcttcatgtcatatttcctatttttaagatttacagatattaacgactccttgggaaaastggacttcagtcgcctctctccaacaaaaaacgactattgggcgatgctggcttataacaggtccaagctctgcaacatcctcttctccaacgagctgca

SEQ ID NO: 16732 - DNA, 201 bp, Homo sapiens
ctgacccagtgctaggcacgtgagagtgagagggatggaatgcttgcaggagttgccttggatatcacacactgacttgggagacacacatagcgacagawaattacaacatagggacacccggggaaaatgtagacgaggtttaggggttgctcagaggaggaattaactctataaggaagtattctgataatggctttc

SEQ ID NO: 16733 - DNA, 201 bp, Homo sapiens
tcaacttgcactctttcctgcatacagcttgtttctctaatgtggctgttctcatgtttacttaatggcccagccatctcctcctcctcctcctcctcctyctcctgctttctattctccttcctcatcattgtcctcttctgcgagttcagaaaattgggttacaatacctacaacgtgcagtgaggacactcttttatc

SEQ ID NO: 16734 - DNA, 201 bp, Homo sapiens
ttcttcatcaactttggccaaaccttcgtggattcctgtgtgctgattattagtgccttgcctacaaatttttaatacattgacttatctaaatattcctscatgcacactccccaatctaagaaaaatgtgagatgttgggaaatgtttccaagaatagaccaaaggattagtcagcctagagaagtgaactttaagagg

SEQ ID NO: 16735 - DNA, 201 bp, Homo sapiens
gtctgactccagaagcactttcctcttttgcctcctaatacattttcttatagggagcatcctgcaatacaactgttaagaccacttaatgttatctttgrattaaaaatggtaccactctcataaatcaatgagtttcataccctaaattatgccagattaagaaaatgaaatctgactgtaaattacttctctaggagc

SEQ ID NO: 16736 - DNA, 201 bp, Homo sapiens
aaaagttgctatcatgtccttcaataacccagtctaaccatgtttttccagtggaaatgattcccggtagaatgtcctatgttccttttgcacatttctcmttacaaacatcatctcatttaatcctcaccacaaaactgatagtgtcatctccaatttatagttgaggaaatagaggatcagagaagctacgtgatctat

SEQ ID NO: 16737 - DNA, 201 bp, Homo sapiens
tccaggtactttcacctctaggctcttacctggcttttgtgaagcccctcagggaagaggaggaaagctgggcaagggggaggggtaaaccaagtcccagsaaagtcattccagtttcccaagatcccggagcttgtttgtatccagctgagatccagttgagaccagaattcactctctccacacctccatcagctgtgg

SEQ ID NO: 16738 - DNA, 201 bp, Homo sapiens
gtatacaagtttctgtgtggacatgttctcacttttcttgggtatatacttaggggtggaattgctgggtcatatgatcagtctaggtttaactttttgaygaactgacaaactgctatccacagtggctgcctgtaccattttacagaaaatctctgcttttaatacttctggatgtgttctaaggcactaggcttttca

SEQ ID NO: 16739 - DNA, 201 bp, Homo sapiens
aacttctgagtggtgagtataagtgtgattattatattattcttagtatttggtttttttctgtagtgtgtagtttccctccatgacactgagggctcagrtggctctgaccttggagacagggagacatttagtgaaggaatgggaggtaaggagctggcatctctggtgtgtccatcatgcactgacctgcactagatg

SEQ ID NO: 16740 - DNA, 201 bp, Homo sapiens
tccacccacctcggcctcccaaaatgctgggataacaggcatgaaccaccatgcccggccatcagaaatattttatttcactattttaaaaaattagcaargaagcaaatatgacaaaatgctaacaattccaaaatgctaataacttctgagtggtgagtataagtgtgattattatattattcttagtatttggttttt

SEQ ID NO: 16741 - DNA, 201 bp, Homo sapiens
gattacaggtgtgtgctaccacggccggctaatttttttgtattttattagagacggggttttgccatgttggccaagctgatctggaactcatgtgctcragcaatccacccacctcggcctcccaaaatgctgggataacaggcatgaaccaccatgcccggccatcagaaatattttatttcactattttaaaaaatt

SEQ ID NO: 16742 - DNA, 201 bp, Homo sapiens
tgactcactgtgttgatgttatgttttctaacattgactttcctttaaaccatagggttcgaaaccgccaagtcttttgccctccatggtgcacatgtgaycttggcctgcaggaacatggcaagggcgagtgaagcagtgtcacgcattttagaagaatgggtaagcgcttgactgttgttgttttttttaattgtcaaa

SEQ ID NO: 16743 - DNA, 201 bp, Homo sapiens
gaccttgtgtccgtccccgctggccctcagttctctggatcagggttgaaaggctgaaattctttgggtgttagcttaggatgcctctgatccatcctaasccgacattcccttgatctctcctgatctgtgagcatcctggcccttcttttcttttcagttttaatttttgcgctggctccaaccccttttcattcctga

SEQ ID NO: 16744 - DNA, 201 bp, Homo sapiens
ttcagtggagtgtgtaaagtttattgctcttggaatcatgtctttatttttaaagtcatcttcactttgtttgtcttatgaatgaaagcatgagcaagtcmattattattcacgcatttgtttgtagttcattgtcagtgtcatctgctttattagtcaggggtttgagaatgtttcttcctttaactcatttattaagaa

SEQ ID NO: 16745 - DNA, 201 bp, Homo sapiens
gcgtctcctcctttgccactcagccccagaggtgcttctgcttccctgcaggcttgccctggagcctggcgctagggccctggggctcccttgctcctgcktgccccctgcgcctgccttcctgctgcctggcctttctcccatctgctttcttcctgagtggcccctggccaggggactcgggtgcatacatggtttcca

SEQ ID NO: 16746 - DNA, 201 bp, Homo sapiens
gaaaggctccttctcatccttcagagctgagcttacatgtcactgcccaagagaccttcttaactgtgggtgtcccctcgaccttgtactagtcaccttgyttctctgcttcttcgtgcttagccttggctgtgtactcctccttgttggccctgtctcccttgcccaggttgcagatgtcatggggcagcttgttcatct

SEQ ID NO: 16747 - DNA, 201 bp, Homo sapiens
agtctaggtagagggaacagtgagaggagagaccccctgcatggcctgtccaggggcctgtgatctttgtgagggtccaggaatgtgaaggttaaggcagsgaagggaggacccatttcaaggatttctgtgccttgccgagaagcttgggctctgttggcagagccagagagtggcattcattcagcttgtgaattctgg

SEQ ID NO: 16748 - DNA, 201 bp, Homo sapiens
gggtcagttcaggcactgtgcgtaaagcacatagcaccgtgtctagtaggtactctctgttccttaactgtcgttccttgattgctcttaagatacgacartgcctcttatatcggcaccttagaatcacctaggaaatgtcctaaatacacgttttgggtctccatagagaacctactgtagccgactctcaactttggg

SEQ ID NO: 16749 - DNA, 201 bp, Homo sapiens
aaaatgggttgatatgagggtcagttcaggcactgtgcgtaaagcacatagcaccgtgtctagtaggtactctctgttccttaactgtcgttccttgattrctcttaagatacgacagtgcctcttatatcggcaccttagaatcacctaggaaatgtcctaaatacacgttttgggtctccatagagaacctactgtagc

SEQ ID NO: 16750 - DNA, 201 bp, Homo sapiens
ttttcacctgtaaaatgggttgatatgagggtcagttcaggcactgtgcgtaaagcacatagcaccgtgtctagtaggtactctctgttccttaactgtckttccttgattgctcttaagatacgacagtgcctcttatatcggcaccttagaatcacctaggaaatgtcctaaatacacgttttgggtctccatagagaa

SEQ ID NO: 16751 - DNA, 201 bp, Homo sapiens
ctgcaaactacccccgcccccgggttcaagcaattgtcgcacctcagcctcccaagtaactgggattacaggtgcccaccaccaagcccggctaatttttstattttcaatagagatgaggttttgccatattggtcaggctggtcttgaactcttgacctcaggtgattcacccacctcagcctcccaaagtgcagggat

SEQ ID NO: 16752 - DNA, 201 bp, Homo sapiens
tatttttcgagatggactttcgcttttttgcccagcctggagtgaagtggcatgatctcggctcactgcaaactacccccgcccccgggttcaagcaattstcgcacctcagcctcccaagtaactgggattacaggtgcccaccaccaagcccggctaatttttctattttcaatagagatgaggttttgccatattggt

SEQ ID NO: 16753 - DNA, 201 bp, Homo sapiens
cctggtggcagtattggtggtcacagctggcaaagggaagtgtggctgcccggagagcttggctgaggttggaacgtgggagtttaagagagcaaactccmacagcttggtgcagagagaaaagtgtagaaaggtcgggtgtcatacagcagagggctgtgatgctctactgaggagtggaagtgtttttctgagggcatc

SEQ ID NO: 16754 - DNA, 201 bp, Homo sapiens
caggttttaggcaataataagtgagcagtatggcgccctaatagaaggagggatgcctgtggccaatatacacggctcaaagttgaccatgatagagaagytttccctagaaggtctgtgagggaggaggcctgggagagacagcagggtgaccagagtaagtgaagtcaccgaggtgccaatgagtgtggccctgcaggt

SEQ ID NO: 16755 - DNA, 201 bp, Homo sapiens
gcaggttttaggcaataataagtgagcagtatggcgccctaatagaaggagggatgcctgtggccaatatacacggctcaaagttgaccatgatagagaasctttccctagaaggtctgtgagggaggaggcctgggagagacagcagggtgaccagagtaagtgaagtcaccgaggtgccaatgagtgtggccctgcagg

SEQ ID NO: 16756 - DNA, 201 bp, Homo sapiens
caaatatcttactcctgggctgtgctggggatggcagcagagtggggtggttggatgggaaggcgggaaagagctagcttggagatgatacgcttttccayccttgaataacttgggaaaaagtcaggagtgtggaatgaagaattggaatataaaggctgagggcggacctaattttttttttaaggattaagaaaaaag

SEQ ID NO: 16757 - DNA, 201 bp, Homo sapiens
aggttcacatgataaatattttctgctttgtggcctacaaggtacctatcacaactactaagctatcatgcattagtgaaagcacatagataatctataarccaatgggcatggttgtgtgacaataaaactttatttagaaaaacaggtggtagactggatttagcttgtgggttgtagtttgctggcctctggtcaaga

SEQ ID NO: 16758 - DNA, 201 bp, Homo sapiens
gaggttgcagtgagctgagatcacaccactgcactccagcctgggtgacagagcaagactgtctcaaaaaaaaaaaaaaaaaaaaaaaaattcaacatacsaattttgcgaggacgcaaacatttaatccgtagtactgatgtggatatgatttgagctaagactctgctgttgattctcttcaaaaacttggcagtagcc

SEQ ID NO: 16759 - DNA, 201 bp, Homo sapiens
ttttcaacgagagttcagaaccacaccatacgggcagtagtccgcattttcaacatttcctaacagcacaattgttaggtagctaacaattgaattgactrtgtcaggtagacttatttttcgagttgtgctggttaactgcaatccaagtttaggaagcaaactaccaatttcatttaatagaatgagctaaccaaggca

SEQ ID NO: 16760 - DNA, 201 bp, Homo sapiens
ttccaatgataaatcctccctcctttgtcacagagccactgtgtactttcatagaccatcctatttttcaacgagagttcagaaccacaccatacgggcartagtccgcattttcaacatttcctaacagcacaattgttaggtagctaacaattgaattgactatgtcaggtagacttatttttcgagttgtgctggtta

SEQ ID NO: 16761 - DNA, 201 bp, Homo sapiens
tataactatctgcatttcaggtacagtgatctcctttaaaaaggctgcgtcccagcagcatagaccagctttacctcccagcgtagtcttcagacaagttrgggtattgccgaagtccattcttgactttttttaatagtgcaaacaaatcatcttgtttttaggaaaacatgaaattataaagaaattgacttcaatcac

SEQ ID NO: 16762 - DNA, 201 bp, Homo sapiens
gccaaattgaagggtaaactgagttcaccaggcaaactgaggaagggtactcaggctgaaggatcatgggaggggaggagcgtgagttcctcttaagtgartataaaccagggggtaggaaacaacatgagatgaggctggcgagagagaaggatgccaggtgaggtgctgtggtgcgccagagactgcggaagtggcttt

SEQ ID NO: 16763 - DNA, 201 bp, Homo sapiens
aatctttcggtctaagcaaattaatgtcatttttataactatctgcatttcaggtacagtgatctcctttaaaaaggctgcgtcccagcagcatagaccarctttacctcccagcgtagtcttcagacaagttggggtattgccgaagtccattcttgactttttttaatagtgcaaacaaatcatcttgtttttaggaaa

SEQ ID NO: 16764 - DNA, 201 bp, Homo sapiens
ggccccctgcatctcaaagccagcaacagaaactctcttgtgcatggagtcccctcctgctttgaatctctctgactttccttgactttgatgtctaggtytggatttcaagggctcagaaactctctcatgcatgtagttccctcctgctttgaatctctctgactttccttgattttgatgtctaggtctggatttcaa

SEQ ID NO: 16765 - DNA, 201 bp, Homo sapiens
aatcaactcaattaccagccctctcagacattttcataatgttttctggtagttgctctcctgtgaaaatctttcggtctaagcaaattaatgtcattttyataactatctgcatttcaggtacagtgatctcctttaaaaaggctgcgtcccagcagcatagaccagctttacctcccagcgtagtcttcagacaagttg

SEQ ID NO: 16766 - DNA, 201 bp, Homo sapiens
acttttggccccctgcatctcaaagccagcaacagaaactctcttgtgcatggagtcccctcctgctttgaatctctctgactttccttgactttgatgtytaggtctggatttcaagggctcagaaactctctcatgcatgtagttccctcctgctttgaatctctctgactttccttgattttgatgtctaggtctgga

SEQ ID NO: 16767 - DNA, 201 bp, Homo sapiens
accaaggtcatactaatcaactcaattaccagccctctcagacattttcataatgttttctggtagttgctctcctgtgaaaatctttcggtctaagcaarttaatgtcatttttataactatctgcatttcaggtacagtgatctcctttaaaaaggctgcgtcccagcagcatagaccagctttacctcccagcgtagt

SEQ ID NO: 16768 - DNA, 201 bp, Homo sapiens
gttcagaggcagtgaaagcgtgcttctcaggactcattgtccagaagattctgcctacagctggttttacgcagagaagtagcacacaaacccagtccatsatttcttatttgactctgtcctgtttactctgtcagggtgaaaagcacaggccaagctcggctagtcaaagcattactttgtcacaggcaggcttggctt

SEQ ID NO: 16769 - DNA, 201 bp, Homo sapiens
gtattctgttccctctttgctagttcagaggcagtgaaagcgtgcttctcaggactcattgtccagaagattctgcctacagctggttttacgcagagaastagcacacaaacccagtccatgatttcttatttgactctgtcctgtttactctgtcagggtgaaaagcacaggccaagctcggctagtcaaagcattact

SEQ ID NO: 16770 - DNA, 201 bp, Homo sapiens
ttcccactgcagccggtagcatattgcttcataaatgtctataaaaaaatacgaaaaatagaatcagagcaaattcagcatagacctccttgggatgtttwttctttgtttatgttggtgttttgttttgtgttgtttcagctggggtgcagttgtattctgttccctctttgctagttcagaggcagtgaaagcgtgctt

SEQ ID NO: 16771 - DNA, 201 bp, Homo sapiens
aatatatggctttttcctattggaaaaaattagtcgtgtgaactttattcttcaagaaaaagtagtttttatctgccttggaaatgtcaaaaggattcacragtttcacaagtgatgatctgggttgattgctaggaactgtttttagttagtttttttttttttttttttttttcagacggagtcttgctctgttgccca

SEQ ID NO: 16772 - DNA, 201 bp, Homo sapiens
agccagacatggaatcctttcttatgattaatgcagctaaatttcccactgcagccggtagcatattgcttcataaatgtctataaaaaaatacgaaaaayagaatcagagcaaattcagcatagacctccttgggatgtttattctttgtttatgttggtgttttgttttgtgttgtttcagctggggtgcagttgtatt

SEQ ID NO: 16773 - DNA, 201 bp, Homo sapiens
cctaaggtcccagccacctatggttctttggacctgtgattttcgctgaccccgaatgactggaggaactgctgcctgcatccccaacccagccctccttrtcagtcacgtagaaagcagttattgtttccaagttccctgcccttgttaaatgtcagctttgagtgaaaatgttcctaattttactcagagtgcaaagaa

SEQ ID NO: 16774 - DNA, 201 bp, Homo sapiens; identical to SEQ ID NO: 3303

SEQ ID NO: 16775 - DNA, 201 bp, Homo sapiens
ccatgagtaacgaagtcctctgtatctgatcctgggtctcctgttttctgctagcttcctcaaaacttggtagctaactcattaacttacaaggaagaggktgaacgtgtagacccttcacagtttgaaaaatcacctgatcaataactgagattatgaaaaggtaggaatgaaccaattatggcccaaaggctaactcca

SEQ ID NO: 16776 - DNA, 201 bp, Homo sapiens
aaatatgtgtatatatatatttgttagggtaaaacaaagtctataaaaactgttttcctttgttattgcccccaccaaatatttatatatatatacacacctatgtatatatgtatgtatagagagtctattatatatattacatatacataatatatacataatatataatagactctataatatagactctaataatta

SEQ ID NO: 16777 - DNA, 201 bp, Homo sapiens
tttgggctgttattaggtagactctcctgggacattctacacagctcctgcctccttctgtatgtaatatatatattatatatatataaaatatatattakgtatagataatttatatataaatatgtgtatatatatatttgttagggtaaaacaaagtctataaaaactgttttcctttgtcattgcccccaccaaata

SEQ ID NO: 16778 - DNA, 201 bp, Homo sapiens
cctgagtagatgggactacaggcatgtgtcaccatgccaggctaatgtttaaaaatttttcttagaggtagagcctcactttgctgcctaggctgatctaraactcctggcttcaagtgatcctcctgccttgagctcccgaagcgctgggaccaatagagatttctctgagaattaggtcccccactattaataaggtca

SEQ ID NO: 16779 - DNA, 201 bp, Homo sapiens
tgcagactgtataggcttctgcctctcgggaggcctcaggaaacttacagttatggcagaaggtgaaggggaagcaggtaatgtcttcacatggctggcastggaggaagagagaaagtagggaggtggtagatgcttttaaacaaacagatctcaggagaactctttcacaagacagcactagggggatggtgattagaa

SEQ ID NO: 16780 - DNA, 201 bp, Homo sapiens
tcttatttatcctgcatttataaatacacaaattcttgtacaattaactcagtttttcactcctttcttgcttgcaacttgtcaggtcgttccctccccastagttgtgaacttctttatgctagcttcttccatcaggggctcacaaccagggactgtagaggtttgcagaggtaaatcttggtagataaggattttatg

SEQ ID NO: 16781 - DNA, 201 bp, Homo sapiens
acgagacactcattccgaaggcgggtgtgtatgtgcaaactgtataatttttttcttcttttctatctgctagcaaagtgggtaagttgacccatgacatsgtccactggagggaccacatttgtgactctagcaattaagcctcccttctcatctgtggataaaactgacctcccagtgtgctggagtcaaacatattca

SEQ ID NO: 16782 - DNA, 201 bp, Homo sapiens
acaaggcagtagaggttggacgagacactcattccgaaggcgggtgtgtatgtgcaaactgtataatttttttcttcttttctatctgctagcaaagtggrtaagttgacccatgacatggtccactggagggaccacatttgtgactctagcaattaagcctcccttctcatctgtggataaaactgacctcccagtgtg

SEQ ID NO: 16783 - DNA, 201 bp, Homo sapiens
gtctcagtttcataatatgtgtaaaaattatcatgcccattcattatttaaagtgctgtggctttttagtgaataccaacattaacaaaccatgttaacaygatttaaaatatgtaatgaaatttgcaatgcatcagatgatggaactatcaaattagttcacgtggcgttggctgatcacccttatgaagagttacttgc

SEQ ID NO: 16784 - DNA, 201 bp, Homo sapiens
gaaagagagggaactgaacgggatgctttttattttgggctgttattaggtagactctcctgggacattctacacagctcctgcctccttctgtatgtaayatatatattatatatatataaaatatatattatgtatagataatttatatataaatatgtgtatatatatatttgttagggtaaaacaaagtctataaaa

SEQ ID NO: 16785 - DNA, 201 bp, Homo sapiens
atctatatatagatatctatataatatatataatctatatatgatatatatatcttattatatattatatatatagatagatatctatatacagatatctrtatacagatatctatatatatagatatctatatatatagatatctgtatacagatatctgtatatatatatagaaagagagggaactgaacgggatgctt

SEQ ID NO: 16786 - DNA, 201 bp, Homo sapiens
tattttttctagtttttttgttttgcttaataggctctctctctgtctctttctttctatatatatatataatatatagaaagatatataatctatatattgatatctatataatatatataatctatatatgatatatatatcttattatatattatatatatagatagatatctatatacagatatctgtatacagata

SEQ ID NO: 16787 - DNA, 201 bp, Homo sapiens
taaatagtggatgtattttttctagtttttttgttttgcttaataggctctctctctgtctctttctttctatatatatatataatatatagaaagatatrtaatctatatatagatatctatataatatatataatctatatatgatatatatatcttattatatattatatatatagatagatatctatatacagatat

SEQ ID NO: 16788 - DNA, 201 bp, Homo sapiens
cctgggacagtctacacagctcctgcctccttcttttcttcaggattatctcgagttggtttgcaaagtgaaacgcattagacatcttcaagtgggctgaagaaagggactcaatttttgtgggtccatgttaatgtaattcttatgaatttgagataaagtggtcattaaagcctagaaggaagggaaaagctacacccc

SEQ ID NO: 16789 - DNA, 201 bp, Homo sapiens
cactgcagtcctgggacagtctacacagctcctgcctccttcttttcttcaggattatctcgagttggtttgcaaagtgaaacgcattagacatcttcaagtgggctgaagaaagggactcaatttttgtgggtccatgttaatgtaattcttatgaatttgagataaagtggtcattaaagcctagaaggaagggaaaag

SEQ ID NO: 16790 - DNA, 201 bp, Homo sapiens
cagtattttgtcctattcatgcaatataatttatataacctaattgataaaacattttggttgattgcagtctgtcgtagataatgccgtactgaatattmctcccacatatttgcaagtctatttgtaggataaatttctggttgtggctgggtcaaagagcatgtccacttcaaatttgatagctatgtcccaactgcc

SEQ ID NO: 16791 - DNA, 201 bp, Homo sapiens
acaagtcacagggcttatctccattgttctgaacgatctgtagctaaacaaaaagataaaagctattaatattattaatagttgtagattaccgggaagarcgcatcctaaatcagccattagatttgttcctcatttctttgctttacaaattgtttttctgtatagtattggattttcaataaataaagtatgatataa

SEQ ID NO: 16792 - DNA, 201 bp, Homo sapiens
gcaagtgtgatcattcaggtaatcaaagtaactacagaaacagaggtatggattagctagtcattgcagatgtggcattgagcatataagcgtggtgtacwtcttagaacttcatctggaaatgcctgtgggggagttggatttcaagatcatcgtcaatgtcatgtcactgtaatttcatttacattaatcagattagtt

SEQ ID NO: 16793 - DNA, 201 bp, Homo sapiens
tcccatcctggcactgcagtcctgggacagtctacacagctcctgcctccttcttttcttcaggattatctcgagttggtttgcaaagtgaaacgcattagacatcttcaagtgggctgaagaaagggactcaatttttgtgggtccatgttaatgtaattcttatgaatttgagataaagtggtcattaaagcctagaag

SEQ ID NO: 16794 - DNA, 201 bp, Homo sapiens
atgcggaagccttcgcccccttcttgagggtgtttagggattagatgagtgtcccatctgggtttcccatccctgcagagcccacgtgtggggtgctgagrggtacgtggtgggtgactccctggggagcactgtttggtactgatcactgtcccatcctggcactgcagtcctgggacagtctacacagctcctgcctcc

SEQ ID NO: 16795 - DNA, 201 bp, Homo sapiens
ccgaggctggggaggttgaggccgcagtgagccgagatcgagtcactgcactccagcctggacaacagagtgagaccctgtctcaaaaaaaaaaaaaaaaatccagtaggaaactatataaacactagggttgctttaaaatgtcaaggccaactcttatgatatgcggaagccttcgcccccttcttgagggtgtttagg

SEQ ID NO: 16796 - DNA, 201 bp, Homo sapiens
tacaagggccggatgcggtggctcacacctgtaatcccagcactttgggaggcctaggcgggtggatcacttgaggcctggagtttgagaccagcctggcyaacatggtgaaaccctgtctctactaaaaatacaaaaattagccaggtgcggtggcgcaaacctgtaatcccagctacttgggaggctgaggcaggagaa

SEQ ID NO: 16797 - DNA, 201 bp, Homo sapiens
cgaatggttttccaatcttcaaaccaacctatatcacaaaagcattctgaaaactgggaagagatcacttcacagtttcctgaaccactagaaaaaaaaaatgttcataaatttatagccgctgacattgaagttggagaaaagagcatatctagtacctatgctatgtggagaacactctccatgtctttgaaaaataag

SEQ ID NO: 16798 - DNA, 201 bp, Homo sapiens
gggttttaccatgttgcctaggctggtctcgatctcctgggctctagcaatcctcccacctcggcctcccaaagtgttgggattacaggcgtgagctaccrtgcccggccttacgtttcagcatctttcaatccatctaatacgcagtgccagggaaggtttgtgaaaacatttgaatcacagagtcacaaacagtgagaa

SEQ ID NO: 16799 - DNA, 201 bp, Homo sapiens
aaatcaggatgctcaggaaataccttgtttggaataggaataggctcctccctttttttctcacttgccttgattgctctgtattaaaattcataaaggcycatgaattatcaattagatagcatttggtttgttatttttagtttcttcctatagcaggcatgtatgcatgtgttaaaaatggaagtagcgtcgacatta

SEQ ID NO: 16800 - DNA, 201 bp, Homo sapiens
aaacaaaaaggaggataccaatttaagcttgtcaaaaagattttcccccaaaagaaaaacacattaaaaacaacgacaaaaatcaacaaaaactaacactrttcccccatcaacaatcaatattactttctaaaagcaagggcgttttgacaccagatattgtgaggacatccacctgctctaagggacagccatttcact

SEQ ID NO: 16801 - DNA, 201 bp, Homo sapiens
ttcaaaagctacagagataccgtaacatttaaaaaaataaattttcattgtggaaatcaactgccacaaaaacacaaccttttacgagacaacgtgatgtrcatgagaagccctgatgttgagaagctcataattcggtgtgagaaacacacaaggcatgatgccattcccatctgggatgaacagggaagacttcctggg

SEQ ID NO: 16802 - DNA, 201 bp, Homo sapiens
ggtcttctaattctctgtgatgaagttcaaactgaagactgttactagtgtcgtgtttgtttctttttctctctcttttgttttgtttgtataaaatgccrgggatgaagggatccacttaataaaaaggcccattgtgttcagggagcagcctgttctgccaaatcacacaagggcatgtgttttcatgacattattgct

SEQ ID NO: 16803 - DNA, 201 bp, Homo sapiens
gtgggcttttctttctcatttgctttcgcttagtattttccattattcatttggcttcttgaaccctccctatctgtaccccacacttactcttattcacycagaacaggtgtgtgccaccttggagaagatgaagccagagagaaaatcagtcagacaggaattatgttgaaaggtgactgaatacattaccacctccca

SEQ ID NO: 16804 - DNA, 201 bp, Homo sapiens
gctctttttttctctctcactctgagtatttagaggcttttattgctatttttctaaaaggcaacattagtaatcaactttgccaaaaatttcatatgaayggtgggcttttctttctcatttgctttcgcttagtattttccattattcatttggcttcttgaaccctccctatctgtaccccacacttactcttattca

SEQ ID NO: 16805 - DNA, 201 bp, Homo sapiens
gaaaagattactgacgatcaacatgctgaactgacatttcacagatatgcagatttattcatctctgttcaaggtatgccttttccaatcataatagccaygtagaggacattaaacaaatattttattgtggtaaaaacacttaacatgagacctacccttttaacaaatttttaaatatataatttattattattgttg

SEQ ID NO: 16806 - DNA, 201 bp, Homo sapiens
cactttctgttggactgcttttggaaaaagaaccacaagtctctatttttaaaatagaggtacaatgataaaacaaaacaaaacaaaacaaaaaaacaacaaaaaaaaaacccacacaggtctcatcagccaagggatttaaaaatcaaatttaacttcaaaaaactgaagttgatatagcaggatcttggagatgcagtt

SEQ ID NO: 16807 - DNA, 201 bp, Homo sapiens
tgtccaagaagcatggtgccaatgtatttctgatgagggcgtcaggcagcttctactcatggtggaaagtgaaggggagccagcatgttcagagaacatayagggagaaagggagcaagagaggggaggggaggtgccagagcctttaaaagaaccaactctctgggaacaaatagagggagaacattaatctagccatga

SEQ ID NO: 16808 - DNA, 201 bp, Homo sapiens
cacaaatgtgatccttctggaggccagaagatagattcagtgggccccagttctttcaggtttaaggaataagcattttggtctatgaaaaatggggtttkcctaaagtataagattgtcttatatttataaatgcctgtgttcattgctgtgggttcactgctttctcttttgggcagccatataaataaaagaaccacc

SEQ ID NO: 16809 - DNA, 201 bp, Homo sapiens
ccacctaatttttgtgtttttagtagagatggggttttgccatgttgctcaggctggtctcaaactcctgacatcaggtgatccacctgcatcggcttcccaaagtgctgggattacatgcatgagccatcgcgcctggctaggaactcctgtttctgtttttatcctcttcccaagtctgcaggccccgcctggcccacc

SEQ ID NO: 16810 - DNA, 201 bp, Homo sapiens
aaagcacacacaatgatggccagagacactgctcagtgtactgtcttccaccgggacagcccactcaccaagggttaggtcctgtgctgactgggtcccgkgtctcctcggaggtcggtttgcatcacgtggatacactaatctacccaagttgacttggagaaccaatctgaaatcagatgggagctcccggaagcaaag

SEQ ID NO: 16811 - DNA, 201 bp, Homo sapiens
tgaggcaggagaatcacttgaacccaggaggcggaggttgcagtgagccgagatcacgccattgcactccagcctgggtgacagagtgagactccgtctcaaaaaaaaaaaaaaaaaaaaaaatctgtgttcttgcctggcttattgagctccatggtaaatgttcagaggctgcaggaatgattcaaagtctgactgatt

SEQ ID NO: 16812 - DNA, 201 bp, Homo sapiens
cattaaataacatgtccaaagtctcccatttcagagacaggggcatttggctccaggtttttctgactctagacagtagtttgtttttagcacatcaaatktctgagacttgtgatgtgttagaaagcacaaaggactttgatcacaagatcaagccccagagggccatgactgcataaaccacaacaactgcgtggctgc

SEQ ID NO: 16813 - DNA, 201 bp, Homo sapiens
acaagggaatatgtgaggtagggtaggacattttggtagcagtcacacagcccaaagagcatggtgaatttaattagtctgccacacctgtatggccttaygttttccgggataacttaacaagcattgtgtgcagccaggtcaggcagatggaggttctaatccaggctgcacacctcatcagccaggagactacagata

SEQ ID NO: 16814 - DNA, 201 bp, Homo sapiens
aatcccagctgctagggaggctgaggcaggagaatcacttcaacccggaaggcggaggtttcagtgagctgagatccagcctgggtgacagagcaagactycatctcaaagcgaaacaaaacaaatgagggtcctcatcagcgtgcctttgacactgtcctctggtcctggtgatctgaatacatcaccacagaactgcca

SEQ ID NO: 16815 - DNA, 201 bp, Homo sapiens
agagcaagactccatctcaaagcgaaacaaaacaaatgagggtcctcatcagcgtgcctttgacactgtcctctggtcctggtgatctgaatacatcaccrcagaactgccagggtacgtgtttcctagcccatagcgagtcccagtgaaagcagagatgagaaagaaaggagggacacaaggtctgggtcctgagttcca

SEQ ID NO: 16816 - DNA, 201 bp, Homo sapiens
tgctggattatctagtccctgaacagccatttatatttttgttacgcttgtggtttttaaatcatcctcatttccttgatcgcatttgcttctcctggctrgaatgtgtaggagacgggtcggggagactgtgcccatttgacaggtgtgaatgcgaacagaggctgcagctggttagaccagggctgtgcaaccctagag

SEQ ID NO: 16817 - DNA, 201 bp, Homo sapiens
gcttgtggtttttaaatcatcctcatttccttgatcgcatttgcttctcctggctagaatgtgtaggagacgggtcggggagactgtgcccatttgacagrtgtgaatgcgaacagaggctgcagctggttagaccagggctgtgcaaccctagagccattgccttgaccacaaagccacagtctcctagtcctaatatta

SEQ ID NO: 16818 - DNA, 201 bp, Homo sapiens
ttaaatcatcctcatttccttgatcgcatttgcttctcctggctagaatgtgtaggagacgggtcggggagactgtgcccatttgacaggtgtgaatgcgracagaggctgcagctggttagaccagggctgtgcaaccctagagccattgccttgaccacaaagccacagtctcctagtcctaatattaagaggtaggag

SEQ ID NO: 16819 - DNA, 201 bp, Homo sapiens
ggagacgggtcggggagactgtgcccatttgacaggtgtgaatgcgaacagaggctgcagctggttagaccagggctgtgcaaccctagagccattgcctygaccacaaagccacagtctcctagtcctaatattaagaggtaggaggtagatagagattgtcccttaagccacattccattcttcatatttttgtaccca

SEQ ID NO: 16820 - DNA, 201 bp, Homo sapiens
gacttaatcttcatgatgtttgtaaagtaatacttcttggagaaacctcccaaatttctatcgacactagacatctcaggatttgaaatgttaagctaacraattgttcatcaggtgtatctccagccctccgtaaacactgccggatggatgaacctacgtaatgatctcctggtgccattttcctgactgtagatactt

SEQ ID NO: 16821 - DNA, 201 bp, Homo sapiens
ttcccttgcatttggttttcatcccccatagtcttcctttttttattttttattttatttatttatttatttatttatttatttatttatttatttatttattttttgagacagggtcttaatctgtcccccaggctggagtgcagtgacatggtgatggctcaccacagcctcagcctccctgggctcagtcgatcctcc

SEQ ID NO: 16822 - DNA, 201 bp, Homo sapiens
tgctgtttaggaaagaaaaatgatatcgctcagaaaatcatttaaaaacttcctggtgaatgcacccagctcgccaatgcatgccagccacagggcctcayagcacatttcaggagcaagacaattcagaccccactcttccccctgaaaaacctccttccagaaccctcttttgcagtgagcagagataagcctctccaa

SEQ ID NO: 16823 - DNA, 201 bp, Homo sapiens
gctccctggaagatggatcttgccttgtggatgtttttctaccgtgacagaagatagaaaggatgaaatagaaagagtgtgagtgaattctgcacccaccmcccccccccagcttccccacctgtaaaatgatttgctcaaagtttgcaaagaatggaggcatattcaaagtgctcagcactgggccggacccatgggtat

SEQ ID NO: 16824 - DNA, 201 bp, Homo sapiens
ccagatccaaaaagttattttggcaaaatgaaatcagaacgtggccccttccatgaaagtcagctcaggcgtagaatgttcttttttttaattttttttttaacgaaactcacatcttctttaaataaaatctccatttagaaatttttgaagacttgtggatagaagaagtaaccttgaaaagggcagagctgagccaga

SEQ ID NO: 16825 - DNA, 201 bp, Homo sapiens
agtttgtcttggctctgatcacccctttttgtgacttagctggctgggaagtagcaaaagtatcttccaagctcagcttctctctgcttgcattctttccmaatacgtgattccaaagcccatgcccaatccttgcactgaagcttttagcaggaaaggtgaacagaggcatctggatgcatcgcggccagtctgcccctt

SEQ ID NO: 16826 - DNA, 201 bp, Homo sapiens
gtgttcttgcctggcttattgagctccatggtaaatgttcagaggctgcaggaatgattcaaagtctgactgatttatgtgcattgggcattttgttgatrtcattcagattaatgatggcactgaaaatgtgtaatggaaatgagaagtttgtatcctgcctgctataccatgattccaatttaagagggggtaaaaata

SEQ ID NO: 16827 - DNA, 201 bp, Homo sapiens
agaaatactcccttctggacactggaagggcaaatgaggtgcaagccttttttttttctttcttttcttcttcttcttcttcttttttttttttttttttttgtttttcctcccagcctctctcctttcccattatgcacaatgcgctgagaaaggattcccagtccccctggtaaaaagtctgaaggatgccgaggagtt

SEQ ID NO: 16828 - DNA, 201 bp, Homo sapiens
gttcagaggctgcaggaatgattcaaagtctgactgatttatgtgcattgggcattttgttgatgtcattcagattaatgatggcactgaaaatgtgtaayggaaatgagaagtttgtatcctgcctgctataccatgattccaatttaagagggggtaaaaatattgcactttttaatctattgttttttgaaagagact

SEQ ID NO: 16829 - DNA, 201 bp, Homo sapiens
agagcccaggaagtctaggctgcagtgagccatgaccttgccactgcacaccagcctgggtgacagagggagaccttgtctcaccaaaaaaaaaaaaaaaagagagagaggttgagctcaactgatcagcatctcagattaagggcctccattccccccatgctttgtaattgctgcctgttttccatgaagcctgactgt

SEQ ID NO: 16830 - DNA, 201 bp, Homo sapiens
tacagtggctcatgtctgtaattctagcactttgggaggccggggcgagcaaattgcttgaactcaggagttcgaggctagcctgggcaacacggcaaagscctcatctctacaaaaaatacaaaaattagctgggcttggtgacagacgcttgtagtctcagctactcgggaggctgaagtgggaggatctttagagccc

SEQ ID NO: 16831 - DNA, 201 bp, Homo sapiens
gtcactccatagagaggggtttgtggaaatcctttttttttttttttttttttttgcttctttctgtggatctgtttggaaatgtaacattttaaagcccytcttggctggaggattttttatggtaaacataaaacgttcattgaaacattaaacattttacagctgtttttcagcacataaattttcatagacatccac

SEQ ID NO: 16832 - DNA, 201 bp, Homo sapiens
aaaacgttcattgaaacattaaacattttacagctgtttttcagcacataaattttcatagacatccaccccctcactgccacaccccctcatagatttcytcttttcctcctccttctcctcctccctcttcctcctctttttccccccccttcaaatagttccaagaccagagttgagggtgggtgggtagagggctag

SEQ ID NO: 16833 - DNA, 201 bp, Homo sapiens
gttgacctggaatgacctagaccagcagtcacaagctcctgcccatggacaaaatacagccggtacctctttggctatggcctgcaggctcagaatagttyttacattttcaatcatctgcaaaaaagaataaagaggagaatattatttcttgaaggaggaaaatgatatggaattctgatttcagtgtcataaagtttt

SEQ ID NO: 16834 - DNA, 201 bp, Homo sapiens
aaactataatctttctctctgcctcagtttttccacctgtcagtggaggggcatgctcttggatgcctgagtttttcttagactcagcatcctgcagccgmaataaccatgcttcttagtggtcctcttgcgtagcagcctaagaaactccaagtccatctgcgccgaagagtattgaacttggccagagcacttgggatc

SEQ ID NO: 16835 - DNA, 201 bp, Homo sapiens
taattatataaaaaaagcatggaaactgggcattttaattagcaagtacagccttgacacaaataaaggcatggctttggttatgcagtgcatttatttgrttttcttgaaataagaaaaaaagatttcttctccatcaccagagttgctgagtttgacagtgtgaatgagatgacctctaaggcctctacttatagatct

SEQ ID NO: 16836 - DNA, 201 bp, Homo sapiens
tgggcattttaattagcaagtacagccttgacacaaataaaggcatggctttggttatgcagtgcatttatttggttttcttgaaataagaaaaaaagatwtcttctccatcaccagagttgctgagtttgacagtgtgaatgagatgacctctaaggcctctacttatagatctgcacggttgggcctgggagctgtact

SEQ ID NO: 16837 - DNA, 201 bp, Homo sapiens
acagtctgtgctgtgtcctgcactgtccattatctgcaggggtggtactgctgtccccagggaagagaatgctgtccacaaagagccagccatttatactmttaaaagaatacacaggagttgaacaatgagaacacgtggacaacgggaggggggaacatcacacaccggggcctgtctgggggtagggggaaaggggag

SEQ ID NO: 16838 - DNA, 201 bp, Homo sapiens
tttcgagaaggcaatatagaaaatgcagtgggtagcccaggactcctggtccaggtaaagcaggccttgttgctattcccctggaccatgatattacatgytgggatgatggggtcttgtgatactgattaatttaaggctgcatgatgatgagggaggaacaaagatgttcttgagtcagtacctgccagagtggctgta

SEQ ID NO: 16839 - DNA, 201 bp, Homo sapiens
gtctcaagctgctgatttccgggagcaaagctgctgtgggacatgagactctttgaggcagaatacctctcatgcctggagagcattacaggctgcattastctgttttcactctgctgataaagacatacccaagactgtgcaatttacaaaagaaagaggtttaatgaactcacatttccccatgtctggggaggcctc

SEQ ID NO: 16840 - DNA, 201 bp, Homo sapiens
ggcctggtcacatcttctgacctcaagtagtttatagtccaaaaagacattggctctttgggatagaggcactttttgggggagagaaacatgaatgcaaytttttacatagagtatgaaactctgttccaaatctctcaaactcaggttctttgattcttaaggtatttttcactgccgagttgctgtcattgaaacaaa

SEQ ID NO: 16841 - DNA, 201 bp, Homo sapiens
tctctcaaactcaggttctttgattcttaaggtatttttcactgccgagttgctgtcattgaaacaaaatctgtcctggtcaccactgtatgcccagcacstagtacagtgccctgaacatattaggtactcattaaatacttgttccacgaagttgttatttggtattcacgagttttgtctcaattccttttgattctt

SEQ ID NO: 16842 - DNA, 201 bp, Homo sapiens
ctgggacaaggacgatggacaaagttatgggggtgctaaaaacctcagtaatgaagataaatgatattctaatctaatattttaaaaaatcgaggctaggygtggtggctcatgcctgtgattccagcattttgggaggccaaggtggacggatcaccagagttcaggagtttgagaccagcctggccaaaatggtgaaat

SEQ ID NO: 16843 - DNA, 201 bp, Homo sapiens
agttatgggggtgctaaaaacctcagtaatgaagataaatgatattctaatctaatattttaaaaaatcgaggctaggtgtggtggctcatgcctgtgatyccagcattttgggaggccaaggtggacggatcaccagagttcaggagtttgagaccagcctggccaaaatggtgaaatgccatctctactaaaaacacaa

SEQ ID NO: 16844 - DNA, 201 bp, Homo sapiens
cagcctgggcaacacagcgtgactccatctcaaaacaaacaaacaaaacaaaacaaaaaaggtttaagaaatgttctagtaccttgaaaccaaaataggtrtcagatacttggctgttttgttttttcttcttagccattttgacctgtgagattttatgtgatgaaaacataagaatgtggtattacaccctgtgatttg

SEQ ID NO: 16845 - DNA, 201 bp, Homo sapiens
ggtatcagatacttggctgttttgttttttcttcttagccattttgacctgtgagattttatgtgatgaaaacataagaatgtggtattacaccctgtgakttgaattttccatactccattccattctatatgtcagatgcatcttcctaaaacacacctttgtcacatcactcctctgctcaaaaacattcagtggctc

SEQ ID NO: 16846 - DNA, 201 bp, Homo sapiens
cagatggagggaaagagaggcgggggattccaggtacagtggctcatgtctgtaattctagcactttgggaggccggggcgagcaaattgcttgaactcasgagttcgaggctagcctgggcaacacggcaaagccctcatctctacaaaaaatacaaaaattagctgggcttggtgacagacgcttgtagtctcagctac

SEQ ID NO: 16847 - DNA, 201 bp, Homo sapiens
gagaggaagcaaagtgagacagaggtggtgtgtgagcgtgtgtttgtgtgtgtgtgtgtgtgtgtgtgtgtgtgtgtgtgtgattgagagagagagagacrgatggagggaaagagaggcgggggattccaggtacagtggctcatgtctgtaattctagcactttgggaggccggggcgagcaaattgcttgaactcagg

SEQ ID NO: 16848 - DNA, 201 bp, Homo sapiens
cgggaggcagaggttgcagtgagccaagatcacgctattgcactccagcccaggcaacaagagcaaaactctgtctcaaaaaaattaaaaaaaaaaaaaaagaaagaaaattaatttctcagaggtagtaataggggtggctgtcaccatccttggccaaggagagggagcagatactggagacagttgaaggtgccagga

SEQ ID NO: 16849 - DNA, 201 bp, Homo sapiens
attgcttgaatccaagagatggaggttgcagtgagccaaggtcgtgccactgcactccagcctgggcaaaagagtgagactccatctgaaaaagaaaaaagaataggcacagacaatttacctggatcctcacattgcaatgctgaccactccggaaggagtgtagaagttgcagctcatgcctgcattccaaatggctgc

SEQ ID NO: 16850 - DNA, 201 bp, Homo sapiens
ccatgtggcacatacccctgtacatgtttgccaagactgctatatggtagagcttggaattcttaggagctttatcaggtaattgcaagtcccccacctcyaagaaagcactctctaggtcaagaatcagcaaatgttttctatagaggcccgtaaaattaatattttatactttgtgggtcatatagtctctgtttcaat

SEQ ID NO: 16851 - DNA, 201 bp, Homo sapiens
gaggcaggaggatcacttgagcccagaagttcaacattatagtgagccactgtactccagctgggtaacagagtgagaccctgtctctgaaaaataaaaayaaaaaaaaaaattaagttagaagggagggattacgaccctcatgtgtatcaagaaacaagctccatgaagccccgtaggatggctcagcaccagaacgag

SEQ ID NO: 16852 - DNA, 201 bp, Homo sapiens
aggcaggaggatcacttgagcccagaagttcaacattatagtgagccactgtactccagctgggtaacagagtgagaccctgtctctgaaaaataaaaatwaaaaaaaaaattaagttagaagggagggattacgaccctcatgtgtatcaagaaacaagctccatgaagccccgtaggatggctcagcaccagaacgagg

SEQ ID NO: 16853 - DNA, 201 bp, Homo sapiens
tgtctgtgtgtgtgtgtgtgtgtgtgtgtgtgtttgaataatactcctatgaacattgtaccaatatctattcagatctctgctttcgattcttctgcatrtatacctaggagtgaaattgctgcgtcgtttcgtatctgtgtgcttaaccttttgagaaactgccaaactgtcttcaacagcagccgcatcattttacat

SEQ ID NO: 16854 - DNA, 201 bp, Homo sapiens
gtggattggtaagggacaggtggtgaagactgaaacagggtatccagttaggaagctaccacagtgatccaacccccagcttctgttgaggttgaagaacmtgcatgcccaacctaaatatatgttcaaaggtggttattactgtttgaggtgatgaaagagttttggagatagaagtgatggttgttcaacatcatgagt

SEQ ID NO: 16855 - DNA, 201 bp, Homo sapiens
agccctttcttgtttagtgttgtgtcttctgtgtcaacatctctggaacatagtcaatggcagtacccagtagaagccatatggatactttttctcaagtsttgaaataaattaatggtgtggccatggttctcgtacttcaggtccctgtgagcccctggggtcctacacaacttggggtaatgctatggtcacctgcat

SEQ ID NO: 16856 - DNA, 201 bp, Homo sapiens
cctggggtcctacacaacttggggtaatgctatggtcacctgcatcccctcctctccagccctcacctggttttctcttctccttccaagaaaaaacaccyataccattcttaacatctctggaagctgggggtcaggagagggagatccataaagttcttgtcttccccgactcaagaagcttaagggtacattcactca

SEQ ID NO: 16857 - DNA, 201 bp, Homo sapiens
tggtaccctgagcaattttaagttataaatatgagatcactgaaagtggagttggggaacacgttattatatagtattttcaccacacacaggatacagtmaatgacttcaagagcataggtaacagtaaaatgtagtaaaacaatttagaagtcatgagttttgagtacttagtactttttagtatgatttatttaatag

SEQ ID NO: 16858 - DNA, 201 bp, Homo sapiens
tgggattacaggtgtgagccaccgtgcccagctcagcattattatttttagtctacacacagtgaacttaaatctcctctagaaaagtcagaaggtctacstacaactttaagagttcagccaaaagagaccagtatctactaccgtggacaaccctatttaacatggaggagataagcagaaactgaaaagaggagcctg

SEQ ID NO: 16859 - DNA, 201 bp, Homo sapiens
ggctattatgtgaagttaggaaatatttaaaactctgcctttctaaagaaacagggacacggtgcagaaaagttcatctggagttaggcttgtgtcttgcygtctctttaacggagagttcatgggcagggtacagtctgtgagaaggaatgaaaaccccagggtagatgctaacaaaaatcacttttaaaaaatgtatgg

SEQ ID NO: 16860 - DNA, 201 bp, Homo sapiens
tggtgtccatctgggttagcaaacacatgctcacacgtctgtgcttgctggatttttaagaacttaccagcatttaagattttcttatgaaactgattttwctcaccagggatagagtctcaaagttggaggtattttatgttgttttaaataatatcgtcatcacatgtcattttagaccccaaaagtccactccgaatc

SEQ ID NO: 16861 - DNA, 201 bp, Homo sapiens
agttcctctccaaactgtcaaggacagtgccaagatctgcgaatatagaaagattaagagtttttttctgccttgttgggtcttctttctagcatgccagsaacatttttctcatcttttgaacattagggaataacacccaatgccaccctataatctcgagacagaagtggaggatcctcttaagacaagaaatctttc

SEQ ID NO: 16862 - DNA, 201 bp, Homo sapiens
agatctgcgaatatagaaagattaagagtttttttctgccttgttgggtcttctttctagcatgccagcaacatttttctcatcttttgaacattagggamtaacacccaatgccaccctataatctcgagacagaagtggaggatcctcttaagacaagaaatctttcaaagccaaataatgaattaatccaaagccact

SEQ ID NO: 16863 - DNA, 201 bp, Homo sapiens
cttcgcaaagggaaataactcttctgctaaccctcctgcccaacctgagatgaagtatcaggggatgcagtatggatgtattttcctgacgattggtcctkctgtcctgggacccaggtgtgagtgcatagggaaaagggaggagaaatttaatcctgtaactatctccttatggaaaacaggaaaccacaaatgaatcaa

SEQ ID NO: 16864 - DNA, 201 bp, Homo sapiens
tctaatattttaaaaaatcgaggctaggtgtggtggctcatgcctgtgattccagcattttgggaggccaaggtggacggatcaccagagttcaggagttygagaccagcctggccaaaatggtgaaatgccatctctactaaaaacacaaaaattagctgggtgtgtggtagtgtgtgcctgtagtcccagctactctgg

SEQ ID NO: 16865 - DNA, 201 bp, Homo sapiens
atttatgttattattatcatttttcatgtgtagatgtggtgatcgtttgtgctttgttaaatattcctcgtctgtccttctggggatgatgctttttctccctttttggtcaggcatagataggtgacttgctttagccaaagaagcatgaactgtcacttcaagggggagatttacaagccagtgcaggtggattccctg

SEQ ID NO: 16866 - DNA, 201 bp, Homo sapiens
gggcattaatgcatttagcaaagacttcctgagtgtctgcttggtcgagtgacacaaactggaacagagcatagcctgtcttccaggaaccggcaccagcratgtcgtaggctgagggagaagccacagaactgtgagtgacatgtttctttggctgctcccgacacaaggaactgcaactaaattgaaggcttgaggaca

SEQ ID NO: 16867 - DNA, 201 bp, Homo sapiens
ctgcttgaacctgggaggcagaggctgcagtgagtcgagatcacaccactgcactccagcctgggcgacagagtgaaactctgtctcggaaaaaaaaaaaaagagtttaattcatgcagagctggctgtgtgggagaccagagttttattattactcaaataagtctcccccaaaactcagggatagagatttttaaggag

SEQ ID NO: 16868 - DNA, 201 bp, Homo sapiens
agggagaagccacagaactgtgagtgacatgtttctttggctgctcccgacacaaggaactgcaactaaattgaaggcttgaggacaggaagcaccttagyggttcgcctttcatttgagtgggcccagggtccagaaaagggtagatattcaggaagaattgatcaccttttggatgccaccacacatgcctaggcacaa

SEQ ID NO: 16869 - DNA, 201 bp, Homo sapiens
aaatatttattttgagagcaagcacgggggtttatgtgatggctccacagagcagtgaaaagactcccgccctactgctcgcaacctcagatgtccctggscactagcccatctgtatgtctttaaaaaaaataaattaaatttttaaaaacatgactttctggccaggcgcagtggctcatgcctataaccctgcactta

SEQ ID NO: 16870 - DNA, 201 bp, Homo sapiens
tccggtgacatcctggattagaccctgaatcagaaaaaggactgtagtgggaaactcgtgaaatcctaaatacagtctgtcatttacttaatagtaacatwccattttcataagcataccatgggctgggcatggtggcttatgcccgaaatcccagcattgcgggaggctgaggcaagctgatcacttgaggtcaggagt

SEQ ID NO: 16871 - DNA, 201 bp, Homo sapiens
aaccatttcacaaatatttattttgagagcaagcacgggggtttatgtgatggctccacagagcagtgaaaagactcccgccctactgctcgcaacctcaratgtccctgggcactagcccatctgtatgtctttaaaaaaaataaattaaatttttaaaaacatgactttctggccaggcgcagtggctcatgcctataa

SEQ ID NO: 16872 - DNA, 201 bp, Homo sapiens
gactcatttaaccatttcacaaatatttattttgagagcaagcacgggggtttatgtgatggctccacagagcagtgaaaagactcccgccctactgctcscaacctcagatgtccctgggcactagcccatctgtatgtctttaaaaaaaataaattaaatttttaaaaacatgactttctggccaggcgcagtggctca

SEQ ID NO: 16873 - DNA, 201 bp, Homo sapiens
tttgtatatttagtagagacggggtgtcaccatgttggccaggcaggtcttgaagtcctgaccttaagtgatccaccctcctcggcctcccaaagtgctcrgattacaggcatgaaccactgcgcctgactgtacttttttttttttaaagtatacccatacccattgtacacatttggtattttttctttaaaaaaaaaa

SEQ ID NO: 16874 - DNA, 201 bp, Homo sapiens
gaacaagggttacgtttgctgtatctggagaaagtccatagtttatgatgaattttctattaatgtaaactcccactgtttataagtcacccaaattgttkgtattaaattagatgtgtaccatcttatgtctcttctttcagaaaatgaatctctgtttttttttctctttctcctaaatgttaggaattttctgaagtt

SEQ ID NO: 16875 - DNA, 201 bp, Homo sapiens
aattgctcctagggaaatacacatacacacacatgtacacacatacacatacacacattttttcctaaacaacatcaatgtcataacagttttgaagcacrtatacacactgacacatagattttgtaaatgaggcacatctattcttgaaatgcaattgcttaaaaatggaagttctgaaaataaataaaaagaaacatc

SEQ ID NO: 16876 - DNA, 201 bp, Homo sapiens
caatagaaacaccaagaacatggattcatcaaaggaaaaatgttgaagtttccatttttatgcttcctggtaatccttcagcccttgatggaaatttccaracctaaaccagtgaattaagagtatggggaagaggagccctcatacagttctgttaaatggtcctttaatattcttcttcagagtgacgggtaccccttg

SEQ ID NO: 16877 - DNA, 201 bp, Homo sapiens
ccacaatacgcctccctttggcgtgaaatggggcagaaagtgccccaaacagctgttattttcgcagtgattcattcattcattcattcattcattcatthattcatccacccatccattcattcattcactcatcacatggcaactcatcacccctgtataccagacccagtgccaaatactggggagatgtgtgtgaac

SEQ ID NO: 16878 - DNA, 201 bp, Homo sapiens
gggcctaggcccaagcaaccaggactccctgtagtcaaccccactcctcaatttttggcacccatgttattccacctcaagatcatgtcctcttttaaccyctctgaatatgctcctcctgtgatacccatagggaccctgaacctctagtcctcaagagcagtcattcacccctttggactatggatccctttgcaaccc

SEQ ID NO: 16879 - DNA, 201 bp, Homo sapiens
atgtcactgagtacatccttgctgtttttcatgaattttccactgagtcgcaacatgccactggccagtgaaggtcaggcaggaaacagattaacaacatstcataccacaatgtcaaaatacttaaaagtgtttacagatgccagtgacacccagtgaatctaaaacaagaggaccagagcagaagtaaaactattcttg

SEQ ID NO: 16880 - DNA, 201 bp, Homo sapiens
gcatccaccaagtgcctggtgcagactggatgctcaataagtctttggtgggtccatgtattgaattggaatctgcacattatggccattatttaggtttmttgtgtcctaatctatgtcactgagtacatccttgctgtttttcatgaattttccactgagtcgcaacatgccactggccagtgaaggtcaggcaggaaa

SEQ ID NO: 16881 - DNA, 201 bp, Homo sapiens
ttgtcttctcctctgagcgggaactgggcaattggaggttctttcccctcccgtgctggtgggagaattgtttagtaggtcataaagtggaatctccattycagtctgatccggtcaattctggtaggacttcatccaagcacaaagaaacctttgttttcattcaagacttccctaaaaggtggctgggtgcggtgctca

SEQ ID NO: 16882 - DNA, 201 bp, Homo sapiens
atcgtgtccagcctaaatggcattcttggaagtaaaaccacaggggatctgttggaagtggcatgatggaggaattttaaaagaattgaacaaataaaatrgtcagagctcaaaaattgagtactgcttcgtttctcccaaataaccatcaccagacaaacaggtgtgtgtgtgggtgggggaggtggcctggtggtactt

SEQ ID NO: 16883 - DNA, 201 bp, Homo sapiens
ctgtctgttttcttttctttcaaatgtttcacttaattccctgatataataaggcttccaaattcttggtgtttttctacaaccaagaccttgaacttttkcctctcaggatttctttcatgagaacccattttctggccatttggatatcattgatgagggaattgaagcatttccctattctttagagtttcattaaag

SEQ ID NO: 16884 - DNA, 201 bp, Homo sapiens
ttccagtaacaattgttgcataacaaaccacccccaaatttagtggcttaaaacaacaacatttattttgttcaggaatctgtagtttcagcagggctctsaggaacagcttgtctctgctccagcatcagctgaagcagcttgaaagccagggtctgagatcatctgaaggttgttcactcatgagtctgaggaatgatg

SEQ ID NO: 16885 - DNA, 201 bp, Homo sapiens
gtctcaaggaactatgataagtagcaaacaatatcccagaaaaatctccagtcaaaaatccactggaggccaggtgcgttagctcatgcctgtaatcccarcactttgggaggtcgaggcaggaggatctcttgaggctaggagctcgagaacagtctgggcaacatagcaagtctctgtctctacaaaaaatacaaaaat

SEQ ID NO: 16886 - DNA, 201 bp, Homo sapiens
gctctcaggaacagcttgtctctgctccagcatcagctgaagcagcttgaaagccagggtctgagatcatctgaaggttgttcactcatgagtctgaggawtgatgctgactggtgggtgggacccttgctggagggtctattggctggaacacctacacattgtctccatgtaccctgagcttcctcacaatatggcggc

SEQ ID NO: 16887 - DNA, 201 bp, Homo sapiens
gttttgagtacttagtactttttagtatgatttatttaatagtaaccttatataatgtttttcttttaattgttttattgagatgtatttcatacactttmcaataagcccatttgaagtgtaacattcaactttttttagtatattcgcatggttatgtaattttcatcaaaatctaattttagagtatctttttgtccc

SEQ ID NO: 16888 - DNA, 201 bp, Homo sapiens
actcaacagttgctaatgttttgccatgttttgtcagttcatctatctgtccatctctttgtccatccatccaactacccacttacccatccatccatacrtttatccatccatctacccacccatccgtccatccatccatccatgcatccatccatccatccatcatccatccatgcatgtaagttgcagacatcaaca

SEQ ID NO: 16889 - DNA, 201 bp, Homo sapiens
agtcaatttcatctaggagcattttatggcttatggaaagaaatattctcttagattgaagggcgccagcctgtaatgggcatcagctgattctcagaaaraagaaacaacgtactgttacataattggggcttctccaaagtggcctgaccaaactgtagagctgcttgtttgtctgatacggtagccattagccacatg

SEQ ID NO: 16890 - DNA, 201 bp, Homo sapiens
aaagtggagttggggaacacgttattatatagtattttcaccacacacaggatacagtcaatgacttcaagagcataggtaacagtaaaatgtagtaaaasaatttagaagtcatgagttttgagtacttagtactttttagtatgatttatttaatagtaaccttatataatgtttttcttttaattgttttattgagat

SEQ ID NO: 16891 - DNA, 201 bp, Homo sapiens
tccattttaaagcgttattgaatccatactaacctgatcattacatatttactaattgatgattactaaaaatgtggacctttgtgaatttccgatgtcayagaagggtgttcttaactggaaaagtcagtagccaacattctgggaagtagaggcctcttcctcactgcttcattggtttaaaataaactccaacagaaa

SEQ ID NO: 16892 - DNA, 201 bp, Homo sapiens
cgtggtgtgtgatcttgaccactagcctaaactgctattttatgtccacccatcaacctctacggctgcccctcatttgaacacacaaaatatagttgtgyggcttggtggagccatctaaattccgttaggccatttgccaatgctgctattaggggcgaaatgtcatgcgcttgatctaaatgtacttaggagaattct

SEQ ID NO: 16893 - DNA, 201 bp, Homo sapiens
cacctggatctgttaaatggcagcttagctatgaaatatcatgttctgcccaatcacctaccctgcctcatatgatcagccggtatatttatgtggacacrtgcagccacacttgtttttaacatttgagaatgacagcgtattggcagttcatataagctatcaaatattacatgtcaactcagaaaacatccctaggaa

SEQ ID NO: 16894 - DNA, 201 bp, Homo sapiens
ctgttgtacactgtcccttcaataaaagttgctaacaccaccaccttgcccttgaattctttcctgggcaaagccaagaaccctgttggcctaagccgcarttctggggttcgcctgccctgcatcaccagcacagtggaaggccacaagctcacagcattttcatccgtaaacaaagcttggcaatatctctgatggtta

SEQ ID NO: 16895 - DNA, 201 bp, Homo sapiens
ggctaataaagtagatgagtttcaggattgcaaaatattgtgatcctggcctttgtccattgtgtaatcttcacagtgaccagagtgtttgcagttcctasgaagttcacccattcccaacagtgtcccagggtcaagctcagatgacctgtggtatttttatacccatatatgtgtcaatgtttataacttttaaagttg

SEQ ID NO: 16896 - DNA, 201 bp, Homo sapiens
agggtcaagctcagatgacctgtggtatttttatacccatatatgtgtcaatgtttataacttttaaagttgttttcaggaagcactgaggcatgtggtcrttcacaggtgacaaagacagaggctcagggaactcagttggttgctgagctttaaacccaagtctatttctgaggctggactgagtctttgagaaaatgc

SEQ ID NO: 16897 - DNA, 201 bp, Homo sapiens
acattttttcctaaacaacatcaatgtcataacagttttgaagcacatatacacactgacacatagattttgtaaatgaggcacatctattcttgaaatgyaattgcttaaaaatggaagttctgaaaataaataaaaagaaacatcaataaataaaagccccattttcatattcttatttgacctcttgcctctccatca

SEQ ID NO: 16898 - DNA, 201 bp, Homo sapiens
ttaaacaattactgtatctgatttttcatttttcattttttttttttctggaagaaagagcagatctggataaagtcagtatacaatgtggtctttggtgmcagacccaagttcaagaccaaggtgtatgcatgggtttgttcaagttgtctacccttattatcccctcagtgaaacatgattaaccatgcttaccttgaa

SEQ ID NO: 16899 - DNA, 201 bp, Homo sapiens
gaaaataaataaaaagaaacatcaataaataaaagccccattttcatattcttatttgacctcttgcctctccatcattcttaaatttgacctccatcatkcttaaatttgacctccatcattcttaaatttgacctccatcattcttaatcctcatgttcttaatggacatccctcccaccctatctgggccttctgaga

SEQ ID NO: 16900 - DNA, 201 bp, Homo sapiens
tgctgtcctggttttcacactgaaagttccgtatcctaataagcctctcatcctcagcaacggaggacagttgcccactcaaagccttgtgacattctagrgtatcctatttctacatggtgggaatctagaagacggagaaagaatttctcattcccgaaggagcatggattatccttggttgtagtgtttatgtccaca

SEQ ID NO: 16901 - DNA, 201 bp, Homo sapiens
taagactggaatgtgggtgtgtgcactcctcatgttccggtttctgtgatcattcaggcatgcacaggtatcctgatgggtagccaggtcattaggcccaragtcggcagtgtagcatggcaagagaagtcattgcatctccaaactgtgcctaaattgcctgtaatgggttctttgcaacttgcagaaccagatcttacc

SEQ ID NO: 16902 - DNA, 201 bp, Homo sapiens
gacctccatcattcttaaatttgacctccatcattcttaaatttgacctccatcattcttaatcctcatgttcttaatggacatccctcccaccctatctkggccttctgagactgttcccccagccccagtcaggagggcttgtccacaagttgctgtctgaactgggcaagcctcctggcttccctgaaatggtgctga

SEQ ID NO: 16903 - DNA, 201 bp, Homo sapiens
ccgtgtcattgtggtctcctcagagtcccatcggtgggtttgaattgcatatttgttcacttatcccctttctcataccagctaatattcccccaaggctstcattctgaaaataattttcattagtcctgcttgagacatgtgggtggactcagcttggctcacttaatttttccaggtcttttttgttcgcctgtgatt

SEQ ID NO: 16904 - DNA, 201 bp, Homo sapiens
tgactaagactggaatgtgggtgtgtgcactcctcatgttccggtttctgtgatcattcaggcatgcacaggtatcctgatgggtagccaggtcattaggmccagagtcggcagtgtagcatggcaagagaagtcattgcatctccaaactgtgcctaaattgcctgtaatgggttctttgcaacttgcagaaccagatct

SEQ ID NO: 16905 - DNA, 201 bp, Homo sapiens
gcttgtccacaagttgctgtctgaactgggcaagcctcctggcttccctgaaatggtgctgatgtcttcacttcctgccaccttggcaacctttgtagttsctctctttttgccaggggaacaaattaagagagagaagagtgatagtgtctacatgtggtctgctcactcagccagtattttccacagccagtctttccc

SEQ ID NO: 16906 - DNA, 201 bp, Homo sapiens
caatatgatggctagtctgtttcatagtgaataaaaagtgatcctggatgaatgaataaagtgaaattcagataatttttctcaaaactgaaattgtttamatcttcctttagttctcttttttctgcctgccccttctttcatataccctgtttttcacctcttttgtctcagtcccatctgatatttgaataacaatat

SEQ ID NO: 16907 - DNA, 201 bp, Homo sapiens; identical to SEQ ID NO: 3306

SEQ ID NO: 16908 - DNA, 201 bp, Homo sapiens
aatttcatatatgaaggcaaaggaaaaaaaaattaaactttaaataatgaccagttatacttcatcaactctaacaaatgaaggagcagagttggttttcyggagtttgcttcagttctttgatatggtcagtgtaggtcggggaggtcttccctagcttgagaaatcataacctaggatatttaagctgtcagtaatagt

SEQ ID NO: 16909 - DNA, 201 bp, Homo sapiens
tcgcagctggtgggtgtacacactgctgtttaccttggcgaggcctttcaccaagtccatggtaagagaacagcttctggcgccgcaaacaccttgggtcytagagaaacctgcacacttgtgtctccacctttttacctcttgcgggcatgagtctggtctcagtaataacattgtccagcccatcataaagggctcttg

SEQ ID NO: 16910 - DNA, 201 bp, Homo sapiens
tcagtaatagtgttttaaaactccaggcctataataaagtaaaaagtgtgtctgataaaatgggtttttttccttgcttagtgaatgtcttctgtttctckctaaacattgtcacttgccaaaccatgttttctgtttcatactaattttctactggcagtgagaccagcggaatctaagaaattgcatacgaaattcaag

SEQ ID NO: 16911 - DNA, 201 bp, Homo sapiens
caggcctataataaagtaaaaagtgtgtctgataaaatgggtttttttccttgcttagtgaatgtcttctgtttctcgctaaacattgtcacttgccaaascatgttttctgtttcatactaattttctactggcagtgagaccagcggaatctaagaaattgcatacgaaattcaaggattggaaagaagaagaggaagt

SEQ ID NO: 16912 - DNA, 201 bp, Homo sapiens
accacatgctaaaataaaaaaaaatgaaccacatgctaaaatcaaatggcttctgcacctgtgtgcgttcctggactctggggtcacaggatggctgatgwgatgccttcgagaaattaatactctaatgagggaaacatcctttcatgttggtgcaagagacgttctaggcctggttctacctctagttggaacggtggt

SEQ ID NO: 16913 - DNA, 201 bp, Homo sapiens
gcgtgtgtgaaacacaaggtcacctgccaaaagcaaaacaattaggccagcattgggctaggtgaggatccattgtcttttgggcaggtgattgtgatacwataggagccggtgtcctgttgatggcatcccacaactttctaacctctgttgtagagttttgttagccacgatttggaccaacctgcagttaggccaagg

SEQ ID NO: 16914 - DNA, 201 bp, Homo sapiens
ttgaaccatttgacacatttcgctagcattgggaaaatccccattttcctcactatccatttttcttcctctctttccttcctcttttcccttcttcctcttttttttcttttctttccttccctttttccttttctttccttctttccttgccatttaaaacatactgataacttggcagcacagggcagtgattaaact

SEQ ID NO: 16915 - DNA, 201 bp, Homo sapiens
gaaattctttcacaactctttgattgtactaaaactttgaacactttaaatgggtgaattgtatggtatatgaatcatatctcaacaaagctgttaaaaaattgtatgaaaactgtgatgggattcaagtagtctaacgctcaaatttcccaagtgccctcatttaagtctggaccacgacaggaacccagatgtggcctg

SEQ ID NO: 16916 - DNA, 201 bp, Homo sapiens
gtttgctggctcatgcgtttcatgccttctctatggtaccatacaggcactttgtctcccagtggaatataagttctttgaggccaaggactgtgtcttaytctgtgttgcatccctttggcttcagcctcattgtcttgagtttattaagcatttggaacatttcagctgaatgagtgaatgagtgaatgagtgaagcca

SEQ ID NO: 16917 - DNA, 201 bp, Homo sapiens
tttgaggccaaggactgtgtcttattctgtgttgcatccctttggcttcagcctcattgtcttgagtttattaagcatttggaacatttcagctgaatgastgaatgagtgaatgagtgaagccatcagtcaaatcagaacactgctcacacatgcatcccaagtccagctgtcgaacgtctggaactgagcagtatggag

SEQ ID NO: 16918 - DNA, 201 bp, Homo sapiens
accatgtccccattgaacactgctctgtgctgagtctgcagaatatttaaataaggggttaatttataaagtgagctacgggaaagtttccaggattgtcrtgcgtgtgtctcataaatcggcacaaattgaatctaggtttctaggtttctgtgcccctcagctcctaagtaaaccaaaatttattgagaggtgtatagg

SEQ ID NO: 16919 - DNA, 201 bp, Homo sapiens
acttgcctaagaacacacagcagttctgaaactcaccctgtgctaatctgacctcgtgaagaaattgagcaaactaggctccagggagaaacgaaaacaayaacaacaaaaaatgtattgccaaaaaattgctagcagacatctagaaaaatgtcttcaacttcttttggtaggaaaagaggaaaaattcaaatctgaatt

SEQ ID NO: 16920 - DNA, 201 bp, Homo sapiens
tacatagtgacatgaaaattgtgtattcacattgttctattgatttcgttgagaaagtgaccttgtatgcacacatgagaatttagagatctatatatacygcctggcctcttctttgtaagggtataacagcagtggttaacatgcattttttttttttaacagttagatttactcttcctttgcacagactaatagcac

SEQ ID NO: 16921 - DNA, 201 bp, Homo sapiens
cagctctgagagcaaggccaaatcaccagattgatgcctttggctgtgtatctaaaggacgtgccattgcagctaagtggacctgaatgtacagtaagacytagtggtcaccagaatgcatgccaccccggtgcttctgcatgcaaagggtgcgggccatgtgccagtcacagtggaaaaggcatgcttcgtgtcagcaca

SEQ ID NO: 16922 - DNA, 201 bp, Homo sapiens
ccgaacatcaatcagggaagataaacaatgggaaatgataggtgtacaaaagggaaaatggcaacagcacatgtggagggaaagaccgcagaattctggcrgggttataaatcatacagtcaaataatttccgtgcaattaatatcctcaaattaaaacatacgtttttaaagaaagattttgcagacttttaagctgggc

SEQ ID NO: 16923 - DNA, 201 bp, Homo sapiens
cttccttcacccccaggagcactgaagcagacactgattcctctgcagttgttgggcttttgagctacttccctcctggggagatgcgtgttaactgtttmatgactggcaatgccgtaacagtgagcaagcaatgtgaccttacaaatacatgtgcagaaatgcagatgagtgggcctaaagaatccagactcaacttac

SEQ ID NO: 16924 - DNA, 201 bp, Homo sapiens
ttttattttagataaaatgaaaagatgttactatgcaggtaactttatttattatttgcatgcagtttatcaaatagaattccttggttcagcaaaatgamacctttaagtcttttagcaccaaatgtttgaaattatcatgaaacacattctaatttggcagtgagttcaggagatgaagactgtcctttagttaacatc

SEQ ID NO: 16925 - DNA, 201 bp, Homo sapiens
tgttattttccttttgtatctagcctaacattgactatcttgtcatttcattttcctataaaatgcctccaccaaggctgaatctttgaattgatcactasaggccttttccctagtagtaacattataataaaactttgactcatgctcataactcgattttccaaaaagttttcctttacaggagaaaagaacagctgc

SEQ ID NO: 16926 - DNA, 201 bp, Homo sapiens
gggtccaagcctccctgaagcagatctctatcctgtcaccctgctggaaatgaaacacttaggggttagaaggggatcaaggaaagtccgagagttggttstgattatcttcagtcagaaagtgcctacttttccaagcatccagactgcaacctgtctttcctactcaaaatggtttttatggattctattcttatttgg

SEQ ID NO: 16927 - DNA, 201 bp, Homo sapiens
cttaggggttagaaggggatcaaggaaagtccgagagttggttgtgattatcttcagtcagaaagtgcctacttttccaagcatccagactgcaacctgtytttcctactcaaaatggtttttatggattctattcttatttggcaattgcctggactacagtcaccaacacaagtttatacgcaagaagtgcacacagcc

SEQ ID NO: 16928 - DNA, 201 bp, Homo sapiens
gtgctggccttttcactcaagttctctgatgtaactgcccacagtaatcctgtaaggtatggctaatcatttccattttatagattaggaaaccaaggtcmaaagtggtgaattgatttgaccaaaatcacagacccaggaatttcctcagccaagagcctacagcagctgtgtcttaagactgtgccctttcatccaccc

SEQ ID NO: 16929 - DNA, 201 bp, Homo sapiens
gtgcagtgaggatgaatcaacaagtaaatatcatgagaatttcttagattgaagaaatattactcctatttggtgtcaactctgtgctggccttttcactsaagttctctgatgtaactgcccacagtaatcctgtaaggtatggctaatcatttccattttatagattaggaaaccaaggtccaaagtggtgaattgatt

SEQ ID NO: 16930 - DNA, 201 bp, Homo sapiens
ttggcttctccacagaggcctggttctggtcccttcccctgcaaccccaaggcagggggcagattcccgtatcatggtgctccttggcctgattctgtggsctttatattagaactcaccttctggaatcttttattgtcttgttctctcttccaagctgcgcatcttccttcccttcagaggtttggtgatcagcgtggt

SEQ ID NO: 16931 - DNA, 201 bp, Homo sapiens
tggattggtgattttgactaagactggaatgtgggtgtgtgcactcctcatgttccggtttctgtgatcattcaggcatgcacaggtatcctgatgggtarccaggtcattaggcccagagtcggcagtgtagcatggcaagagaagtcattgcatctccaaactgtgcctaaattgcctgtaatgggttctttgcaactt

SEQ ID NO: 16932 - DNA, 201 bp, Homo sapiens
accctggacagatggattttctaaaattacagaggaaactagatctgtaactctgtacatttactcctgtgccagtaacaatggcaatattttaatactgwaataaattttttcttatgcatttgctataaattagtaaatctgtgtaaagctgcttattgcatcatcatgtagaatttctacatcctgcagaagtttaag

SEQ ID NO: 16933 - DNA, 201 bp, Homo sapiens
gtcagctggtgggtgatctccactgaactcctattcagaggctcagtttctctgcaggacagaaatgagaggcacaaaatttcatagctgtcttgcccctyctgtggtctgtaagaatgggaccaggactcctagttgtgaacccgaaaggatttccattaggatcaggaagtgtgagttggcttagaaaaagtaaagaaa

SEQ ID NO: 16934 - DNA, 201 bp, Homo sapiens
cctaggcttggttacaaagggcaatgaagggtcttttctgtccttaagcactcacaggtagcttaacagtaatgccttggattccttccttcaagagcgayagcaggaagcccagcttctctggtagcagagcaggggtcctcaaagcagaccgtgaggtcagaggagcactggagtcaggagtttccatctccaccctgc

SEQ ID NO: 16935 - DNA, 201 bp, Homo sapiens
gtgcttgttaactttgcactctatagccaagtgcgatgatcagaaaatacatacattgaagacaccagaaaatagtgtatggattggtgattttgactaaractggaatgtgggtgtgtgcactcctcatgttccggtttctgtgatcattcaggcatgcacaggtatcctgatgggtagccaggtcattaggcccagagt

SEQ ID NO: 16936 - DNA, 201 bp, Homo sapiens
agaaaatgtctgtcatacattacgtgcctttctctgtctttccctgcccctctcaccttcatcgatcacacttttgcttcacagaggtaagaggaaatcamactcacacagtatcttttgttttctagcaagctagaacacaagattttctagatgcatcttttgagttgatatgcaatattttccttgacagatttgtta

SEQ ID NO: 16937 - DNA, 201 bp, Homo sapiens
gctgtttaccttggcgaggcctttcaccaagtccatggtaagagaacagcttctggcgccgcaaacaccttgggtcctagagaaacctgcacacttgtgtstccacctttttacctcttgcgggcatgagtctggtctcagtaataacattgtccagcccatcataaagggctcttgaacacattttcatcaactttaggt

SEQ ID NO: 16938 - DNA, 201 bp, Homo sapiens
caggaaggcccttccactgaagctacaactggagctaagcagatggataagccaaaaccacctccgttgctgtggccccatctccaccacaaggaagctgragaagggaccccagaaccggaagacaaaaaacttccttcacacactcccttgctaagaggagaagccccaaagaagctggatatggcccttccctcacat

SEQ ID NO: 16939 - DNA, 201 bp, Homo sapiens
taactcagttctcggaattttcaatcagaaattatctgatgacgggactaattcttattacgatagttccaatggatccacccaggatccacctccacaastaggtgtacagaagctggagatcccatcatgccgccgggcaccggtttacgagaactctatgtcttatcttggtagtacgattaggaaaacaaacacaat

SEQ ID NO: 16940 - DNA, 201 bp, Homo sapiens
tgggaagtcagaacttggttgcttcatgtcatatttcctatttttaagatttacagatattaacgactccttgggaaaactggacttcagtcgcctctctscaacaaaaaacgactattgggcgatgctggcttataacaggtccaagctctgcaacatcctcttctccaacgagctgcaccgtcgcctctccccacgcgg

SEQ ID NO: 16941 - DNA, 201 bp, Homo sapiens
agtttctgtgcatacaacatcttcctttctcattcccagtaccctagaaacacagccgttcactgaagaggatttgagtgttgtctcctctgtggggtcamaacatcatgcttctttctgttctgccccatggcagtggtgacgatggcctagcttccatcccgtagcttcttgtgtttttctattccaccagtctatcaa

SEQ ID NO: 16942 - DNA, 201 bp, Homo sapiens
aaagctgtgtgggaagtcagaacttggttgcttcatgtcatatttcctatttttaagatttacagatattaacgactccttgggaaaactggacttcagtygcctctctccaacaaaaaacgactattgggcgatgctggcttataacaggtccaagctctgcaacatcctcttctccaacgagctgcaccgtcgcctctc

SEQ ID NO: 16943 - DNA, 201 bp, Homo sapiens
tggcctagcttccatcccgtagcttcttgtgtttttctattccaccagtctatcaaccctgtatttgttgtcaaatttacactgtccacaggcaaagatcyattctcctttagaatttaataggagggtttggaaatgatgccatggaaaccctgagcagcttggcaatgctgaccccaaatgagaaataactatcattgg

SEQ ID NO: 16944 - DNA, 201 bp, Homo sapiens
gaacattccagggccaggttcagtggatcatgcttgtaatcgcagcatgttgggaggctgaggagggtggaccacttgaggccaggagtttgagatcagtytgggcaacagggtgaaaccccgcctccactaaaaatacaaaaaaaagaaaaaaaaaaagaaaaaaatagctggccattgtgacatatgcctgtaaccgta

SEQ ID NO: 16945 - DNA, 201 bp, Homo sapiens
tttgagatcagtctgggcaacagggtgaaaccccgcctccactaaaaatacaaaaaaaagaaaaaaaaaaagaaaaaaatagctggccattgtgacatatrcctgtaaccgtagctactctggtggctgaggcttgagtatcgcctgggaggcagaggttgcagtgagccaagatggcactgctgcactctagcctgggtg

SEQ ID NO: 16946 - DNA, 201 bp, Homo sapiens
tctcattctcctttccaataaatccttttattcccagaaacaagcattcttgtttcaatcattgtaactttgttttacctgttctagaacttcatttaatrgaaatcatacctactgctttgtatgtgtcgtcttctgcttaatgattcacataatgtttttgtgattcatccatgttgatgggtgtattaggggttctct

SEQ ID NO: 16947 - DNA, 201 bp, Homo sapiens
gcagtctgattgtgcgacagaaaagaaaaacccattttctggggagaaattcaagctggctgcagaaatttgtgtaagtggcaaggaacctaatgttaatstcgaagaccatgaggaaaatgtctccaggccatgtcagagactttcacagcagcccctcctatcagaggcctgaagtcccaggaggaaaaaatgatttca

SEQ ID NO: 16948 - DNA, 201 bp, Homo sapiens
aagcagagcatcaaggtttggaaaatttgcagtctgattgtgcgacagaaaagaaaaacccattttctggggagaaattcaagctggctgcagaaatttgkgtaagtggcaaggaacctaatgttaatctcgaagaccatgaggaaaatgtctccaggccatgtcagagactttcacagcagcccctcctatcagaggcct

SEQ ID NO: 16949 - DNA, 201 bp, Homo sapiens
gtgaggacacatcacttgcacctcagtgtgagtttgaaagtgttttctctggagaataattctgaagaaataggccctccagatatcagtagtgacagggstatcagtaatgttgattactaagttcttgccacaggtagaagccatgctactgcacaagtttcatacttgaagagtggacatctgacacagtgttggtgg

SEQ ID NO: 16950 - DNA, 201 bp, Homo sapiens
aagaggtgacttgggtgctgttaaaggcattcagttttataaaagaagcagagcatcaaggtttggaaaatttgcagtctgattgtgcgacagaaaagaaraacccattttctggggagaaattcaagctggctgcagaaatttgtgtaagtggcaaggaacctaatgttaatctcgaagaccatgaggaaaatgtctcca

SEQ ID NO: 16951 - DNA, 201 bp, Homo sapiens
ttattttaattttttaattgaattcagctttacagtatcttttgtagggggtaattttagcttctttctccgttgaaaacttcaagtaaggaaacacttayattgctagtgagtggccagctggagttgtaggtctaattctttttttttttttaagacggagttgtgctcttgtcacctaggctggagtgcaatggcatg

SEQ ID NO: 16952 - DNA, 201 bp, Homo sapiens
attcagaggttgtttttatagcagcaacacagtaagttgggaagagggacacatttttaacatagacaccaaaagagaggctggaagagttgaccacttaraaatgtcacgagtgtctgtgaatagtgttgggggctgagaggcaagagaagaaaatagtcctaatgttgtacaagtagcaatggaaacaaacttgttaaa

SEQ ID NO: 16953 - DNA, 201 bp, Homo sapiens
acccttctaaccagtgtttgaagtacgtaagacgttcatttccacttctaatgaggaattagaggaacggaattataaaggaattctggttataattgcakgtacttttagagacgatgtctaacagtgcaacccatagaaccaggctgcctggattcaaatcccagctctgctattactgagatctctatgagagctcag

SEQ ID NO: 16954 - DNA, 201 bp, Homo sapiens
ggtctaattctttttttttttttaagacggagttgtgctcttgtcacctaggctggagtgcaatggcatgatttctgctcactgcaacctccacctcctgkgttcaagcagttctgcctcagcctcctgagtagctgggattacaggtgcctgccaccatacccagctaacttttgaatttttagtagagatggggtttca

SEQ ID NO: 16955 - DNA, 201 bp, Homo sapiens
caatggcatgatttctgctcactgcaacctccacctcctgggttcaagcagttctgcctcagcctcctgagtagctgggattacaggtgcctgccaccatrcccagctaacttttgaatttttagtagagatggggtttcaccacgttggctaggctggtgtcgaactcctgacctgaggtgatccacctaccttggcctc

SEQ ID NO: 16956 - DNA, 201 bp, Homo sapiens
atgggcatgtgctgtgtgccattctctccccttatcagtgggttcccagctgcctggtgtacaggagggttaagtagatacctgttgagtgattgtgaatrttttcattcacgggggcagatttgtgtcctactaacaccagacatgtcctgttttcagattacttctttttcaacatctgagtacctataacatctaaag

SEQ ID NO: 16957 - DNA, 201 bp, Homo sapiens
gccactgcactccagcctggatgatagagcgagaccatgtctcaaaataatgataataattgtagtagtagtagtggtggtggtggtggtggtagtagtastagtgaatgccctgactttggggtttgcagtaagctaggattaagtgcttcacagtgaggcacagtggggagctactctgaggatgaattgcctagtaaa

SEQ ID NO: 16958 - DNA, 201 bp, Homo sapiens
ttttgataaatacctaggtgtgaaattattgactcttagtgtttaacttgtaagaatgctgccaaacagttgtctaaagtaattgtatcattttaaccccycgctagaagtgtgtaagagtttatgttgcttcacatcctcatcagcactttgtaatttcagtctttttaattatagcctttttgtgggtgagaaacgcta

SEQ ID NO: 16959 - DNA, 201 bp, Homo sapiens
tcctcttacagttttggttctttccatgagaaagtatttttaatagcaaagtaatgaacaagaaagtattaataagacccaaataataatataaactactmctttactaatggtcattatgtgccatgccctgctctaaacacttgccatgtagtcactaatttaatcctcacaagaattctgtaatgtagtgtagtttcc

SEQ ID NO: 16960 - DNA, 201 bp, Homo sapiens
tagtgtttaacttgtaagaatgctgccaaacagttgtctaaagtaattgtatcattttaacccctcgctagaagtgtgtaagagtttatgttgcttcacakcctcatcagcactttgtaatttcagtctttttaattatagcctttttgtgggtgagaaacgctatctcttgctagttttattttgcattttcctagtgac

SEQ ID NO: 16961 - DNA, 201 bp, Homo sapiens
gaaatacaaaaattagctgggtttggtgacaaacgcatgtaatcccagctgctagggaggctgaggcaggagaatcacttcaacccggaaggcggaggttkcagtgagctgagatccagcctgggtgacagagcaagactccatctcaaagcgaaacaaaacaaatgagggtcctcatcagcgtgcctttgacactgtcct

SEQ ID NO: 16962 - DNA, 201 bp, Homo sapiens
gtttctcataacatttgtgtgtgtgtgggtgggtgggtgtgtgtgaaaggtaggatcacctctctgtgcctcagtctccccatcatccttcggtggtagawcaatgctatctgatgaggccttttttgggatcacccactccaacatgcatgtcctttctctgtcccctcctggtgcctgtattagtctgttctcacattg

SEQ ID NO: 16963 - DNA, 201 bp, Homo sapiens
cagcactttgtaatttcagtctttttaattatagcctttttgtgggtgagaaacgctatctcttgctagttttattttgcattttcctagtgactaatgcmtctttttatgaactcattggccgttcatatattttctttctgtgaactgcttgtttatgtattggccattttctaaaaattagatagtctttttaatatt

SEQ ID NO: 16964 - DNA, 201 bp, Homo sapiens
gtccaatttatctttttcatttgtttagtgctttcttgttctaagaacctttaccaatcaccaggtcacaaaaatattttcctatgttttcttctagacastccataacttcaatctttacattcagatctatgttccatctcaaattaatttttgtatatggtgtgaggtaatggtagaggtttatttttctctccataa

SEQ ID NO: 16965 - DNA, 201 bp, Homo sapiens
actatttgttcaaagactaatcctcgcgctattcaatttccttggcatctttgtcaaaaatcagttgactatatatgtgtgggtgtatttctagactgttrtactccattgatctaattttttttcttatacttactgctcgattgcctggaagctaggtaataataaggattcaaactttgttctttatttcaagattgt

SEQ ID NO: 16966 - DNA, 201 bp, Homo sapiens
tttccttggcatctttgtcaaaaatcagttgactatatatgtgtgggtgtatttctagactgttgtactccattgatctaattttttttcttatacttacygctcgattgcctggaagctaggtaataataaggattcaaactttgttctttatttcaagattgtttgggttagtttagatactttccttttacatatata

SEQ ID NO: 16967 - DNA, 201 bp, Homo sapiens
aggttgtgtctgagattcagaggttgtttttatagcagcaacacagtaagttgggaagagggacacatttttaacatagacaccaaaagagaggctggaaragttgaccacttagaaatgtcacgagtgtctgtgaatagtgttgggggctgagaggcaagagaagaaaatagtcctaatgttgtacaagtagcaatggaa

SEQ ID NO: 16968 - DNA, 201 bp, Homo sapiens
tctttggagaagaggcccacgttcttttcagattctgatttctccgtgatataaatagttttttaggtgatcacttgtttttaatgtacctacctatctawacctttctctctctctctctctctctgtgtgtatgtgtgtgtgtgtataaaattacatatccagtatgaaacctaaaaataagattttggggcctgtgaa

SEQ ID NO: 16969 - DNA, 201 bp, Homo sapiens
ttggtattgaatctgttgatcaatttgaggaggatcaaaatcctgaaagtgttgagcgttaccatccatgagcatgcatctctccatttatttaaggcttstttatttataaacatttcagtgatatttgatgattttgaatgtggaggtcttatacttttttgttaaattaactcttacacatttgatttttttatgcta

SEQ ID NO: 16970 - DNA, 201 bp, Homo sapiens
aagatatccctaaagacatcctgctggtttcagtggctcatgcctgcaatcccagcactttgggaggctgaggcaggcggatcacttgagctcaggaattygagaccagcctggccaacatggtgaaaccttatccgtaaaaaaaataaaaaattagccagacatcgtggtgcatgcctgttgtcccagctatttgggagg

SEQ ID NO: 16971 - DNA, 201 bp, Homo sapiens
cttcttctccaatttttatggcttttgtttctttttcttgttttaatgcactggctatagcctgtaggacagtgttgaacagaggttttgagacagacatmattgctttattcaggacttctctattatatgtgatcctagttgtatgttttctgtacctatacttcattagattaaggagtttgaatttatttctagttt

SEQ ID NO: 16972 - DNA, 201 bp, Homo sapiens
cttgttttaatgcactggctatagcctgtaggacagtgttgaacagaggttttgagacagacatcattgctttattcaggacttctctattatatgtgatsctagttgtatgttttctgtacctatacttcattagattaaggagtttgaatttatttctagtttgctgagagttcttttataaatgtgttcatatatata

SEQ ID NO: 16973 - DNA, 201 bp, Homo sapiens
cttgtctacattttgaggctcttctattatggaagagggctagagaggccatcagaatttggtttcactagcctttgatccttcctgtttaaggagctcarcatttagcttcacttccctgtcattcatcagaattcattctcagattggaattgtccagtcttagagtgatttttgtccccagtgacacttcccttatat

SEQ ID NO: 16974 - DNA, 201 bp, Homo sapiens
tggaggaggattcaagccccttgcaacggactgaagtgcccaagctctaaatccctgccacccacagcctctgttggccccaggttgtgtctgagattcaraggttgtttttatagcagcaacacagtaagttgggaagagggacacatttttaacatagacaccaaaagagaggctggaagagttgaccacttagaaatg

SEQ ID NO: 16975 - DNA, 201 bp, Homo sapiens
agggggtggaggaggattcaagccccttgcaacggactgaagtgcccaagctctaaatccctgccacccacagcctctgttggccccaggttgtgtctgarattcagaggttgtttttatagcagcaacacagtaagttgggaagagggacacatttttaacatagacaccaaaagagaggctggaagagttgaccactta

SEQ ID NO: 16976 - DNA, 201 bp, Homo sapiens
attttactcacccagaaggaagccgggtccctctttgcccctttgggtgtttgtgaaaagcaagttgtaaacactgaattctataaactgttggagacagrttctggagagacactcaggcttagctctagaaagaaacgggtaagacagaggaggttcagggcaactgtgttgccttccttgactggtgcatgggaattc

SEQ ID NO: 16977 - DNA, 201 bp, Homo sapiens
tgtcgggccatttgttttttaacgaattgccctttcatcttatatgcatgactattggatatgtatcgattactaattgattgcttgcctcatgtgctatmatttaattttcaaaatgtcccttagaagttaatttataaagtgtctattactttaagtacctgttcaatcctgtgatcaagaggaaattcacagagaaag

SEQ ID NO: 16978 - DNA, 201 bp, Homo sapiens
tagaaacttggacagaggaaaatgaaaatgttctattaattccactagcatgagataatcactcttaatattttgttgcatgttcttttctttcttctgartgatagcatttttttcaacaaattgggctcgtaatatataggcacatagatatataattaaaaaaacaagaatttctcatgtcattaaacattgcttgaa

SEQ ID NO: 16979 - DNA, 201 bp, Homo sapiens
accctctgattcaggctcagcaggagcgggagaggatgcataggactacatgttttctgggccaggactggaagcagcatatctcagatccaacctctttmccttggcaaaaattcaggatgtgcaggacgaggaggaaaatgggagtagtgactatttagccagtctttgccacatcccggttcatatctcactccgtca

SEQ ID NO: 16980 - DNA, 201 bp, Homo sapiens
aaggagaagaaaatgaagaaaaatttagaaacttggacagaggaaaatgaaaatgttctattaattccactagcatgagataatcactcttaatattttgktgcatgttcttttctttcttctgagtgatagcatttttttcaacaaattgggctcgtaatatataggcacatagatatataattaaaaaaacaagaattt

SEQ ID NO: 16981 - DNA, 201 bp, Homo sapiens
ttcttgttctcgtatcactcagactaagcagttgatgtaacagataacccccaaatttcagtgatttcacatttaatctgtaaaaaatgaggatttgtttrtagccccaaagacagtctagtttggattatttgaggacctagacttcacctgcacagtggtttcaccatccatccccccatggcctccatggtaccctct

SEQ ID NO: 16982 - DNA, 201 bp, Homo sapiens
cctgtagataatacagtcccattctctggggaaacagatacctccgccagggtcctgatctgaatatgatttggggtgatggaacagaaacacccgaggastgtcgttggggaacaggaaacctgtctgtagtcctggctctgtctccaattggctacgagggcttgtgtgtactctagttctctttccgtgacactgcat

SEQ ID NO: 16983 - DNA, 201 bp, Homo sapiens
tgagttctccataaatgttagttattattttaatattacagcatctgtggaaacagtgggtttatatttcagcgtcctgagaaacactcatcctgaacaaygggaacattggccacatccgccattgtcaattttaaataaaagatatgatgactagttggtgagttgatcttgtaagacttttacagatacccagaacgg

SEQ ID NO: 16984 - DNA, 201 bp, Homo sapiens
agttattattttaatattacagcatctgtggaaacagtgggtttatatttcagcgtcctgagaaacactcatcctgaacaacgggaacattggccacatcygccattgtcaattttaaataaaagatatgatgactagttggtgagttgatcttgtaagacttttacagatacccagaacggctctacttcttcatattcc

SEQ ID NO: 16985 - DNA, 201 bp, Homo sapiens
aggcatttttctgttgactgtgcatgaagccacatagtaataaacagtttccatatccaagcagctaaggcttgtgccttgcaagttaagtggaacatcasgatctatatctcagttttccttatgtttccccagttggcacatcatggccaacaagagagtagggatcattaaggagtttattttcatctttattttatc

SEQ ID NO: 16986 - DNA, 201 bp, Homo sapiens
ctttttctgactagctgattctgctgctgctggatttattcattcttctccctcacaattttggctcgcacatgcttcctttttagctcatgaccgtgcarttcaactcaacctcatggcatctttttatcagctgtccctgctgcaacaggcttagagttggtttcccaattccctagcgcagaaatccactggcatgag

SEQ ID NO: 16987 - DNA, 201 bp, Homo sapiens
cctcctgttttgtgtcagctcagacactgaaggggaaagtttccagcctggtttctccatacactgaacatgttgaaatctatgccttaagcccaaatgarctgtcactcaagtatgcacgctcatattattaaaaactgtgcatgtaatttgctgggcacccaaataatttgttttttatttttccttaaaaatgagact

SEQ ID NO: 16988 - DNA, 201 bp, Homo sapiens
tcttctcaggcttccaaccactatgtttggaaatgaaatatgccttgaaggaaaaaagctgccaaatgctggccttgcagtttttgcagatcttggccccmaaaattcttagtcatagtgcccttctgatgccttcaaacagatatgggtgtgtatgcacgtgtgttattttgtccatcttttctaattgttctcagtagg

SEQ ID NO: 16989 - DNA, 201 bp, Homo sapiens
ggcgttctctttttctgactagctgattctgctgctgctggatttattcattcttctccctcacaattttggctcgcacatgcttcctttttagctcatgrccgtgcaattcaactcaacctcatggcatctttttatcagctgtccctgctgcaacaggcttagagttggtttcccaattccctagcgcagaaatccact

SEQ ID NO: 16990 - DNA, 201 bp, Homo sapiens
caaataatttgttttttatttttccttaaaaatgagactttctgttaggaaagtgattcatgaaacagtgaagatcctgcctcacaactttcaagaaaccsacagaggtccctattcacataagaattttctaagcagaggttccaatttggatatttcgtggccttcaggttatttgtaaccagtacacaaaccacaaag

SEQ ID NO: 16991 - DNA, 201 bp, Homo sapiens
agatggttctatgttgtcaggggctgccctgttcatggtaagatgttttgtaatgcctggtgtttacccactagatgccagtaggactctaccccacaacygtggccactgaaaatgtctccagacatttgcttctgtcccctggggatcaaaatcacccctggttgagaacttggggtaatttaagtggtgctccggtaa

SEQ ID NO: 16992 - DNA, 201 bp, Homo sapiens
ccaagtcttttgccctccatggtgcacatgtgatcttggcctgcaggaacatggcaagggcgagtgaagcagtgtcacgcattttagaagaatgggtaagygcttgactgttgttgttttttttaattgtcaaatacacatgccgggctaaccatatggagatttcagtggagtgtgtaaagtttattgctcttggaatca

SEQ ID NO: 16993 - DNA, 201 bp, Homo sapiens
tccggttctcccagtcattacctttctccttcaagctgggattcagagtccattttcatagggcaaaatgcagagttcgggttccttcctatccatgagartaggtgctgaaggagataaaggaatgaagacatagactttgaaagcaatagtctggcaatcatccaaaggtttgtgggaggacaaaagatcacaaagtat

SEQ ID NO: 16994 - DNA, 201 bp, Homo sapiens
aggaacatggcaagggcgagtgaagcagtgtcacgcattttagaagaatgggtaagcgcttgactgttgttgttttttttaattgtcaaatacacatgccrggctaaccatatggagatttcagtggagtgtgtaaagtttattgctcttggaatcatgtctttatttttaaagtcatcttcactttgtttgtcttatgaa

SEQ ID NO: 16995 - DNA, 201 bp, Homo sapiens
acattatagaatattttcacggaaatatttcggatggaattttggctttaattctttctctttttttcctgttcttttccctctccccacaaccacttctstttcattttctgttttgctccttcttttcataagtagctggtagtcagtgttctctttttcttcctgtgagacaggatctccctctgttgcccaggctcg

SEQ ID NO: 16996 - DNA, 201 bp, Homo sapiens
tcctttaactcatttattaagaaaaataaaacgtggtgaacgcccatgattgcaactaggagactgttatgcttatggttgttaagattagaaagaaggargctttaaccctatctctgatttcttacttttctctgtctatgtagaagttgatgttgatacgtgtctacataaatatttactaagggcttgcattagtct

SEQ ID NO: 16997 - DNA, 201 bp, Homo sapiens
ttcccccgtgactgctgcgggggcctaggccaaagatatgcccgagtagaaaatctgacaccagcttcccagttttctcttctgctctctttggctgcaasgcttttaccatggctaaaccattaggccggctctgcagggagggcaagaccacagcagctcagtatttcctgctcagggaaaaaggccaggtcttttgtt

SEQ ID NO: 16998 - DNA, 201 bp, Homo sapiens
ttccctttggtggccatttaggttgtttgcattgttttgctatttgttattccaagcaatggtgtttcacagttctctctttcttgcatcagtctttcttrcgatatcatctgatattgggcctaaactatgctgctgtgagcattctttatttacgtatttgtgagtaaatgcctggggcagaatcttagcactggactc

SEQ ID NO: 16999 - DNA, 201 bp, Homo sapiens
tgcgggggcctaggccaaagatatgcccgagtagaaaatctgacaccagcttcccagttttctcttctgctctctttggctgcaacgcttttaccatggcyaaaccattaggccggctctgcagggagggcaagaccacagcagctcagtatttcctgctcagggaaaaaggccaggtcttttgttggtggaaatccactt

SEQ ID NO: 17000 - DNA, 201 bp, Homo sapiens
cgagtcattttcttttttcttttttttctttttcttttttattttttttttgagactgagtttcactctgtcaccaggctggagtgcagtggcacaatctygactcactgcaactttcacctcctgcgttcaagcaattcttctgcctcagcctcccgagtagccgggactacaggcacgcgtcaccatgcccagctaatt

SEQ ID NO: 17001 - DNA, 201 bp, Homo sapiens
gtctaatttatgtaaaataaattgcatccatttaaatatacaattcaatgagttttgacagatgcacatgcccatgaaaccaacacgaaaataaaaaaaawagaacatttacgtcacctcaaaaagatttcaaatgccacttctgtggtgtatgactctgagtccagacagcctcagctccaggaaaaccctggtctgttt

SEQ ID NO: 17002 - DNA, 201 bp, Homo sapiens
tttgatattttttaaaggaaaaatttgaggcattgacacatgccttttgcttacttgcttggattggtttgatcaactttgttgcggtctaatttatgtawaataaattgcatccatttaaatatacaattcaatgagttttgacagatgcacatgcccatgaaaccaacacgaaaataaaaaaaatagaacatttacgtc

SEQ ID NO: 17003 - DNA, 201 bp, Homo sapiens
aaaaaagtaaaataaagcatgggaagtcccttatacagtttgtgatatgggtacacactcagtgaaatggccattaatactgctgttcttaactctgaaarcagagtgggccatttgaatgctcactttgatattttttaaaggaaaaatttgaggcattgacacatgccttttgcttacttgcttggattggtttgatca

SEQ ID NO: 17004 - DNA, 201 bp, Homo sapiens
aaaaaaacaaacttgaaaagcatagcaggctgccaggacatgtctgagtaccgcgcagatagtggggaatagtctatggattctgcttacaccatggacarccaggctgggccatgggttgtgttttttttcctctcattttatagaaatgttaccaggcatattttccctgtttccctaagaagagcttcctctcagtgc

SEQ ID NO: 17005 - DNA, 201 bp, Homo sapiens
taactgtctcttgcgatcccctcctgcacaactgtggcgttctctttttctgactagctgattctgctgctgctggatttattcattcttctccctcacarttttggctcgcacatgcttcctttttagctcatgaccgtgcaattcaactcaacctcatggcatctttttatcagctgtccctgctgcaacaggcttaga

SEQ ID NO: 17006 - DNA, 201 bp, Homo sapiens
tggctgacagagggagactctatctcaaaaaaaaataataaaaataataaaaaaaaaattacatgaaaaatagagacaaagtctcgctttgttgcctaggstggtcttgaactcctgggttcacgtgatcctcctgcctcggcttcccaaagtgctgggattacaggcacgagctgccacgcctcacctcttgttttcaat

SEQ ID NO: 17007 - DNA, 201 bp, Homo sapiens
cagggctctgcccattagaatctctagggacagaccgaggtttgagagttcctgctcctgatctcaggggaatcctgaattacaggtgttaacctgattakccccagcccagctcttcgttaattacctgaagtgaatgggacagtttccaatactcagcacaaaggcgtgcgcagtgactctgtggcgtactatctattt

SEQ ID NO: 17008 - DNA, 201 bp, Homo sapiens
atggctaaaccattaggccggctctgcagggagggcaagaccacagcagctcagtatttcctgctcagggaaaaaggccaggtcttttgttggtggaaatscacttttccatccactgtcttctaagaatgaaagtaaatctgttgtgctttcctctgccctgtcctcaggcttagccttagtgggcctggtttttgcccc

SEQ ID NO: 17009 - DNA, 201 bp, Homo sapiens
ggcacaatctcgactcactgcaactttcacctcctgcgttcaagcaattcttctgcctcagcctcccgagtagccgggactacaggcacgcgtcaccatgyccagctaatttttgtatttttaatacagacggagtttcaccatgttggctgggatagtctcgacctcctgatctcatgatctacacacctaggcctccca

SEQ ID NO: 17010 - DNA, 201 bp, Homo sapiens
ctaaatactccctagaggtttcccattggccacttggggtacaccccttataaatgaagtggtggcctgcaatcagtcttattggttgcagaaagcaaccratcagaggctgaagtgaagttacaaatatcacactcctatgcaaacatctgattggttttggaaagcaaccaatcagaggctaaagtgaaattacagagt

SEQ ID NO: 17011 - DNA, 201 bp, Homo sapiens
ttctgcctcagcctcccgagtagccgggactacaggcacgcgtcaccatgcccagctaatttttgtatttttaatacagacggagtttcaccatgttggcygggatagtctcgacctcctgatctcatgatctacacacctaggcctcccaaagtgctgggattacaggcatgagccaccgtgcccgacctcccgagtcat

SEQ ID NO: 17012 - DNA, 201 bp, Homo sapiens
ttataactacagaaaatatattttcattccttccacttcatgctttcagctagaaatgtgagtctctgagacttgtattcttggggtcacttaaaacataytgcataatgaggccttcaatgactctgatttggaactgaccctctatgaggggttatacccctggacaccaagctgctggcctgagcatgaggttgatgg

SEQ ID NO: 17013 - DNA, 201 bp, Homo sapiens
accatgcccagctaatttttgtatttttaatacagacggagtttcaccatgttggctgggatagtctcgacctcctgatctcatgatctacacacctaggmctcccaaagtgctgggattacaggcatgagccaccgtgcccgacctcccgagtcatttcttatcttgttgctccaatttccattcccactgacagtgtag

SEQ ID NO: 17014 - DNA, 201 bp, Homo sapiens
tactcaaataagtctcccccaaaactcagggatagagatttttaaggagaatttagtgagaagggggtcagggaatggggagtattgattggtcaggtttragatggaatcagggagttgaagctggcctcttgcactgagtcagttcctgggtgggagccacaagaccatatgagtcaatttattgacctgggtggtgcc

SEQ ID NO: 17015 - DNA, 201 bp, Homo sapiens
gcttgcagtgttcttgggactagcaggagggcgtgtcaaaattgtaaaactctgcctatttgatgtaatatttgaaactagaaaggtaaaattccagggaygctagtgacactatggtaacctgattgtacagtgacattcatgtttaaaccagtcttggaagataatgctgtagcacaactgtttttgcatcattaaatt

SEQ ID NO: 17016 - DNA, 201 bp, Homo sapiens
agtgggttgcgcctgtaatcccagcactttgggaggccaaggcgggtggatcacctgaggtcaggagttcgagaccagcttggccatcacagtaaaacccygtctctgctaaaaatacaaaaattagccaggcatggtggtgtgggcctgtaatcccagctacttgtgaggctgaggcaggagagtcacttgatcccgggg

SEQ ID NO: 17017 - DNA, 201 bp, Homo sapiens
catcaattgcagggtctgcaaagtatctaaagtactgatgttcggttttaccatagtgacattatcccctggagcaatttggggaggttcagaatcttgcrgcctccggcagcatgactcctaaaccctaatttctaatcttgtggctaatttgttagtcctgcaaaggcagtctagtccccaggcaggaaggttgtttat

SEQ ID NO: 17018 - DNA, 201 bp, Homo sapiens
cccaagatgatgattatggaaactcaaattttgcaccagaagctgtagttaccatttcattccattgcaccattcataccctgcagagaggatgtgaagtygtaaggccttcttgctctggtgacatctgttaggcttcgtctctatatcatcccccaactccttgacccttgatatttgctggtctacttcccttcaggt

SEQ ID NO: 17019 - DNA, 201 bp, Homo sapiens
ccttagcagacatcatttctctgtttaatctgtctacttgctaattgtctcactgccctccccctccccactggagagtgaatgaaggcttaaggttttgyctgccttggtctctcctgggtcctgagtaccagtggccttacgtggcatttggtagattacatgcttaatgaaaagtgagtgaatgggctgggtgtggtg

SEQ ID NO: 17020 - DNA, 201 bp, Homo sapiens
ccatcccactaatatatttcttaccaggagtacatagtttgttctttaagcaaaaccatatgcatcgtattttaaatggaacagggaggttgttccatgcrtcaacttagtccaaatgtagagggtcaggaaaacaatgatatgagaaaagggccggttactgtctgggaatccataaatactgcttggcaaatggcacat

SEQ ID NO: 17021 - DNA, 201 bp, Homo sapiens
tttcttttttttttttttgcattttccagacgagccaagggatggctcagaagggtgaaggaactcacccgaattgcacagctggtgagctcagagtcagkctccttgcttggtccatctggcttccaaactccaagtctgtctgctccaccccatggcccatctttttaccatgtttagtatcaatgttcatactttgca

SEQ ID NO: 17022 - DNA, 201 bp, Homo sapiens
attcttgcaaatgtttttggtttctctgtctactcattacgtacactctgccagaggttgaaaactcaatgttgagatcacatacatcctgaaaacactgkttaaataaaattttggcctgcatcctgtttttgaaaacttgcaatggcttgccaacgttttcaagttgagaagtttcacaaaaaaaattcggatttccag

SEQ ID NO: 17023 - DNA, 201 bp, Homo sapiens
aagcaaaaccatatgcatcgtattttaaatggaacagggaggttgttccatgcgtcaacttagtccaaatgtagagggtcaggaaaacaatgatatgagaraagggccggttactgtctgggaatccataaatactgcttggcaaatggcacattgcatgcttattccttaggcatccgtttagcaaaataagatgtcaag

SEQ ID NO: 17024 - DNA, 201 bp, Homo sapiens
tggtgccctcacctcttaagacaagcacctatcgttttcctgtgtattccaagaggccagtgtggctggtggaataagatgttttcctgttttcaagatgsagtggactctcttttatttagcagcagtgtctatgtgttaggaatccatgtgagttctctaagtctgggacaacgataggtgtgtctgagtcctgcatta

SEQ ID NO: 17025 - DNA, 201 bp, Homo sapiens
aaggctacagtgagctgtgatcctgtctctacacctcagtctgggtggcagagcaagaccctgtctcaaaaaaaaaaaaaaaaaaaaaaaagtaaaataawgcatgggaagtcccttatacagtttgtgatatgggtacacactcagtgaaatggccattaatactgctgttcttaactctgaaagcagagtgggccattt

SEQ ID NO: 17026 - DNA, 201 bp, Homo sapiens
taactaccttgcttgcctatgggacatgttcccatttcagtgcatacttgacctttaccataaatcacatatttgtaaactgtaccctcctgctgttttaytgggcatggagaagcagtcttttctttttcttgatggcctgggttgaccagatcctgacttttgtggagacattaaagtgctagaaatgataatggtgaa

SEQ ID NO: 17027 - DNA, 201 bp, Homo sapiens
cagtatctattggagttgggcttctgttgctttatttctcggggtctggcatatcccactccctgtcttgagatctcaggacctctgaggggcattgcatktaaagaacaagagcttattaggtatcaaaacatacttcatgaacagctacagcaagacctcgacattccagtgtagagctcttgaaagaccccagtgggg

SEQ ID NO: 17028 - DNA, 201 bp, Homo sapiens
ttggtaattgaatgaaataagactcttaggaaaattctccccagtggcaatgttgtaagaaacaccaggccgggcacagtggctcacacctgtaatcccarcactttgggaagctgagacaggcagatcacttgaagtcaggagtttgagaccagcctggccaacatggttaaaccccatctctactaaaagtacaaaaat

SEQ ID NO: 17029 - DNA, 201 bp, Homo sapiens
tggtcagagagggctggtatgggaagaggggcaggtggctctcccttagagttactatttgactcacccctgacttcccagaatgtgtcttgagtctattmccctctcatatgggaggggtgacccaagtatgtttgtggcaaccaaaatgtctccaggcattgccagatgtctcttgggggtgcaaatcgtccccagttc

SEQ ID NO: 17030 - DNA, 201 bp, Homo sapiens
ttaaaagtcctggttcaggctgggacttctgctcagggtctcatgaggctgaaatcaaagcgtcagccagggatggggtcttatcagaggcccttggttaytaacagaattcattttcttgtaactgtaggactgaggtgcttgttttcttgctggctgttgactgagggccccttgcagcccctagaggctattctcagg

SEQ ID NO: 17031 - DNA, 201 bp, Homo sapiens
acctgtcccaggccttgtcttccagccccacaaacgtgcacctgcagccggagaccagggggccccgatcaggtggcagggcctttaattggagccacgtktgtataatgagcagcgcacacacacaaaggcgagctaaaaatgtctccacccttctaaatatgggatgccttggccaggtattgagtcagctctgtgacg

SEQ ID NO: 17032 - DNA, 201 bp, Homo sapiens
gagcagcgcacacacacaaaggcgagctaaaaatgtctccacccttctaaatatgggatgccttggccaggtattgagtcagctctgtgacgccagtgcarttatcccgattcagcatcagatttattcaccattaaacatgttctaacttgattgcaaacaagccttgtattatttagagggatccacggagctggcaga

SEQ ID NO: 17033 - DNA, 201 bp, Homo sapiens
gctggagtgcagtgacatggtgatggctcaccacagcctcagcctccctgggctcagtcgatcctcccacttcagcctcccaagtaactgggactactgtsatgtgccaccatagccagctattttttttgcattttttagagatgagtttttgccgtgttgccgaggctggtctcaaactcctgggctcaagctattcac

SEQ ID NO: 17034 - DNA, 201 bp, Homo sapiens
ctgggactactgtgatgtgccaccatagccagctattttttttgcattttttagagatgagtttttgccgtgttgccgaggctggtctcaaactcctgggstcaagctattcacctgctttggcctcccaaagtgctgggattacaggcatgagccaccatgcccggcccccttttttaaaaaacaaaaaaacaaaaaact

SEQ ID NO: 17035 - DNA, 201 bp, Homo sapiens
gatggatgtcttctatctctgccctgtccagtataaaagccacaagccacatctggctgtgtggcacttggcatgcaactagtatgacatcttaatttttytttttgagatggagcctcgctctgtcacctaggctagagtgcagtggtgcaatctcgactcactgcaacctacacttcctggattcaagtaattctccta

SEQ ID NO: 17036 - DNA, 201 bp, Homo sapiens
cagtgtttacagaccccaaagcttgctgtcccctgggcaggtgcatgagggggtcccaggcaatcaggctcttctcaaacctgaattatacccggcctcarggtataggggtcaggcagctgtttgacaggattcttgcaaatgtttttggtttctctgtctactcattacgtacactctgccagaggttgaaaactcaat

SEQ ID NO: 17037 - DNA, 201 bp, Homo sapiens
acctgtaatcccaacactttgggaagctgagacaggcagatcacttgaagtcaggagtttgagaccagcctggccaacatggttaaaccccatctctactraaagtacaaaaattagccagacgtgatggtgcgtacctgtaatctcagctactcaggaggctgaggcaggagaatcacttgaacccgggaagcggaggtt

SEQ ID NO: 17038 - DNA, 201 bp, Homo sapiens
cattgccctccattcagatcttgtcacttaggccttggtagcatgagctattaacagccctccatatttactatttttttttttttttttaactctgggasttcctgttgcagaaattggatcacttacctaaaaagctccccacccccacctttggtgactggtgggtttcatcaccaggaaagcacattgttccaactc

SEQ ID NO: 17039 - DNA, 201 bp, Homo sapiens
gtattgttccatttttgagtattactttaatacattattgataagttaatttagaagtatcaagtgaaaggggaagaaaaacagttttgaataaaaacggwgtttcctctggactattttgccaaatgcatttttattggtagaacgtaagcaaatttaaaaaagcaacaaaagcagtttttatgaatacctagcgtactt

SEQ ID NO: 17040 - DNA, 201 bp, Homo sapiens
acctgtaatctcagctactcaggaggctgaggcaggagaatcacttgaacccgggaagcggaggttgcagggagctgagatcacgctgatgcattccagcstgggtgacagagcaggactccatctcaaaaagaaaaactcaacgaaacaccccagcttctatcattctcaagcttagtgtgtgcaagactcatggatgct

SEQ ID NO: 17041 - DNA, 201 bp, Homo sapiens
tttcaatagagttgatatcgggtctatttattttgtgggagtgaagggatagggatagtactgacagcattatgtgattgcagcctcattgataagcatcrgaaataatgactttaacattattttcagatagggagcactcagtaccaaccattatattaggctcatgggctcaacattttgctgtgcttttcatagata

SEQ ID NO: 17042 - DNA, 201 bp, Homo sapiens
atttattttgagagcaagcacgggggtttatgtgatggctccacagagcagtgaaaagactcccgccctactgctcgcaacctcagatgtccctgggcacwagcccatctgtatgtctttaaaaaaaataaattaaatttttaaaaacatgactttctggccaggcgcagtggctcatgcctataaccctgcacttagaga

SEQ ID NO: 17043 - DNA, 201 bp, Homo sapiens
ggccaccatggtgaagccccgtctctactaaaaatacaaaaaattagccagctgtggtggcacatgcctgtaatcccagctactcgggaggctgggacagragaaccactggaacctgggaagcggaggttgcagtcagccgagatctatgccattgcactccagcctgtgtgacagagcaagactttgtctcaaacaaac

SEQ ID NO: 17044 - DNA, 201 bp, Homo sapiens
attgataagcatcggaaataatgactttaacattattttcagatagggagcactcagtaccaaccattatattaggctcatgggctcaacattttgctgtrcttttcatagatactgacacttgtgttttcattttgttgttgttgttgttttccctgccgggaaactgccgcatcctgtgttttcatggcatgatattaa

SEQ ID NO: 17045 - DNA, 201 bp, Homo sapiens
gatggcagctcaaggggtttttgcctgcgtcttcacccaaagccactaacacgggatctgtcaattgcattgctggtgatcaagaaatgccagctcctccrctcttccctgagtgccttgttggagacaaaaccagcaggattatatccccagcactgtaatttagtgtggcagtcaggggaaaacaccttgtagaatttc

SEQ ID NO: 17046 - DNA, 201 bp, Homo sapiens
tgactttaacattattttcagatagggagcactcagtaccaaccattatattaggctcatgggctcaacattttgctgtgcttttcatagatactgacacytgtgttttcattttgttgttgttgttgttttccctgccgggaaactgccgcatcctgtgttttcatggcatgatattaaggaacgatgggtaggatgctg

SEQ ID NO: 17047 - DNA, 201 bp, Homo sapiens
attggttagatgccgtatctttaaaacaccatcagcttggaaaacactatccattagcaagagatcagagcaagagaaacctcgaagggtcgaacggtccrttctgagggctccacaaagaactcggcatcccagaaggatgattagccttccatctctcgagttgtctcagagcacaacaggtctgagtgtttttttctt

SEQ ID NO: 17048 - DNA, 201 bp, Homo sapiens
cattttgttgttgttgttgttttccctgccgggaaactgccgcatcctgtgttttcatggcatgatattaaggaacgatgggtaggatgctgaggagtaarttgctcgcacttttaaagacttctgcaaaactccacctacttttaggctccttaaaattcagtgactttatgagctggtatagcttcactgtttgtggga

SEQ ID NO: 17049 - DNA, 201 bp, Homo sapiens
catagctcactgcagcctccaactcctaggctgaagccatcctcccaccgtagcctcctgaatagctgggactaaagtgtgcaccacaatgcccagctaasttttgtattttttgtagatacggggtcttgctatgttgtccaggctggtctcaaagtcctggcctcaagtgatcctcctgccttggcctcccaaagtgct

SEQ ID NO: 17050 - DNA, 201 bp, Homo sapiens
aaccatacacatccagtagaaaccgaactttacattttgagtttcgatttttttttttcacctgggctagtaatacgtggtaggatactctctcacaatgytaggccacagcagcgagctgcagctcccagtgatcacaagggcaaagaatcgatattctaccaggcacggtgttgcctgataaccttgcccagctgtagg

SEQ ID NO: 17051 - DNA, 201 bp, Homo sapiens
agtatcattctgatgtagggaggatatcacctcacaggagtctttcctggctatcctgtccaaagtcactactcacaatttctctatcccataactctatyttatttctctgtctagcacttatcactatctgatattttctgtctatccatccgtctattcattcattcattgctaatttattagtattgccttcccatg

SEQ ID NO: 17052 - DNA, 201 bp, Homo sapiens
ttctgtatagtattggattttcaataaataaagtatgatataaacaagtctgcaaaccagcaagaactatataagccacttgctcaagtcaataagcgcaygctcacaaaggaacgtaaagttctgaagttcttctttggggcgtttgcaaaatgtcctattattgtcacctgcaggtggggggttggatattcctatttg

SEQ ID NO: 17053 - DNA, 201 bp, Homo sapiens
tcacctgtcctttatcttggctggtccaattccataagaagtaaatgctgtgtgtctgcaattcaaaagacccctttcacgggaggctgggagatttttcyatctaaatagcttaattgttactctacagggcaatcataaatgtaaatcgacttaatatgacttgattgttagtaatgactgtgcctctaatgacgctgg

SEQ ID NO: 17054 - DNA, 201 bp, Homo sapiens
cacagctgggagataacggggtggatccaagatttgcagctggtgtgtgggtgatgccggaagattggcctttttcaaggacttagacaagtattgtactsatacattatttgcatttatttgtatgaatacttctgggttcctaatatgagggtacctaaaaagtacatccgctgcgcttcttgtaatctgagggagttg

SEQ ID NO: 17055 - DNA, 201 bp, Homo sapiens
ttgttctttgatcattgtctttgtgtcttctccttttttttttttttcctggccaccgctcgcagtcttgaaccgaatctttcaaactttatatccatgtracctttgtataatgagggctgtgattaactgcagagttttaaagagtgaaagtcaagcataggtggctggctctgaaccatcactcccaataatgtgaaa

SEQ ID NO: 17056 - DNA, 201 bp, Homo sapiens
ctattagcaaaataacagacagtgttatcagtcattgactcagaagatagtttcttaccgtttggggaaagtgcttgtctattcctctccaaagccatttwaaaaaaaaaattgcaccagttctcatcccatcatctgccttgatcaaacatttgcttattggaatcacttcgaaaaggaacttggtatcgttcacatgtg

SEQ ID NO: 17057 - DNA, 201 bp, Homo sapiens
gactgggaagaaaaagaggtttaactggacttacagttccacatggctggggaggcttcagaatcatggtaggaggcgaaaggcacttcttatatggtgtmagcaagagaaaaatgaggaagaagcaaaagcagaaactgcctgataaacccatcagatctcttgagacttattcactatcatgagaataggatgggaaag

SEQ ID NO: 17058 - DNA, 201 bp, Homo sapiens
agtgatttgcccaccttagcctcctaaagtactgggattacagacaagagccactgcgcagacggacatatgaatttttaatttgatatcattgtgatcartttgaagatccacatatggctgagggctactctaatgagtggtgcagctccaaggcagagagatggctgtgattaaccaatgaatgagggaacaaatatc

SEQ ID NO: 17059 - DNA, 201 bp, Homo sapiens
cccaccttagcctcctaaagtactgggattacagacaagagccactgcgcagacggacatatgaatttttaatttgatatcattgtgatcaatttgaagakccacatatggctgagggctactctaatgagtggtgcagctccaaggcagagagatggctgtgattaaccaatgaatgagggaacaaatatccaggcagaa

SEQ ID NO: 17060 - DNA, 201 bp, Homo sapiens
ggtatctccctgccctggtctgaaagctgccacttgccgcccaccgcacagccccagggctttagctcactgtgcaggaagaggccttcctctgtgcatcstcccacagggtcgagagtgaatgccttgcctttaaaaataaaatgcatacgcctgtcctcatgcgctctgatctgccagcaggctgtgctggggagtggt

SEQ ID NO: 17061 - DNA, 201 bp, Homo sapiens
ctaagagtaaaacgcatgtccccccatgaagtcactcaaagctcaggcgtgtgcaacagggacagcaaaagcacacacaatgatggccagagacactgctyagtgtactgtcttccaccgggacagcccactcaccaagggttaggtcctgtgctgactgggtcccgggtctcctcggaggtcggtttgcatcacgtggat

SEQ ID NO: 17062 - DNA, 201 bp, Homo sapiens
ctgggtcccgggtctcctcggaggtcggtttgcatcacgtggatacactaatctacccaagttgacttggagaaccaatctgaaatcagatgggagctccmggaagcaaagcaattgcaggttcatttgttacttttattgtctcatttcttcttatttttttagcccaattgcctcctacatggggaaggttggggtcct

SEQ ID NO: 17063 - DNA, 201 bp, Homo sapiens
gtatggtcttaggccctggaataagacagtgtaggaaacacagaaggtgcctgatttcctgggcctagctaaggggaaaaagcgagacaatggggtcagakgaagctcagctgaacagatgaagttgagatgaacagaattccagtgccaccatgatttccagccgtgtgaccttccacatgctttttgatttttcttgaa

SEQ ID NO: 17064 - DNA, 201 bp, Homo sapiens
agctcagctgaacagatgaagttgagatgaacagaattccagtgccaccatgatttccagccgtgtgaccttccacatgctttttgatttttcttgaactmacttttcctttgtttgcaaaatagtaacaatattttccttccaagtgatggtgaggatttaagagttaacctgagtgtctgctgcatagtaggtgctcaa

SEQ ID NO: 17065 - DNA, 201 bp, Homo sapiens
cgtgtgaccttccacatgctttttgatttttcttgaactcacttttcctttgtttgcaaaatagtaacaatattttccttccaagtgatggtgaggatttmagagttaacctgagtgtctgctgcatagtaggtgctcaataaactataacgtctttatttcttttccttccaatgagaagtcacttcctggagggaagcc

SEQ ID NO: 17066 - DNA, 201 bp, Homo sapiens
gtttgcaaaatagtaacaatattttccttccaagtgatggtgaggatttaagagttaacctgagtgtctgctgcatagtaggtgctcaataaactataacstctttatttcttttccttccaatgagaagtcacttcctggagggaagccacctccaggaacagtcctggttcaactcatgaggagggtcactggttgggt

SEQ ID NO: 17067 - DNA, 201 bp, Homo sapiens
ctctgagctctaatttcctcacagggccgcaggactgaggttaaggacctgctgtcactggtacagtggttgaagaaaaggtgaatgaaggaagggcctcrttttactccttgtctcacattcctttctgctacttctctttggctcaccaaaaggagacagaagtttgtgtccatggctgtgaactgccaaagagttgcc

SEQ ID NO: 17068 - DNA, 201 bp, Homo sapiens
gaatgggctgtcctctcctgctactttataaaagccaagtttttgcttctagctggtcgaaggtcctgtgggagctcacgtttttctcaatcactgatgaycatttgagacataatttggagaaggtttctatcaaatcctagttggactgcagtgaaatgttttcaaactagagaagcaccaaataggccatgataaaga

SEQ ID NO: 17069 - DNA, 201 bp, Homo sapiens
ctgcacaaagaatgggctgtcctctcctgctactttataaaagccaagtttttgcttctagctggtcgaaggtcctgtgggagctcacgtttttctcaatyactgatgaccatttgagacataatttggagaaggtttctatcaaatcctagttggactgcagtgaaatgttttcaaactagagaagcaccaaataggcca

SEQ ID NO: 17070 - DNA, 201 bp, Homo sapiens
tggtctcgaactcctgagctcaggcagtctgcccgcctctgcctcccaaagtgctgggatcacaggcgtgagccaccgcgcccagcccatgacttctcttyatgggagagaaaggccaccgagatagtaagtggacatcaggacatggattctattaaatctaacacctttatctttgcatttccatacattttgcttatt

SEQ ID NO: 17071 - DNA, 201 bp, Homo sapiens
acatatattgagcattgaccaggtgcccaatattttaatgtcccatgggtgtgcatcaggtacgctgtggaaggacagatgtcattccttaaaggggctgsactgaattagaccaggggttctcaaagtggggtccctggaccggcagcatcaccatcacctggaaacttgttagagatgcagatcttgggccccgcccca

SEQ ID NO: 17072 - DNA, 201 bp, Homo sapiens
cagggtttcaccgtgttgcccaggctggtctcgaactcctgagctcaggcagtctgcccgcctctgcctcccaaagtgctgggatcacaggcgtgagccascgcgcccagcccatgacttctcttcatgggagagaaaggccaccgagatagtaagtggacatcaggacatggattctattaaatctaacacctttatctt

SEQ ID NO: 17073 - DNA, 201 bp, Homo sapiens
cttttctgactgctcaaaacagggaataataaacagtcagagtgtccaagtaatctgagctagaaagttccttctttcagagaaaagttataaaaagtatwtttgccggatccaaaaaaaatactgtgtatcaactactgagacctgcataatgttttcttagtattctcactctttaaaagaaaaaagaaaacctgtaaa

SEQ ID NO: 17074 - DNA, 201 bp, Homo sapiens
ggggtactgataccagagttcatttgaagtcattggaaaccaaggcatattttcttaaagagacaactgtttttggtgaataggccatgttgtttatagtwaaaacaaacatgaatattctgtaatagaagatatcgtttgcatggtgttttaaagctaaaacttgagttattaaacacccttctctccctggggatgcct

SEQ ID NO: 17075 - DNA, 201 bp, Homo sapiens
aggcacctgccaccacacctggctaattttttttgtattttagcagagacagggtttcaccgtgttgcccaggctggtctcgaactcctgagctcaggcartctgcccgcctctgcctcccaaagtgctgggatcacaggcgtgagccaccgcgcccagcccatgacttctcttcatgggagagaaaggccaccgagatag

SEQ ID NO: 17076 - DNA, 201 bp, Homo sapiens
tcagagtgtccaagtaatctgagctagaaagttccttctttcagagaaaagttataaaaagtatatttgccggatccaaaaaaaatactgtgtatcaactmctgagacctgcataatgttttcttagtattctcactctttaaaagaaaaaagaaaacctgtaaaatttgggaacttaaactttttttgatattttaatat

SEQ ID NO: 17077 - DNA, 201 bp, Homo sapiens
agtgcagcctccgcctctcgggttcaagcgattcttctgcctcagcttcccgagtagctgggactacaggcacctgccaccacacctggctaatttttttkgtattttagcagagacagggtttcaccgtgttgcccaggctggtctcgaactcctgagctcaggcagtctgcccgcctctgcctcccaaagtgctgggat

SEQ ID NO: 17078 - DNA, 201 bp, Homo sapiens
acagtgttatcagtcattgactcagaagatagtttcttaccgtttggggaaagtgcttgtctattcctctccaaagccattttaaaaaaaaaattgcaccrgttctcatcccatcatctgccttgatcaaacatttgcttattggaatcacttcgaaaaggaacttggtatcgttcacatgtgtttataactctcaaatct

SEQ ID NO: 17079 - DNA, 201 bp, Homo sapiens
gccttaccccgctacagagaggccccaagagagaggcctcacaccctctggctccactgaaattcacttcacgtttccaacttggattaaactggcacgamagttcagtcaaatgtcaagtccattttgtcaagggagggaactcattcagaagatgaactagttggtgttacttagatgattaactacttggcattaggt

SEQ ID NO: 17080 - DNA, 201 bp, Homo sapiens
atatggtgtcagcaagagaaaaatgaggaagaagcaaaagcagaaactgcctgataaacccatcagatctcttgagacttattcactatcatgagaatagsatgggaaagaccggcccccatgattcaattacctccccccgggtccctcccacaacatgtgggaatcctgggagatataattcaagttgagatttcggtg

SEQ ID NO: 17081 - DNA, 201 bp, Homo sapiens
tgatcaaacatttgcttattggaatcacttcgaaaaggaacttggtatcgttcacatgtgtttataactctcaaatcttcttcttccaatttttaatcttsatcaccacagctttataacaggaagaacgctcaaagaagaaaaatagaagaagcctgaattttaatttgctatttcttcacacacaaaacaccccaagct

SEQ ID NO: 17082 - DNA, 201 bp, Homo sapiens
ggtatggggtggggaaggggggggggataaagatattaatttggaagcatttgattgctccattattttatcatcttcccatggaaatgttttcataacgycttgttttttaattattattattattttttgagacagagtctcactgagtcgcccagggcggcggtgtgatctcggctcactgcaacctcagtctcccag

SEQ ID NO: 17083 - DNA, 201 bp, Homo sapiens
agatcaggccactgcactccaatctgggtgacagagcaagactctgtctcaaaaataatagtaataataataataataataataataataataataataakaagaatctgactaaggttattaaccattaaggtatgctgtgctaaggagcagggggccccttccatccgtagagggcagaaaggtgcctatcatgtcttc

SEQ ID NO: 17084 - DNA, 201 bp, Homo sapiens
gggagtgtggttgtacttcaacctggaactgtctaactcctaaggttttattaatatctagtccatttctctcaatctaatagtaaatggaagagaagcamcaacttttgttttccaattccttttgaacatttgaaaggttttctgaaaggacttaaagaaaccatagcttccttaccagttcccaaagcttcagtcctt

SEQ ID NO: 17085 - DNA, 201 bp, Homo sapiens
tttgaactctaattagggaaagggaatttggaaccattgtcttctctgagtgtgcagacacgatgttatcattgtgtttacagaggtggtcagattcccakcacagtgtactcccgcacagataaccgtcccatcttgataaaacaatgctctcagccgaatcctaaacacgctgcacaaggaagaccttatgctgacagt

SEQ ID NO: 17086 - DNA, 201 bp, Homo sapiens
gagataagaaatggagcaagggaggggtttcatcccgccgtgttcatttgcttggctgtcctgaaattgcgaatacgcagttgttacctgctcccggtggraggggggggatatttatttggcatcttgcaattgataggagctgagtgattttagtaggtagtttaactccttaaaaacttccagtggtttcatattcta

SEQ ID NO: 17087 - DNA, 201 bp, Homo sapiens
tggctgattcatgtcatgagagatcctgagtcagaaccacccagcagctaagccacttctgaatccttgacccacaaaatatggtaagataccaaatggtkactgttttaagccactatgctctgggggaatttgtgatgtagcggtagataactatcacaggatccatggcctcaaggggagaaggatccttaagagaga

SEQ ID NO: 17088 - DNA, 201 bp, Homo sapiens
tatgtctttatcagcagcgtgaaaacggactaatacagtgaggaaatccatgtgttaggaagggagtgtggttgtacttcaacctggaactgtctaactcytaaggttttattaatatctagtccatttctctcaatctaatagtaaatggaagagaagcaacaacttttgttttccaattccttttgaacatttgaaagg

SEQ ID NO: 17089 - DNA, 201 bp, Homo sapiens
ctgataaattctgggaaagtttatccaattgttacaacccagggtcaggaaaactgttttcaattttctgctgtatgaagttgccagtgttaaaccctttygatagcaagtagaagaaatgttcattcaaacaggcttaattaactgaaagatataggtgtggtaaggggatcaggtaaagcttgacccaggggctaaact

SEQ ID NO: 17090 - DNA, 201 bp, Homo sapiens
ggcagctggagagcgtgcagactcaggagccaagacctgccttgccttccctggagttaatgaatcagtgtgaatgaagagcacagtcttcttttaaatgrcaggggaaccgtgcacttatttaccggcaattctcagattctaattgttccgactacaatgcgtcctgtaaaccgggtagctgggagaaacttcaatgca

SEQ ID NO: 17091 - DNA, 201 bp, Homo sapiens
ccaggacaggtgccctcctcagcggagacaactgtccccctccatcctgcaggagttttgcagccatccttccagccactgcttctctaccggggcaaatyttcccccaagggataattgataatgtctgaggcatttttaattgtcacaacttggggaaggggcaagggattgagggagagtgctcctggcatctggtgg

SEQ ID NO: 17092 - DNA, 201 bp, Homo sapiens
aaccacatctttccagattcaatatagtaggagaagaccagacttgctcttttcctggaatttagtctgacgtggctgggacaacatgcccactctcaacyaatttttgtagccatggagatttggaagtctggcaagtcttgggtcacatgatctaccttacagctgttactgcagacctcccaaagctcacgaactgag

SEQ ID NO: 17093 - DNA, 201 bp, Homo sapiens
tttattgtgggacatttagagaatctcagactagcaggtgttagattaaacagaggagaaacggtccttgtggtgataaaacttccctacgcaaggacaartagagaaacaactgtagatgaagcagccagtctcaggctggggcagcacgccctgcgataggttaaggtttattttagacaaatatttaaaatgcagcta

SEQ ID NO: 17094 - DNA, 201 bp, Homo sapiens
agcgtgcagactcaggagccaagacctgccttgccttccctggagttaatgaatcagtgtgaatgaagagcacagtcttcttttaaatggcaggggaaccrtgcacttatttaccggcaattctcagattctaattgttccgactacaatgcgtcctgtaaaccgggtagctgggagaaacttcaatgcatctttgtaatg

SEQ ID NO: 17095 - DNA, 201 bp, Homo sapiens
atccgtcgttccaaatatgagcactttctcttgtcttttctgagctacctattccaagaacacagaggagttgttattgtggttacttgtggtaagaagastacctttctgattggacccagggcagaaaaaagaactttcaggtggaaatacagtcgtggtgtcaggtagtgtgtaacttcgttaagttcagtcatagca

SEQ ID NO: 17096 - DNA, 201 bp, Homo sapiens
caaatgtttacatggggctgtggaccattttgtatcattggaggagaagccagggcacttggcaggggtgttcatgatgataatcaggtggctgggtggastcaccatttgtggcatcctcaaagacttgccaacatagacatttttggggagacagaaacacagaaataattctgcagtgctttaaagaatctgttaaaa

SEQ ID NO: 17097 - DNA, 201 bp, Homo sapiens
gttccaaatatgagcactttctcttgtcttttctgagctacctattccaagaacacagaggagttgttattgtggttacttgtggtaagaagagtaccttyctgattggacccagggcagaaaaaagaactttcaggtggaaatacagtcgtggtgtcaggtagtgtgtaacttcgttaagttcagtcatagcagccgctg

SEQ ID NO: 17098 - DNA, 201 bp, Homo sapiens
cacagaaataattctgcagtgctttaaagaatctgttaaaaatcaagtttctttcagtcatgtatgatccattgggctttatataacttttagcctttgcyttgcagggacagcaaagatgtgagcaaatttgtgcaaacctaatagggtgaaaaattgaggtatgaattagtaaagtcatttgtccttctggaaagagtt

SEQ ID NO: 17099 - DNA, 201 bp, Homo sapiens
cccgggatcaagcgattctcctgcctcatgctcccgaatagctgggattacaggcacacaccaccacacctggctaatttttgtatttttaggagagaggkgttttaccatattggcccagctggtctcgaactcgtgacctcatgatccactcgccttggcctcccagagtgctgggattacaggcatgagccactgcac

SEQ ID NO: 17100 - DNA, 201 bp, Homo sapiens
gcactttaaatgcattaattcagttcatctttatgacaacactatgagatagctaatattatgaatcctattttcagatgaaagactgagtcttagggaasaaacagccgagagatgaaatgccacagggatgtctaggttcaaacagcaacagaggtgcgtaccatagggatgtggaagccttgcttgtcttgttcctct

SEQ ID NO: 17101 - DNA, 201 bp, Homo sapiens
attgtatcagtcagcgtagactaggtttgccgcagtaacaaacgaccccaccatgccatagcttgcaaaaacaaagactgagttcttgtctacactgtagkgccgtcaagagctggctctgcttgctcttggtcttctccatgccaggatccagagtaaaagcacagcttctctctaggactccaggggaaagagaaaaga

SEQ ID NO: 17102 - DNA, 201 bp, Homo sapiens
gggatgtctaggttcaaacagcaacagaggtgcgtaccatagggatgtggaagccttgcttgtcttgttcctcttggtataaccccagtgagtagcatagygcctggtcaattggagggatttggtaaatatttactgagtgagtgagagggtaaaacagctgagccatgggagttataacttgggcagcagtaatcctgc

SEQ ID NO: 17103 - DNA, 201 bp, Homo sapiens
gctcttaatatcctataattgaaaaagagattgccattttcaaagacctttcacagtcattctcttaatcaagtctcataataaagatgtcattgggactkagcagcttactcacattctcatttcactgatgaggaaactggagctcagggaggttacatggattctggatgacctacaggtcatggaggtaagagagga

SEQ ID NO: 17104 - DNA, 201 bp, Homo sapiens
tcattctggagcagtgggagccgactgtgatgcagagtggactcataatccagcttgattttgagggacagaaacctgggcctttaggtagaatgaacagsttaaaaggctgcacctgagagtagggggcatatgggtaaatccagctgtacccaagagttgggggcatatgttagccctactgggtaaatccagctgcac

SEQ ID NO: 17105 - DNA, 201 bp, Homo sapiens
tactggggctaaagatttggcttggagtttcctggtagtcaaggcaaaaaagggaaacaaaactagttacagagtttctcggacctatgagcaaaaggatktccatttctaatcggaggcagaggtatcatggccttcaagaatcttccggttaaacacggtactgaaatttgattttattgtctatcgttgagtccctag

SEQ ID NO: 17106 - DNA, 201 bp, Homo sapiens
acttaattcactgggtgactgcatccataccaagcacacagccgtgatcagttagcctctcacttctctactaatccccactgtggggaagagctcatcaytaacatgccttatctgacatgtggcaataacttctgcctttcttatgtcatctgcatggttgcagtggatagtcactggacaattgatgaacaactacta

SEQ ID NO: 17107 - DNA, 201 bp, Homo sapiens
tcatcattaacatgccttatctgacatgtggcaataacttctgcctttcttatgtcatctgcatggttgcagtggatagtcactggacaattgatgaacamctactacatgctagatctctccctggggagagtgcttgtctttgaaacagtcaaaggaggaaggaagaaaagagaggcagaacaattataataaagcaac

SEQ ID NO: 17108 - DNA, 201 bp, Homo sapiens
ccttatctgacatgtggcaataacttctgcctttcttatgtcatctgcatggttgcagtggatagtcactggacaattgatgaacaactactacatgctaratctctccctggggagagtgcttgtctttgaaacagtcaaaggaggaaggaagaaaagagaggcagaacaattataataaagcaacttaacccattgaga

SEQ ID NO: 17109 - DNA, 201 bp, Homo sapiens
aaactatggagtcttaagtccaaccagtggttatgaattccggctctgccacttgctataatagctgtatcaccatgagcgataacttaacctctttgtgsctcagtttcttcatatataaaatggggatcatgatagtctctgtcccaggggagttaggaggattaaatgcaacagtaatccaaccacagtatgaaaaga

SEQ ID NO: 17110 - DNA, 201 bp, Homo sapiens
gtccagtgcttggccagtacaaggccattatatatttgttgaatgaatgaattcgtgaatatgtttataaagacaaggaaacgccattctgcaaatctacrtgcagtaaaatagtttttcagtcactttgccttcatttgtttgacattcttggaatatttgggctctacaaggtgctagggtaaggcacgcaggatgcaa

SEQ ID NO: 17111 - DNA, 201 bp, Homo sapiens
tgaggtggcacatgtcagcggctttgctcagaagcacccagggatgatggaaaaggcaaccgaaagggctcagcttctgcagatagagtctgtgctttgcrctttctggctttgtgacctttctgcaggttacttctctcccctgagcatcagtttactcagctgaaaaatgcatctgctaataatacctatggcataggg

SEQ ID NO: 17112 - DNA, 201 bp, Homo sapiens
ctgagcatcagtttactcagctgaaaaatgcatctgctaataatacctatggcatagggtttggggaggattaaataagataatgtaaatagagtttagcrtggtactgtgtatatagccagcactcactgctgttggcttattgaaaaaacaaaaataatacctacaataaccacaatatagcaacagcaatcatgttca

SEQ ID NO: 17113 - DNA, 201 bp, Homo sapiens
gcatagggtttggggaggattaaataagataatgtaaatagagtttagcgtggtactgtgtatatagccagcactcactgctgttggcttattgaaaaaamaaaaataatacctacaataaccacaatatagcaacagcaatcatgttcaagtctgtatttggtttaaggagggggaatgtgacccgggggctctgtcatt

SEQ ID NO: 17114 - DNA, 201 bp, Homo sapiens
gtcattagatatatgcacacacttgacctaatggaaagcttgaaagcaattggatgggaaaacagtccatcttgttggaaggctgtcaagctgtgtaatamaagaattactgttctccctttgcatttatgcattgcatgtctctgttgaattcagagtgctttatagacctctgatcagcttccagcatcctcttggtat

SEQ ID NO: 17115 - DNA, 201 bp, Homo sapiens
aggagagataagaaatggagcaagggaggggtttcatcccgccgtgttcatttgcttggctgtcctgaaattgcgaatacgcagttgttacctgctcccgktgggaggggggggatatttatttggcatcttgcaattgataggagctgagtgattttagtaggtagtttaactccttaaaaacttccagtggtttcatat

SEQ ID NO: 17116 - DNA, 201 bp, Homo sapiens
tttcctcccctgtaaaacgggttaatatcagcacttatcacatagtttttgagaaagctaaacgtgcttatctatagtggttattattactagaaagaatrtcgtggtgcccccaaacatggatttaacaagcattgatcaaatacctcctatgcccctacgaaccaggtactagaaatccactcctttcacttgcttttg

SEQ ID NO: 17117 - DNA, 201 bp, Homo sapiens
gcaacttgggtcatgccactacagatcgacacccactaaatccttttaatttagtctagtgcaacaagtatttgtgtaagtgtcctctgccctggacaccrgtgaggtcaccgtgggaatggctgggcaggaacaaagccttttgtttccagctgagtttccttttctgaagattgcctgtcctagacaccagttctctgt

SEQ ID NO: 17118 - DNA, 201 bp, Homo sapiens
acctctcctcggccttgcaaagtgctgggattataggtaccccgcctggctgatactttccttagttgttttcagtgtaataacctgtcttcagtctactytttgtccttttctctcctttcctccctgaatactcaagcttccagtgcacagatttctccaaccctgaatgtgactgataccaacaccatactagctctt

SEQ ID NO: 17119 - DNA, 201 bp, Homo sapiens
ttttgcatccctagacatcatcctttttgagagagaaaattccgagtgtcagttttcctttatcggaacctccttttatttgaactaaccacaatgggtcrtaatttataggcccagtcagcgcatcattgctcagatagagtcatttacctacaagtatccatcagttaggtgggggctgctagattttttaagtggaaa

SEQ ID NO: 17120 - DNA, 201 bp, Homo sapiens
ttccaagtagctggttttgcaggcatgcaccaccacacccagctagtttttctatttttagtagaggcggagtttcaccaagttggccaggttgttctcaractactgacctctcctcggccttgcaaagtgctgggattataggtaccccgcctggctgatactttccttagttgttttcagtgtaataacctgtcttca

SEQ ID NO: 17121 - DNA, 201 bp, Homo sapiens
tgcctctctttccttagtcctgtgtgcttccccttgatttcaccaggacaattttataccaatcccttgtattttagaagagcctgatacatttgcaaggwctctctttatattcctgaattttgcatccctagacatcatcctttttgagagagaaaattccgagtgtcagttttcctttatcggaacctccttttattt

SEQ ID NO: 17122 - DNA, 201 bp, Homo sapiens
gagattcttgtgcctcagccttccaagtagctggttttgcaggcatgcaccaccacacccagctagtttttctatttttagtagaggcggagtttcaccawgttggccaggttgttctcaaactactgacctctcctcggccttgcaaagtgctgggattataggtaccccgcctggctgatactttccttagttgttttc

SEQ ID NO: 17123 - DNA, 201 bp, Homo sapiens
ttgtccttactctgacacccactgcaagtttgaggtggtcctcaaacccatcctcatggctgatatttgctagaaggacttgtggcacttagcagaagctrttgtatttacagttacagtttattacagggaaaggatacaggttaaaattagatcggggaagagacaaatggggcaaagtccaagacaagtaccagatgt

SEQ ID NO: 17124 - DNA, 201 bp, Homo sapiens
atgcagtgttttccctgcaaaggagaagaaatatatttcttgcctctctttccttagtcctgtgtgcttccccttgatttcaccaggacaattttataccmatcccttgtattttagaagagcctgatacatttgcaaggtctctctttatattcctgaattttgcatccctagacatcatcctttttgagagagaaaatt

SEQ ID NO: 17125 - DNA, 201 bp, Homo sapiens
tgggcctttaggtagaatgaacagcttaaaaggctgcacctgagagtagggggcatatgggtaaatccagctgtacccaagagttgggggcatatgttagycctactgggtaaatccagctgcacccaagagtagggggtatatgttagggctagtgcgtaaacccagctgcacccgagatatggggtatacatgagtgct

SEQ ID NO: 17126 - DNA, 201 bp, Homo sapiens
atgagggccaggacctcatggtcataaaagtaacattagacctattcctagtaatttgatctaggttggcctgatttttgttgtggtggcagtggtggctrtggttgtcaatttaatggaatgtatttggaaagagcaagcttcttcccaatgcagtgttttccctgcaaaggagaagaaatatatttcttgcctctcttt

SEQ ID NO: 17127 - DNA, 201 bp, Homo sapiens
ggtatacatgagtgctattgggcaaatccagctgcacaggagagtaaggggcatatgttagggctagtgggtaaacccagctgcacctgagagtaggggtrtatgttagggcttgtgggtaaatccagttgcacctggcagttggggcatatgttagggctagtgggtaaacccagccgcaccggagagttgtgggtatat

SEQ ID NO: 17128 - DNA, 201 bp, Homo sapiens
gactctttttttcaggaatatattctgcatatatttcagtgatttttttttttttttgagacagtctctcattctgtcgctcaggctggagtgcagtggcrtgaccttggctcactgcaatttctacctcccgggttcaagcaattctcgtgcctcagcctcctgagtcactgggattacaggcatgcacaacaacaccca

SEQ ID NO: 17129 - DNA, 201 bp, Homo sapiens
tacatgagtgctattgggcaaatccagctgcacaggagagtaaggggcatatgttagggctagtgggtaaacccagctgcacctgagagtaggggtatatsttagggcttgtgggtaaatccagttgcacctggcagttggggcatatgttagggctagtgggtaaacccagccgcaccggagagttgtgggtatatgtta

SEQ ID NO: 17130 - DNA, 201 bp, Homo sapiens
tttttttttttttttgagacagtctctcattctgtcgctcaggctggagtgcagtggcatgaccttggctcactgcaatttctacctcccgggttcaagcrattctcgtgcctcagcctcctgagtcactgggattacaggcatgcacaacaacacccagctaatttttgtatttttagtagagacagggtttcaccatgt

SEQ ID NO: 17131 - DNA, 201 bp, Homo sapiens
agctgcacctgagagtaggggtatatgttagggcttgtgggtaaatccagttgcacctggcagttggggcatatgttagggctagtgggtaaacccagccrcaccggagagttgtgggtatatgttagggccagtgggtaaatccagctccatctgagatatggggtatacatgaatactagtgggtaaatccagctgtac

SEQ ID NO: 17132 - DNA, 201 bp, Homo sapiens
cctcccggattcaagagattcttgtgcctcagccttccaagtagctggttttgcaggcatgcaccaccacacccagctagtttttctatttttagtagagrcggagtttcaccaagttggccaggttgttctcaaactactgacctctcctcggccttgcaaagtgctgggattataggtaccccgcctggctgatacttt

SEQ ID NO: 17133 - DNA, 201 bp, Homo sapiens
attggtaaaaacatatatcagagtccttttgactgtttagaaagtgttaatttactccacgattatccattcaacatttattagttggcttctgtgtgggwgagtaaccattaataccttgaataagtttataatctggtcattctgtagagcttcctatatgatgtcttctgtttaagtatttctgtaataccttataga

SEQ ID NO: 17134 - DNA, 201 bp, Homo sapiens
cacctgagagtaggggtatatgttagggcttgtgggtaaatccagttgcacctggcagttggggcatatgttagggctagtgggtaaacccagccgcaccsgagagttgtgggtatatgttagggccagtgggtaaatccagctccatctgagatatggggtatacatgaatactagtgggtaaatccagctgtacacgag

SEQ ID NO: 17135 - DNA, 201 bp, Homo sapiens
tgttttccttaaactctgtgcacatgaatatttgtggtatatggcttaattgtaagcgatcaggcatcaatggctttttatgaggcaaaatctactttctrcatttgcgtgtgccattattatagattgctgatgtttgccaatggatattcttggaagtcgtcttctggtttaaatgcagttaagtatttaaaaataata

SEQ ID NO: 17136 - DNA, 201 bp, Homo sapiens
gtccttttgactgtttagaaagtgttaatttactccacgattatccattcaacatttattagttggcttctgtgtgggagagtaaccattaataccttgamtaagtttataatctggtcattctgtagagcttcctatatgatgtcttctgtttaagtatttctgtaataccttatagacatctcttttagactactagtg

SEQ ID NO: 17137 - DNA, 201 bp, Homo sapiens
tggggtatacatgaatactagtgggtaaatccagctgtacacgagagtagggggcatatgttagggctagcaggtaaacccagctgcaccccagagcaggkgtatacatgagtgctagtgggtaaatccagcagacgtccggactgtgcttgagggtgtcatcgagagagagaaggttgatccgaagttagtaaaggcttt

SEQ ID NO: 17138 - DNA, 201 bp, Homo sapiens
gaaagcagtgctcagaggtaaagagcctcgctgaagccctagttctagcctaccaggatttggtcatttcttggtttttcatttgatcccacccttgcctmccttcagaatgaaggtagaatgtgggactgtttcagaccatgaatgcgattgggcagaaagactgtgaaccaagagggcagggagaagggaagggatgtg

SEQ ID NO: 17139 - DNA, 201 bp, Homo sapiens
ttggaggtaagtataaaaaccttcttgttttctactacttaaagctgaaaacccagcttgggttggctttgcttctaatatccttcttcctttttgtttcrtaagtaattgtcctgaagcctgtcgagataaatgtatactgaaagagaaagacacagaggagagacaggcatacagagaaagagagacacgcagacacac

SEQ ID NO: 17140 - DNA, 201 bp, Homo sapiens
tgagcccaggagtttgagaccagcctgggtaacatggcaaaaccttacctctcaaaaatttacaagcttagccaggcatggtggtgcccacttgtggtttyagctacctgggaggctaaagtgggaggatatcctgagcccaggaggtggagattgcagtgagccatgctcgtgccattgcatttcagcgtgggtgacagt

SEQ ID NO: 17141 - DNA, 201 bp, Homo sapiens
ccccatcaacatgatggcccttggaaaggactcttttagcctccgcgagttccttttccgcaccaggctccacttacgaaggactgcaaaaacttgctaaygtcatcagtctgaaaggattgagctgtaaaatgtgttatgggggcctaagcaacgcatctggaatttagccttcccaagttcaaatccggtttatgccac

SEQ ID NO: 17142 - DNA, 201 bp, Homo sapiens
ctcgtgccattgcatttcagcgtgggtgacagtgagaccctatctcaaaaaaaaaaaaaaaagttcctaagaaaataaagcctggcccatgcaatttgaaygtaactgtctataatttctcttggttactgaaattctgagtttgtgtctatggtttctccatccttgtctttgaggaggagcaggatggcgaagtcgcag

SEQ ID NO: 17143 - DNA, 201 bp, Homo sapiens
atgaacctgggaggcagagcttgcagtgagccgagattgcgccactgcacttcagcctgggtgacagagcgagaatctgtctcaaaaaaaaaaaaaaaaaraaagaaagaaagcaaaggttttttcctcccaagaactcatggtccaagttttggtttttaaatatgcatctatgacagcacggatcacatagtgcattga

SEQ ID NO: 17144 - DNA, 201 bp, Homo sapiens
tggaattataggcatgagccaccatgccctgcccaggcaccattcttgactgcgagaaagtcactgtgatggtttctccagcctgagttttctcctgtatraaatggaccttgttttgaggagagaatgaggtatgtggtactcgtgagcaggattttcaatgcctggctggttgttacttatccatttagtccgagcttc

SEQ ID NO: 17145 - DNA, 201 bp, Homo sapiens
ttaatagtaataataatatctaccacccactaggggtctatgtgtgtatgtgttgggggcggtgtggctggggagggaagcaaggcctgtattatggcccragctcaagaatattcgggcaagagcagatacaatgcctgtatttctcatcacttttgggtggcataggaccagttggttatgagcgtgaaaggttttctt

SEQ ID NO: 17146 - DNA, 201 bp, Homo sapiens
atttatttattcttttagggacagggccttacgctgctgcgtaggttgtggtgcagtggcacagtcacagctcactgcagcctcaaactcctaaggtgaasagaccctcccaccttagcctcctcagtagctgagactacaggtgcgtgctaccgtgcccagctgatttttaaatttttttttctttgttttgagacggag

SEQ ID NO: 17147 - DNA, 201 bp, Homo sapiens
cttcagcctgggtgacagagaaagactccatctcaaaaaaaaaaaaaaaggtagagatggtggagtggtgacatttggtagataatatagctctgcagaamttttcattgcaaaatgaaaattcttcattgttattataattacttcaaggagcaaggccattttgtgtaagctatcctgggcctccctgcctcccatttt

SEQ ID NO: 17148 - DNA, 201 bp, Homo sapiens
aattcttcattgttattataattacttcaaggagcaaggccattttgtgtaagctatcctgggcctccctgcctcccattttacaccctgtttattgatastaagaagagcctccaactgaataagaactaatgacttctgcctgccatcattttggaatgtccaattccccgttctggagagcctttgattataacatca

SEQ ID NO: 17149 - DNA, 201 bp, Homo sapiens
tgaaaaatctcttcctttcctatcgtgaattcggtcattgttataagccaagctttgcaaaggtggaacaccttggagatacttatctcctccttactctmcccaagtaatgactcatccttttatacagaatgtctcttttttgatttagatgtctttttttgatatagatgtctcttgatatagaagcatttctcggga

SEQ ID NO: 17150 - DNA, 201 bp, Homo sapiens
ttctcctgctctgcctcccgagtagctgagactacaggcacctgccacgacgcctggctaatttttgtattttcagcagagacggggtttcaccgtgttasccaggatggtctcgatctcctgacctcatgatccacctgccttggcctcccaaagtgctgggattacaggcgtgagccaccacgcccgactgctttattt

SEQ ID NO: 17151 - DNA, 201 bp, Homo sapiens
tcaccgtgttacccaggatggtctcgatctcctgacctcatgatccacctgccttggcctcccaaagtgctgggattacaggcgtgagccaccacgcccgrctgctttattttcctttgtgttcctaatacctggcccagtgtctggcaaatggaaagttcccctggatgtagttgggtgacactatgagtgtatcgttag

SEQ ID NO: 17152 - DNA, 201 bp, Homo sapiens
ttttcacgcggaaactggatgtttcttacatcctcagctgcaggcatggggaagagacgcacatcagccattaagaaaaaggtatgcagtctacatgcctsttaatttcctccacatacacagtaaacccatcatgtccatcagcaccattgtcaaaacatctgtgcaccagtaaagggttctgatgtgtgataaatttat

SEQ ID NO: 17153 - DNA, 201 bp, Homo sapiens
catcagccattaagaaaaaggtatgcagtctacatgcctcttaatttcctccacatacacagtaaacccatcatgtccatcagcaccattgtcaaaacatstgtgcaccagtaaagggttctgatgtgtgataaatttatttagctattactcatctgaagttatactattttaggatcttggggcagtgaggactttgga

SEQ ID NO: 17154 - DNA, 201 bp, Homo sapiens
tagtataaagactgtagattcatcaaacattgtttactgtcttcaaacttcaacagtgttttaactatcaaatagaaaatcgaaaggaagcataaacgcayatggtcactttactggtataataggggccaagagccgttgtgttttataatttcttgatgatcctggtggtaggtaagccaaccgctatgaactctgatg

SEQ ID NO: 17155 - DNA, 201 bp, Homo sapiens
tttatatttttagctaaattaaaatactcacattcccattattttttagaggttgtaagctaagtaataacattctagaaactctctgttttttgaaaggkcatcaccactgttgaaggcgctaatgggagatcctaagtttcaggctctgctacagacgtcaggtcccctaggagttgggctgcctttgctctcctctcc

SEQ ID NO: 17156 - DNA, 201 bp, Homo sapiens
agagtgtgctgtgtcagggtgtttcattgcattttcatatttgtcatttctctttggagcgtgtcttttggtgccacggaaaagggctggattttctatcrggtacaataggtacctgcagggcttagggtacaagagcttgtcggggacctgcacacatgtttgagacctgtaaaaatattgctggctctgaattatgga

SEQ ID NO: 17157 - DNA, 201 bp, Homo sapiens
gacctcggtgctcacggtaatgcttccttccaccatatcagaaggtcctcagcagccgcagccacttaacatgctcggtgcttctctgtaggaggattttkaaaaagcaggaactgtcagggtcccaaatgttcagtggcacttcagccagaggtaggatagggattttgaagtgtttggagaagtgttttcatatttgaa

SEQ ID NO: 17158 - DNA, 201 bp, Homo sapiens
aagctctcaaagtgactttttattttattttttatttttacatggagtctcgctctgttacccaggctagagtacagtggcgtgatctcagctcactgcartctccatctcccaggttcaagtgattctcccgtctcagcctccagagtagctgggattacaggcacccaccatcacgcccagctaatttttgtattttta

SEQ ID NO: 17159 - DNA, 201 bp, Homo sapiens
ctacaagtggagcgtgatttcatctttcatcaagagaagcagcttttcctcctcttgtatccgttttcttccttttctaactatcaaggtcatgcggtatstgccattttgcatattcttgctttgcttcatgttttccttaaactctgtgcacatgaatatttgtggtatatggcttaattgtaagcgatcaggcatcaa

SEQ ID NO: 17160 - DNA, 201 bp, Homo sapiens
gtttaacctgacagttgatcaattgatatcctttgacttgttggaattttattctttacattcgtcttttaaaaagctttattttatgccagatgcagtgmctcatgcctgtaatgtcagcactttgggaggctgaggcaggtggatcacttgtggtcaggagtttgagaccagcctggccaatatggcgaaaccctgtct

SEQ ID NO: 17161 - DNA, 201 bp, Homo sapiens
ctgtgtcacctcagcatttaatttacttccgtcacaaaactacttgaagttgtcccaggctagttggtcctattaattacaacctagagggattctattartaaactaatggattacagtacctaaatggaagccagcagatgactttggaaggactgatccgcaagggccttctgtgtgaagattaaatgaagcttcctt

SEQ ID NO: 17162 - DNA, 201 bp, Homo sapiens
aggctgaggcaggtggatcacttgtggtcaggagtttgagaccagcctggccaatatggcgaaaccctgtctctactcaaaatacaaaaagttagccgggygtggtggcacgtgcctgtaatcccagctactgaggaggctgaggcaggagaattgcttgaacttgggaggcagaggttgcagtgagccaagatcgtgcca

SEQ ID NO: 17163 - DNA, 201 bp, Homo sapiens
catgtagaggttggcaaaggggacaggagactgtgggatgattagtatattcttatttggcctgggagggaaaaaaaatctttcatttccaacaatattcwttctctgtgtcacctcagcatttaatttacttccgtcacaaaactacttgaagttgtcccaggctagttggtcctattaattacaacctagagggattct

SEQ ID NO: 17164 - DNA, 201 bp, Homo sapiens
ggctgacacaggcagatcacttgaggtcgggagttctagaccaacatggtgaaaaccagtctctactaaaaatacaaaaaattagctggccgtggtggtgygcacccgtagtcccacctacttgggaggctaaggcaggagaattgcttgaaccgcggaggcagagattgcaatgagccgagatcgcgccactgcactcca

SEQ ID NO: 17165 - DNA, 201 bp, Homo sapiens
gctcagtctttgaagggttacagaaacagtttcactagaaggtgtgacattgtgtaacagaaatcggttccttaacctgccaaagggaagaaaatagtgcrgaatcttttctccaggtttcaggacccatgtctgttgtccttcctttaccttaacttcagcagggcaagaatggttcaagccacattagaaagcagttac

SEQ ID NO: 17166 - DNA, 201 bp, Homo sapiens
taaaggcttactgggtatcagggctgctttcctttataatcttttacccgtcttatgggggatgaacagaaacacactttagtgctagaaaagctgggccyaaaagaccagtctcctgtcccatacttggacatttattgttctttttgggcaaggtgaaaacttgaaaccaaaagtctgttgagtttggaagacttgact

SEQ ID NO: 17167 - DNA, 201 bp, Homo sapiens
tctgttgtccttcctttaccttaacttcagcagggcaagaatggttcaagccacattagaaagcagttactttctcacccaattttaaaggagaaaggtaratgcggtgggttctagggatttcagtgacgtaacaggtgtttcccaggcattaagacctagtaaggtttccatttccattaggtattatggatgcattcc

SEQ ID NO: 17168 - DNA, 201 bp, Homo sapiens
ccaattttaaaggagaaaggtagatgcggtgggttctagggatttcagtgacgtaacaggtgtttcccaggcattaagacctagtaaggtttccatttccrttaggtattatggatgcattccaagaatttaattactataacatcacttcattcattgtaattccttactagagttatgagaacttgggattgtgtggtt

SEQ ID NO: 17169 - DNA, 201 bp, Homo sapiens
caagaatttaattactataacatcacttcattcattgtaattccttactagagttatgagaacttgggattgtgtggtttcttattcaatcgattaaaagstacttgctatagttttctaactagctatttatatgaaatttagtacttgtcaatatgtattaaatcaatacagttatatttatcaaagtggtgagaagag

SEQ ID NO: 17170 - DNA, 201 bp, Homo sapiens
tacttgtcaatatgtattaaatcaatacagttatatttatcaaagtggtgagaagagtttacatctgaacatagaatagattgcttgccttggccgggcgygggagctcacacctgtaatcccagcactttgggaggccgaggcgggcagatcacgaggtcaggagatcgagaccatcctggctaacacggtgaaaccccg

SEQ ID NO: 17171 - DNA, 201 bp, Homo sapiens
gggattacctggaaagggtggggcaattttggggggtcaagaaaatgttctaggacaagactgtggtgatggctgcacaactggataaatatactaactawcatcaaactgtatatttacaatggttaaatcatatggtatgtgaatttcacattaataaagtcataaaaaatgaattccaggaccattaaatcaggtgac

SEQ ID NO: 17172 - DNA, 201 bp, Homo sapiens
gtcctacaactggtgagctgtgagctgtaaattgtggaactaatttttatactgccaatctgaggccttttctgacctcatcgctgccactgtaaaatgarttctagccccagaccatgacatgcctactagcttagctctaaccaaaaagatttattatcccaagagttgtgaaaatgtggaagaactagaactgtcatt

SEQ ID NO: 17173 - DNA, 201 bp, Homo sapiens
gctatcgataaaagctaatgtaccacacgaaattggaaggggaacaaaatcacttaagtgttcagggccaccaaggcactggtgcatcccctgtgagcctrtttggctcctggcggtgtttttgttgccctggcttgcaacgtagcctgattgttctaagtaaatggcagagcacgcaaatcaaggacattggcaataaac

SEQ ID NO: 17174 - DNA, 201 bp, Homo sapiens
caagactccgtctcaaaaaaaaaaaaaaaaaaaaaaaaaaagtgccatgtatattttgattacaaaaaatttcatgcggtgttactttctttttattggtrgagggtctttatgttttatttttttgagacagaatctgctccatcactcaggctggagggcagtggcaggatcgtagctcactgtaacctcgaattccta

SEQ ID NO: 17175 - DNA, 201 bp, Homo sapiens
ttgtagctcctgtgaagattcaggaattttttttttcttctatttgcaagctttagtcctaggcatggaaaaagaactttgaagaaaacctgagagatatsagtgtaaaacaagagaatgattccctctggggtgctggtagtgggggcttaatttcctaaaggcttactgggtatcagggctgctttcctttataatctt

SEQ ID NO: 17176 - DNA, 201 bp, Homo sapiens
tttagtgtcacagctcaaaaccatcagtagtcctcgtgatctttcggcattgtggctccctttgtgagaagggcctaagagtgaatctcccaaccataagmtgtattcaggcaggcacgaagtctcttatttactcagtgtttctggagcccagcatagtgcctcgcacacagcaagtgctcagtgggtatctgttgaacc

SEQ ID NO: 17177 - DNA, 201 bp, Homo sapiens
agcaggagataaaaaggcatcagttccattccatatccaagtctgagtccaagggcaggagaagctgatgtctcagcttgaagtcaggcatagagaggcarttctttctcactcagccttttattttattcaggccttcaacagattgtatgaagccacccacactgggaagggcagtctgctttactcatagtactaatc

SEQ ID NO: 17178 - DNA, 201 bp, Homo sapiens
ttgcatactgacctttctgctcttttatgctgcctgctctctaatattgtccaaaaaccttctctaaagaaagtacacaaatggagagagggggaattggrcatgccattgggagaacaaatttatttagatatctttggctgtgttgacagaagctgcccaattatacccaatatacaaattttaaatgcatattagtca

SEQ ID NO: 17179 - DNA, 201 bp, Homo sapiens
atatataaatatgtgtatatatatatttgttagggtaaaacaaagtctataaaaactgttttcctttgtcattgcccccaccaaatatttatatatatgtrtatacacatatgtatatatgtatgtatagagagtctattatatatattacatatacataatatatacataatatataatagactctataatatagactct

SEQ ID NO: 17180 - DNA, 201 bp, Homo sapiens
tatgtaatatataatatattctatgtaatatataatatattctatgtaatatatattaatatgtagggaatatgttacatattatgttgagagtgtatatrttatatatgggtttctatatattataataaacccatatataatatacataatagactatacacatatacagctaatatatatacacaatagtctagtata

SEQ ID NO: 17181 - DNA, 201 bp, Homo sapiens
accaccattctcccctactttgtctatgaattcgactactcttggtacctcatataagtggaatcacacagtgtgtgatgtgttcttttgtggctgacttmtttatgatactggattctcagcatcatgggagttaggactgtctgtcgcaccatcaaacaggcatagctggctggctagaccatgtcacagggatgttgg

SEQ ID NO: 17182 - DNA, 201 bp, Homo sapiens
gactgtctgtcgcaccatcaaacaggcatagctggctggctagaccatgtcacagggatgttggaactgggtggcactgactggcccagccaaggggtcaygcaggggactcctgattcattcctggggaaagtagttatgtcaggaagcacaggctatggctcacggctgtggctgtgcccacgtggtctgtgtgggctg

SEQ ID NO: 17183 - DNA, 201 bp, Homo sapiens
tttgctcaggaagaagagcaaatggatttttgttaagaagctggcagtctgtcacaggagctacttgaggatacacacagttttctccccattagcatctscagtctctggtataaacttgagtcttctctttggtccctgataaatatacatagaatgtatggatgtgagaaagttaaactgatgtctgtgtgtcttcat

SEQ ID NO: 17184 - DNA, 201 bp, Homo sapiens
tttattttactataaatatgggataattatagtttttactgcatagttttgttatgaggagtaaatgagtcactatttctgagacacttcgtgcctggcasagaacgagcactgtgtgtgtgttacagaaatatatgtgggtgggtgtgtttctgttttccgtaattccagctaggcaaagacatatttaacaaaagcctt

SEQ ID NO: 17185 - DNA, 201 bp, Homo sapiens
tttcctggcttgcagctgcaactatctgacctctgcgtctgtcctcccacggccttctccctgtgtgtttctggatctcttctcctttgttatcaggacastggtcacattggattaagggcctaccctattccagtctgactgcatcttaactgtttaactctgtattccaatctaattacatgtctatttccaagtaac

SEQ ID NO: 17186 - DNA, 201 bp, Homo sapiens
gcgcatttgagacaggttgagggttcaagctgtccaatccctgctcatctgcagcacaccaaggaatgtggactaatgaaaaataaactgcatgcatgcartgcccatcacactgcctgcattttctaatcttcacaataactctgtgttgagaaatattcctgtctgtaatcccggcactttgggaggctgaagcgggca

SEQ ID NO: 17187 - DNA, 201 bp, Homo sapiens
ttcaccatgttggccaggctggtcttgaactcctgacctcaagtgatcggcctgcctcagcctcccacagtgatgggattacaggcatgcgccaccatgcstggctaatttttgtatttttagtagagatggggtttcactatgttggccaggctggtctcgaactcctgggctcaagcaatgcactggccttggcctccc

SEQ ID NO: 17188 - DNA, 201 bp, Homo sapiens
gggagcaggggaggaaccatctgaggtgtttttttttttttttttagatttctcattgctgagaacagttccagctctgctgaccaaaggctgagtgtccytttattagtctgagcccctagagaaaccaaagaggcaaccctcgagccaactgacagccagctgtggggttggaccctgtttttcatacagtgagcactc

SEQ ID NO: 17189 - DNA, 201 bp, Homo sapiens
cctgcctcagcctcccacagtgatgggattacaggcatgcgccaccatgcctggctaatttttgtatttttagtagagatggggtttcactatgttggccrggctggtctcgaactcctgggctcaagcaatgcactggccttggcctcccacattgctgggattacaggcgtgagccaccatgcctggccccctttcact

SEQ ID NO: 17190 - DNA, 201 bp, Homo sapiens
tctctaacatgcacatggccagaaaaatagcttggacattctgttcaaccctccacatcaactggtcagtttagtctttaaaaggtgataggcctgttgtsgtggctcacgcctgtaatcccagcactttgggaggctgaggcaggtggatcacttgagccccggagttgaagaccagcctgggcaacacggtgaaactaa

SEQ ID NO: 17191 - DNA, 201 bp, Homo sapiens
tctgagctgtgagtccttcctgtgcaccaggcatggatggcaaggcacgattgataatgttccctcttatctcgaaatgtccactctctctcccatgcacrgggagtcaagctgtgctcttcaaacacaaattccttctcccacttcctgggtagttatgctcttttcttccctgaggttgctaattgtgggcagtacagt

SEQ ID NO: 17192 - DNA, 201 bp, Homo sapiens
tgtgttactaaagttctcttagatactttacatttcctttcacggatttccaaaatttctttctttgagaatgtcaggaccagtaggaggttcagcacgcrttgccagagaaatcacagatgactaattggaatgcctcagaatcattctccttttgtttcacctaatttccacacttacgaagtcaaactctcagttaaa

SEQ ID NO: 17193 - DNA, 201 bp, Homo sapiens
cagggatagagtctcaaagttggaggtattttatgttgttttaaataatatcgtcatcacatgtcattttagaccccaaaagtccactccgaatctctgcktatggaattgaggaggggtgaggctgtcagaagccgagggacttggccaaggtcacatggctttggacggcccccctgaaccttggagctcatgttctgt

SEQ ID NO: 17194 - DNA, 201 bp, Homo sapiens
aattagctgcgcgtggtggcgcgtgcctgtagtcctagctactcaagaggctgacatgggaggattgattgagcccaagaggtcaagacggtagtgattcrtggtcacaccactgccctcaaccctgggtgacagggtgagaccctgtctctaaaaacaaaagcaaagtctactaaaaattcactggagctatgagaaatc

SEQ ID NO: 17195 - DNA, 201 bp, Homo sapiens
aaaaattagctgcgcgtggtggcgcgtgcctgtagtcctagctactcaagaggctgacatgggaggattgattgagcccaagaggtcaagacggtagtgaktcgtggtcacaccactgccctcaaccctgggtgacagggtgagaccctgtctctaaaaacaaaagcaaagtctactaaaaattcactggagctatgagaa

SEQ ID NO: 17196 - DNA, 201 bp, Homo sapiens
acacaaaacccagcgtggtgattttggcagccttgccatgcatctctaacatgcacatggccagaaaaatagcttggacattctgttcaaccctccacatsaactggtcagtttagtctttaaaaggtgataggcctgttgtggtggctcacgcctgtaatcccagcactttgggaggctgaggcaggtggatcacttgag

SEQ ID NO: 17197 - DNA, 201 bp, Homo sapiens
cagagcatttatctttgatgctgggaatgcgttcattttctttatcttgccattactgtacctctattgggaaatttactctctcttcatagataggatcmgattcagtacatatttataaaaccacacttacatttaaatacaggcctttcccatttcacagtgtttctagctcccctttccaatacatctctctctctc

SEQ ID NO: 17198 - DNA, 201 bp, Homo sapiens
aaacaaacaaacaaaacaaaacaaaaaaggtttaagaaatgttctagtaccttgaaaccaaaataggtatcagatacttggctgttttgttttttcttctwagccattttgacctgtgagattttatgtgatgaaaacataagaatgtggtattacaccctgtgatttgaattttccatactccattccattctatatgtc

SEQ ID NO: 17199 - DNA, 201 bp, Homo sapiens
ccgggaagagcgcatcctaaatcagccattagatttgttcctcatttctttgctttacaaattgtttttctgtatagtattggattttcaataaataaagkatgatataaacaagtctgcaaaccagcaagaactatataagccacttgctcaagtcaataagcgcatgctcacaaaggaacgtaaagttctgaagttctt

SEQ ID NO: 17200 - DNA, 201 bp, Homo sapiens
aatttctttcagaagtcagtactggacattcccttatttcaccttgagctacacatcccatagtcagcttagccctgtccctggtgcgggggagcaggackgttgcctgtatcccttagtcattgccgcaggcttgctgcatcacaaaccaccattagacctcagtggcccgcagcaataaacattcgattctcgccatct

SEQ ID NO: 17201 - DNA, 201 bp, Homo sapiens
aagaacattttgtgaatgtttaaatatcctaagacccactaaggaagtttgtggcaatatttgctcaaagacagtatatataataaatactttagactggytaagagaatggctctgaatgtctacctagctatcacatttagaaacgccccttgccttccttccaggactttcttccttaatcaggattgacttaactgt

SEQ ID NO: 17202 - DNA, 201 bp, Homo sapiens
cagcattgggtgtggctctggggattcattctagtgggcaagtctcatatttctcaacctcaggtttttcatctgtaaatggggacaatactgacatctasctaatgtccttgaggatggaatgagatattgagtataaagtatctagtagagtggctagcgtatagtgagtacccaataaatgcaatagatgttggcttt

SEQ ID NO: 17203 - DNA, 201 bp, Homo sapiens
cctggcatactgcaaatatctatggttgataaattaatgttatcatcatcacgtaagcatcttgggaagtctgtaagtaatgggagttggaggcttaacastgatctttgagctggcgatttttccagccaactcattttggacgttggtgcttaagcatatcctgttttcgagggtggtgttggtggtggaggaggtgat

SEQ ID NO: 17204 - DNA, 201 bp, Homo sapiens
agatcgcgccactgcactgcagcctgggcgacagtgaaacttttgtctcaaaaacaacaacaacaacaacaacaaacaaacaagaaacaaaaaatacataraagaggccttctcttcacaagtttttcttattgttttttgtttttttaagggaggaaatttctttcagaagtcagtactggacattcccttatttcacct

SEQ ID NO: 17205 - DNA, 201 bp, Homo sapiens
tcttgggctggctcattacaggccactctgtctgaggaacactcaggtttgcaaaccgtttcttaaaattacaggatacctagggacctgttggggtgggwgggaagaaccctatgggcagaaatgtgactttctgtagcaaagatgtactgtttcccactgagaagaatcaaaaatagaaaagtgcttccttgtctctct

SEQ ID NO: 17206 - DNA, 201 bp, Homo sapiens
cccgtctctactaaaaatgcaaaaaattagctgggatttggtggcgcctgcctataattgcagctacttggaaggctgaggcgggagaatcacttgaaccrgagaggcagaggttgcagtgagccgagatcgcgccactgcactgcagcctgggcgacagtgaaacttttgtctcaaaaacaacaacaacaacaacaacaa

SEQ ID NO: 17207 - DNA, 201 bp, Homo sapiens
gaacctttctcttataaggatactaatcccatcgtaccccgtcccccatgatctcatttgaaattagtcacctcccaaagccccacctccaagtactgtcmcactggggcatagggcttcagcatatgaatttgggggagctggggagaggaacacatacatttagtccataacaactatctcacttacctctctactaag

SEQ ID NO: 17208 - DNA, 201 bp, Homo sapiens
acggcagtctcaggtttatgtattaggaagcattcagcaggcaggagcagccgatctgagactggcatgggcagtggagacatcattcatctcctgaaacrtaatttggaggagactgttccagggctggctgagtgactccttgatgtcagcactttgccctgtcgtggtcttggcctttctcttgtgttccccagatgg

SEQ ID NO: 17209 - DNA, 201 bp, Homo sapiens
acctgtagtcccagctgcttgggaggctgacgagtaaggatcacttgagccagcatggtggaggctgccatgatcatgctactgcactccagcctgggcarcagagccagaacctgtcttgtaaagaaaaggaaaaagagagagaagggcagaaagaaagaagggaaggaagaaaggaaaattgggcccaggaatgatctt

SEQ ID NO: 17210 - DNA, 201 bp, Homo sapiens
agggaaggaagaaaggaaaattgggcccaggaatgatctttacaatgcctgacaaccaagagaagaagggaaatgagcttcacattgcctgcaagctctarggtgacaagagccaagagaaattattgttactgtagtgatgttccactgaggatcataaagtactttattactctactgagtatggttattggatatgtg

SEQ ID NO: 17211 - DNA, 201 bp, Homo sapiens
gatgctgggaatgcgttcattttctttatcttgccattactgtacctctattgggaaatttactctctcttcatagataggatccgattcagtacatattyataaaaccacacttacatttaaatacaggcctttcccatttcacagtgtttctagctcccctttccaatacatctctctctctctttctctctctctctc

SEQ ID NO: 17212 - DNA, 201 bp, Homo sapiens
ttattagctctgctatcagagtgatgctgtggctggagaagatggagacccatgtgttcaggctgtgagcataggcagatcctttctaatgcagaaggtgyagacacagggcacagaactgccaactgtggctgctgacacctgtctgactttgactgggttagtgacaaagaaatgactttccttttgtatgttagccct

SEQ ID NO: 17213 - DNA, 201 bp, Homo sapiens
taacataataccatagactgggcaggttaaacagcagacctctattcctcacagtctagaggctgggaagtccaaggtgaagccatgggcacattctgtgsctgcctgaggctctctttctggttcccagatggatgcctttgtgtgtcctctcatggcagagagaggaaggggtctggaacctttctcttataaggatac

SEQ ID NO: 17214 - DNA, 201 bp, Homo sapiens
ttatccatgccatctgaaatcctccttcctttttaacaaggcaagtagaaaacgaaaacaacatcaaaggatacactacacaattgttggagccctaggamccgagagaagagtacaagcaggttcttgaactgttctctccccagcaactataactggaaggaacctcagtttgtccattcattcattcatcagagcagc

SEQ ID NO: 17215 - DNA, 201 bp, Homo sapiens
gtagcctcaacctcctgggctcaactgattctctcatcttagcctcctgagtggctgggaccgcaggttcatgctaccgtgcccagctaattgtttaattytttgtagagataggatctctccctttgtggcccaggctgatctcaaactcctgagctcaagcgatcctactcactcggcctcccaaagtgctgggattac

SEQ ID NO: 17216 - DNA, 201 bp, Homo sapiens
atgaactcatgggaagcaaacacacaccctccctccgatccaccaggcactcgggtttcctgtgtgtctggtgatgtgctgggtgttgtggatctggactsaacggcagtctcaggtttatgtattaggaagcattcagcaggcaggagcagccgatctgagactggcatgggcagtggagacatcattcatctcctgaaa

SEQ ID NO: 17217 - DNA, 201 bp, Homo sapiens
caaggacataaacatttactcctgtggtgttatgatatatatagggttcctggctcataactctcatagcccttgttgcagtctattgttacaatattgcstgtgttaggcatcaggaaacagaatctctttgtctcctgtccttctttcacctgccccaaggcaggactctaatctttcccacctttttgattgtgagtc

SEQ ID NO: 17218 - DNA, 201 bp, Homo sapiens
gtttttatatgcagtttgtatttatccatgccatctgaaatcctccttcctttttaacaaggcaagtagaaaacgaaaacaacatcaaaggatacactacmcaattgttggagccctaggaaccgagagaagagtacaagcaggttcttgaactgttctctccccagcaactataactggaaggaacctcagtttgtccat

SEQ ID NO: 17219 - DNA, 201 bp, Homo sapiens
aaatcctttgcaaacattttctctcaatctatgggtaggcttttttactctttttatagtgtcttttgatgaacaaagattttaaatcttgatgaagtccmctttatctattttggatgttgttgcttctgtttttggtgttgtatctaagaatccattgccaaatccaaggacataaacatttactcctgtggtgttatg

SEQ ID NO: 17220 - DNA, 201 bp, Homo sapiens
tagcctagttttccaaactttatccccaggtggttgaactttctaagtttccccaagctgatcagtgttttggggtggtatggaactcagaatagatcactttttttattgactaactctgaccataagtatgcttctgtgcgagcctgacctccacggtaccaggcagagaacaacatgtatgcagagaactcattcact

SEQ ID NO: 17221 - DNA, 201 bp, Homo sapiens
cagtcctcagtgtaccccaggaaagaggaaactgagtctccatgtggctttctgtctggcctttctcttttgcttgccttgtgctttgaatgcaggcctgmtgtttgcctgtggacctcaggatttgtaaggccatctccacccacctacagctaagtttcccaagagccgatctccagccgaagtccaaggttccttgat

SEQ ID NO: 17222 - DNA, 201 bp, Homo sapiens
aggtaagcggctagcacagtgctcagcatgcatgaaggactctttcattatcgttattaactgatgtttttaacttatacattgaaatgtggaaacaagcsttgcttctattgaatgacttcttgaaagtgccagtctgatccttgaccttcaggtgcatctctaaattctttcatgtcagggtctctgaaatctgaacac

SEQ ID NO: 17223 - DNA, 201 bp, Homo sapiens
cttacaatccgttgcagaaagcctagctccccagcttctcctgaatctacgtttttctattttgtctgaactagccaaggtctctggagtttgctgttatmttgcttcagagaaattagtgacattgaaaggctgttgtcttttttagtgtacttttggttgttaggagaaatttacaaggccatttttttctcccgtctc

SEQ ID NO: 17224 - DNA, 201 bp, Homo sapiens
gctcactgcaaactacccccgcccccgggttcaagcaattgtcgcacctcagcctcccaagtaactgggattacaggtgcccaccaccaagcccggctaakttttctattttcaatagagatgaggttttgccatattggtcaggctggtcttgaactcttgacctcaggtgattcacccacctcagcctcccaaagtgca

SEQ ID NO: 17225 - DNA, 201 bp, Homo sapiens
ataaatatatacatatatgtgtatatatagattttgttttttgagacagggtcttgctctgtcactcaggctggagtgcagtggcgtgatcatggctcacygtagcctcaacctcctgggctcaactgattctctcatcttagcctcctgagtggctgggaccgcaggttcatgctaccgtgcccagctaattgtttaatt

SEQ ID NO: 17226 - DNA, 201 bp, Homo sapiens
atatatatatatttatataaatatattttatatttaaaaatatttatattttatatatttttatatatttatgcaagtatatatctaaatatataaaatakatataaatatatacatatatgtgtatatatagattttgttttttgagacagggtcttgctctgtcactcaggctggagtgcagtggcgtgatcatggctc

SEQ ID NO: 17227 - DNA, 201 bp, Homo sapiens
caagaaatgcggcagctgcttctagccgctccatccttccttttcccagtgcgcactaaccctccagagccttccgcatctgctatgcagcattggccacrccagtgggatgcaagaatttatcccttctgttgatgcaattaaagctaatggatctcatatatatatatatatatatatatatttatataaatatatttt

SEQ ID NO: 17228 - DNA, 201 bp, Homo sapiens
gttgctgtactagatgaataatgtccccccaaattcgtgtctatctggaacctcagaatgtgacctcatttggaaataaggcctttttaattaaaaaaaawtttttatttaaaaaacagagatagagtcttgccatcttgcccaggctagtctcaaactgttgggctgaagcagttctcctgctttgacctcctaaagtgc

SEQ ID NO: 17229 - DNA, 201 bp, Homo sapiens
cacagctggagtttaggaaggccaggcagcgtgtgttgaatgccagccactcttctacccagggtcatatccttggatgtttttctgtgcatctgtctttyccgaccctcccgtgattctggaaggaaacacctttccaagctccccagtgaccctggttcatcccggaaatatgcaggaaaagcattatgagcattgcag

SEQ ID NO: 17230 - DNA, 201 bp, Homo sapiens
ctcacatgtaggtcacctacgggagcaggggaggaaccatctgaggtgtttttttttttttttttagatttctcattgctgagaacagttccagctctgcygaccaaaggctgagtgtccttttattagtctgagcccctagagaaaccaaagaggcaaccctcgagccaactgacagccagctgtggggttggaccctgt

SEQ ID NO: 17231 - DNA, 201 bp, Homo sapiens
gagtttgagagcaatctggccaacatggtgaaaccctgtctctactacaaataaaaaattagccgggtgtggtggcgtgtgcctgtaatcccagttactcsggaggctgaggcaggagaatcgcttgagcctgggaggcagaggttgcagtgagctgagatcgtgccactgcgctccatgctaggtgacagagcaagattc

SEQ ID NO: 17232 - DNA, 201 bp, Homo sapiens
gccatgttggagagggatccaacatttattatccccattttacagatgaagaagttaaggtggccaggcatggtggctcatgcctgtaatcctagcacttygggacactgaggtgggtggatcacttgaggtcaggagtttgagagcaatctggccaacatggtgaaaccctgtctctactacaaataaaaaattagccgg

SEQ ID NO: 17233 - DNA, 201 bp, Homo sapiens
ttgcctgatcgcctctccacccctgctacgtgtaatagaaaggtagggccatgttggagagggatccaacatttattatccccattttacagatgaagaasttaaggtggccaggcatggtggctcatgcctgtaatcctagcactttgggacactgaggtgggtggatcacttgaggtcaggagtttgagagcaatctgg

SEQ ID NO: 17234 - DNA, 201 bp, Homo sapiens
ttaactttcagaggagccaccaaattgttttccacggaggctgcaccattttatatttccacttgcagtatatgaaggttccaatttctccacatccttgmcaacactttattttctgttttctttgaaggtatgaaattgtatcgtggttttgatttgcatttccctcatgattaatgatgttgagtatttttatgtggt

SEQ ID NO: 17235 - DNA, 201 bp, Homo sapiens
agccttcatctgttttcctgcagatgcccggctcgtggttaacccaagcaagaggtagttaaacggccccgcagattgccagtgactccgggaatgcctargtttatgtatggattaacacagtgatagaccctgagtagcaaaagacgaagactaattacctgacagagctcccctccactcgcctgggtcattgaaatt

SEQ ID NO: 17236 - DNA, 201 bp, Homo sapiens
acaccagactaatgcttctgacttttccatggtgccccagcagcaggctggagggaagggcgggggcggtcagaggagagatagagcacttcagattccamtcgaatacattagagcattagagcttttctcttcctcagggtgctctctctctctgggttgggaggagatgtggcatttctaggaattcacagtaaaatc

SEQ ID NO: 17237 - DNA, 201 bp, Homo sapiens
aaaattcaaaaaattgcaacctgaggcataaatgggttttaagctccatacagtaaaacctagcatatgaaaacagttctggctgatgggttggtagaagkgatagatatagatacatatatacacatatatgcacagtaatagatataggtaaagaccttgatatatgtacatatattgtatgatacatatccatgcata

SEQ ID NO: 17238 - DNA, 201 bp, Homo sapiens
ccgcacccggccctgtttttgcatttttagtagagacgggttttcaccaggttggccagcctggtctcaaactgttgaccttaggtgatctgcctacctcsgcctcccaaagtgctgggataacaggcgtgagccactgcgcctgtctacattttctgtctttactggtattatggtgggaacccataaaccactgcgagg

SEQ ID NO: 17239 - DNA, 201 bp, Homo sapiens
ctcaggatgaggatgttcaatttgtactgctggtggagctgcctttccattaagtgagtctttctccaagggaacagaagtcttaggttgttgatctggckgtcagaacctaggacaggcaaggcagtgggctgttgtagaggagatgaagctgatcagagcacacccacaccagtgacaaccggtcaggacctgggaagg

SEQ ID NO: 17240 - DNA, 201 bp, Homo sapiens
tgcgcctgtctacattttctgtctttactggtattatggtgggaacccataaaccactgcgaggcagataccattttaagcaggaaaccttatttttttcygaagcacatttaaaaatattttccagtttatctattaaacatcctcctttgcttctggagatcctctgaaagatttatctctttcgattcatctgtaaag

SEQ ID NO: 17241 - DNA, 201 bp, Homo sapiens
ctttgatgtgtgtaggtaagcggctagcacagtgctcagcatgcatgaaggactctttcattatcgttattaactgatgtttttaacttatacattgaaakgtggaaacaagccttgcttctattgaatgacttcttgaaagtgccagtctgatccttgaccttcaggtgcatctctaaattctttcatgtcagggtctct

SEQ ID NO: 17242 - DNA, 201 bp, Homo sapiens
ccttactgttgaagacttgtggaaaagggacatggcccagggaaccagagtggtttgggaaagcactttgtcaagaggcttggggaccccagggtggaagytgccatgcgcatgaggctgtgttagcagaggcagtggcagaagaagacattgcaaacctgcaaaagcaacctctgaggatgggtagacatatacttcatt

SEQ ID NO: 17243 - DNA, 201 bp, Homo sapiens
gcttattgcctgctgcacattttagcctcatctcgttagtgcaagaaataatttaacaactgaaaaagatgtgaggttgtacctggtaaggtctctattgstcaaggaaaggtttagcatggagagatttctcttaaggtgcctaggtattcagaagcacccctaaaactgatttgtgtggccctatgcttacaagtggag

SEQ ID NO: 17244 - DNA, 201 bp, Homo sapiens
tccactgtttatcctggtgaccttaggcaagtcatttaatttccttgagttttggtgtaagtattgatggagcagaccatcaataactgttcttatgtctrttattaccatgtgtctgtctacatgtttgtttgtaaattctctgtgggtaaaagttctcttttcatccccttgcctcagcacggagcccagagccagact

SEQ ID NO: 17245 - DNA, 201 bp, Homo sapiens
ctgtgagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactgggga

SEQ ID NO: 17246 - DNA, 201 bp, Homo sapiens
gtctggatatgaattccaaagaccactggactttggaatattcgtaggtctctgaaaattcagacccacagaggccttaccccgctacagagaggccccargagagaggcctcacaccctctggctccactgaaattcacttcacgtttccaacttggattaaactggcacgacagttcagtcaaatgtcaagtccatttt

SEQ ID NO: 17247 - DNA, 201 bp, Homo sapiens
accttgtagcaagggggaaaaaaagagcttcttgacatctttttgaagaatggcgctctttaaaaaaacataagggaactttttttttcaaacactgtaaygagggtattcaagtctgcaggcaaaacagagctgtttgaaaagacattagcctcgaaaccgcactgtgccagaatagatacagctacgtcaaaatgccgc

SEQ ID NO: 17248 - DNA, 201 bp, Homo sapiens
aaaaaaaaaatcgggaattagcgtgtagctattaggcgtagattcctgcctaaggtctggatatgaattccaaagaccactggactttggaatattcgtargtctctgaaaattcagacccacagaggccttaccccgctacagagaggccccaagagagaggcctcacaccctctggctccactgaaattcacttcacgt

SEQ ID NO: 17249 - DNA, 201 bp, Homo sapiens
tggaaaaaaaaaatcgggaattagcgtgtagctattaggcgtagattcctgcctaaggtctggatatgaattccaaagaccactggactttggaatattcrtaggtctctgaaaattcagacccacagaggccttaccccgctacagagaggccccaagagagaggcctcacaccctctggctccactgaaattcacttca

SEQ ID NO: 17250 - DNA, 201 bp, Homo sapiens
cctcccgagtagctgggactacaggcatgcaccaccactcccagctttgtgtgtgtgtgtgtgtgtgtgtgtgtgtgtgtgtgtgtgtgtgtgtgtgtgtgttttgtagagacagggtctcactgtgttggccaggccggtctcaaactcctagcttcaagcgatcctcctaccttggcctctcaaagtgctaggattacc

SEQ ID NO: 17251 - DNA, 201 bp, Homo sapiens
aataactctgtgttgagaaatattcctgtctgtaatcccggcactttgggaggctgaagcgggcagatcacctgaggtcaggagtttgagaccagcctggscaacatggtgaactccccccaaccaacgacccttcccatatctactaaaaatacaaaaattagctgggcatggtggtggggacctataatcccagctact

SEQ ID NO: 17252 - DNA, 201 bp, Homo sapiens
agcattcacacaggcactaagacggtgagtactcactacttagcgctgtcaacatcatctccgtccacatcaatgtcgtcatcgtccttatgaaaagccckgggcatcattttgcccttgagctggatgtccatgttggaaaaacagctagtggaaggcgtgcccaaatctcagaagttggcgtttccttgcagatatcat

SEQ ID NO: 17253 - DNA, 201 bp, Homo sapiens
acaaatcttgtttttgtctttttattgaatttaaccactattgacttgcgacttgcggcaatcaccagatcccagatctctgtgtttggagctacacgtcyttctgaatcgaggaggtggggcactgatttttcttttatcactgacttccccgaagtgggaagttccagtgcttaacaagtttcattaagaacacagcta

SEQ ID NO: 17254 - DNA, 201 bp, Homo sapiens
ttggttatttctttattcaagggttgttgagaggatgaagtgctaaaaatgcttgaccagcattcacacaggcactaagacggtgagtactcactacttakcgctgtcaacatcatctccgtccacatcaatgtcgtcatcgtccttatgaaaagccctgggcatcattttgcccttgagctggatgtccatgttggaaaa

SEQ ID NO: 17255 - DNA, 201 bp, Homo sapiens
ctgggtaaaataaatatgatataaaacagacacaaataagaatatatagatgatgttaatttcttcagagcttcccggtgttacgtcttcaagaatatgaygacaggggaacagcccagtgtggcagtcatgtgacgacatgagcattggaaccagccacatctcagttggcaacacgtatctgtgtcttactagcttggc

SEQ ID NO: 17256 - DNA, 201 bp, Homo sapiens
gtgacgacatgagcattggaaccagccacatctcagttggcaacacgtatctgtgtcttactagcttggccactgtcacgtcactcagcctctgttttctmatctgtaaaatggggaaaattatagatgcttcagaagatatttgctatcactattaaatgaaaacaagcatgtcatcagtgcttattatttttgttgctt

SEQ ID NO: 17257 - DNA, 201 bp, Homo sapiens
ggtgatcctgctgcttggcagcatcttcccagcgtacaacagaggaaaactgcctgttgtagttaaaaaaaaaaagagagagagagagagagactgatacmcaaagagaatcagaaaggagtagagatgaaacaaagatagagctagcatgattgcaagctgaggacatacgaggagtccctgggtcagctgggccataca

SEQ ID NO: 17258 - DNA, 201 bp, Homo sapiens
taatacaaaagttttccccataccaactagtagtgtaagttgatttcatatccttttatttcataaagttttgcttatcgggtttgtcatcctctatttgmaattaaaatgtgtggtctcgagatgaccttaaagtatctgacccccaaatctaatcactcctagcatctgtgaaaattgacaaatatgtcaggtataact

SEQ ID NO: 17259 - DNA, 201 bp, Homo sapiens
cttggccaaatatccgagtgtggaagctctcactgtgaacctgctaacatacatttcagtgtctacaaaatgtcttttgagagaaaacagcagggacattygtgagctcttttttttttctaaccactttcccagtgagacttcagttttcattctccccttagcagctttcaaatatgtacgtaacacaaatgttacatg

SEQ ID NO: 17260 - DNA, 201 bp, Homo sapiens
agcctcccgagtagctgggactacaggcatgcaccaccactcccagctttgtgtgtgtgtgtgtgtgtgtgtgtgtgtgtgtgtgtgtgtgtgtgtgtgtgtgttttgtagagacagggtctcactgtgttggccaggccggtctcaaactcctagcttcaagcgatcctcctaccttggcctctcaaagtgctaggatta

SEQ ID NO: 17261 - DNA, 201 bp, Homo sapiens
atttctttatcgtaagcacacttctctacattacctttataatccaacaactctgctattagtaaattatagaaacaacttttgtaacactatcttgtttscagagtatatgaaaaatttgaagttaaaattcagctccacgaatactgcagtggtgagaaaatggcgacaaagattagtcttctgtgagaagtctgctaa

SEQ ID NO: 17262 - DNA, 201 bp, Homo sapiens
ttaagttttttataggagtcattaatctccctcagcctcagtttccctatctgtgaagtgagtctaaccaggatgataatgaagagttaggtcaagtgagrttggcagccagacacccaccaccagctgtaacataagaacagatgttctctccagacccccaggtcagctgaggtcgctctgcttggaataatgaactgc

SEQ ID NO: 17263 - DNA, 201 bp, Homo sapiens
tatacaatgtcagtgctctgagctcattaggcgtcatctgagacagtggctgtaggggaggggaggtaggctctgagtcaagcagacctggaattttcttyatgggccattaggaactgtgtgacgctggggcatctgacttcacctttctgagtcttagtttccttacctgttgaataggtctaatgatatcattatggc

SEQ ID NO: 17264 - DNA, 201 bp, Homo sapiens
gttcaagctggcctcgtgtttgtggttttagacacagctttgagtcgtgaccggtgtggccaagacctatttcccttgcaaatgctctctctcttttttcrgtaactgtgttactaaagttctcttagatactttacatttcctttcacggatttccaaaatttctttctttgagaatgtcaggaccagtaggaggttcag

SEQ ID NO: 17265 - DNA, 201 bp, Homo sapiens
tggctggaggtacccctcagctcctagaggcatcaacagttcctgaatatctgggcttttcccacaaagcagcttccttcatcaagccagcaacaagagtytctggggcaagttggtcaacaagatggtgtcttacatgcccaatgtaatcatggaagccatgtatacctcatcacatttgccagatttctgctgattaat

SEQ ID NO: 17266 - DNA, 201 bp, Homo sapiens
cctttacattttaaagagggatgaggttgagtctgtccctagcactgacaatgaaacatttatgctgtttataaaaatcaggaaacacacaaataatttgmttaacgctcaccttctggtccttttgtgatttgagaggtcttgagataagaaaaactgtggatgaattttactgaactattgaattgagaatggctgagg

SEQ ID NO: 17267 - DNA, 201 bp, Homo sapiens
gctcttatttttaagtcatccttatctctttcacttattccctcattcaggcaccaaaaatgctgtttgactgggagagcaagtggagctgttcaaagttstagggacagccgggcgcagtggctcatgcctgtaatcccagcactttgggagggcgaggcgggcagatcacaaggtcaggagttcgagaccagcctggcc

SEQ ID NO: 17268 - DNA, 201 bp, Homo sapiens
gccaaaatattcttttcaaagtgattagaagtaggagaagcttgctctctttttattggcacttctgtcttacatgcactttttgatttaaattattctgkcttctatgaaatgacagtgattggaggtggtttatttttttttaagtctgcttactcggaaaaataaaacaaagttgacaacctgatttcagacctccca

SEQ ID NO: 17269 - DNA, 201 bp, Homo sapiens
gtttcagtgcctgacacagttgtattcctaagacatagttgggaccagacctcaagaaaatagccaacaaatactgggtgaatgaacgaaagaggccataygcagtcagcccccctctctctgggttctacatatgtagatttaactaatgacagattaaaagcattcgaacaaacggagggtggtatctgtactgaaaat

SEQ ID NO: 17270 - DNA, 201 bp, Homo sapiens
cctctttaaggataagactttctgatttttcaactggatttaccattgtggcatctgcacatgagcagactgactgctttttggccctacctggagcctgrgtcctcaggtagctgacccgagagaccgtggagctgcttgtgatatacaatgtcagtgctctgagctcattaggcgtcatctgagacagtggctgtaggg

SEQ ID NO: 17271 - DNA, 201 bp, Homo sapiens
gatgggtctttgtttagaggaagctctttatcctggtacgctggaagttggcatagtcttagcagttagtccagatgtgaatttcaggattattctgtgartcttccaagtcctgtctcagcagtgaaataggctcagtgtagcttatgtctaggtggctgagttcattttctagtctaggtaaagggcacctcctgtaat

SEQ ID NO: 17272 - DNA, 201 bp, Homo sapiens
tctttcttttttttttttgaggtggagtcttcctctgtcacccaggctggagtgcagtggtgggatcttggctcactgcaacctctgtctcctggcttcaygccattctcctgcctcagccttccgagtaactaggattacaggcatccgccaccatgcttgggtaatttttgtacttttattagagacagagtttcacca

SEQ ID NO: 17273 - DNA, 201 bp, Homo sapiens
ctatgctgggcacaaggaatgttatggtggataaggggaaaatggtccctaccctctgtcagttttttatggaagaagaaagacggtctttaaagaaattyacataattaatcacaaaaagctaatactatgacaaagaatgtaagttactaatacagcttagaacagatgactctaaccttgtgtaggagctagagaagg

SEQ ID NO: 17274 - DNA, 201 bp, Homo sapiens
cccagcctgattcctgttttacatattaaaaatttcatctctccaatcttcgaagaatccgtagtccatttttaagtagctcttgtcttccaaaggtatgsgatgtgcctacctaatgctcttcctggatgggagaatattaccaaaaacgtttggtcgactaattttatgacagtttccaactacaatttttttcctctt

SEQ ID NO: 17275 - DNA, 201 bp, Homo sapiens
gtggtggctcctgcctataatcctagccctttgggaggccaaggtgggaacatcatttgagcccaggagttaaagaccagcctgggcacatagtgagacascagctttacaaaagagagagagagaaagaaagagagagagattatttctagaataagcaaaccaaacgtgaattaagttttcattctcattttagtgatt

SEQ ID NO: 17276 - DNA, 201 bp, Homo sapiens
tgggtatggttgtgcactcctgtggttccagctactcaggagactgcggtagggggatcacttcagcccagaagttcaaggctgcagtgagctgtgatcgytccactgcactctagcatgcgtgacagagtgagactatctcaaaaaagaaaaaatgagattatggccaggggtggtggctcctgcctataatcctagccc

SEQ ID NO: 17277 - DNA, 201 bp, Homo sapiens
tggctgggcatggtggctcacacctctaattccagcactttgagaggataacttgagtccgggagtttgagaccagcctgggcaacagagccagaccatcyatctctacaaaaaatttaaaaattagctgggtatggttgtgcactcctgtggttccagctactcaggagactgcggtagggggatcacttcagcccagaa

SEQ ID NO: 17278 - DNA, 201 bp, Homo sapiens
atattaattattaataaaatccaactccttaataatacaatcatagttaccatttattgagagcactcttctgaacattttgcattctttatttaatcttmcctacaaccttattaagtagacattatcttcatcttattaagtagtcagttcctcatttgcagatgaggaaactggctgactgagttaaatgaatgccaa

SEQ ID NO: 17279 - DNA, 201 bp, Homo sapiens
actaatattctctctgactataattgtaaaacagtagatgtctttcaccaagcgctaacattatattaattattaataaaatccaactccttaataatacwatcatagttaccatttattgagagcactcttctgaacattttgcattctttatttaatcttacctacaaccttattaagtagacattatcttcatcttat

SEQ ID NO: 17280 - DNA, 201 bp, Homo sapiens
cctagccaagcagaaacccatgtttttgactttcaggatatttgtgaattaatttacttgcatatattggccaagatctagcataatctcttaatattcartgaataaaaaattgagttttgagagcaaatattttggtaggaaatagagaactgacactaatattctctctgactataattgtaaaacagtagatgtctt

SEQ ID NO: 17281 - DNA, 201 bp, Homo sapiens
gtggccctgaagagggtgggaatgtctcatccccctgtgggcttagaagaaaaccagaggtctgtgcacactatggatttttactacaatgatgccctttyacatacagcgagaaggattaagaggtactgtattgttggttgataaagtcaaacttgtgaacagagcaaaagggcattgcttggtcattgcagcttccac

SEQ ID NO: 17282 - DNA, 201 bp, Homo sapiens
tacttcttggagaaacctcccaaatttctatcgacactagacatctcaggatttgaaatgttaagctaacaaattgttcatcaggtgtatctccagccctycgtaaacactgccggatggatgaacctacgtaatgatctcctggtgccattttcctgactgtagatacttgggtaaggaggagactttgactctagatga

SEQ ID NO: 17283 - DNA, 201 bp, Homo sapiens
aacttgatatggaaggtcttcacagattaaaacgaaggaaaaaaaaaaaaaaaactagataaatctccctggacatgaacttttgtagaagtagttacaaygctagtgacctcatatactcatggtaacggcttccggcatccaatgaccttgccattgcggaggtcaatttcatgtgtgtgtgcacacatgggtgcgtat

SEQ ID NO: 17284 - DNA, 201 bp, Homo sapiens
agggccctttgtcatttatgtagcaccagccctgaaatcggagactcataaaacctacaaatacacacacaaacacaaaccaggcaaacccacacaccacrgagaagaggcaaagtgtgcataaagataccctgttgttattcacccagtacaactctctaattcatgtataaacagtaagtgtaaaatgttccacaccct

SEQ ID NO: 17285 - DNA, 201 bp, Homo sapiens
agagacttcaggtggatctggaggtccttccccaaccttctgcaaaccatgtcttcccagagagcttctaagccaaagcaaaggtgttgctctctgcctcytgttgctctgtaattcatctcagcaaccatctttcccatctctgggaagagaatgttgtcccccagaaaaagtccttatggatagatttagttattgctt

SEQ ID NO: 17286 - DNA, 201 bp, Homo sapiens
atcaggccttgggagatgcaaacagtttgcccttggaccatgtcttctgctttcatccttatgctctcaacagatcatgccaaggtcctgtgttcaccgcsttcctgagtccccattcagaggctcaagaattgagacaaaagggcatcctgcaaatttgctgccctggaagctgtgctgggggagccagtagagacttca

SEQ ID NO: 17287 - DNA, 201 bp, Homo sapiens
tggagtgcagtggcgtgatcttggctcactgtagctgctgtctcccggattcaagcgattcccctgcctcagcttcccgagtagctgggattacacccacsaccatgcccggctagtttttgtatttttagtagagatggggtttcaccatgttggccaggctggtctcaaactcgtgacctcaagcagtccacccgcctt

SEQ ID NO: 17288 - DNA, 201 bp, Homo sapiens
attctcgccttctagcctgggcttgtcagcttggggtgtatgccgcacctcctctttgaagaggatcttcatttggaggggtgatctgactcccaaccctmcccaggtgaaagcaccgggattcatacctagggggctttgggatttggggctgactttgacccgtcattatttctgactgcaaaattcctgacaaatgtc

SEQ ID NO: 17289 - DNA, 201 bp, Homo sapiens
ggttggcgtttcagtgcctgacacagttgtattcctaagacatagttgggaccagacctcaagaaaatagccaacaaatactgggtgaatgaacgaaagasgccatatgcagtcagcccccctctctctgggttctacatatgtagatttaactaatgacagattaaaagcattcgaacaaacggagggtggtatctgtac

SEQ ID NO: 17290 - DNA, 201 bp, Homo sapiens
acagggacaagaaataaataactttgatgcaaatcctgggaagactctggaacaacatggaggcacctatgttaactctatttcattttggaaaagttgastagacaaaaggtgcagagtagagtatgcagtgatttcagggtgttgggctctgacaagatgatgccgacttagacagtgttagtcaacatcaaatgtctg

SEQ ID NO: 17291 - DNA, 201 bp, Homo sapiens
ccagaggtctgttttcatcacatcgtatcaagcattccaccttcatcatgactcttcactgttgatggtgactctgattcacctggtcaaggtagtgttcrttaggtttctccactgcacacttagtctttccctctactttccacactgctgcctttggaggagtgttgctgtgcccagctcatgcttgtggagtgggga

SEQ ID NO: 17292 - DNA, 201 bp, Homo sapiens
tctcagttaatgcccacaaatttctgaactttgaacataaataccctcactgcaatacatgtttttctttctctctctttctttctttctctttttttttytttttttttttttgaaaaacttttttggagcagcacctgcatgttgtaaaaacacaaaataaaaaaaaaataaataaaagcagaccccttggttcagata

SEQ ID NO: 17293 - DNA, 201 bp, Homo sapiens
catgtacaacagcgcctgtgctgggcctgctaggagtcgatattttctggctcaaagaagttccaaaagaattcaaagccagtgtgtctctttctctggamggccaagtgatgcaggtaccacgcttaggtctgctggtgtttagcttgacttaaaacccagccagggaaatatgtttcactttgctggggtgcaggtgga

SEQ ID NO: 17294 - DNA, 201 bp, Homo sapiens
ttatttgtcttttggcttgtatcccacctgttcactttttaccatagctaacctttctaagtggtcaggtgggactcatggagattttccgttctttggaractagcagcgactgcagattactcatcagctgtctccttgagtccacaatgccgggcggtggacgggcttcctgcctcctggcccagggcccctttgccg

SEQ ID NO: 17295 - DNA, 201 bp, Homo sapiens
tattcctcgcctggcctcattgctcgcttcgtttcggaggaaattttccctgttaaagtactgtacttgtcatttatttcccttttttccactctccctccgtggctgggtttggatatgcatttatccaaaaggcaaggcttttacacacttccgctaacctcttatggtcaggctcataaaagcaacccaacaaagctt

SEQ ID NO: 17296 - DNA, 201 bp, Homo sapiens
gtggcgggcacctgtagtcccagctacttgggaggctgaggcaggagaatggcgtgaacccgggaggcggagcttgcagtgagccgagagcccgccactgyactccagcctgggcgacagagcgagactccgtctcaaaaaaaaaaaaaaaaaaaaaaaaaaaaaaaagacacgtacacagacaaatgttctgacagaaat

SEQ ID NO: 17297 - DNA, 201 bp, Homo sapiens
tctagtggatattttgttaaaaaaaaaaaatggggtctcattctgttgccccggctgcagtgcagtgacatgatcataactcatggtgacctcaaattcaygagcccaagcgatcttcccacctcagcctgagtagatgggactacaggcatgtgtcaccatgccaggctaatgtttaaaaatttttcttagaggtagagc

SEQ ID NO: 17298 - DNA, 201 bp, Homo sapiens
ctgagtttctgtggatttctataggctcctgcaaattttatctagtggatattttgttaaaaaaaaaaaatggggtctcattctgttgccccggctgcagwgcagtgacatgatcataactcatggtgacctcaaattcatgagcccaagcgatcttcccacctcagcctgagtagatgggactacaggcatgtgtcacca

SEQ ID NO: 17299 - DNA, 201 bp, Homo sapiens
aattttgtgttgcgtaatatttcaggaacttgcaaccctgataacttgtgcctgcctgtctgtaggcctttaatgatgttttattgaattttggttttccmctagactttgcagtgcatgacacatagtaattgctcaataaatatgtgttcaactgaactatggtggttaggttagtaattagatgcacagacaaaatca

SEQ ID NO: 17300 - DNA, 201 bp, Homo sapiens
cgagcatgctctgaactcctgaactgctcattctgttctctgagagaattgctcaagctgcagtttatcattatatgcctccaaagactttgtgtttcctrtgtttgacatcgagatagaatttttcataaccctttactagtaataaatttgattgttaagggaccgggttaatcttatttctaataccagcatctgatt

SEQ ID NO: 17301 - DNA, 201 bp, Homo sapiens
gaatgactccatggatgacctttccgtgcctttgtctgtagcctgccctcctctttaactgaacaccttccagacgagcatgctctgaactcctgaactgstcattctgttctctgagagaattgctcaagctgcagtttatcattatatgcctccaaagactttgtgtttcctgtgtttgacatcgagatagaatttttc

SEQ ID NO: 17302 - DNA, 201 bp, Homo sapiens
ttgttattgtaaaagcatcatgcaccaggtaaaatgtttaataacacagagaaatctaattgtcaagtatcttctcaacacacattaatcaacaattctcmtatcgaaggataacctcttgtatttacaaaaaaaagaagaaaaagtgctgtcatcagtaaattcattcatgtatgttatacacttacatacaaaatgtat

SEQ ID NO: 17303 - DNA, 201 bp, Homo sapiens
tcacgtttgtttaatattttaatttccccatgagtcttaaacctctgcgtggtgtgcaagttgaggcctggtgtatgcacttcggccacgggctttcccaytgtaatgaagatggaatgactccatggatgacctttccgtgcctttgtctgtagcctgccctcctctttaactgaacaccttccagacgagcatgctctg

SEQ ID NO: 17304 - DNA, 201 bp, Homo sapiens
ccgggaagtggaggttgcagtgagccgagatcttgccattgttctccagcctgggcgacaagagtgaaactccatctcaaaaaaaaaaaaaaaaaaaaaaraattatgtcatttcgttgtcacagcgtcagcagaataaatcttagatcaagatgggattactgcgccactcccttcttcccagtctgtggtttagcacgg

SEQ ID NO: 17305 - DNA, 201 bp, Homo sapiens
ggttggagaatgttcatatcacattattttggatgtctggggttgcacctggaagctcagatagcaatatctaggcacggctgccagtgctctatacattsacgtttgtttaatattttaatttccccatgagtcttaaacctctgcgtggtgtgcaagttgaggcctggtgtatgcacttcggccacgggctttcccact

SEQ ID NO: 17306 - DNA, 201 bp, Homo sapiens
aagcggggcaaggggttggagaatgttcatatcacattattttggatgtctggggttgcacctggaagctcagatagcaatatctaggcacggctgccagygctctatacattcacgtttgtttaatattttaatttccccatgagtcttaaacctctgcgtggtgtgcaagttgaggcctggtgtatgcacttcggccac

SEQ ID NO: 17307 - DNA, 201 bp, Homo sapiens
gaaggggacatgctatgtcagagtggagggacatggggaggcaccaggactggtcaagaggcagagggagagggtcaaaccgtgggttctgtggggaggamtgaacgaggcagggtaagtagactagggtttgagtaagttcagcaggctctggggaagaggggctgtccctatttttctggtacctggccctgggtgatt

SEQ ID NO: 17308 - DNA, 201 bp, Homo sapiens
ctcacttagtcatttcactattaaaagagaaaaatagttagtttacaatttccaggaaatcagacaggtcaccaccacctcttcaacgactggaatttgcrcagtctcactactcataggcccatctgttactactaacagtgctaatgtgattgtctgtaggtctagcaattggaggttgttcgtttctttgagacaagg

SEQ ID NO: 17309 - DNA, 201 bp, Homo sapiens
gccagagtttttttttcccttgtcttataccagtggtgcctagcatggtgtcaggtttatagaggactaatacatataagaaggagaaagggagggaggargaattccagttgttttttttttaatctaggtacaagtctctctgttgatttctaaacatcgaatgaagatgaaggaaatacttaaagcacctaagcactc

SEQ ID NO: 17310 - DNA, 201 bp, Homo sapiens
ctcttttctgaagtgatggggatattcgatggcaattttgtgttttcttcacttggaaaaactaaaaagtttgcaacatttaaaaaaaatacaacccttaygctgatggatgtacactgtaaaacaaccacgtttggtaaactgttaatcactttcatagtgtatgtggatggagccagttaaaccagttttcatgtcttt

SEQ ID NO: 17311 - DNA, 201 bp, Homo sapiens
ctctcaaagatagacatggacatataaataattttttaaaatcctcttttgcaaaaaaaaaaaaaaaaagaggtgaatttagttgaaaggatatagccacwcttttctgaagtgatggggatattcgatggcaattttgtgttttcttcacttggaaaaactaaaaagtttgcaacatttaaaaaaaatacaacccttatg

SEQ ID NO: 17312 - DNA, 201 bp, Homo sapiens
cttatttgtcttttggcttgtatcccacctgttcactttttaccatagctaacctttctaagtggtcaggtgggactcatggagattttccgttctttggmgactagcagcgactgcagattactcatcagctgtctccttgagtccacaatgccgggcggtggacgggcttcctgcctcctggcccagggcccctttgcc

SEQ ID NO: 17313 - DNA, 201 bp, Homo sapiens
tcttgctctgttgcccaggctggagtgcagtggcatgatggcatgatcatagttcactataatctcgaactcctggtttcaagtagtcttcctgccttggsctcccaaaatgctaggaatacaggcaggagccactgttactggtctgtttttttccttaaatacataggcaacttcctcgattgtctctcctttattggc

SEQ ID NO: 17314 - DNA, 201 bp, Homo sapiens
ttaaacagagacagatcttgctctgttgcccaggctggagtgcagtggcatgatggcatgatcatagttcactataatctcgaactcctggtttcaagtartcttcctgccttggcctcccaaaatgctaggaatacaggcaggagccactgttactggtctgtttttttccttaaatacataggcaacttcctcgattgt

SEQ ID NO: 17315 - DNA, 201 bp, Homo sapiens
tgattgccagtccattctctagccttctgaagaagatagattgtaatctttaattaagctatcactcacaccaaaaaaaaaaaaaaaaaaaaaaaaaaagyggggcaaggggttggagaatgttcatatcacattattttggatgtctggggttgcacctggaagctcagatagcaatatctaggcacggctgccagtgct

SEQ ID NO: 17316 - DNA, 201 bp, Homo sapiens
tttggcagttacctgaaagaaaatttagtgattgccagtccattctctagccttctgaagaagatagattgtaatctttaattaagctatcactcacaccmaaaaaaaaaaaaaaaaaaaaaaaaaagcggggcaaggggttggagaatgttcatatcacattattttggatgtctggggttgcacctggaagctcagata

SEQ ID NO: 17317 - DNA, 201 bp, Homo sapiens
accacccttacatatcccagtgtatatggtagccaaggacagtactgtttgagcctcccccattaagtgtcaacattgaatcaatgcaatcccatgcaaasaaagctgagcatgggattgtgccggtttagccagctaaagtgtggtctctgatgctgatcatgactatgaaaagggaaaatggaggagaatgatgacgaa

SEQ ID NO: 17318 - DNA, 201 bp, Homo sapiens
gggtgtgagagtggcacattccacaggaagggaaccctgcatgtccatgtgccatgtgccatgtgccatcttagagacgtaaaaacactttgtatgtttgsggtacaactcagtaacccattggtgcagatatgtgattcttaggatggcccacatgggtctctttcacacacccacgtgcatgacccaagtgagcaaaca

SEQ ID NO: 17319 - DNA, 201 bp, Homo sapiens
tgttcgtctcagcctcccaaagtgctgggatgacaggcatgagccaccgcacgcagcgtattgctttatattttaagactatacactgatatccccgagcmcccaagttcctgtccgctggtagaattcacaaagctggttttatgtctccttctcttcctcttccagtgttgtcttttccctgcattgagatagcattgc

SEQ ID NO: 17320 - DNA, 201 bp, Homo sapiens
ctccaggctgtgtgacagagcaagaccccatctctaaataagtaaataaatgcctctgtgaatccatttcattgcattggaaagacctccaggattctctscagaagaatctttcccaacataaaatccattgttaatcacatttgacacacatgtgtgcccatgtctctgggcctgtgtccataggcatctacgtcactg

SEQ ID NO: 17321 - DNA, 201 bp, Homo sapiens
attttattttttttgagacagagtctctgtctccaggctggagtgcagtggcacaatctcagctcactgcaacctccacctcccgggttcaagcgattccmctgccctgatcagcttcctgagtagctgggactacaggtgcgcgctatcatgcctggctaattttttgtattttagtagagactgggttccaccatggtg

SEQ ID NO: 17322 - DNA, 201 bp, Homo sapiens
ttttttattttattttattttttttgagacagagtctctgtctccaggctggagtgcagtggcacaatctcagctcactgcaacctccacctcccgggttyaagcgattccactgccctgatcagcttcctgagtagctgggactacaggtgcgcgctatcatgcctggctaattttttgtattttagtagagactgggtt

SEQ ID NO: 17323 - DNA, 201 bp, Homo sapiens
aaatattctagtatttgccaaaactagaggatgaatgagtgatgggtaagagagttctcagaaaaatggatataaacaatattgtaaatcatatttggaarataaatactagaatcattgaatccctgagttatagaaaaatttattaatagcgctatctggctactttttaaagtgtggacatcctcgatgtattagcta

SEQ ID NO: 17324 - DNA, 201 bp, Homo sapiens
aaggctgcagtgaaccatgatggtgccactgcactccaggctgtgtgacagagcaagaccccatctctaaataagtaaataaatgcctctgtgaatccatytcattgcattggaaagacctccaggattctctgcagaagaatctttcccaacataaaatccattgttaatcacatttgacacacatgtgtgcccatgtct

SEQ ID NO: 17325 - DNA, 201 bp, Homo sapiens
gaactcgctggttctcgtcctcgccctcagcatacttgctcattgtttgtttccatctctatcatctctgtgagccctttgaggatggatgtgtgtccatsttgttaacagttggctccccagtaaccagtacagtgccagatacagagtagtaaccctacattctagcgtaggcaaatattctagtatttgccaaaacta

SEQ ID NO: 17326 - DNA, 201 bp, Homo sapiens
taacctcgatttgtgctccaggtctgagcagaaatgttattccctccagaaagccttccctggatgttgagggatgaagttgtagccccctcccgaatgcrtcctcagaactcgctggttctcgtcctcgccctcagcatacttgctcattgtttgtttccatctctatcatctctgtgagccctttgaggatggatgtgt

SEQ ID NO: 17327 - DNA, 201 bp, Homo sapiens
agactcactagaagtttcagaaagatgcagactgctttaaaaaaaaaaaaaaagggcaaggggaggtgtgagaagaaagtataattctttttcttctaackggagatataaaaatcatataagcatgatttatgatttgattggaacattgtattttatggttgcagagcacacgtatcatcctatctgcttctgacaccc

SEQ ID NO: 17328 - DNA, 201 bp, Homo sapiens
cctctcaaagatagacatggacatataaataattttttaaaatcctcttttgcaaaaaaaaaaaaaaaaagaggtgaatttagttgaaaggatatagccaytcttttctgaagtgatggggatattcgatggcaattttgtgttttcttcacttggaaaaactaaaaagtttgcaacatttaaaaaaaatacaacccttat

SEQ ID NO: 17329 - DNA, 201 bp, Homo sapiens
aatgtcagagccctaaatggtatgaaaaataggcaacttgggtcatgccactacagatcgacacccactaaatccttttaatttagtctagtgcaacaagkatttgtgtaagtgtcctctgccctggacaccggtgaggtcaccgtgggaatggctgggcaggaacaaagccttttgtttccagctgagtttccttttctg

SEQ ID NO: 17330 - DNA, 201 bp, Homo sapiens
taccaagtcatttggtttacatcgggaatgccttttgtcgttatgtctagacccctggagaacagcccacggcaatgcacttgtggaaattcggactgtgrattacactgagtaacaatcctaataatacctgcacacaatcagttgcctgtccaaaaagcaataaagaacctctagattttgtggtcaccatattaatca

SEQ ID NO: 17331 - DNA, 201 bp, Homo sapiens
cactggtgtgtggggtcataccaagtcatttggtttacatcgggaatgccttttgtcgttatgtctagacccctggagaacagcccacggcaatgcacttstggaaattcggactgtggattacactgagtaacaatcctaataatacctgcacacaatcagttgcctgtccaaaaagcaataaagaacctctagattttg

SEQ ID NO: 17332 - DNA, 201 bp, Homo sapiens
gacggtggaaagagaggactgctcctagcgtgagagtgtcagggaagcttgctgggggaaatacaaggaaggaagagaatgcaggcagctcaaaagagccsggcaaggagacctgcagagcgagcggaggcctggtttctgtgaagcacagggcaggaaaatccaaactcacttgagtacacgctcagggtcatgggcttg

SEQ ID NO: 17333 - DNA, 201 bp, Homo sapiens
ggaggcctcaggaaacttacagttatggcagaaggtgaaggggaagcaggtaatgtcttcacatggctggcactggaggaagagagaaagtagggaggtgstagatgcttttaaacaaacagatctcaggagaactctttcacaagacagcactagggggatggtgattagaaagcacctcatgatcccgtctacttcctg

SEQ ID NO: 17334 - DNA, 201 bp, Homo sapiens
agggaagagcagggatagaagtgggctccgggtctaggagacggtggaaagagaggactgctcctagcgtgagagtgtcagggaagcttgctgggggaaayacaaggaaggaagagaatgcaggcagctcaaaagagccgggcaaggagacctgcagagcgagcggaggcctggtttctgtgaagcacagggcaggaaaat

SEQ ID NO: 17335 - DNA, 201 bp, Homo sapiens
ccctgaggagcgggattcgctgacccatgctggcagaacgggtgatggatgaggcagagaagggtacaggctggctggaccatgcgatggggaatgcaggyggaacaggcttcctcctgaatcaggagtggaagaggagtctggggtgaagccaaggggaagacagttaagctttaaaaaaccaactgcccagccgggcgc

SEQ ID NO: 17336 - DNA, 201 bp, Homo sapiens
atttgatcctggagttgctgtaatggcaagaaaaaccatggcctccagccccagtgttgaagttttgacgctaatgtgatgataattctcttttctttgastggggacttgcctttgtttatctttttttgttgttttagccatgaaatatcacatgtaaatagccgaggatatctgggctctgagtctttaaaaggcaac

SEQ ID NO: 17337 - DNA, 201 bp, Homo sapiens
aacgcagaatgcagaggccatgcctgcagatcaggggtgctagaggataggcaagaagtaaagtggccaccctatctcgtgttgagagcatgctagtctcygaacggcctgccagggtgcctgacagccagagccacctaatgggcctatttgatcctggagttgctgtaatggcaagaaaaaccatggcctccagcccca

SEQ ID NO: 17338 - DNA, 201 bp, Homo sapiens
agagggagaggacagtaaccaataccgctccttctacatgatcagtgttcaggttgaagacaaacagggctccaattatgttgtgatttagaaggcgacaragctgagacctcaccctctgcttatgggctgcatgcctttctcagtgaaataacgcagaatgcagaggccatgcctgcagatcaggggtgctagaggata

SEQ ID NO: 17339 - DNA, 201 bp, Homo sapiens
aagcccacattttaaagggaatttggtatttttaacaaagcatcagggggccgggagcagtagctcacgcctgtaatgccagcactttgggaggccgaggygggcggatcacaagatcgggagatcgagaccattctggctaacatggtgaaatgctgtctctactaaaaatacaaaaagaaattagctgtgcgtggtggc

SEQ ID NO: 17340 - DNA, 201 bp, Homo sapiens
gacactggtctgcacaatgagtgtttttgtatatgaaccgaaaaacaggtagcaaaagcaaaaatagacaactgggattacaacaatctaaaaaatttctktacagaaaggaagcaatgaacagagtgaagcagcatcctacagaaagagagagaatatttgcaaaccacacatgtgataagggattaatattcaaaatgt

SEQ ID NO: 17341 - DNA, 201 bp, Homo sapiens
cttctgttaggtgtatctctgctcatgcttgagagtggtggtgtttggaaagactcaatagcatatgcacatgaggaagttgaccaaatgattccacagcrcatactcattttttgctctgattctagcttttcctccaattttattcagaatttgttcttttcttacctcacaccatatagaaaaatcaactcaaagtgg

SEQ ID NO: 17342 - DNA, 201 bp, Homo sapiens
ggcaggaagattgcttgagcctgggacgtcaaggctgcagtgaaccatgatggtgccactgcactccaggctgtgtgacagagcaagaccccatctctaartaagtaaataaatgcctctgtgaatccatttcattgcattggaaagacctccaggattctctgcagaagaatctttcccaacataaaatccattgttaat

SEQ ID NO: 17343 - DNA, 201 bp, Homo sapiens
actctgggaggccaagatgagaggatcacttgagcctagaagtttgagaccagtcagggcaatatagactacctgcaaaaagaaaaaaaaaaaaatgccakgtgtagtggtgtgcgcctgtagtcccagctactcagggggctgaggcaggaagattgcttgagcctgggacgtcaaggctgcagtgaaccatgatggtgc

SEQ ID NO: 17344 - DNA, 201 bp, Homo sapiens
aaaaaattgaggtgaaattcacataatataagattaaccatttcaaagtagacagttcaatagcagtacattcacaatggtgtgtaaataccgcatctathtatttccaaaatatttgtatctccccacaataaaagtctgtaccaattaagcagctactacccattcctcttccctaccattctaccttctgtctcagta

SEQ ID NO: 17345 - DNA, 201 bp, Homo sapiens
cttgtacttcttttaggctatttttccacctggtactatttggctttactgactgccctcattccccatacaccaccttgttttgttcagattcccctaartcttcattctcgtcccacctccccatcactcctgactacttgaaacacgacttctgtcctcagaaggcagcagtgttccctcctcccgttcatttttcat

SEQ ID NO: 17346 - DNA, 201 bp, Homo sapiens
aaatctcataatgttttaagaaagtttatgaatttgtgttgggccagattcaaagttgtcctgggccgcatgtggcccaccagccatggtttggacaagcytagtctacaggttcttcaagaggggcttgagcatttgaaagacttctagtgggagagatcacaaggtacaagtagaaaatcctgggctggcctgagaggc

SEQ ID NO: 17347 - DNA, 201 bp, Homo sapiens
tggctgcacataatatacaattgttgatgagctaaaaaaaaaaaaatccccaaaaaatctcataatgttttaagaaagtttatgaatttgtgttgggccasattcaaagttgtcctgggccgcatgtggcccaccagccatggtttggacaagcttagtctacaggttcttcaagaggggcttgagcatttgaaagacttc

SEQ ID NO: 17348 - DNA, 201 bp, Homo sapiens
ctgaattatggagttttagttttgctttagaatttttggatgattagacttgtacttcttttaggctatttttccacctggtactatttggctttactgamtgccctcattccccatacaccaccttgttttgttcagattcccctaagtcttcattctcgtcccacctccccatcactcctgactacttgaaacacgact

SEQ ID NO: 17349 - DNA, 201 bp, Homo sapiens
ccaaacttttggcttccctgggccacattggaagaaaaagaattgtctttggctgcacataatatacaattgttgatgagctaaaaaaaaaaaaatccccraaaaatctcataatgttttaagaaagtttatgaatttgtgttgggccagattcaaagttgtcctgggccgcatgtggcccaccagccatggtttggacaa

SEQ ID NO: 17350 - DNA, 201 bp, Homo sapiens
ataaacacatttatagttctcagagattccttgagagaggaacatctttaaatggataaccacagtcttctaaacacctgaaagggtgtcttttgctgaaytatggagttttagttttgctttagaatttttggatgattagacttgtacttcttttaggctatttttccacctggtactatttggctttactgactgccc

SEQ ID NO: 17351 - DNA, 201 bp, Homo sapiens
gtgtccaaacttttggcttccctgggccacattggaagaaaaagaattgtctttggctgcacataatatacaattgttgatgagctaaaaaaaaaaaaatycccaaaaaatctcataatgttttaagaaagtttatgaatttgtgttgggccagattcaaagttgtcctgggccgcatgtggcccaccagccatggtttgg

SEQ ID NO: 17352 - DNA, 201 bp, Homo sapiens
attatgccagattaagaaaatgaaatctgactgtaaattacttctctaggagcaaatgattgcttgattctattgtagaaaataaaaattttttacttaaaccacacaaattaaaaaatggaactcactttcacagtcaagagttacttctatttttttttacagtaaatgcgctctttaagatgttgcaagctcaattca

SEQ ID NO: 17353 - DNA, 201 bp, Homo sapiens
gagagagaaaaaaataattcctagatctagagttggtgtgaggctaaaataagctgcttttagtatcacatttggcaagtagtaaactctggataaatatrcttttgaattgtgtgattattgttgttaccatttattgaaagggaatgatgaatgtagtgagagaaggaaggaagagagagagggaagaaggggaaaaag

SEQ ID NO: 17354 - DNA, 201 bp, Homo sapiens
agagttgacggagaggggacaggaggtgactagatttggaaggaaaattagaaaacttttggccgggcatggtggctcatgcctgtaatcccagcactttygggtcagttgagtctaacataggggtgtccaaacttttggcttccctgggccacattggaagaaaaagaattgtctttggctgcacataatatacaattg

SEQ ID NO: 17355 - DNA, 201 bp, Homo sapiens
catgattcaattacctcccacctggtccctcctgcaacatgtgggaattcaagaagagatttgggtgggtacacagccaaaccatatcaaaaaccatttayaaaactctaagcagccttaaaggaaaccaccaagggaccaaggcctgatgaagcaagagtaggagggaacagatgcttggatagggcaggtgagtcacag

SEQ ID NO: 17356 - DNA, 201 bp, Homo sapiens
caggcaagaaagaacttgtgtagggaaactctcccttatgataccgtcagattccttgagacttatttgctattgtgagaacaccttgggaaagacctgcytccatgattcaattacctcccacctggtccctcctgcaacatgtgggaattcaagaagagatttgggtgggtacacagccaaaccatatcaaaaaccatt

SEQ ID NO: 17357 - DNA, 201 bp, Homo sapiens
ggcgacacagtgatggcagaaggtgaaaggcacatctcacatggcagcaggcaagaaagaacttgtgtagggaaactctcccttatgataccgtcagattycttgagacttatttgctattgtgagaacaccttgggaaagacctgcctccatgattcaattacctcccacctggtccctcctgcaacatgtgggaattca

SEQ ID NO: 17358 - DNA, 201 bp, Homo sapiens
gctggggaggcgacacagtgatggcagaaggtgaaaggcacatctcacatggcagcaggcaagaaagaacttgtgtagggaaactctcccttatgataccrtcagattccttgagacttatttgctattgtgagaacaccttgggaaagacctgcctccatgattcaattacctcccacctggtccctcctgcaacatgtg

SEQ ID NO: 17359 - DNA, 201 bp, Homo sapiens
gtggcagagggagaggacagtaaccaataccgctccttctacatgatcagtgttcaggttgaagacaaacagggctccaattatgttgtgatttagaaggygacagagctgagacctcaccctctgcttatgggctgcatgcctttctcagtgaaataacgcagaatgcagaggccatgcctgcagatcaggggtgctaga

SEQ ID NO: 17360 - DNA, 201 bp, Homo sapiens
agagtatgtgcgccttctttttggttaccctggaccagacattcctcagcactggcttgcattggcaggaggtggcagagggagaggacagtaaccaataycgctccttctacatgatcagtgttcaggttgaagacaaacagggctccaattatgttgtgatttagaaggcgacagagctgagacctcaccctctgctta

SEQ ID NO: 17361 - DNA, 201 bp, Homo sapiens
ttgaggttctttccaagtaaaggcgttattctttgtggtgtgctcctggaggtcactaacaaaacgtctccagcaggtgttgtgtggattcccccaaatcygtaggctcttatttcctagacatgaagagtatgtgcgccttctttttggttaccctggaccagacattcctcagcactggcttgcattggcaggaggtgg

SEQ ID NO: 17362 - DNA, 201 bp, Homo sapiens
aaacagccagctattctgatcatttgaaatctggaacattctttcctacggtggttgacttttcactgcctttgaggttctttccaagtaaaggcgttatyctttgtggtgtgctcctggaggtcactaacaaaacgtctccagcaggtgttgtgtggattcccccaaatccgtaggctcttatttcctagacatgaagag

SEQ ID NO: 17363 - DNA, 201 bp, Homo sapiens
ggagaccagactccaagttctggcctcacgttgcttggtatacatcactcagttctgttggcatggatgctcctcctataccccatcagccatcttgcagwatgggtttggtggatcacacagggattcagataagagggttcagatccttctatccatcaacccacccatccacatcactgaaaaagggactctcagatg

SEQ ID NO: 17364 - DNA, 201 bp, Homo sapiens
ctatatgatcatatgattttcctttagctttttgatatggtggactatattgattttaaatattgaaccagccttgaagacctggaataaatcccacttgstcatggcatatatgtttttttatacattgttggatacagtttgctaacattttgtggatagctcaccaacttttattcagaaaacatccgtctcagttta

SEQ ID NO: 17365 - DNA, 201 bp, Homo sapiens
gacttcttgtgcctgtagagtttattcatatcactctttgcttgctcagcagttgaaatgggatggaggaaagccccctaactccaaaaaaaaaaaaaaaactttcttcccagcctgagacagttgccataattagtaacctgcagctcccttgatatcttgatgatactttattaaaacaaacaaacaacaaaaaacaca

SEQ ID NO: 17366 - DNA, 201 bp, Homo sapiens
agaattggcaggaagggcacaggggcaaggtataggctcacgtctccacattctgcacctcccaggctcctgccattgatgtgagcgggttcctgtactgyatgaagcaggggtttgcatccgaaacaaccacccgtgctgaatatgtaggtgatacgttgatctgtacagcaaaccaccatggcacacatttacctatgt

SEQ ID NO: 17367 - DNA, 201 bp, Homo sapiens
taagatctgtctgcactccttttgtctggcctgtacctgccttttctgaatgaccctgttaattgcaattgactctcatagaatgtggatagcagtgccasttgacaccagactaatgcttctgacttttccatggtgccccagcagcaggctggagggaagggcgggggcggtcagaggagagatagagcacttcagatt

SEQ ID NO: 17368 - DNA, 201 bp, Homo sapiens
agatacccagccaatggtccacagtgatgtaactcatcagtggtccacctgacattggaaattcggttgctttggaaccttctactacatcccctttccttactcactgacatcattcccagatcaaagaaagataaaagaaggaagggctggagacgttgttttcctgtatgctccttgatgaagggctcagagctaagc

SEQ ID NO: 17369 - DNA, 201 bp, Homo sapiens
acatatcagtcattttttgaggaaaataaatttaaggcttggttatcggtccttgagtcagcacattgagcgttttgtcaattagctcctccccccatctktatggtatggcttttcctgtaattacagtcaagatcctatagccggaggaaggcctgtcaattgagtaagaggctgatgttcatcgcacagtgacagccc

SEQ ID NO: 17370 - DNA, 201 bp, Homo sapiens
ggacaacatatcagtcattttttgaggaaaataaatttaaggcttggttatcggtccttgagtcagcacattgagcgttttgtcaattagctcctcccccmatctgtatggtatggcttttcctgtaattacagtcaagatcctatagccggaggaaggcctgtcaattgagtaagaggctgatgttcatcgcacagtgac

SEQ ID NO: 17371 - DNA, 201 bp, Homo sapiens
aggtaccttggaaagactgcatctcctggattttgcatggttctggcttaatggacaacatatcagtcattttttgaggaaaataaatttaaggcttggtyatcggtccttgagtcagcacattgagcgttttgtcaattagctcctccccccatctgtatggtatggcttttcctgtaattacagtcaagatcctatagc

SEQ ID NO: 17372 - DNA, 201 bp, Homo sapiens
ctaaattatgccagattaagaaaatgaaatctgactgtaaattacttctctaggagcaaatgattgcttgattctattgtagaaaataaaaattttttacytaaaccacacaaattaaaaaatggaactcactttcacagtcaagagttacttctatttttttttacagtaaatgcgctctttaagatgttgcaagctcaa

SEQ ID NO: 17373 - DNA, 201 bp, Homo sapiens
ctagggtgttgataagaaacagcaggcatagttactgggtgattgagaagagtttaacaaaagactatattagtctgttttcatgctactgataaaggcayacccaatactaggtcatttacaaaagaaaaaggtttattggacttacagttccttgtggctggggaggcgacacagtgatggcagaaggtgaaaggcaca

SEQ ID NO: 17374 - DNA, 201 bp, Homo sapiens
tagctagggtgttgataagaaacagcaggcatagttactgggtgattgagaagagtttaacaaaagactatattagtctgttttcatgctactgataaagrcatacccaatactaggtcatttacaaaagaaaaaggtttattggacttacagttccttgtggctggggaggcgacacagtgatggcagaaggtgaaaggc

SEQ ID NO: 17375 - DNA, 201 bp, Homo sapiens
ggattgatactagctagggtgttgataagaaacagcaggcatagttactgggtgattgagaagagtttaacaaaagactatattagtctgttttcatgctwctgataaaggcatacccaatactaggtcatttacaaaagaaaaaggtttattggacttacagttccttgtggctggggaggcgacacagtgatggcagaa

SEQ ID NO: 17376 - DNA, 201 bp, Homo sapiens
ctttctgttataaaatcatgtttttattgaattacattttaatattggtatcactttaaaatgaaaatgagtacttgcaaaatgtatttttgaaggagttkggtggtggtggggggatgccattttggcaacagatgacttcggttcaagtcctctctctgtctcttacttgctttgtggctttagaccagccacccactc

SEQ ID NO: 17377 - DNA, 201 bp, Homo sapiens
ttttttttctttttcccttatgcatttgggagtggaagagctgtcagattctgaatttagttagatttataatgctagagacattcagcagtctgcctttycctttctgttataaaatcatgtttttattgaattacattttaatattggtatcactttaaaatgaaaatgagtacttgcaaaatgtatttttgaaggagt

SEQ ID NO: 17378 - DNA, 201 bp, Homo sapiens
ctacaataactttttcagtctctttctccctttcccaccttcccaaaagggtgggaaatttttaaagtaaagtaataaacaaataagttttgggttgggcrggagattagttagagacaggatctgtaggtcagaagtggtatttgggggagtagggagttttttttttttttctttttcccttatgcatttgggagtgga

SEQ ID NO: 17379 - DNA, 201 bp, Homo sapiens
gcacaactgaactccagcctgggcgacagaggaagactctgtctcaaaataaacaaacaaataaataaataaaaattgtttaaacctgccaactacaatawctttttcagtctctttctccctttcccaccttcccaaaagggtgggaaatttttaaagtaaagtaataaacaaataagttttgggttgggcgggagatta

SEQ ID NO: 17380 - DNA, 201 bp, Homo sapiens
tttttgatttggtttggttctttggagttgtttgcatttcgtgagtcttggcatctttttggtagagaaccttgctaggttctcacaatgtagaaattaarcagaaaacagaggtctcaatttgccttttcagcgtgaatgcagactcttacattcagtgctgggagtctttcttgagggacagtgagagcgaggaagggt

SEQ ID NO: 17381 - DNA, 201 bp, Homo sapiens
tactaagaaacttttgaaaatgataatgggtgtgtactttttatcaactgctttttgtatgccaatctatatgatcatatgattttcctttagctttttgrtatggtggactatattgattttaaatattgaaccagccttgaagacctggaataaatcccacttggtcatggcatatatgtttttttatacattgttgga

SEQ ID NO: 17382 - DNA, 201 bp, Homo sapiens
gattcttctcaattcctaaattactaagaaacttttgaaaatgataatgggtgtgtactttttatcaactgctttttgtatgccaatctatatgatcatawgattttcctttagctttttgatatggtggactatattgattttaaatattgaaccagccttgaagacctggaataaatcccacttggtcatggcatatat

SEQ ID NO: 17383 - DNA, 201 bp, Homo sapiens
tttatttttgtttgtatttgttagtttttttgagatttcttgggattttctatctagcctgtcatgtcatatgcaaatagagaattttatttcttcctttrtaatatgtgtgccctttttttattgccttattgtagtggctagaacttcctgtgctatgttgaacaagagtagtgagaacatccttgccttgctcctgat

SEQ ID NO: 17384 - DNA, 201 bp, Homo sapiens
gttttttatttttgtttgtatttgttagtttttttgagatttcttgggattttctatctagcctgtcatgtcatatgcaaatagagaattttatttcttcytttataatatgtgtgccctttttttattgccttattgtagtggctagaacttcctgtgctatgttgaacaagagtagtgagaacatccttgccttgctcc

SEQ ID NO: 17385 - DNA, 201 bp, Homo sapiens
gcctatcatataggaatgatagaggcagcacagtgctgtaatggaaaccataagggcacgcacaatggctcatgcctgtaatcccagcactttgggaggcmgaggcgggaggatcacataagaccaggagtttgagaccagcctggccaacatggtgaaaccccatctctactaaaactacaaaaatagccaggtgtcctg

SEQ ID NO: 17386 - DNA, 201 bp, Homo sapiens
cataagaccaggagtttgagaccagcctggccaacatggtgaaaccccatctctactaaaactacaaaaatagccaggtgtcctggtgcatgtctgtaatyccagctacctgggaggctgaagcatcagaatcgcttcagcttgggagctggagcttgcagccagccaagatcacaccactgctctctatcctgggagaca

SEQ ID NO: 17387 - DNA, 201 bp, Homo sapiens
ttctttggagcgattgtaaatggcattgtgtttttaattccaacttctacatatatctagaaatatgattgagttttgtgtgttgatcttgatcctatgascttgctgattgcatttattataaagttccaggagttttttatttttgtttgtatttgttagtttttttgagatttcttgggattttctatctagcctgtc

SEQ ID NO: 17388 - DNA, 201 bp, Homo sapiens
tgggtatctttctggcttctttattccactgatctatgtgtctgtctctctgacaattatacgctgtcttcattactatagctatgtagtaagcctcatgycaggtagagtgattcttctcactgtattcttttttattaagattattttagcttcctaagacctgtgctttttcatataaattgtacaatatggttgtct

SEQ ID NO: 17389 - DNA, 201 bp, Homo sapiens
gcctaggaacatctcattgttttagcaccatttgctgaaaatgatcttcctccagagaatttttttacctttattcaaaatgaattgagcatgtttgtgtrggtatctttctggcttctttattccactgatctatgtgtctgtctctctgacaattatacgctgtcttcattactatagctatgtagtaagcctcatgtc

SEQ ID NO: 17390 - DNA, 201 bp, Homo sapiens
tgaactcctggcctcaaagcgatcctcctgtctcagcctcccaaagtgtggagattacaggcatgagccactgcacacagccaaggtcagctttttcactycagcacaccaggattttcatcccagctctccaatcccccagctgtgtgggcctggtcaacctgtttagcctgtcaagacttcagtcccttcaactgatag

SEQ ID NO: 17391 - DNA, 201 bp, Homo sapiens
tacaaaaactgttaccgcctaacacattaaatgtatttaaattatttgttctattaaaatgtcagtgtatttcttgaattttaactgtgcctgaagatcartcattgtaacagctgcagggaaggctttatgacttacctgaacggtggtgtattctgtggctcggctaagtggattcttcgactttaatagattttacta

SEQ ID NO: 17392 - DNA, 201 bp, Homo sapiens
caaggtgttgatagaaccccttagtgtcctcctcataccacagacactctcttcccccacttacttggccaattttttttttttttttttttttttttggkggagtctcgttctgtctcccaggctggagtgcaatggtgcgatctcagctccctgcaacctctgcctcccatattcaagggattctcctgcctcagcctc

SEQ ID NO: 17393 - DNA, 201 bp, Homo sapiens
gaaatgacagtgattggaggtggtttatttttttttaagtctgcttactcggaaaaataaaacaaagttgacaacctgatttcagacctcccaattttttsttaaaaaaaataaaagtcttcttggtccatgaaatccagaaactggagaccaaactagcaaattcgcaaggagctgcttgatagaaaaacacttgagatc

SEQ ID NO: 17394 - DNA, 201 bp, Homo sapiens
tggatggtttaataaataagattgatacaaacacaaagcattaagcaaacaaaaggaaataaaaacggcaacaaataaaacttctgtgctttttgaaattytgtttttggcaggcaacattccaaagatctttttcatttaaagtccaggagtcttctgtgtgaaccccacacaggtaccttggaaagactgcatctcctg

SEQ ID NO: 17395 - DNA, 201 bp, Homo sapiens
attattccttaaacaatccaacataaccactatttatatcgtgtttatattgtattaggtattataagtaatctagagatgatttaaagtgtacaggagcrtcacatacattatatgcaaatactatacaattttatgttagggacttgagcatttgtggattttggtatttgggggggttccttgaaccagtcccctttg

SEQ ID NO: 17396 - DNA, 201 bp, Homo sapiens
tgatgtaggaatgaacagatgaacaaccccacacaacctaaggacaactttgaatcaattcttctaagctggtagcagaagccacctttccatttgacttstatctcgctctttttttctttcttttttttttttttggagacagagtctcactctgttgcctagactagagtgcagtggtatgatctcagctcactgcca

SEQ ID NO: 17397 - DNA, 201 bp, Homo sapiens
gtgtgactaatattagaagcagacacagccatgatgagcaatactctttttttgtttatttttgttgttactgctgtaagccactttcttctccctctccrttaaaatgcaacttaattggtaaagtttagttgactagagatttcatttatttatttatttatttatttatttatttatttgtttgtttgtttgtttgag

SEQ ID NO: 17398 - DNA, 201 bp, Homo sapiens
cttgataaaggttggggtttgtaagcttggggctcctcagccatgactgaaacgtactatgagcacggcatctaccgggctgttccacatcctccctgtgkgactaggggccagggcaatgggaatcagtgcagaaataaagctcatgctgtttgctctgccatgagtaacgaagtcctctgtatctgatcctgggtctcc

SEQ ID NO: 17399 - DNA, 201 bp, Homo sapiens
acagttgtattcctaagacatagttgggaccagacctcaagaaaatagccaacaaatactgggtgaatgaacgaaagaggccatatgcagtcagcccccctctctctgggttctacatatgtagatttaactaatgacagattaaaagcattcgaacaaacggagggtggtatctgtactgaaaatgtaccaactgctttt

SEQ ID NO: 17400 - DNA, 201 bp, Homo sapiens
cctgcaattctttgtacatatgaaatttaatatggtgagattggcatctagctgctgctagagatagtgctcataataatttttaacattgattgagtgtrgataataatccaggagctgtgctaaacgttttacaacacattatctcacttaatttcacaactccataaagtagttttcacttagttgagggatgaaaaa

SEQ ID NO: 17401 - DNA, 201 bp, Homo sapiens
ctgcctcctgtccctatcattgatacctgcaattctttgtacatatgaaatttaatatggtgagattggcatctagctgctgctagagatagtgctcatartaatttttaacattgattgagtgtggataataatccaggagctgtgctaaacgttttacaacacattatctcacttaatttcacaactccataaagtagt

SEQ ID NO: 17402 - DNA, 201 bp, Homo sapiens
ctggcaggggatgcccgtgacccctgaaaccctaaaaggagtgttacagtcagtgctcttttagttttgccatccacggacggcttaagtgttaacagttsagtggagggtcagcgtgacagccttttgcacccacatctgggttcttgtccagtgtccaggaggaatgaggtctcatgagcaaattttaaggatggcaaa

SEQ ID NO: 17403 - DNA, 201 bp, Homo sapiens
aagtatcacttatcctacgttccatgtaagatctctttcctagggtaaacttgatatggaaggtcttcacagattaaaacgaaggaaaaaaaaaaaaaaaactagataaatctccctggacatgaacttttgtagaagtagttacaatgctagtgacctcatatactcatggtaacggcttccggcatccaatgaccttgc

SEQ ID NO: 17404 - DNA, 201 bp, Homo sapiens
tgaagcaggaaatttccctgacccctttgcaggcaggaagtggagtgcggatgctggaactagctggctgctttggtgccagtagaggtgaactgcactcwcttgaaccccctgcactccaccccttctgggaggaagcatgcaggtgagcaggtgcaggagccagggtaaatgcttttgggcactggcaggaatgaactc

SEQ ID NO: 17405 - DNA, 201 bp, Homo sapiens
cttaatctcccttttccatgggcccaacacctgaatctagggcaaacaggtgtcccccagattggatcctctgctctaggacacattcttgtcctagagcrggttgggcaagaggcttttctctcagtcaccagccccaaaccctgtggtcttgccagcccaggacgtgtcaagactgcagcctttgctgacctgtgacca

SEQ ID NO: 17406 - DNA, 201 bp, Homo sapiens
tataattttgatgaaagaagtttcccaacagtatttcggtgtgcatgctcacacaccagccctggtcgtcagtgaacagattcttccaggtcttcattgtrgcggaagaaagtgagatcagagatcccgaggaagggcttcagtttcaccagtagtggagctagggagtaggggggcagaagccgcaggaagtcagtgcag

SEQ ID NO: 17407 - DNA, 201 bp, Homo sapiens
tgcttctgacacccagtaagcagctctggcttttataattttgatgaaagaagtttcccaacagtatttcggtgtgcatgctcacacaccagccctggtcrtcagtgaacagattcttccaggtcttcattgtggcggaagaaagtgagatcagagatcccgaggaagggcttcagtttcaccagtagtggagctagggag

SEQ ID NO: 17408 - DNA, 201 bp, Homo sapiens
gattggaacattgtattttatggttgcagagcacacgtatcatcctatctgcttctgacacccagtaagcagctctggcttttataattttgatgaaagargtttcccaacagtatttcggtgtgcatgctcacacaccagccctggtcgtcagtgaacagattcttccaggtcttcattgtggcggaagaaagtgagatc

SEQ ID NO: 17409 - DNA, 201 bp, Homo sapiens
ccaacctttttgctggctctctttcaaactgtactgctcactttgggctgtacgttagaaccacctgagaagttctttttctttcttttttttttttgagrtggagtcttcctctgtcacccaggctggagtgcagtggtgggatcttggctcactgcaacctctgtctcctggcttcatgccattctcctgcctcagcct

SEQ ID NO: 17410 - DNA, 201 bp, Homo sapiens
ggctgcagcagtgtctaggtatctgtgaatgtgtaagaaattgagacagcctgcaaaatagctcacccagcttttctttaaagttccaacctttttgctgsctctctttcaaactgtactgctcactttgggctgtacgttagaaccacctgagaagttctttttctttcttttttttttttgaggtggagtcttcctctg

SEQ ID NO: 17411 - DNA, 201 bp, Homo sapiens
tttgggaagttcccaaatctgtcagtatatattacaaaaactgttaccgcctaacacattaaatgtatttaaattatttgttctattaaaatgtcagtgtmtttcttgaattttaactgtgcctgaagatcaatcattgtaacagctgcagggaaggctttatgacttacctgaacggtggtgtattctgtggctcggcta

SEQ ID NO: 17412 - DNA, 201 bp, Homo sapiens
tgtgggcccttctctttcctcgtgatgcacggtgatagtgcgtatctaacacttgaaggtgtccacgctggccctagctcagtgagatggctttgctttgsgggggtgagggggcggaggtggtggaaaggcagcaagctacgatgttcttatgtgtgtggccttgcttctggtggtggggtggcacacatgctctgtagt

SEQ ID NO: 17413 - DNA, 201 bp, Homo sapiens
catctgggaagaggtaacattgatcttaattgttattagagagaattttcaatttcagttgtagcatgaaaaatcacagagtccatttatttctcctcttygagtcagtatatctcaaaacattttttcaacgttaatagaaatataagaagtgcctggatcagtttttgtttttgttttgtttctttttgagatagggtc

SEQ ID NO: 17414 - DNA, 201 bp, Homo sapiens
aacacatgacagtttcttgttcatatttggccagaaggaagcagtgtccattaggttgactctccagtgcttcttggtgttgtgataagcccgtctagcayggagggccagaaggaagcagtgtccattaggatgactctccattgcttcttggtgttgtgataagcccgtctagcacggagggccagaaggaagcagtgt

SEQ ID NO: 17415 - DNA, 201 bp, Homo sapiens
cctttgtttttgttgtcatcgttttatgattaacttatatctggtcctttagacatttagattttttctgttttatctctctctctctatatgtatatctrtatatatatttatctatatctatatagatatatatatatatatataaaataatgaatgaaatggactgtttgcaacctcagatgtatttctaggacttag

SEQ ID NO: 17416 - DNA, 201 bp, Homo sapiens
cgtggtcacttgcttgcacacacttgtttagatgtctctgccctgctgttaattagactgtgagcctccagagggtgagactgacatctcatttctctttkcagtcacagcagagatgcaggcccacagtagggactcaccagatgtggcagggtgagggaattgtccatagatgccttaaagatatgctatccacaggag

SEQ ID NO: 17417 - DNA, 201 bp, Homo sapiens
ttggaacaactgcctcactcctgtggccccactgtgccatagacaggttagagaacatgggccctggcatcagacctggcaggcagtcttgattaggcccsttattagggtgctctgggcaagtaagtttacctgtgccagggatgcacctttttaacccaacacttagaggggtcctccatgtacagccatgatcacaac

SEQ ID NO: 17418 - DNA, 201 bp, Homo sapiens
ccttgtgattgaaagcccaagccctgtgatccacagcaggggccacagccagaaataattccccgagaatactgcgtgtgccttcaaatggtccttgatcrtttttcttggatgccccactttccaaaggccagaaattgtttcagggagtcattccagttggggaaggttttatgttctaagagcaaggtgctgtactca

SEQ ID NO: 17419 - DNA, 201 bp, Homo sapiens
ggtaaaaataattctagatgaagatagacccgtttacattccaaggaagggaaatgttttacccaaactgtttccatggaccctgtgggttcttgttaatrctgttcaaccttgtgattgaaagcccaagccctgtgatccacagcaggggccacagccagaaataattccccgagaatactgcgtgtgccttcaaatggt

SEQ ID NO: 17420 - DNA, 201 bp, Homo sapiens
ggccctgatgtcacttcttaggctaatttctgtgaaattgtgattgggaggaaaaagtgaacaggaacttaaagccagcagaggaaagctacctgcccttsactggtggtcagtgcatggattccagagacagggtgggcaccagttcctcaccgggtcctttctagttgcatgacctggggcaggtgactttatgtggct

SEQ ID NO: 17421 - DNA, 201 bp, Homo sapiens
ggtcttctgaagtataggaaaaggcagcttacagaaaaaaacttgcttgtttactgtcttctgagctgatttctcacctactggcaagtggataggtctastttttgtttagctgtttttctaatttaatcttgtacatgagacagctatagatggatgtatagtctttgaagtggggccagttggctccgtctattagct

SEQ ID NO: 17422 - DNA, 201 bp, Homo sapiens
tagtgttggcaaaaggcttgcaatttattattaagtggaataagcagtttaaaaacagtatgtacagggtggttttctggctatataaacacacaggcatwgaaaatagatatacataaataatgttactataatttgtctgcctcccttctctcagaaaagaccaatgaattatctattatgtgccactcactatttgag

SEQ ID NO: 17423 - DNA, 201 bp, Homo sapiens
tttttctccttggcaggttttcactattaatttgcttgacaaaggatagatacattttccatgtgtggaggtaaaagcagtgcagtgagctaaaaagttarcaaaggtgaagtggtcctaatctgcggccctggtacacttagataggcatcattgcctttcctctgagctcttggtgctgataacagcttccttgaccga

SEQ ID NO: 17424 - DNA, 201 bp, Homo sapiens
gctaagttacagcaggtgaacttgaatttgaggaaagacaaagcaaaccctggctattaaaggaacacacacacacacatacacacacacacacacacacmcgtttctggtattaggaaatggagatttctaacataataaaaaagattgaacttaaaaatgacttccattaaatagggtaagaattttgaggtggaatcc

SEQ ID NO: 17425 - DNA, 201 bp, Homo sapiens
gcaccactgctcgcattcccatgttggagttttccctttggggttcttatgccattttaaagactctgaaaacaggaagactttttctcttgggtattttwttttttttttcctctgcaagggatggggtcataagacattggtgaggttaggccttcctttgtctcccaggagcacacttgatagcaatgtagggtgaat

SEQ ID NO: 17426 - DNA, 201 bp, Homo sapiens
agaaagtataattctttttcttctaactggagatataaaaatcatataagcatgatttatgatttgattggaacattgtattttatggttgcagagcacaygtatcatcctatctgcttctgacacccagtaagcagctctggcttttataattttgatgaaagaagtttcccaacagtatttcggtgtgcatgctcacac

SEQ ID NO: 17427 - DNA, 201 bp, Homo sapiens
ccccccccagcttccccacctgtaaaatgatttgctcaaagtttgcaaagaatggaggcatattcaaagtgctcagcactgggccggacccatgggtatgmattcataatgatcagcttcattctctccctttccctctctctccacacctttccattcctcctaactaatgtgggagagaagagaaaattacagtgagag

SEQ ID NO: 17428 - DNA, 201 bp, Homo sapiens
gctttaaaaaaaaaaaaaaagggcaaggggaggtgtgagaagaaagtataattctttttcttctaactggagatataaaaatcatataagcatgatttatsatttgattggaacattgtattttatggttgcagagcacacgtatcatcctatctgcttctgacacccagtaagcagctctggcttttataattttgatga

SEQ ID NO: 17429 - DNA, 201 bp, Homo sapiens
atcttggcagatacttagctgaattccatcgatttagtgataaaatgggaacagtagtaatggtgcagattagagaaaaaaatgtgatttgtgcattcatwtgtctgtgtgtacatatatgtatatgttctgtgtatatgtagacatgtatagatgcatgtgtgtacgtatacacgcacacatacataaattgtgtacata

SEQ ID NO: 17430 - DNA, 201 bp, Homo sapiens
gattaaatacaatgatgtaacctacttgaaagtgtcatataaattctgaggtgaagtggaggcattatggatgcattttattttgttttattttatttcayttattctttttttgaagaggtatgggtcaagcagatctgcagcccacactcggctcactgatcacgtcccatacaatcttggcagatacttagctgaatt

SEQ ID NO: 17431 - DNA, 201 bp, Homo sapiens
agctgcaggatcacttgctttagatggaatcacccagcggatggcgtttaactctgctttaaaccccttcatggcttcccaccacacttacaaatacaactccttatcctgtcagcaggggcttgcttaatctgaccctttccacatatgctggatcacttcacgcctccctgttctttcaattccttgaacacaccaagt

SEQ ID NO: 17432 - DNA, 201 bp, Homo sapiens
gcagctgcaggatcacttgctttagatggaatcacccagcggatggcgtttaactctgctttaaaccccttcatggcttcccaccacacttacaaatacatctccttatcctgtcagcaggggcttgcttaatctgaccctttccacatatgctggatcacttcacgcctccctgttctttcaattccttgaacacaccaa

SEQ ID NO: 17433 - DNA, 201 bp, Homo sapiens
tacgtttttctattttgtctgaactagccaaggtctctggagtttgctgttatattgcttcagagaaattagtgacattgaaaggctgttgtcttttttaktgtacttttggttgttaggagaaatttacaaggccatttttttctcccgtctctgcagttcaggagattatattagaaaatattctatacaaaaaatatg

SEQ ID NO: 17434 - DNA, 201 bp, Homo sapiens
acaaagcatcagggggccgggagcagtagctcacgcctgtaatgccagcactttgggaggccgaggcgggcggatcacaagatcgggagatcgagaccatyctggctaacatggtgaaatgctgtctctactaaaaatacaaaaagaaattagctgtgcgtggtggcgggcgcctgtagtcccagctactcgggaggctga

SEQ ID NO: 17435 - DNA, 201 bp, Homo sapiens
tccatgacactggtctgcacaatgagtgtttttgtatatgaaccgaaaaacaggtagcaaaagcaaaaatagacaactgggattacaacaatctaaaaaayttctgtacagaaaggaagcaatgaacagagtgaagcagcatcctacagaaagagagagaatatttgcaaaccacacatgtgataagggattaatattcaa

SEQ ID NO: 17436 - DNA, 201 bp, Homo sapiens
acagtgtaaaattagtagaagaaaacaaggaggaaagctccatgacactggtctgcacaatgagtgtttttgtatatgaaccgaaaaacaggtagcaaaarcaaaaatagacaactgggattacaacaatctaaaaaatttctgtacagaaaggaagcaatgaacagagtgaagcagcatcctacagaaagagagagaata

SEQ ID NO: 17437 - DNA, 201 bp, Homo sapiens
tgaagggacttggggctcagagaaatgaagtaactcagctaagtctgtacagtacttagccaggggatttagaaatccacccagggatggctccagttgcmtgtttcttttcatttgacacgggatggcctaatgggtccccaccaggggtggcttggaaaggagaaagcaactgcattcccactggaaggtgttctgtag

SEQ ID NO: 17438 - DNA, 201 bp, Homo sapiens
aagtcctcaagaagaaaaatttaaggagcaaatatgtgagccaggatctcatgctggactatctaagcaagcatgtaggaagagtttgtttcttcctgctrtggccatagaggtttggttgtcactatgaagaatgggcctgtgtttttttttaaaaatatgctgatctgggtgaggtcacattttgctattctcagtgga

SEQ ID NO: 17439 - DNA, 201 bp, Homo sapiens
tttatgattaacttatatctggtcctttagacatttagattttttctgttttatctctctctctctatatgtatatctgtatatatatttatctatatctrtatagatatatatatatatatataaaataatgaatgaaatggactgtttgcaacctcagatgtatttctaggacttagagtgattagcttgaggcgatgg

SEQ ID NO: 17440 - DNA, 201 bp, Homo sapiens
aagaaaaataaaacgtggtgaacgcccatgattgcaactaggagactgttatgcttatggttgttaagattagaaagaaggaagctttaaccctatctctratttcttacttttctctgtctatgtagaagttgatgttgatacgtgtctacataaatatttactaagggcttgcattagtcttgggaccaaggatatagt

SEQ ID NO: 17441 - DNA, 201 bp, Homo sapiens
agaaggaagctttaaccctatctctgatttcttacttttctctgtctatgtagaagttgatgttgatacgtgtctacataaatatttactaagggcttgcmttagtcttgggaccaaggatatagtattaaacgaaacagaatccctgccctcataggcttaccttctaggtaggaaaaatagaccataatcaagtttaat

SEQ ID NO: 17442 - DNA, 201 bp, Homo sapiens
gtcttaacttttcaaaaacaggacatgggtgatcaagcagcagtatatctctttactccttgtattagtccattttcacactgcttgataaaaacataccstagcctgggaagaaaaatcggtttaatggacttacagttccatattgctggggaagccttacaatcatggtggaaggcaaggaggagcaagtcacgtctt

SEQ ID NO: 17443 - DNA, 201 bp, Homo sapiens
gttaaagtcacactggaaggatatatattgaggctttatctctgccatggtgtcagcatcagtgaattaacacagggtgtcttaacttttcaaaaacaggrcatgggtgatcaagcagcagtatatctctttactccttgtattagtccattttcacactgcttgataaaaacataccctagcctgggaagaaaaatcggt

SEQ ID NO: 17444 - DNA, 201 bp, Homo sapiens
ctgcgggtgtgtgagccaagggggccctgtgacccttgaaatagaaaagggggaaatggctgcatgccaaccgaagagaccactgcattgttggccataartgaaactagtgagatgtgtgggatatcataaaaagaacattgacataatccttttttggatgaagttatatcacaaccagaacacacaatgaccagcagg

SEQ ID NO: 17445 - DNA, 201 bp, Homo sapiens
aacaaagagagatcctgtctccaagtctgtctgtctgtctgtctgtctgtctgtctctctcggaaatattccttcagtgtattagtaaagaagttacttakgagtcacttatgcccttgaagagtgagtgatgtatcaaaatatgtctgtctttattgtttcactttcatccttctttttttggagatggagtcttgctct

SEQ ID NO: 17446 - DNA, 201 bp, Homo sapiens
gttttctattctgggcctccctgcttccagcgatagcaaggagcgaaatgagatgctgtctaagaaaggaaggtgctgcgatctttgattactacacagcytcggcagtgtttgtatgattaatgagtccatgtttcagacgttcccatttaatgtatttgagccttctaacaacattgcctttcatatgttgctgactgt

SEQ ID NO: 17447 - DNA, 201 bp, Homo sapiens
atcccctttgcaaaagtaagaattgtatcgtagcctgactcagggttttagccaacttctctggatgctaatgctattctcttctttatacttgtcttccytcccaggcacacatccactggagctttgcagggcctatctgcccttagccctccaatatccttttcattttctttaatagttttattgatatataatgtg

SEQ ID NO: 17448 - DNA, 201 bp, Homo sapiens
taagagacctcttctcaacaggatccatgtttgatccgggggaataaagctagagttgctttcttccttgtaatatgtataatgactcatgagagaattcyccactgtcttccccacctgagacctgagaggaggagaaggaagcttggagtcgctgccctgtggcctgaattggtcagtgaccaatcactcagacccagc

SEQ ID NO: 17449 - DNA, 201 bp, Homo sapiens
cttgagcccaggaggcagaggttgcagtgagccgacattgcaccactgcaccccagcctgggccacacagagaaaccttgtatccaaaaaaaaaaaaaaaaagtgaccacactgtggctttgctgctttgcctaagtatttcgtgaaattgatcgttcattcacaatgctcagtgcagtgactttgccgagcacaagtggt

SEQ ID NO: 17450 - DNA, 201 bp, Homo sapiens
gctctcacagttagaaaacagtgagccttggtcaagtctcataaactgtgtctcagttttttcatttatacaatggccaaaaaaaaaaaaaagaaagaaascacaaaaccataccttctttgcagggttgtgtaaaggaaggttgaactagaataggttgaagtcaatcacatctctaaggcatttggcatgtagtggaac

SEQ ID NO: 17451 - DNA, 201 bp, Homo sapiens
cactcttagctctcacagttagaaaacagtgagccttggtcaagtctcataaactgtgtctcagttttttcatttatacaatggccaaaaaaaaaaaaaagaaagaaaccacaaaaccataccttctttgcagggttgtgtaaaggaaggttgaactagaataggttgaagtcaatcacatctctaaggcatttggcatgt

SEQ ID NO: 17452 - DNA, 201 bp, Homo sapiens
taccagtggtgcctagcatggtgtcaggtttatagaggactaatacatataagaaggagaaagggagggaggaggaattccagttgttttttttttaatctaggtacaagtctctctgttgatttctaaacatcgaatgaagatgaaggaaatacttaaagcacctaagcactcataactcacttagtcatttcactatta

SEQ ID NO: 17453 - DNA, 201 bp, Homo sapiens
cactgcagtcttgacctcccaggctcaagcaatcctctggcctcagcctcccaagtagctgggactattggcaatgccaccatgttcggctaatgtttttrattttttatagagacaaggtttccctatgttgcccaggctggtctggaactcctgtgctcaagccatcctcccacctcagtctcacaaagtgctgggatt

SEQ ID NO: 17454 - DNA, 201 bp, Homo sapiens
gcagtgagccaagatggtgccactgcactccagcctgggtgacaaaaaaaaaactttacctgggcttagtaagttgcctgacttctcatcctggagttcgkatccccttgtttctagaagagaaatccctcagatgtgaaggtgtgttccatgattttgtcgaacttgccctacatactgttttattatatattctgccca

SEQ ID NO: 17455 - DNA, 201 bp, Homo sapiens
gccctactgcactccagcctgagcgtgagactctgactcaaaaaaaaaaaaaaaaaaattagctgggcgtagtggcaggtgcctgtaatcacagctatccrgaggctgaggcaccagaactgcctgaacctgggaggcggaggttgcagtgagccaagatggtgccactgcactccagcctgggtgacaaaaaaaaaactt

SEQ ID NO: 17456 - DNA, 201 bp, Homo sapiens
atttccatgttctccgcacagtgcggagctactgcgggtgtgtgagccaagggggccctgtgacccttgaaatagaaaagggggaaatggctgcatgccarccgaagagaccactgcattgttggccataagtgaaactagtgagatgtgtgggatatcataaaaagaacattgacataatccttttttggatgaagttat

SEQ ID NO: 17457 - DNA, 201 bp, Homo sapiens
agatgcagagtcttcatcttgttgggctgtgatcaagtacatatgctccccagcagttctttgagatttccatgttctccgcacagtgcggagctactgcrggtgtgtgagccaagggggccctgtgacccttgaaatagaaaagggggaaatggctgcatgccaaccgaagagaccactgcattgttggccataagtgaa

SEQ ID NO: 17458 - DNA, 201 bp, Homo sapiens
gccaagaacaaattaacccagggcaacaagaaacaatgactaattagaccctaatgaagtgctgcggtactggcgtccttccagatttgacttgtaatcgmcacaatgtattacagatgcagagtcttcatcttgttgggctgtgatcaagtacatatgctccccagcagttctttgagatttccatgttctccgcacagt

SEQ ID NO: 17459 - DNA, 201 bp, Homo sapiens
tccaatttttcaagctgctggccagcttgagcgtattcatatgttacctacgatgaatcacatcagtgtcggggccgggaaggtactgcaacatattggcrcctcacgggaggctctcaaaatgatccaaagttttttgttgcagcaaaagctcattcagaagtctttgggccatttggctcagcggaggctgtcatgtgc

SEQ ID NO: 17460 - DNA, 201 bp, Homo sapiens
aaacatgctgtattatagtggcaaagattagaatcagatacatcttatgaccttgggcaagtttcttaacttctttaaacctcagtttcttcatctgtaamatgcacatcataatatctctattcagagatacaggtggttctattaaacacatcaactctgtgtatataaagtcttaacccattgtggaataaattaagt

SEQ ID NO: 17461 - DNA, 201 bp, Homo sapiens
aatttctatataaagtgcttagcatagtgcctgccacttagacctcaaaatatattgttttcattggataattaaatataaaataacatacagcatgatgrttaatacaactaataaatagtgcattagtattataggcacaaaagacagtatgaagtacagcacagatcatgaggagggtagggtcagttctacgtaaaa

SEQ ID NO: 17462 - DNA, 201 bp, Homo sapiens
cccttgagcaggaataagtgagtggcagagggggtcagggatgttaacgcaaatggagatcccttcacccagaaagacacatctgaaatggagaagatgcytttttcctcctgcaaccaataagagagtgatgaaaattatgacgccttgggaaataagactgcaacgtaaatgtgtgtccaccccctagttttcttttgg

SEQ ID NO: 17463 - DNA, 201 bp, Homo sapiens
cagtgagccgagatcaggccactgcactccaatctgggtgacagagcaagactctgtctcaaaaataatagtaataataataataataataataataatartaataataataagaatctgactaaggttattaaccattaaggtatgctgtgctaaggagcagggggccccttccatccgtagagggcagaaaggtgccta

SEQ ID NO: 17464 - DNA, 201 bp, Homo sapiens
ctcctgtatctcagtaggcactgttcaagcatttgaacttcatcaagtatcaagacaagtctaagagaaggtggggagagaccatcagggcctaggattgsaaaacctccaacgcaaaatagagatgtagttttagcgtgctgcccaatattaaaagattgtataaatgaggggggcacacttcctgatatgttcgttatg

SEQ ID NO: 17465 - DNA, 201 bp, Homo sapiens
taaaatgttgcctcctgtatctcagtaggcactgttcaagcatttgaacttcatcaagtatcaagacaagtctaagagaaggtggggagagaccatcaggrcctaggattggaaaacctccaacgcaaaatagagatgtagttttagcgtgctgcccaatattaaaagattgtataaatgaggggggcacacttcctgata

SEQ ID NO: 17466 - DNA, 201 bp, Homo sapiens
aagggatggggaattagtcatagggtatttccagataatgtagttaacacctcgtgtaatattaggtgggcagggagctctgctctcaggaccaaaattgytcctgccagctctaatagggaatgtgtgtatttttaaagtctgggtaagcactgtgagtcatttccacaatacgcctccctttggcgtgaaatggggcag

SEQ ID NO: 17467 - DNA, 201 bp, Homo sapiens
tagcgtctaggggatatacacttctaagcccattcttcaatggagaattacttatgcgcataagtagtttaaacaaaattagtggaaaaacagggagtttmagggagcaagagatcaggtcttctgggctcaccacacatcaggtgatttaagctaaaaatggcttaaaataccgcaatcacttgaaacgccttacataaa

SEQ ID NO: 17468 - DNA, 201 bp, Homo sapiens
ttactttgcaggattgctgtaaggattagaaccaccgtctctaaggcattcagcatagtcccttagggtaacatgagtgctcaagaaatagtaaattttartatgtgtctcatttttttccagatgctctggggtcactaccaaccttgcctttcaccctacctgtggatctatgaccctgtccttctcagaacaccactc

SEQ ID NO: 17469 - DNA, 201 bp, Homo sapiens
tttcacctacaaaatgaaggctacaatatttactttgcaggattgctgtaaggattagaaccaccgtctctaaggcattcagcatagtcccttagggtaamatgagtgctcaagaaatagtaaattttagtatgtgtctcatttttttccagatgctctggggtcactaccaaccttgcctttcaccctacctgtggatct

SEQ ID NO: 17470 - DNA, 201 bp, Homo sapiens
gacttgtatctcttaatgagtttaactacatttaaccatgtatgtgtcagtcctactatgcaccttacagctcactaaccctgtttaataatgtatgttgytacatttaatctttatggtagcctcatgaacaggctcttatttagttcagtggttcttgatcaggagtgatattgcctgccagggaatgcatgtcaatgt

SEQ ID NO: 17471 - DNA, 201 bp, Homo sapiens
tgccattgcactccagcctgggcaaaaagagcggggtaaaaaaacaacaaaaaaatgatgtaggaatgaacagatgaacaaccccacacaacctaaggacractttgaatcaattcttctaagctggtagcagaagccacctttccatttgacttgtatctcgctctttttttctttcttttttttttttttggagacaga

SEQ ID NO: 17472 - DNA, 201 bp, Homo sapiens
cacacctgtaatccctgctacacaggaagctgaggcaggagaatcgcttgaacccaggaggtgaggttgtggtgagccgagatcatgccattgcactccarcctgggcaaaaagagcggggtaaaaaaacaacaaaaaaatgatgtaggaatgaacagatgaacaaccccacacaacctaaggacaactttgaatcaattc

SEQ ID NO: 17473 - DNA, 201 bp, Homo sapiens
aggaacaagagagagagaaagtgcatggcaaagacccatcattgatgagtgactggatgtgaggaatggagcaggggagatgctgatgatttggttacccscttctccatcccccaccacccactgatgttattatccagtaaggaccaggagagaagaagagatttaagaagaagacaatggctgtggtttgatgaagat

SEQ ID NO: 17474 - DNA, 201 bp, Homo sapiens
gctttaaggagaaatattttgttgggacacagaagttagactgcaagaaggagaagattggattcagggcaggaaatcagtacaacttgcagtagtccacrtgacagttacgcaaaggcctggtctgatagaggaacaagagagagagaaagtgcatggcaaagacccatcattgatgagtgactggatgtgaggaatgga

SEQ ID NO: 17475 - DNA, 201 bp, Homo sapiens
ccagccttttgctattgcaaattgtgccgcaacgtgtaaccttgcaccgacatcgcttcccacgtgcatgcatgtatttgcaggattgagtcttagaaatmgcagcatcggctgagagagtatgcactccggtcgttttcatagatattgccaaattgccctctacggaggttgttctgatttacattcccactaagcaac

SEQ ID NO: 17476 - DNA, 201 bp, Homo sapiens
ttgctatagataccaaactccacaatcagtaattagagcgtgccccctgccccagaactggtcaaacggtgcagagcgctcggcaaatggtcttaaaagcrtccgcgcttgcatggaaatgcatttccaatggtgacggggtttgttttattcatggactttttgaaaaaaaaatcactggtttattggaaaccatagaga

SEQ ID NO: 17477 - DNA, 201 bp, Homo sapiens
tctaggctcattcatacaccagttcattcatcctcataacagttctgtgcctgagtagattcttgtccttatgtaaggattaaggacgttgagacccagargggtctcatctaacaggcagtagtagagccagcagtcaaaatagtttgaccccaaggctccaggctttttccctatttctttctcacccacagccaattg

SEQ ID NO: 17478 - DNA, 201 bp, Homo sapiens
aaggccagttatgtgatggatacttctattaccttatgtctttctgatttcatacacttaaatgtacagtttttatcttccttcaaaaccttatttttccragcaagttttatttattcactttcagtcattactgaagtgaataacaaacatataacagatgctattttgggtcatagctgttttgctaagtaatactta

SEQ ID NO: 17479 - DNA, 201 bp, Homo sapiens
gtgaacagattcttccaggtcttcattgtggcggaagaaagtgagatcagagatcccgaggaagggcttcagtttcaccagtagtggagctagggagtagsggggcagaagccgcaggaagtcagtgcaggacgccggaggccactcctaattgcttcatgtgttgttgccgtgctgatgaccttggaggcgctgctggtc

SEQ ID NO: 17480 - DNA, 201 bp, Homo sapiens
ctgaggcagataaatcacctgaggttaggagttcaagaccagcctggctaacacggataaacctcgtctctactgaaaacacaaaaattagcttggcttcstggtgcatgcctgtaatcccagctactgcagaggctgaggcaggagaatcgcttgaacccaggaggcggaggttgcagtgagccgagatcgtaccattgc

SEQ ID NO: 17481 - DNA, 201 bp, Homo sapiens
gcatcttacctataaaaataatgcagatacattcgtaactccccaggttttcgggagtggaaatgagggcagctggggagtgaatctgtcgtttgttgagrctctttttcctgcttgccagacactgatctaggctcattcatacaccagttcattcatcctcataacagttctgtgcctgagtagattcttgtccttatg

SEQ ID NO: 17482 - DNA, 201 bp, Homo sapiens
gaattgtgcatttattattgctaggatgcatatacacattgaactcagtcaacttactctctctaaattatctcaccggtggagacattgcctcaggagtygagccctgtggtgtgcctcctgctgtcaccacatttgaccacctaactgaccccactgtggtcacctttgccacctgccctgctttggtcccttctctgc

SEQ ID NO: 17483 - DNA, 201 bp, Homo sapiens
tcaggcccataaaatactgcacatcttggcatcttacctataaaaataatgcagatacattcgtaactccccaggttttcgggagtggaaatgagggcagytggggagtgaatctgtcgtttgttgaggctctttttcctgcttgccagacactgatctaggctcattcatacaccagttcattcatcctcataacagttc

SEQ ID NO: 17484 - DNA, 201 bp, Homo sapiens
aagcatgatggcaattgcctgactctgtcctcggtggggacaggagagctgagcataaggatctaagtttagacgccctcctaggattaccaacgtaggcrtgatcaggcccataaaatactgcacatcttggcatcttacctataaaaataatgcagatacattcgtaactccccaggttttcgggagtggaaatgaggg

SEQ ID NO: 17485 - DNA, 201 bp, Homo sapiens
ggacccttgccggggcctcgccatccacatggtcattgcctcaaaatttgggattccagttgcccttttccttcttctctcttgaacaatgtgaacgcaakgtgaggatgggccttctccgccttcaaaagttgctgccttccaaggggaaaaggtctggtcttgtaatttctggtctgtgcgtgctgtataaggaagaag

SEQ ID NO: 17486 - DNA, 201 bp, Homo sapiens
tgtagtctcagcttcccagaaggtcaaggcaggaggattgctggagcccaggaggttgaggctgcagtgagctacaatcataccactgcactccagcctargcaacagagtgagaccttgtctcaaaaaataactggctgggcatggtggctcatgcctgtaatcccagcactctgggaggacgaggtgggcggatcacga

SEQ ID NO: 17487 - DNA, 201 bp, Homo sapiens
agtcttctctttggtccctgataaatatacatagaatgtatggatgtgagaaagttaaactgatgtctgtgtgtcttcatgtcattaaactttgaatctayggacatgtctttttctttctggcatagtttggaggtcttcattttgtgattgaatacaaaacaccgagggctttaaggaggcatagtggtatgttcagct

SEQ ID NO: 17488 - DNA, 201 bp, Homo sapiens
tagaaggccttaatctcattgtacatacttttctattcctcccagtaccatttaaaggttagtgaaagcaacctttagtatcatctgttttttgggggggkttttttgttgttgttgtttagctgtttatgggtaggagaatgcgtgctcttttagggacatctcttcaaataagaacaggttgtaacctacactcaaaag

SEQ ID NO: 17489 - DNA, 201 bp, Homo sapiens
tgttagcaggctatttcaatgattttctctgcggaagagtagggaaaggtgacattccaactgggaatattcgactctgcagatccctactcggagtttttcagccctgttttaagtgccgagctgggttttgcctcatgatccaattgttttattagcgaaatcatcatctgtttcattttgctttggtaatagtgcagt

SEQ ID NO: 17490 - DNA, 201 bp, Homo sapiens
ttcataatcagcagaagtcttttctctggaaggaacaaaggattaagttagggagacagtaatggtattgttagcaggctatttcaatgattttctctgcrgaagagtagggaaaggtgacattccaactgggaatattcgactctgcagatccctactcggagtttttcagccctgttttaagtgccgagctgggttttg

SEQ ID NO: 17491 - DNA, 201 bp, Homo sapiens
aaatcacagagtccatttatttctcctcttcgagtcagtatatctcaaaacattttttcaacgttaatagaaatataagaagtgcctggatcagtttttgkttttgttttgtttctttttgagatagggtctcattccgttccctaggcgggactgcagtggcaccattatggtttactgcagccttgacctcccaggccc

SEQ ID NO: 17492 - DNA, 201 bp, Homo sapiens
cagaggggcagtccaataaaagaggcagaaagggctcttgaaaaatgtccctgggcacttgcccgaatgactttagtgacagtatctactaaaactgataytaattctgttacgtgttatggcgcatacccaagaccctccccataaactatttgaaagaagcaaagttgtaattctccaaatacggacttgtacatttct

SEQ ID NO: 17493 - DNA, 201 bp, Homo sapiens
ttgtttttctttcttttttttttttttttttgaggcaggccttaggtctggcacccaggctggagtgcagtgacgtgatcaaggctcactgcagcttccamctcctgggctcaagcaatcttcgtgtttcagcctcctgagtagctggaattacgggctcatgccaccacacttggctacttgtttaattttttgcagaca

SEQ ID NO: 17494 - DNA, 201 bp, Homo sapiens
tactgctattgttagtttctaaaggcacttgtcatggtgtgactaatattagaagcagacacagccatgatgagcaatactctttttttgtttatttttgwtgttactgctgtaagccactttcttctccctctccgttaaaatgcaacttaattggtaaagtttagttgactagagatttcatttatttatttatttatt

SEQ ID NO: 17495 - DNA, 201 bp, Homo sapiens
aaataaaagtaaataaggggaaattgcatactcctatctggactgttttcttatggttttggaatctctggcaggtagaagtaattatttctgtaactctyaggcagggcttaggaattatctcccttaggtttgacttctttctttcttgagaataagcgctgtgtttcgcaagagtaaagaagtggcatttattctgtt

SEQ ID NO: 17496 - DNA, 201 bp, Homo sapiens
gggaaaactaggttagtgccagataaggtccattactctttaaaagtggccactcatccctaataataaataaaccaaacattgggatattaaaacaattygttctcagcatcagaaaagaggtcgtgtgtgtgtttgtgtttttttaatatcccatccagcccccagccccagtaaccctaagattgaacaaaaccctac

SEQ ID NO: 17497 - DNA, 201 bp, Homo sapiens
cctttgaatcttcagtgtttcaacatagacttgttacaaagagaaggaatataagcctctgttctttcttgtttccctttgttaattcctttttcctttcrttccttcttatctatccctttcttaccttctttatttcctcgtttatttgggctttttcggttgtgaagatcagtaccttgaaattcagaatagatggca

SEQ ID NO: 17498 - DNA, 201 bp, Homo sapiens
aaactgtgtgattctgtctgcagttgagaactgtaagaaaaagatcaagattaacattattattattggtgttacctcatgtctgtacctttttggacacktgggtctgtttcccgagaaatcatttttcctcctccttgaaaatagtgaatttcaagtggttttaattttaactgcattatttgtttgctttatatagtt

SEQ ID NO: 17499 - DNA, 201 bp, Homo sapiens
aaccacacagcccagtggccgtggcctgggcagggaaaccgcaactgcctgcaggaagagtgcagtttatttagataacattttcacttaacatcctgccrttaatgacctccacctggcaacctttatttaatccaaaactcagggactggattttccatacggcctgtgaggccagggggctcagttgttcctcataga

SEQ ID NO: 17500 - DNA, 201 bp, Homo sapiens
cggaggttacagtgaaccgagatcgtgtcactgcactccagcctaggcgacagagcgagaccctgtctcagaaacagaaaataaaacaaacaaaaaaatastattccatagctgactattttctgaaatgattttgttacttttctaatgagaaaaaaatagatctcgtgtgtggagggaattgaagatgtaatttcagac

SEQ ID NO: 17501 - DNA, 201 bp, Homo sapiens
acaacataaccacacagcccagtggccgtggcctgggcagggaaaccgcaactgcctgcaggaagagtgcagtttatttagataacattttcacttaacaycctgccgttaatgacctccacctggcaacctttatttaatccaaaactcagggactggattttccatacggcctgtgaggccagggggctcagttgttcc

SEQ ID NO: 17502 - DNA, 201 bp, Homo sapiens
cagttttcagaccaactccattgttactagatatcctgacactgaagaagctaaaaccaaacaacaatgacaacaacaaacccaagtctgccttatggcasattcttcacgtcgtaacaccttccttgggaccctatttctcagtatggacctgactctcccagggatcctagaatgcaagcatagtgattgcaaaccaga

SEQ ID NO: 17503 - DNA, 201 bp, Homo sapiens
ggagaatccagagaaacacagcggaaattcaatttatgggctacattaacccagcattttggattggagggtttctaaagaggtttcgttatattaatggrtgacaagtggatacttaagaaaaagtgtattttggagaaagttgcaataatacctactagagattgtgtcctccctcaaaatcggagtgccatccgcgct

SEQ ID NO: 17504 - DNA, 201 bp, Homo sapiens
gatcacttgagctcaggaattcgagaccagcctggccaacatggtgaaaccttatccgtaaaaaaaataaaaaattagccagacatcgtggtgcatgcctsttgtcccagctatttgggaggctgaggtgggaggattgcttaagcctgggagattgaggctgtagtgagctatgattgcaccactgcactccagcctggg

SEQ ID NO: 17505 - DNA, 201 bp, Homo sapiens
ttccttgggaccctatttctcagtatggacctgactctcccagggatcctagaatgcaagcatagtgattgcaaaccagaccatttgagggaaactcctcyagtaagcaccctgcatggtcacaatgtaaaccctgcaggggcagaaaaatgataagctttgggtcgggtcggaaagccatttcccccacaatcaaagttc

SEQ ID NO: 17506 - DNA, 201 bp, Homo sapiens
tgcccatggcaaccacaattaacccatgcctgccttccagtctttttaccacgtgttgtgttgtgtggtgtttgtcccacatagagatcattgccatacgsccatttggcacattgcttatttttccctgtctttatacatttcatcatgttgttctaaatgcttcttaactgcaattcttagtggttgtgatagtccaca

SEQ ID NO: 17507 - DNA, 201 bp, Homo sapiens
agcattttgagaggcagaggtgagaggattccttgagtccgggagttgaagaccagtctgggcaacatagtgaggccttatctcttcaaaaataaaaaaaattagctgcccatggtggtgtatgcctgtggtcccagctacttgggcagctgaggcaggagaattgctggagtacaggagattgaagctgcagtgaactgt

SEQ ID NO: 17508 - DNA, 201 bp, Homo sapiens
accacttttgctctctgctggcatagatggctgtgctttggttcattttcttgctcatcttcatgatctagcaagttcttgttgagtgccagcccagtgcyaggtgctgaagaacaatggtgaacggcacagtcatggtaccagaactcggtctggtggaacagagagattaagcaatcagaaaaacatatgtgtgtgtaa

SEQ ID NO: 17509 - DNA, 201 bp, Homo sapiens
ttgatgtcaaaagtaaagaagttcagaacctacggggcttgctttgggtcccaaattatcttagctttctggaaagagaagaatctataatgtattctccrtggagtatctttactcacttgtgatgagatgtctgtaaaagtaatcagctccatacatctgggcatgatgaccctcaggcccttgagactcaggtgttct

SEQ ID NO: 17510 - DNA, 201 bp, Homo sapiens
tttttgttcccccatgggatagtaggtaaattaatggaggaagggagtcaactaaacaatttatttgagcaattaatggaggaagggagtcaactaaacartttattagggctttatgtaaagccctagggttagttggttggttggttttgttttgttttgttcctttttttttttgccaggggatgctgtggttgaatt

SEQ ID NO: 17511 - DNA, 201 bp, Homo sapiens
agcctcccaaagtgctgagattacatgcatgagccaccatgcctggcctctggccttcttttcactttagaaaaaaacaaaaaacaaaaaacaaaaaaaaacacaaaaaaaacttttttttttagaactgttttagtttgggagccaaaattgagcagaaagtacagagagttcccgtatacctccggcagagccctggct

SEQ ID NO: 17512 - DNA, 201 bp, Homo sapiens
cgcctcagcctcccaaagtcaggtgtgtctttatcagcagcattaaaacaaagtaataaaattggtttcttagggttggatggcttaaaacaacagaaatrtatcatctcacagttctgaaagtgagaagtccaaaatcaaggtgtcagcacagccacgttctttctgaaggctccagggatgatctactccatgcctttg

SEQ ID NO: 17513 - DNA, 201 bp, Homo sapiens
tataagttttcatagttctgtgcatttcctcttggcagcaatgcactgagctgcagttttacatttttgtttttttgttttttgagtttttttttttttttgagacaaaagtctcgctctgtcccccacgctggagtacagtggcacgatcttagctcactgcaacctccacctcccaggttcaggcgattctcctgcctc

SEQ ID NO: 17514 - DNA, 201 bp, Homo sapiens
cactttattggtgatatggtttggctgtgtccccacccaaatctcatcttgaattgtagctcccataattcccatatgttgtgggagggaccgggtgggasaatattgaatcatgggggtggttcccccatactgttcttggggtagtgaatgaatctcatgagatctgatggttttataagggggaaacacctttcactt

SEQ ID NO: 17515 - DNA, 201 bp, Homo sapiens
catgccaaaggcagatagcaacactcttcaatggatgtgggtgagaggacagtggaatccagcaggggccattgtttccttccataatatttttaaactgyagcaaagtgatctttttgagacccaaatgtgagtatgccattctaatcttcccaccctcagataaaccacagcaatgattttatactgtctgtagggtaa

SEQ ID NO: 17516 - DNA, 201 bp, Homo sapiens
actccacatctttgtaactttttatggctctcagccctactttcttaatagtagcagcagtatttatctactgtttattgtattccaggtaaaggatatgygaagcacttttcatgcattatttaacctagctataatactcccatttgacagatgagaggactgaggcttgtagactttccaaggctgtgcagctctagg

SEQ ID NO: 17517 - DNA, 201 bp, Homo sapiens
tgtcattgaaaaaaacaccagtaattaaatcattatttcttagatgtgaggtccaaggacattctagaggaagtcaaaggcagagggaggaagggtgggacgatggaggcctgaagggctggtggagaggaaagaaggcagcctgtgccgtcagagagagttcaactccatccgtgcagctgctagcatcttgccttactc

SEQ ID NO: 17518 - DNA, 201 bp, Homo sapiens
cattgaactgaatctccaccttgggcttgagactctgcaaagtgcattaaatgggaaggaaaccaaagggcctgctgccctgcccccgccatagcccaagkctgtggccatggctggggaattggcctgtcagttcaatcaggcagcccctctgactggtgtttttcactaagctggccccatggatggccctggtcatgt

SEQ ID NO: 17519 - DNA, 201 bp, Homo sapiens
cacgcaggcattaaatggattgtgaagagggactttgttccccctcagtcttgtctctgcctccgtaaaggagtaagttaaaaaagaaagtttctttttttaaaaaaaagccttactgctcaataaatccctgtggaaaaaaaaaaaagagggggaaaaaggaatgcacattagtcttccattaaaaatagatcaaaaaag

SEQ ID NO: 17520 - DNA, 201 bp, Homo sapiens
agccatactcagagtggccctaggatggctcctcagatagctgctggcagaaacctgcactcagtacatctatacatggtgtaatgattgactcaagatamttagcatagccatcatctcaaacctttattatttgtgatgagaagattcaaaacccgctttttgaactgttctgaaatatgcaataccttgttgttaact

SEQ ID NO: 17521 - DNA, 201 bp, Homo sapiens
ccatcatttacttacgtaataaatctgttaaataattttaatataaatctattcatctatccatctattaaaagagatttaagttatttctaatctttgcrtattataagttgcatttcagcttataccttgactttctttgacatatacatcaataggtagagtatattcctagaaattcaattgtggaccaatgagatg

SEQ ID NO: 17522 - DNA, 201 bp, Homo sapiens
aattttatggattacatttattttcatttctgtatatttagttaattcttttaaaaggctgcctgttatcccattgtctgtcttcaccatcatttacttaygtaataaatctgttaaataattttaatataaatctattcatctatccatctattaaaagagatttaagttatttctaatctttgcatattataagttgca

SEQ ID NO: 17523 - DNA, 201 bp, Homo sapiens
ctcaaatgctctaatctccacagaagttaaaatatccctaaacaggcatgtgcatatatgtctttctttcttttcttaggttaacttttttttttttttttccttttgaatgaccacaaagcatatctacccagcggggttactttttttttccttttcagtattcatgacgtcaagtccctgtttgttatcttattgtcc

SEQ ID NO: 17524 - DNA, 201 bp, Homo sapiens
tcctcctttttcctgaatatggaaccaaagcctgtgtttttcttgctcacatgtgagtcttctccttgcttcaaccctccccgctgacagccacaagactctgcctccctgcagcctgtggaacataatattcgttgggatcatacattgaccaaagatccgccatgtctttgcaactaacatactcactcatgacttcac

SEQ ID NO: 17525 - DNA, 201 bp, Homo sapiens
tccgctcatattcttgcatttgctgcagcaaaacctgacctctctttgtgttacctgagtcttgacgaagaagactgaggaaaggcccccccccccccccrccaaattgtcccgttgtctcttggctggtcttgccagctggcacacagcttcctctgaccaccctgctaggtacaaatcccacatgaaaagtctcaatca

SEQ ID NO: 17526 - DNA, 201 bp, Homo sapiens
atccgctcatattcttgcatttgctgcagcaaaacctgacctctctttgtgttacctgagtcttgacgaagaagactgaggaaaggcccccccccccccccaccaaattgtcccgttgtctcttggctggtcttgccagctggcacacagcttcctctgaccaccctgctaggtacaaatcccacatgaaaagtctcaatc

SEQ ID NO: 17527 - DNA, 201 bp, Homo sapiens
ttgaccgataagtgtaccagatttccttacctgtcccagggcaagatagcaagagtttcttgatgcatttaaaaaatgcatttagtgttggcaaaaggctkgcaatttattattaagtggaataagcagtttaaaaacagtatgtacagggtggttttctggctatataaacacacaggcatagaaaatagatatacataa

SEQ ID NO: 17528 - DNA, 201 bp, Homo sapiens
tgcaattccctctcagtttacatcaaaatcagctcgtcacccttgagattgaagctcgcactctgtaagctctgaataaatattaaccatctcctgaaccytgaaggagacattttctggggagcagtgatttgatgatttgatgaagttgtgtgtgtgtgtgtagtttttcagacatatctccatctgattcttacctct

SEQ ID NO: 17529 - DNA, 201 bp, Homo sapiens
atgtctgatagatattaggcattcagtctctctctctctctctctctctctgtttattatagatagaaataaaaaaattataaatagaaatttatttctcrtggttctagaggctggaaaattcaagatcaagatgcagacaggcttggtgtctggtgagggctgctttctatccttcaaaaaggcaccacgttgctgtgt

SEQ ID NO: 17530 - DNA, 201 bp, Homo sapiens
agctgccgttgagtgtgtgcatgtacaactgcttgaaaacagcttgtgagttcactattaggtccatgaaatttttctccttggcaggttttcactattartttgcttgacaaaggatagatacattttccatgtgtggaggtaaaagcagtgcagtgagctaaaaagttagcaaaggtgaagtggtcctaatctgcggcc

SEQ ID NO: 17531 - DNA, 201 bp, Homo sapiens
cattgacccacttatgtgtagtcccctagtgaaatgacaagaatccccagagctgggaaaacatttccatgcaattccctctcagtttacatcaaaatcakctcgtcacccttgagattgaagctcgcactctgtaagctctgaataaatattaaccatctcctgaaccctgaaggagacattttctggggagcagtgatt

SEQ ID NO: 17532 - DNA, 201 bp, Homo sapiens
cagattttaatatctttcctcccacacttgctttgactccctcctttagtaattagataattatgtataataagcacattaattatgtgcaacagctgccrttgagtgtgtgcatgtacaactgcttgaaaacagcttgtgagttcactattaggtccatgaaatttttctccttggcaggttttcactattaatttgctt

SEQ ID NO: 17533 - DNA, 201 bp, Homo sapiens
ttatttaggaggggaatttggggacattgacccacttatgtgtagtcccctagtgaaatgacaagaatccccagagctgggaaaacatttccatgcaattmcctctcagtttacatcaaaatcagctcgtcacccttgagattgaagctcgcactctgtaagctctgaataaatattaaccatctcctgaaccctgaagga

SEQ ID NO: 17534 - DNA, 201 bp, Homo sapiens
cagaagaagttaaggtaaatggcttttagcacattgcacccccagcttttagcacattgcattatcattataataaatgtttacggttactgatattattwtagttctttatcgacattattacagtccattatttacagtccttatgttatttaggaggggaatttggggacattgacccacttatgtgtagtcccctag

SEQ ID NO: 17535 - DNA, 201 bp, Homo sapiens
cttgatgtcggagtgttctctagacctcacacccagtccctattcttaggttttatttctcaaaccaggttttgcctgagaaattacagcaaatgattcakagcacaatgatgttgctcatttttgataagtagttgaaagctgatggtgccctccatttcaaagcaacagaagaaacgctggtggtcatggagaaagagt

SEQ ID NO: 17536 - DNA, 201 bp, Homo sapiens
tctgcttcttaatccattagtacctgagtgggggtatataggttttctcaaatgctctaatctccacagaagttaaaatatccctaaacaggcatgtgcayatatgtctttctttcttttcttaggttaacttttttttttttttttccttttgaatgaccacaaagcatatctacccagcggggttactttttttttcct

SEQ ID NO: 17537 - DNA, 201 bp, Homo sapiens
aatgatgtgaggaagccaggaatgatgagtacctggattaaactaccttaaggctgattgagtaaaagtgaaagatcatcccgtcaactgctggcctgccrcttgtgttcgttaatagaacatttccctctgattgtcaggctttcttagcagctacagaatacttattttcttctttatattataagtttatgccactgc

SEQ ID NO: 17538 - DNA, 201 bp, Homo sapiens
catccttcatcaaggtgacataggtctggcgatctttttggcatagacgtgtggacgttgtttttgacatttgtacatgcttttgctcaagttgaaggccsaagtttacccaattcgactgcccccacccagatagaatattcatggttagaccataaactacataactggaaattttaaatctatttttatatgcataca

SEQ ID NO: 17539 - DNA, 201 bp, Homo sapiens
atggttttaaaataccaaaaaatatttcttcaatttttttctgctactcataatgtagcatctgtagagcgacacacttttgaatttgagttaatatttcytttttattttattttattttttgagatggagtctcattctgtcgcccaggctggagtgcagtggcgcgatctctgctcaccgcaacctccgcctcctggg

SEQ ID NO: 17540 - DNA, 201 bp, Homo sapiens
attttcatttttattaagaagtaaggcaaaaacaaaataagacatatgtcagaacttcacttatccttctttgctgaattgtataatggttttaaaatacyaaaaaatatttcttcaatttttttctgctactcataatgtagcatctgtagagcgacacacttttgaatttgagttaatatttcctttttattttatttt

SEQ ID NO: 17541 - DNA, 201 bp, Homo sapiens
agaccttgatatatgtacatatattgtatgatacatatccatgcatatacgtgggtgtacacacacaggtacacacaaatatatatgtgcctttggacaaraaaaaatccccaggacagtctcatttggcttttaaaatgctgcagttgaataggaccgtagaggtggcctaaggcagccttccattcagggcacgcagat

SEQ ID NO: 17542 - DNA, 201 bp, Homo sapiens
gacatgaatattggttgatattttcatttttattaagaagtaaggcaaaaacaaaataagacatatgtcagaacttcacttatccttctttgctgaattgkataatggttttaaaataccaaaaaatatttcttcaatttttttctgctactcataatgtagcatctgtagagcgacacacttttgaatttgagttaatat

SEQ ID NO: 17543 - DNA, 201 bp, Homo sapiens
caacctaaataaagccacagccagtgttacagaaatagtgtttcgtgattaaaataatggtacttatttgggagagttacttgccacgtttcagatgattkggaggtagtcttttcaggaatattctgagtttgtttcttgatctcgatagcagcaacctttccatttgctctctgtctggtttctctgtgtctctctttt

SEQ ID NO: 17544 - DNA, 201 bp, Homo sapiens
gtttgtgccaaaccaggtgtcattgccctccccaccctaccttgctcccctggagtgtatcctgattcttttgaggatcacttgatcctgattttttttttatgtgtatagatgggatttcattatattgcccagactggtcttaaactcctggcctcaagcaatccagccacctcggcctcccaaagtgctgggattata

SEQ ID NO: 17545 - DNA, 201 bp, Homo sapiens
gttcattcagttatctcacgtttctggagggccctctatgtgcaatacctagtgatacagcagtgaacaaaggaaatccctgccctcagggagctttcatkctacttggggaaagagacgtgaaagaaatcaagacatgcaagcaaggataagtgctgtaaagataattcattcctgtttagagggctgaggacaggaaga

SEQ ID NO: 17546 - DNA, 201 bp, Homo sapiens
cattttcatggcgatgtgttataacaggacagaccttgtactttggaatcaaacattctcaactctgctatctgctctttgtggggccctgaacaaaaatmtttactctctttgagccttcgcttcctcattggtcaagacttttctcactgcattatatttgagtgagacccgtatcaatggattgaaattctcagaaac

SEQ ID NO: 17547 - DNA, 201 bp, Homo sapiens
ggagaggtgcgatttccctccacataatcttcagttagtgatctctgtaagagaatgtttttcaaaaggctaatagagaagtaatgagatcagaaggaggycaacccggccttctccgtttggcagcttgattaatttatttctccttcttggagattgctgcaaggggcttttgtcaccctgtgtttttcatgggactgt

SEQ ID NO: 17548 - DNA, 201 bp, Homo sapiens
cctaaagatatcccgccccaccaaagatatccctaaagacatcctgctggtttcagtggctcatgcctgcaatcccagcactttgggaggctgaggcaggyggatcacttgagctcaggaattcgagaccagcctggccaacatggtgaaaccttatccgtaaaaaaaataaaaaattagccagacatcgtggtgcatgcc

SEQ ID NO: 17549 - DNA, 201 bp, Homo sapiens
gagcaagcatttctaacaatcatattgcttaagaagtggatggcaagaagataattactaatatgtctgcaattgatctgaaattgacacagttgatctawctgattcatggggaccctgggagtatgtttgtgtatttgggggttgggatgggggggtgggtggagggtcagagaggtggcaaaagcaggtgggaacagg

SEQ ID NO: 17550 - DNA, 201 bp, Homo sapiens
  misc_feature (1)...(201): n = A,T,C or G, or insertion/deletion polymorphism (see Tables 1-2)
gtagtccagtatattggcctccagggcaaagctacctaggttctgagtccaattatggccttcatgagtcttgtttctttggacaggttttccagtgtctntgagcctcaacttcctcatgtataaagtggagatgatgccattacaggttgctgctttatggcacataattaatactagctcttatttataggaactgaa

SEQ ID NO: 17551 - DNA, 201 bp, Homo sapiens
atgttactgttttagctgcccccagtcaggtggttgatgagttggggagcctggtgggcagtctggaagagagcacagtgactgcaaggtcagctcctgaycttcataataaggactcacatgtgtcggtcccaaggatccccaagggatactcatggttgaaggtgtctatgtgttctccttggtgtccagcgaatgcct

SEQ ID NO: 17552 - DNA, 201 bp, Homo sapiens
ctgtaaacaaaaacaacacagccatctagctgcaagacgtagctaattgctctgcagaacagggttggccagcctggccttgatgtcggagtgttctctaracctcacacccagtccctattcttaggttttatttctcaaaccaggttttgcctgagaaattacagcaaatgattcagagcacaatgatgttgctcattt

SEQ ID NO: 17553 - DNA, 201 bp, Homo sapiens
tcttacccattagggattattaatatactagataagagtacagtctctggagctaggcttgtgactttgaacaaattattttatctctctgagctcagtcycctcatctacaaagggggaattgataataggaattgtcgcaaagagctgttttaaagattaaatgagataatagatataaagcacttagaagagagtttg

SEQ ID NO: 17554 - DNA, 201 bp, Homo sapiens
cttttgtgaccctgatgagattacaggtcctcagtctcctcattgtatctgaagactaaagaatcagaaatttgtgactccacttagtttttctccacccmggagccctcaggccgctggtgagtgaagttcttacccattagggattattaatatactagataagagtacagtctctggagctaggcttgtgactttgaa

SEQ ID NO: 17555 - DNA, 201 bp, Homo sapiens
tatatgtgtatacatacatagaagtatatatataaataccagtactagtgtctgctaataggtggcgccactttttatctgtgtgtgttgggggtggaatkagcatgtagaggttggcaaaggggacaggagactgtgggatgattagtatattcttatttggcctgggagggaaaaaaaatctttcatttccaacaatat

SEQ ID NO: 17556 - DNA, 201 bp, Homo sapiens
ataaattaattttttagcattaatattagggaagataatctgacatttaaaaatacatgtctatatgtgtatacatacatagaagtatatatataaatacmagtactagtgtctgctaataggtggcgccactttttatctgtgtgtgttgggggtggaattagcatgtagaggttggcaaaggggacaggagactgtggg

SEQ ID NO: 17557 - DNA, 201 bp, Homo sapiens
aatctaggagaaaggtagagctctcttatgctggggcaacgctaccaacattggtattccacagcattccaacgattctaaatactctcccagagtagggmggaaaaatcatccaaactacttggtaattgaattcaagagtgatggaccaaaaattattaatgcattcccttccgtccaccagccaaagaggattccatc

SEQ ID NO: 17558 - DNA, 201 bp, Homo sapiens
ctctgttttcctacttttctttggccactgtttttgccacagcttctaggatttctctttcccacaatctaggagaaaggtagagctctcttatgctgggrcaacgctaccaacattggtattccacagcattccaacgattctaaatactctcccagagtagggaggaaaaatcatccaaactacttggtaattgaattc

SEQ ID NO: 17559 - DNA, 201 bp, Homo sapiens
catgcaatgttcacaggtctttacatgtaaaaacaaccctgtaaaataaataacattattctcttcattctccaagtaagctgaggcagaggattccagcrcaagcaatttggttccaaaacctgcccttttaacctctaccagattttggtgaactctctgtctttggaagggtaggtggcggctgcggggagaaataga

SEQ ID NO: 17560 - DNA, 201 bp, Homo sapiens
gtcaaagacatgaatattttcttctaagtagaagtaatgatgacgatgatggtagcagttatgagcaggtaacatgcattgaacacttatttgctccatgyaatgttcacaggtctttacatgtaaaaacaaccctgtaaaataaataacattattctcttcattctccaagtaagctgaggcagaggattccagcacaag

SEQ ID NO: 17561 - DNA, 201 bp, Homo sapiens
gaatattgggccgggcttggtggctcatgcctctaatcctacctgaagcaagagaatcgcctgaacttgggaggtagaggatgcagtgagctgagatggcrcccctgcactccagtctgggcaacagagcgaggctccatctcaaataaaattagtcagtcaaagacatgaatattttcttctaagtagaagtaatgatga

SEQ ID NO: 17562 - DNA, 201 bp, Homo sapiens
aactcctagcctcaagtgatccgccagcctcagcctcccaaagtgctgggatcacaggcataggctgctgcaccaggcaaggactttttttttttttttttaaacaaacttcactcagtttgaaggcaccattatttgggtttcctgttaattgcagttaatcctattgagtaaatgtatcaaggacaaagagcagaatga

SEQ ID NO: 17563 - DNA, 201 bp, Homo sapiens
ttaatacctgttgcttttgtgtgcttcctatttaaaacatgtttatctatcccccacccccactttatccaaaagttattcagtgttttacaaagacatgmatattgggccgggcttggtggctcatgcctctaatcctacctgaagcaagagaatcgcctgaacttgggaggtagaggatgcagtgagctgagatggcac

SEQ ID NO: 17564 - DNA, 201 bp, Homo sapiens
tttttttttgagacaaggtctcattctgttgcccagactggagtgcggtggtgcgatctcagctcactgccacctctgcctcccaggcccaagcgatcctsctgcctcagcctcatgagcagctgggaccacaggatgcaccaccatggccagataattgttttgcatctttggtagagacaaggcttcactatgttgccc

SEQ ID NO: 17565 - DNA, 201 bp, Homo sapiens
cccagacacttacatattcctagccattccttttgcttaagtttgcagagatttgtgcttaaaactgaataaacaatctcagggtttttgtgtgtgtgtggatgtgtgtgtgcgtgttatatgaagtcttgctagaatgcataaacaaacaaaaaaaatatcatactctcagatcctggatactgtggtcgcctggacttc

SEQ ID NO: 17566 - DNA, 201 bp, Homo sapiens
taggtgatcccctcaccttggcctcccaaagtgctgggattacaggcgtgagccacgaccaccagcctcagtgaatgttttttaatttggaaaggattttmtaagaaaggattccaactttcccatttacagagaaggaagctgaggctcacaggtttcactcaaaccataaagctcaggagtaactaaaggaactggagc

SEQ ID NO: 17567 - DNA, 201 bp, Homo sapiens
tagtcagttaattacataaagagaacttgagcaaactcttactctgccatatgctgtgcagatccctctgaaaagctttacagatgttcttttttttttttaatccctccccctatctttctttctttgcacccacgatgctctgcacttcaagctaaatataatgtatctgattttacagcatacatactaatcaggttt

SEQ ID NO: 17568 - DNA, 201 bp, Homo sapiens
cttacatttaaatacaggcctttcccatttcacagtgtttctagctcccctttccaatacatctctctctctctttctctctctctctctctctctctcamacacacaacacacacacacacacacagccaaatcagacaccaacataaactgtagagttaacattctttttccaccctcacactttttttagctccgatc

SEQ ID NO: 17569 - DNA, 201 bp, Homo sapiens
gcacatatgtgtgtgtgcaaattgtacttgcagtggctgcctgggaaatgaaatttctgcaccttgccagagcatgttttccctctaaagagaggcagctsataattagtaatgctaatgtcggggtgagatgcaatagataatctaacaccagcaatgatgcccagagcatttatctttgatgctgggaatgcgttcatt

SEQ ID NO: 17570 - DNA, 201 bp, Homo sapiens
ccgattctcttccacgtgtggacagattggcacatatgtgtgtgtgcaaattgtacttgcagtggctgcctgggaaatgaaatttctgcaccttgccagarcatgttttccctctaaagagaggcagctgataattagtaatgctaatgtcggggtgagatgcaatagataatctaacaccagcaatgatgcccagagcat

SEQ ID NO: 17571 - DNA, 201 bp, Homo sapiens
ctatcacatttagaaacgccccttgccttccttccaggactttcttccttaatcaggattgacttaactgttaactcctagaactgtcgttgattgcttgstgaagtaacaattagtatagacattcagcaactggcctcccatactgtgattcactgacccagactttgacatcttgggctcagccataccctggagcct

SEQ ID NO: 17572 - DNA, 201 bp, Homo sapiens
gtccagtatattggcctccagggcaaagctacctaggttctgagtccaattatggccttcatgagtcttgtttctttggacaggttttccagtgtctctgcgcctcaacttcctcatgtataaagtggagatgatgccattacaggttgctgctttatggcacataattaatactagctcttatttataggaactgaacaa

SEQ ID NO: 17573 - DNA, 201 bp, Homo sapiens
ctttctaatgcagaaggtgtagacacagggcacagaactgccaactgtggctgctgacacctgtctgactttgactgggttagtgacaaagaaatgacttkccttttgtatgttagccctgtgcctggcatactgcaaatatctatggttgataaattaatgttatcatcatcacgtaagcatcttgggaagtctgtaagt

SEQ ID NO: 17574 - DNA, 201 bp, Homo sapiens
atctaagaggtaataaccctaatacctcttagtgttgctgtgagaattaactaaagtaccatcttcatgtggtcagcacaatggctgacacatagcaagaycttggtaagttatagctgttgctgtcattcctgcagctgttatctttgtcattacgcttactgttattattagctctgctatcagagtgatgctgtggct

SEQ ID NO: 17575 - DNA, 201 bp, Homo sapiens
ccatttggacttcctttttgtagtgggctattagattttgcctctgcttgtttctgaatacccaagcttgctaacacagggaaagaccaattatcatgattattattatttaccttaagacctgattctacctatctatgatcacatagacatttggaagcaaagagaaatgcttttcatgtgggaaaaaccaataccaac

SEQ ID NO: 17576 - DNA, 201 bp, Homo sapiens
catggtgaaagaagacagacagtgtaatttccctggaaactcaattttgattcagacgtccacagcatctcatttctgcctttaaaaaatttcaagagtgrcattttggcatgattggactcacaggtggagaaggtatgacaaacattctggaaatcttggaaggtgaaatatagggaagatggcccctatggaggttca

SEQ ID NO: 17577 - DNA, 201 bp, Homo sapiens
tgaggattaattgaaataactcgcaaaaatatccagctctctgtttccctgctaggggctcttgtcataggagccattgttgtagccttagaaaacatacrgcattattttagggggagaggttagagtagaattttaaagagtgcatttctcttccagtaagcaattctgcatcgataaaaagtggagaaagaataagtg

SEQ ID NO: 17578 - DNA, 201 bp, Homo sapiens
agatagatgaagggttaggaagatgtaacttgtcctaaatcacgtgtcttctaagcggtggaactgattttctcactgactatagatgttgagcccattamtgtgatacctactgccttttaattttaaaagttctcattgttttatcgttttcatcattatcatatgatttacctcttctcttgtgtcttataatccgat

SEQ ID NO: 17579 - DNA, 201 bp, Homo sapiens
gtcttttttttttttttttttttcctccttttttgagagagagagtctcactctgtcacccagactggattgcagtggcacaatctcaactgactgcaacstgcacctctcaggttcaagcaattatcaggcctcaacgtcctgagaagctgggactacaggcatgtaccaccacactcagctaatatttgtatttttagt

SEQ ID NO: 17580 - DNA, 201 bp, Homo sapiens
atccagtcagagtgaatcagcttgcccagtgcttggcatatagctgctcaagaaatattaggcattctttgttattataaatcccctttgtattttaaaaycctcatgtatcactgaaacaaccaactgaaaaccattgagaggctcatggtgaaagaagacagacagtgtaatttccctggaaactcaattttgattcag

SEQ ID NO: 17581 - DNA, 201 bp, Homo sapiens
taatgattaaatgattctggttattagcataaaacacagctgtagtacataagaggtaacctttattgtttaaatattattcaatgtgcctacatagcacmcagcaaaaaaaactttttttcagactattcagccattatggaaataacttataattacattcagaaatgttgcaaatgcaactcatccttgcagtgggat

SEQ ID NO: 17582 - DNA, 201 bp, Homo sapiens
tgtttaaatgctcaaacttggtatggaactgcacagactatacggctgctctccactcaagaatacaaattgaacattgactttcctcattttttatccarttttgctttccagagacccagatatggcttcattttttaaatgaaattttgcaggtcattagctcataatgattaaatgattctggttattagcataaaa

SEQ ID NO: 17583 - DNA, 201 bp, Homo sapiens
tgtggctctccccagggcctcccttcttgttctccccagttgcagacctcagacaggagtctgcttgtcttcctaggcccttgtcagagtggaaggtggcyctccaccacaccagcccactttccagttatcaaaaaggatctttgatttaatatttccagagcaattttggtgatttccattcaaatctgttttttgtca

SEQ ID NO: 17584 - DNA, 201 bp, Homo sapiens
cccagagtgctgggattccaggcgtgagtcaccatgccaggcccctgcctctgtttaaatgctcaaacttggtatggaactgcacagactatacggctgcyctccactcaagaatacaaattgaacattgactttcctcattttttatccagttttgctttccagagacccagatatggcttcattttttaaatgaaattt

SEQ ID NO: 17585 - DNA, 201 bp, Homo sapiens
ggaaaagctcattttccagtttttccccctccagctgtaggggatatattttcgttaattcctgtgaccatatggcagcatggttaggatcttgggcttcyaaatcagacagttgtaaacttaaactccaattctgccacttattgtgtcactttggacaagttacttcacctctccaagcctcagtttccctgactataa

SEQ ID NO: 17586 - DNA, 201 bp, Homo sapiens
gtgagccacggttggccagctcccaaacaccatgacatacaacttgcaggaaaagctcattttccagtttttccccctccagctgtaggggatatattttygttaattcctgtgaccatatggcagcatggttaggatcttgggcttctaaatcagacagttgtaaacttaaactccaattctgccacttattgtgtcact

SEQ ID NO: 17587 - DNA, 201 bp, Homo sapiens
tagtatttgccaaaactagaggatgaatgagtgatgggtaagagagttctcagaaaaatggatataaacaatattgtaaatcatatttggaaaataaataytagaatcattgaatccctgagttatagaaaaatttattaatagcgctatctggctactttttaaagtgtggacatcctcgatgtattagctatgcatctg

SEQ ID NO: 17588 - DNA, 201 bp, Homo sapiens
tttcttaccaggagtacatagtttgttctttaagcaaaaccatatgcatcgtattttaaatggaacagggaggttgttccatgcgtcaacttagtccaaawgtagagggtcaggaaaacaatgatatgagaaaagggccggttactgtctgggaatccataaatactgcttggcaaatggcacattgcatgcttattcctt

SEQ ID NO: 17589 - DNA, 201 bp, Homo sapiens
cccttatcagagatcaattggccataaatgtaagtatttctttctggactctgaattatatcccattgatctgtatgcctgtccttatgccattgccacaytgttttggttactgtactctgtgtaagttttgaaatttggaattgtgaattctccaactttgttcttcattttcaagattgttttgggtattctgggtcc

SEQ ID NO: 17590 - DNA, 201 bp, Homo sapiens
ctttgaaagttgtccttctgcacccattttccccagacctaacctcgatttgtgctccaggtctgagcagaaatgttattccctccagaaagccttccctkgatgttgagggatgaagttgtagccccctcccgaatgcgtcctcagaactcgctggttctcgtcctcgccctcagcatacttgctcattgtttgtttcca

SEQ ID NO: 17591 - DNA, 201 bp, Homo sapiens
tctattaaatggtctttgcacccttatcagagatcaattggccataaatgtaagtatttctttctggactctgaattatatcccattgatctgtatgcctrtccttatgccattgccacactgttttggttactgtactctgtgtaagttttgaaatttggaattgtgaattctccaactttgttcttcattttcaagatt

SEQ ID NO: 17592 - DNA, 201 bp, Homo sapiens
gcatgtggcccaccagccatggtttggacaagcttagtctacaggttcttcaagaggggcttgagcatttgaaagacttctagtgggagagatcacaaggkacaagtagaaaatcctgggctggcctgagaggcagacctgtgattattttgctctttgaaagttgtccttctgcacccattttccccagacctaacctcg

SEQ ID NO: 17593 - DNA, 201 bp, Homo sapiens
tctcgcatttggtgagaggagtcttctgtgttgattgtcatggtggtgtgagagcagaagggaaacatggtttcagaaaagagtttttccctgaaaccacycctctattttcttctcagacttttatagttttagcacttatgttaagacttttgatccattttacgtcaatttttctatatagtttaaggtaggcattca

SEQ ID NO: 17594 - DNA, 201 bp, Homo sapiens
actttaggcattgatgcgcttaattatgcttttcaacaagattttgcatttttaatatttccttttagagcttccaggaatctcaattattaattgtaccstggatttattggtctttggactctcccgctagtataaagactgtagattcatcaaacattgtttactgtcttcaaacttcaacagtgttttaactatcaa

SEQ ID NO: 17595 - DNA, 201 bp, Homo sapiens
gggaaaatggaggagaatgatgacgaaggaggaggaggaggaaaaggtgacttgcctctagctgatgtggattatttctcttttttaatttccatgtctgygtagcttcatcatagatctcagcttaaggacaatgaaagtcgtttattgagtacttagtatgtgctggttgcagagccaagtcttttttttttttttttt

SEQ ID NO: 17596 - DNA, 201 bp, Homo sapiens
acagacagtgtaatttccctggaaactcaattttgattcagacgtccacagcatctcatttctgcctttaaaaaatttcaagagtggcattttggcatgaytggactcacaggtggagaaggtatgacaaacattctggaaatcttggaaggtgaaatatagggaagatggcccctatggaggttcattgtcccccacctt

SEQ ID NO: 17597 - DNA, 201 bp, Homo sapiens
cgtcctcgccctcagcatacttgctcattgtttgtttccatctctatcatctctgtgagccctttgaggatggatgtgtgtccatcttgttaacagttggmtccccagtaaccagtacagtgccagatacagagtagtaaccctacattctagcgtaggcaaatattctagtatttgccaaaactagaggatgaatgagtg

SEQ ID NO: 17598 - DNA, 201 bp, Homo sapiens
ttttaagatacagaaagtgggccttaaaggtgctactgacttgctgatatgctttggctgtgtccccacccaaatcttaacttgaatcgtatctcccagarttcccacgtgttgtgggagggacccagggagaggtaattgaatcatgggggctggtgtttcccatgttattcttatgaaagtgaataagtttcataagat

SEQ ID NO: 17599 - DNA, 201 bp, Homo sapiens
gtgtcaaaacaggagctgtatttcatgtcctgaaaagtgtgcacggttggcctcctctaggtcccacgtgccttctggatggttttaaccctcagcctctytttggcctgtgagtgaaacccatcatttgacacagaggctttctggaaatgatgctcctcttagatgaaagttccctttcagaaatctttcattccctga

SEQ ID NO: 17600 - DNA, 201 bp, Homo sapiens
cataaccacatctactttgtgtctctatagatttgactattctggatatctcatataaatggaatcacacaatatgtggccttttgtgtctggcttcttgsttttagcatgctttcaaggttcatccatgttgtagaatgtatcagtacttcattctttttatggttgagtgatattctgttacatggatataccactttt

SEQ ID NO: 17601 - DNA, 201 bp, Homo sapiens
accatcccccgctaaagaaacaccatatccattaagtggtcattccccatttcctccttcccccagcccctcataaccacatctactttgtgtctctatasatttgactattctggatatctcatataaatggaatcacacaatatgtggccttttgtgtctggcttcttgcttttagcatgctttcaaggttcatccatg

SEQ ID NO: 17602 - DNA, 201 bp, Homo sapiens
tactttctaaaattctcgggcctttgcaccttctttttatcaacgcttagttctatgttactgaatatttcttaattaagtgcaggaaagaaaataaccaytttttctccttttaaagaagcacacacacctttcttttattggtattacattccttttccctgttggtgcccctgttggttttccaaattgtcttcccat

SEQ ID NO: 17603 - DNA, 201 bp, Homo sapiens
aaacatctgtgcaccagtaaagggttctgatgtgtgataaatttatttagctattactcatctgaagttatactattttaggatcttggggcagtgaggaytttggaaatggaacaggatgctcctttaagttagggtaaaatgaagtctataaaaactgtttttctatatcctcctcctaccccacaaagaaagttaggg

SEQ ID NO: 17604 - DNA, 201 bp, Homo sapiens
gaggaccttgtgttcctgctggagagtgagagtccctccctccccattccactcccaagagcagtgaagagtcaggaaggtgggcttgttttgttttgttwtgttttgttttgcttgttgagcaagggaatgcggttcccctgtgtcggacttgtttcagaaagacaatgtcactgaggctggggcagggagattagctga

SEQ ID NO: 17605 - DNA, 201 bp, Homo sapiens
taaatgaagcaccgccaggcccagttggggaggaccttgtgttcctgctggagagtgagagtccctccctccccattccactcccaagagcagtgaagagycaggaaggtgggcttgttttgttttgttttgttttgttttgcttgttgagcaagggaatgcggttcccctgtgtcggacttgtttcagaaagacaatgtc

SEQ ID NO: 17606 - DNA, 201 bp, Homo sapiens
aacccaactcctagccactgctttttgagcagctactcagtgcctaagactttgaatagtttattaatcatgtgtcactgcagcaaaggggacatttcggycctgatttcagagatgaaagaaccaaggcatagaaattgagtcactttctggagtgtacacaactagtaagtggattcgagttagttttgctctattcca

SEQ ID NO: 17607 - DNA, 201 bp, Homo sapiens
tttttcaattccagagatgttttcacctggaagattccccagatttggcaaaaacaacccaactcctagccactgctttttgagcagctactcagtgcctwagactttgaatagtttattaatcatgtgtcactgcagcaaaggggacatttcggccctgatttcagagatgaaagaaccaaggcatagaaattgagtcac

SEQ ID NO: 17608 - DNA, 201 bp, Homo sapiens
ctttttacagtcatgtgctttcagcccagtaccctttgctatgccaagatccagctgaaactgaaccaggtgggggaggcctgctaatgcccaggcagtcraaatgacgccatctcatcactccttctcttaaaatttttttttgtctttcttcttggatttccagcaacagggagctgccaccaccgtgtactgtgctgc

SEQ ID NO: 17609 - DNA, 201 bp, Homo sapiens
gatcaccattggtagatcatcacttagaatgccatcactaccttctaacagcaatcagtccccttaagtggctttcttctcttttttttcttttatctttktgttttttttttttttttgagggagtcttgctctgtctgccagatggagcacaatggcgcgatctcagctcactacaacctccgcctcccgggatcaagc

SEQ ID NO: 17610 - DNA, 201 bp, Homo sapiens
agaatgaggtatgtggtactcgtgagcaggattttcaatgcctggctggttgttacttatccatttagtccgagcttcagggaaagaacatgacaccggcstccagcagagcctgctcttggtccactgtttatcctggtgaccttaggcaagtcatttaatttccttgagttttggtgtaagtattgatggagcagacca

SEQ ID NO: 17611 - DNA, 201 bp, Homo sapiens
agcaggattttcaatgcctggctggttgttacttatccatttagtccgagcttcagggaaagaacatgacaccggcctccagcagagcctgctcttggtcyactgtttatcctggtgaccttaggcaagtcatttaatttccttgagttttggtgtaagtattgatggagcagaccatcaataactgttcttatgtctatt

SEQ ID NO: 17612 - DNA, 201 bp, Homo sapiens
aattattcttttacccagacacttacatattcctagccattccttttgcttaagtttgcagagatttgtgcttaaaactgaataaacaatctcagggtttgtgtgtgtgtgtgtatgtgtgtgtgcgtgttatatgaagtcttgctagaatgcataaacaaacaaaaaaaatatcatactctcagatcctggatactgtgg

SEQ ID NO: 17613 - DNA, 201 bp, Homo sapiens
tgtgtgtgtgtatgtgtgtgtgcgtgttatatgaagtcttgctagaatgcataaacaaacaaaaaaaatatcatactctcagatcctggatactgtggtcrcctggacttcaaaagccttttgtccgtatgtatttacataatgtattctccatgtttggttttcattaaacccatgagtttaataataaagtgtttggaa

SEQ ID NO: 17614 - DNA, 201 bp, Homo sapiens
gtgttatatgaagtcttgctagaatgcataaacaaacaaaaaaaatatcatactctcagatcctggatactgtggtcgcctggacttcaaaagccttttgyccgtatgtatttacataatgtattctccatgtttggttttcattaaacccatgagtttaataataaagtgtttggaactatgcttttccctaccactttt

SEQ ID NO: 17615 - DNA, 201 bp, Homo sapiens
aaatgtatttaacgctctctcaagaaatccatttaagaataagaacacggtttgggggtgattttcagaccgtaaattgaagtgtaaatattcgaattatyttcataaactcttcagttctgttgggcttttatgttatcatacagtgatttttttttttgtatttaagttttctagcagttctcttttttaagagcctca

SEQ ID NO: 17616 - DNA, 201 bp, Homo sapiens
tgtgagccaccgctcctggcacccatcaaattttcaaaggaagaaatggaatggtgcaaccatggtacatgggaaggaggagggggacacacaagactgtrcctatcatgggggcttcgacctcatctgggaaggtggttggagagagtgagtcctgacctgagctttggaacttatcaagttgagagagaaatttgataa

SEQ ID NO: 17617 - DNA, 201 bp, Homo sapiens
gagcagaagaactcactgaaaagtcctggcaaggttccacggcacctgtgatgcttccatcacacatatttgctgagtacccgctgttcataggtcagtcrctatgcaaggcactgaggtgacaaagacaagcagaatgacagttaaatgtaacatgggctttgtggtcaattagttctgggttcgttcccaggtcctatc

SEQ ID NO: 17618 - DNA, 201 bp, Homo sapiens
catagtggtcatgctaacgtaataacctctcttttttatttgaaggatattaaataaaattgtacttttaatcagagcctttttttgaaaaaaaaaaaaaagaaaaagatagttgatattgtgggagatggctacaatacagattcatcccatattctctttaatgttctattcccaagaagagcactaattaatctctct

SEQ ID NO: 17619 - DNA, 201 bp, Homo sapiens
tgccttcactgcacattccgggatcgccatgttctagaacattcatgtctgccttttagccagcagaatgctattctcacatccacaatgggacagctaayagcccccatttatcaaatccctgtcatatgctgtgtcaggcactttatatccctcatccaggaggatgcaaaaacctggtgtttttcttttttttttttt

SEQ ID NO: 17620 - DNA, 201 bp, Homo sapiens
gtgtgtgttgggggtggaattagcatgtagaggttggcaaaggggacaggagactgtgggatgattagtatattcttatttggcctgggagggaaaaaaartctttcatttccaacaatattcattctctgtgtcacctcagcatttaatttacttccgtcacaaaactacttgaagttgtcccaggctagttggtcctat

SEQ ID NO: 17621 - DNA, 201 bp, Homo sapiens
ttaacagcaagatcttcagagctgcagctcacctgtgccacgatggtctcctaggagccctttcctgctgtagtcccgccccgaggggtttcacttcccaytgcctcttggtagccgtgggcactttggtgctctgatgatgtaacatggagattgtccttgtctccatcgctgtctttactggtgtatgcccatgaggta

SEQ ID NO: 17622 - DNA, 201 bp, Homo sapiens
ggttccacggcacctgtgatgcttccatcacacatatttgctgagtacccgctgttcataggtcagtcgctatgcaaggcactgaggtgacaaagacaagsagaatgacagttaaatgtaacatgggctttgtggtcaattagttctgggttcgttcccaggtcctatcactaactagtacccttatgaacctggacatgt

SEQ ID NO: 17623 - DNA, 201 bp, Homo sapiens
gtcaggccattggtataccattgtttttcttaaacatttatttattttcttatatttacagcatatgtggtcatttaaaattattttatagcatataaaastaaaaagaatataaattaattttttagcattaatattagggaagataatctgacatttaaaaatacatgtctatatgtgtatacatacatagaagtatat

SEQ ID NO: 17624 - DNA, 201 bp, Homo sapiens
ttgtctccatcgctgtctttactggtgtatgcccatgaggtatgtcaaagtctgtatgtctttgtaataatgctggatcatttgtccaccttcagagacarctgaagacagttttaagtgaaaccacacagagggcatataccattgggacaagaggtctgaagtctatttttgagaaagagaagagatcaagtagttaac

SEQ ID NO: 17625 - DNA, 201 bp, Homo sapiens
ccacactcaggaatagtggaaaactgacaagaccctggagatgctgtgtggggagggataatgggaacgcaggtcagcatgctctaggaatggtaagagaractcccaatctgaacggtagtcaaagaaggtcttcttctctttggagactgaaaggctgagagggtacctgccctgctaaggaaatgaacaggacggaag

SEQ ID NO: 17626 - DNA, 201 bp, Homo sapiens
ctgggcttagtaagttgcctgacttctcatcctggagttcgtatccccttgtttctagaagagaaatccctcagatgtgaaggtgtgttccatgattttgycgaacttgccctacatactgttttattatatattctgcccacttctattccctgccaattaattaattgtttcattggtatagttttttttttttttttt

SEQ ID NO: 17627 - DNA, 201 bp, Homo sapiens
ccaggctggagtgcaatggcgtgatcttggctcactgcaacctccgcctcccaagttcaagcgattctcctggctcaacctcctaagtagctgggattacrggcacctgccaccacgctcagctaatttttgtatgtttagtagagacgaggtttcaccatgtttgtcaggttagaccggaactcctgacctcaagtgatc

SEQ ID NO: 17628 - DNA, 201 bp, Homo sapiens
ggaaatgaacaggacggaagaatgatggagggagaatgggaagtcctcagcacataaaagtttgagctggaaatgaaatatacaactctgcatagtcagcrgattttgctgggctgggccagttcagctcagcaaggattgctgggcatgtgcttgaaggagaaaggtgaggatacaaaggcaatgagtacatgatccttg

SEQ ID NO: 17629 - DNA, 201 bp, Homo sapiens
accagtccctagcctgtggagaaggggcaatctcttatctgaaggcctaggaggtgcagggatgtttatatgggctgctagcgcttagtttcctgccacarggagacagtaagaaaggtgacgtcaatctgagatgagagagagagcaaaacagttcttttgaccaccttgaccccgaccttgaaataaggtggaactaat

SEQ ID NO: 17630 - DNA, 201 bp, Homo sapiens
ctccacattggccttctgccgtgattgtgagactttcccagccatgtggaactgtgagtccgttaaacctctttcctttataaattactcagtctcaggtwtgtctttattagcagcatgagaacaaactaatacaccacttgaattgctggtacgtctgaggggcttgactcccagtccttcgaacatggaggggtagct

SEQ ID NO: 17631 - DNA, 201 bp, Homo sapiens
atgtctttattagcagcatgagaacaaactaatacaccacttgaattgctggtacgtctgaggggcttgactcccagtccttcgaacatggaggggtagcyctttttctaagctcctcataaagtattgtatccaattcttcagaagggatgaaggtatctggtcctgtccgcaaacagagaagtgcttcttgtactgacc

SEQ ID NO: 17632 - DNA, 201 bp, Homo sapiens
tccacaatgtccacataccagcttgatggtgacttgtgtcattctccatccccttgttaagagaaaatctactttatgagccctctttccaaccgcagtgwtgaggactagaccaggcaagatgatgccgctggaccactggatccagctggaccgctagaccacagagcccctggagcctcccaaggccaagcccgccag

SEQ ID NO: 17633 - DNA, 201 bp, Homo sapiens
ggggtagctctttttctaagctcctcataaagtattgtatccaattcttcagaagggatgaaggtatctggtcctgtccgcaaacagagaagtgcttcttrtactgaccaggcagtgacctaacgcagtccttgagacaattccaggtgcccctcaggccgtttttccaccctggtgtttttctttgtatagacagcctat

SEQ ID NO: 17634 - DNA, 201 bp, Homo sapiens
tccacctgggcacccagcctggtgaacagggtgcaggctgggatttagccctaccttgcttttggaccattgagctactaagttggagcaacaaggcttgrgaatttttctttgatcataggtaggaaaggtaaaaaaacataaatctgccaatagaaaatagcatcgtaatgagtttctactatatttgtttgggctttg

SEQ ID NO: 17635 - DNA, 201 bp, Homo sapiens
tccttgagacaattccaggtgcccctcaggccgtttttccaccctggtgtttttctttgtatagacagcctatgcctggataagaacatgctgcgtcagasagttctttttcactttgcccctcaaaatgtgcacaccgacagccacagatagatcccagatgtctttttcctgctcttgcaaaccttgaagtgggccctg

SEQ ID NO: 17636 - DNA, 201 bp, Homo sapiens
attctagcaaactgctctcatatcctgtgatcttaaaatttatttattcaccttttcctttttgttaaatagattctgtagaattctctacatctctgaayatagttttacttcttctccaatttttatggcttttgtttctttttcttgttttaatgcactggctatagcctgtaggacagtgttgaacagaggttttga

SEQ ID NO: 17637 - DNA, 201 bp, Homo sapiens
gtttggtggaattaacatagatttcccacatggggaaggttttgggtgaggatttagaacaaggcaggttcttgatcctcggaagagattcttatctgagrggggatttgagaatggcattgcagagtgggaggcgctgctgtgtggaaaaatgaactggaataattattagaacagttctcagaatttacaggatatttg

SEQ ID NO: 17638 - DNA, 201 bp, Homo sapiens
cctggataagaacatgctgcgtcagagagttctttttcactttgcccctcaaaatgtgcacaccgacagccacagatagatcccagatgtctttttcctgmtcttgcaaaccttgaagtgggccctgccggcaggcacacctgccaaggaaaatgctgtcctcgaaatgttcctggcaccgttttcaagaggtgccgacca

SEQ ID NO: 17639 - DNA, 201 bp, Homo sapiens
aggatatttgatcataggagtaactttcctcaggagtgatggatggaatgcctgtacttggaatatttttaaattaatctattttcattacattgaaagtrtgacacacagagaacactaaaattggatgaggcactacctggaattatataaagaatgacaaagatgcggttatccatttattttctaggcaagttagtt

SEQ ID NO: 17640 - DNA, 201 bp, Homo sapiens
caagcgctggaattgctgacctccctgaaagagaagcctgcagctgcggcctctggggtgaattccccccatgggaggacctggtggagttaaaacagackatatccacatcacagagagctggcccattgctcagggcctgggaagtggtagggagggaccttcccagaagagagatgactcaggctggtcccaagcccc

SEQ ID NO: 17641 - DNA, 201 bp, Homo sapiens
gatcacatgaggtcaggaattcgagaccagtctggccaacatggcaaaactccgtctctactaaaaattcaaaaattaggcttggtggcacgtgcctgtartcccaagctactcaggaggctgaggcaggagaatcacttgaacccagtaggcggaggttgcagtgagccgagatcgcaccactgcactccagcctaggtg

SEQ ID NO: 17642 - DNA, 201 bp, Homo sapiens
ggcaggccaaggcgggtggatcacctaaggtcaggagttcgagaccagcctgaccaacttggcaaaacccagtgtctactaaaaatacaaaaattagctgrgcatggtgtcacatgcatgtagtcccagctactcaggaggctgaggcaggagaactgctcgaacccaggaggctgaggttatgttgagccaagattgtgc

SEQ ID NO: 17643 - DNA, 201 bp, Homo sapiens
gttccacatcctccctgtgggactaggggccagggcaatgggaatcagtgcagaaataaagctcatgctgtttgctctgccatgagtaacgaagtcctctrtatctgatcctgggtctcctgttttctgctagcttcctcaaaacttggtagctaactcattaacttacaaggaagaggttgaacgtgtagacccttcaca

SEQ ID NO: 17644 - DNA, 201 bp, Homo sapiens
tggtttactactccttagacggtggcccagagaccctttaaatgaaattcattttactagcaccctttttcatcatgagaaatatattctgtttttcttaraaaatgggttatgttaggtctggtcaaggtaaataagtgttgagagtcgatgttgtgtgcatagttaatttcaattctttgaagaagctcccccatgata

SEQ ID NO: 17645 - DNA, 201 bp, Homo sapiens
aggctcagttaatgataaattgttatcaggagacccagcagtttctgctttttctaccctcctctttgacctctatttaaactaataggttactgggtttsaacatgccatgcagtgggaagaggcgggaaccccactgagctgtcctctaagtgaatcatgcccactatttggttgtgaggctgtggactttacttttca

SEQ ID NO: 17646 - DNA, 201 bp, Homo sapiens
acctgtaatcccagcactttgggaggctgaggtgggtggatcacttgaggtcaggagttcgagatcagcctggccaacatggtgaaaccctgtctctactrtaaactccgtctctactataaatacaaaaattagccaggcttggcgctgggtttctgtaatcccagctacttaggaggctgagacaggagaatcacttga

SEQ ID NO: 17647 - DNA, 201 bp, Homo sapiens
gtattaatagtagggagacagtaagcaagcaaggctcagttaatgataaattgttatcaggagacccagcagtttctgctttttctaccctcctctttgasctctatttaaactaataggttactgggtttcaacatgccatgcagtgggaagaggcgggaaccccactgagctgtcctctaagtgaatcatgcccactat

SEQ ID NO: 17648 - DNA, 201 bp, Homo sapiens
tctcgatctcctgacctcatgatctgtcagcctcagcctcctaaagtgctgggattacaggcgtgagccactgcgcccggccggggatcttgtattaatartagggagacagtaagcaagcaaggctcagttaatgataaattgttatcaggagacccagcagtttctgctttttctaccctcctctttgacctctattta

SEQ ID NO: 17649 - DNA, 201 bp, Homo sapiens
acactttgaaataatttatgttatgtgaatttcatctcagcaaaaagaggctaacacataaggagacatattttgatacatgtggcatattaagctgctgytgttgttttttaaatattccagctgcgtgcagtggctcacacctgtaatcccagcactttgggaggctgaggtgggtggatcacttgaggtcaggagttc

SEQ ID NO: 17650 - DNA, 201 bp, Homo sapiens
taggacccatatccctggattgttgaggaaatacgtgaacatatgtggcacacattatagtgtctggcatacaataaatactttgtaatgttactggtgtyttcttaccgttattgtctcactggtgaccgtttgaaatgttgaagctttattattacagataatggtggatatagtctcttccttgtttattttttgaca

SEQ ID NO: 17651 - DNA, 201 bp, Homo sapiens
ggcgggtggatcacctaaggtcaggagttcgagaccagcctgaccaacttggcaaaacccagtgtctactaaaaatacaaaaattagctgggcatggtgtyacatgcatgtagtcccagctactcaggaggctgaggcaggagaactgctcgaacccaggaggctgaggttatgttgagccaagattgtgccactgtactc

SEQ ID NO: 17652 - DNA, 201 bp, Homo sapiens
tttatataaaatatgcagagtaggcaaattcataaagacagaatacgcatcggtggtttctggggcggcggggagtatggaaagcctgttaatgagtacawgtttctttagttttttttggttttttgttttttttttgagacggagtcttgctctgttgcccaggctggagtgcagtggcaccatctctgctcactgcaa

SEQ ID NO: 17653 - DNA, 201 bp, Homo sapiens
atactttgtaatgttactggtgttttcttaccgttattgtctcactggtgaccgtttgaaatgttgaagctttattattacagataatggtggatatagtstcttccttgtttattttttgacagaatctttttttaaaaaagtttttatttgtttggtgagaatttacttgttacaggtctagtgctgttatagttgaat

SEQ ID NO: 17654 - DNA, 201 bp, Homo sapiens
atgttgacataacagttctgaagaccaaggtggtggaataggttaggttaggatacgtcggaggagccagtgtgaactgctcctttaagacatgaattagyccattttcatgctgctgataaagacatacccgagactgggcaatttacaaaagaaagaagtttattggacttacagttccatgtggctggggaggcctca

SEQ ID NO: 17655 - DNA, 201 bp, Homo sapiens
ttacaggtctagtgctgttatagttgaatgttttgaattatgtaacttaagtgaaacataaagctatgacttgaattttgtggttagaaattttctcagtygattgacaaggatggcgtattggccaccttttgccgcagtaacaaacaatcccagactctcaaggcttgcaaaaataaatgtgtgtttgtttgctcataa

SEQ ID NO: 17656 - DNA, 201 bp, Homo sapiens
agaggagagcttgtgtagggaaactcctgttttttaaaactatctgatctcgtgagacttattcactatcacgagaacagcatgggaaaatcctgcacccrtaattcaattacctcccaccagcttcctcccacgacatttgggaattgtgggagttacaagttgcaattcaacatgagatttgggtggggacacagctaa

SEQ ID NO: 17657 - DNA, 201 bp, Homo sapiens
gtaacaaacaatcccagactctcaaggcttgcaaaaataaatgtgtgtttgtttgctcataacacatgtggctgagggttggccgtggctccacagtcacrggtgggctttcctgggctcagcttctcacagcgtctccttgcagggcccaggctgtaggagatgtcatcagggcctgcagagggcaaaacctcacagagg

SEQ ID NO: 17658 - DNA, 201 bp, Homo sapiens
ccggggccgggcacggtggctcatgctggtaatcccagcactttcggaggcctaggtgggcagatcacaaggtcaggagatggagaccatcctggctaacrtggtgaaaccccgtctctactaaaaatagaaaaagaaattagcctgacatggtggcacatccctgtaatcccagctactcgggaggctgaggcaggagaa

SEQ ID NO: 17659 - DNA, 201 bp, Homo sapiens
ctaagttcttgccacaggtagaagccatgctactgcacaagtttcatacttgaagagtggacatctgacacagtgttggtggttgttgaagtgtatgactwttactgtgttgctttggaagcttgatgccataacaaaagtgcagaattccatgtttgataactttctgacttgatgaaaatgaattgtggatacagattt

SEQ ID NO: 17660 - DNA, 201 bp, Homo sapiens
taatcccagcactttcggaggcctaggtgggcagatcacaaggtcaggagatggagaccatcctggctaacgtggtgaaaccccgtctctactaaaaatasaaaaagaaattagcctgacatggtggcacatccctgtaatcccagctactcgggaggctgaggcaggagaatggcgtgaacccaggaggcggatcttgca

SEQ ID NO: 17661 - DNA, 201 bp, Homo sapiens
acttagccaaaactaatttgggatttttgtttgtttgaattgttggagggtggatgagagtgaagacatatccttttgaaacttaatttaatttttatttwttattattattattattttcaattttttatttttattattattattattttctattttttatttttattttttgagacggactctcgcactgtcgcccag

SEQ ID NO: 17662 - DNA, 201 bp, Homo sapiens
gggattttagttgctggatgctgaagttctgccaacacagtgggtttggagagtaggagtgaaagagtggagactggccataagttgggagggtaagtaaytggttgtgattgaaaggaaagaaggaggtaatgatgagttttggtctgggaaccggagaatggtggtccatggacagaaatagagaaggcaagatgagaa

SEQ ID NO: 17663 - DNA, 201 bp, Homo sapiens
cacgtggccttgctgacatctgagtttgcaacttcttttatgccttctgctaactgggaccccagtgggcttccctgctacaccctctgaggttccccagwcctgccaagctgttccatccccagttccttggtgcctgctggtacttcaccctggagagcccagcccttccacttgttcagatctcagtctctcatctgg

SEQ ID NO: 17664 - DNA, 201 bp, Homo sapiens
gaataaataggtacataagtgcttgctagcaagcagctgaggcaacctattaaaactcatgccagtggtaaagttaagctgctttctggtaagaatttcasaattccaggacgtctcaaatttctggctggtacaccctgggtaaggtccacaggctggatgggttttggaacatgtcttgattgtactttttcctcttgg

SEQ ID NO: 17665 - DNA, 201 bp, Homo sapiens
ctaactgggaccccagtgggcttccctgctacaccctctgaggttccccagacctgccaagctgttccatccccagttccttggtgcctgctggtacttcmccctggagagcccagcccttccacttgttcagatctcagtctctcatctgggagggacagcttgagcactatgacctgtgtgaagcttttcccagtgctg

SEQ ID NO: 17666 - DNA, 201 bp, Homo sapiens
tgaggcaacctattaaaactcatgccagtggtaaagttaagctgctttctggtaagaatttcagaattccaggacgtctcaaatttctggctggtacaccytgggtaaggtccacaggctggatgggttttggaacatgtcttgattgtactttttcctcttggtttggaaagcaacgtaccctaggtaaggagagatttc

SEQ ID NO: 17667 - DNA, 201 bp, Homo sapiens
tggcgtgagctgagatcgcaccactgcactccggcctgggtgacagagcaagactctgcctcaaaaaaaaaaaaaaaaaaaagaaaaaaaaaagattgaamatgtggaatatgagacaaatgaaaaagattgaattccgttccaactgggcttttgaatttattttcgcacttcctattttttgagcccgggagtgcaaga

SEQ ID NO: 17668 - DNA, 201 bp, Homo sapiens
caacctattaaaactcatgccagtggtaaagttaagctgctttctggtaagaatttcagaattccaggacgtctcaaatttctggctggtacaccctgggyaaggtccacaggctggatgggttttggaacatgtcttgattgtactttttcctcttggtttggaaagcaacgtaccctaggtaaggagagatttctgaca

SEQ ID NO: 17669 - DNA, 201 bp, Homo sapiens
ctgtactctttaaccaaggctccttttgcaaagagaaatctgagctgctttttaaagaaggccgtttttaaataaaaatgcaaataagctactttgtaacyacattaattacccacctagcctcttattaccatgtttgtattgtttgcaaatactatttacagtcgtgtggaaattaacattactggtcctgaggaaaga

SEQ ID NO: 17670 - DNA, 201 bp, Homo sapiens
gcaacagtgggtttttgttaaatacggcaaatattaagagtcgtctctgggcattttagtttattcattcatttgttcatttattccacagggatttattrtgcatttactgtgtactaactaatggggagatagcaatgaaggcagactaagtgtctttgttctagtgcagccatatagtcagtgaatgaatgagtgagc

SEQ ID NO: 17671 - DNA, 201 bp, Homo sapiens
gacatccatttgggcattgtatatgttttgataggattacataaataatgaaattgtatgcaaagcatcagaatgcaaaaggtgttttctccaaggtgtayacactgcctgggccttgtactctggccctcaattttcttaaacagctgcatcttttgggggctctgttaagacatgctactgtctttagtattttgcccc

SEQ ID NO: 17672 - DNA, 201 bp, Homo sapiens
acgaaacataccttccagtctcccgagtagtgtattaggctaagtatggtcttttaaattattactttaaaaataaaagataatggaattatagcattaartacattttgcaaatgatcttctagtaggattattgaaagacagtaaaggcaagtataaatcagaagcaaaatcattgtcctctaattcattaatggttaa

SEQ ID NO: 17673 - DNA, 201 bp, Homo sapiens
gctgggagtacaagtgtgcaccaccatgcctggctaatgtttgtatttttagtagggacggggtttcgccatgttggccaggctggtgtcaaactcctgayctcaggtgtaccaagaacaaaaggccaaccccattagacggtggccaagttggtgctgtgaacagggatcctgcctctgcctcccaaagtgatgggatta

SEQ ID NO: 17674 - DNA, 201 bp, Homo sapiens
caagtgtgcaccaccatgcctggctaatgtttgtatttttagtagggacggggtttcgccatgttggccaggctggtgtcaaactcctgatctcaggtgtwccaagaacaaaaggccaaccccattagacggtggccaagttggtgctgtgaacagggatcctgcctctgcctcccaaagtgatgggattacaggcgtgag

SEQ ID NO: 17675 - DNA, 201 bp, Homo sapiens
ccccatctctgctacagatataaaaattggctgggcatggtggggtgcagctgtaatcccagctgctcaggaggctgaggcaggcgaatcgcttgaacccsggaagcagaggttgtagtgagctgagatcatgccactgtactccagcctgggtgacagagcaagactgtctcaaaaaagaataaaaatgaataaaaatta

SEQ ID NO: 17676 - DNA, 201 bp, Homo sapiens
agcttcttaaaggagctgcctcagactgtctcaagatcttagaaggccatgcctacattgccaccagcatcccttggctttttgcttggcttaagaatctrtcttttccgttcctccttccagcatactcagcacagtccacctctgtggtctctctgtggttttctttctgttttcctgctctctccatttctcattcac

SEQ ID NO: 17677 - DNA, 201 bp, Homo sapiens
ggaatgccatttgacagttacaggctcccgtgaggcggtgcaggctcctccgagccagggatggagctggggattgagtgacacaagactctttgggtatstctcaaacaatataaatcaccagcaaaatctcactcctacaaggagaacctgcagggagctccgtgggaggcactgctgtttactctcctcattccccac

SEQ ID NO: 17678 - DNA, 201 bp, Homo sapiens
agcaggacacactgcaaatactaggaatccttaagtacagtggaaccccagagcactctacctgctttctttctcacctccttaaaaactttttttgcccwcacctcatcatttattcagcagtcacaacagtgccaagaacttggctagagattggaaataaagcttatgccttctctcatatctcctgtaccttatttc

SEQ ID NO: 17679 - DNA, 201 bp, Homo sapiens
ggcaggcgaatcgcttgaacccgggaagcagaggttgtagtgagctgagatcatgccactgtactccagcctgggtgacagagcaagactgtctcaaaaargaataaaaatgaataaaaattatgtgattagagaggggaaaacaatcatttcttgtgcgctaatgccactcagcaggtgcttacactgtctggttcatcc

SEQ ID NO: 17680 - DNA, 201 bp, Homo sapiens
tgaaataccttggatttaggaattggagatttccttgggtcaggtttcaccctcttcaagtagcgtctcaaacagtatacccactacagctttctccccastctgtcaaccatgccatggggcctactttttgccctgactcccaccagataatgcccatcagatggcacctcttttggctgaaaaatcgaaaactcatca

SEQ ID NO: 17681 - DNA, 201 bp, Homo sapiens
acttgttaacttctgtattgtcttttctgctgctttatccaactttgcaatctataagcttctgttactggaaaatggtgatggtaaagtaattgctttcytatgttccatcacagagggtagactgctagctctagtatttttcaatgctgctttttaagtgatagatgtataccattcagtaccaaccctgcaccctgg

SEQ ID NO: 17682 - DNA, 201 bp, Homo sapiens
gagtctaggactcagcagctgtcaccttcccaaagtcacactgctgatgagtgacagagaccacatttaaatctgtgtgtttacaaggtctacaactgcaycctgctacctcccagaagctgaggcaggatgggcaggttgccacaccctcccaacctcctgcaaccttagttgttagtgaaaggttattaaataggcctc

SEQ ID NO: 17683 - DNA, 201 bp, Homo sapiens
aaatggtgatggtaaagtaattgctttcttatgttccatcacagagggtagactgctagctctagtatttttcaatgctgctttttaagtgatagatgtataccattcagtaccaaccctgcaccctgggacatgcctccttgctgaaactaccatttatctttgtgaattcattattcgtttttccaacaaacttttatt

SEQ ID NO: 17684 - DNA, 201 bp, Homo sapiens
acatgatggcaaccaggctccaatatctgccagttcccctgtacagattcctctttagcattctctcggcttccctcctcaacaattaattcagatgagcmgttgggagagtgcaggatccagttcaaaaggatctgtccccccgtgaaccccaggacagggtgagaggccacctgcacactttttttttgtcagctcaca

SEQ ID NO: 17685 - DNA, 201 bp, Homo sapiens
aagttaaaaaatagcacagaggggatccctgtgatttttactcacttttctacaagcatgactccttatataactacagtacaggatccaaaccaggaaayatgcctgggtacaatgtgagtgtataattccaggtaggtaaaataatggcccttattaggatgtctgcgtcctaatccgcggaaactatggatatgcttt

SEQ ID NO: 17686 - DNA, 201 bp, Homo sapiens
ttggccagactgctcttgaattcctaacttcaggtgacccacctgcctcagcctcccaaagtgctgggattacaagcatgagccactgtgcccagcctagraataacttttaaatcagaaaaatacattttttaaaaagatgtaaagcatacatagaggataacttacaaatctgcatttcatgaccacatatatctattg

SEQ ID NO: 17687 - DNA, 201 bp, Homo sapiens
gagatgtagctttgaatggccacatgagtgtttttttaaatgaaaaaaaaatctatgtataacttgtttcctgtgagggtgccaggaaactttacaatgarcttcgtgaattaaacctctaccagatgaatagaggtggtggcatggtagcagaaattaggattaaaaaaatggtttttgatttatgaaaaatttttctgc

SEQ ID NO: 17688 - DNA, 201 bp, Homo sapiens
tgtggtgtgcggtgcaacccgggctgtgttcccgagtgcatcaaacggggattgggacctgttttccttcccactcacatgtaggtcacctacgggagcargggaggaaccatctgaggtgtttttttttttttttttagatttctcattgctgagaacagttccagctctgctgaccaaaggctgagtgtccttttatta

SEQ ID NO: 17689 - DNA, 201 bp, Homo sapiens
aagaggtcacataggatattccatttatataaaatatgcagagtaggcaaattcataaagacagaatacgcatcggtggtttctggggcggcggggagtakggaaagcctgttaatgagtacaagtttctttagttttttttggttttttgttttttttttgagacggagtcttgctctgttgcccaggctggagtgcagt

SEQ ID NO: 17690 - DNA, 201 bp, Homo sapiens
tctccgacttatgtatgattcatcaagaggactccaggctgtggtgtgcggtgcaacccgggctgtgttcccgagtgcatcaaacggggattgggacctgktttccttcccactcacatgtaggtcacctacgggagcaggggaggaaccatctgaggtgtttttttttttttttttagatttctcattgctgagaacagt

SEQ ID NO: 17691 - DNA, 201 bp, Homo sapiens
aggagctcttggattgcaatttttcattcacccctccctctccacccttcctgtcttcaagcctgagcaggtgatactgcattttgtaccgtatgactttwaaacagaaccacgagttcagaactttggttaggtcctgcccgtgttctctagctaacgcatggcaacgctggtttccaacctttcactgtgcgggtttct

SEQ ID NO: 17692 - DNA, 201 bp, Homo sapiens
agggagatggagggaggcaaaaagaaaaagggagaaggaaagagaggaaagaggggaagggaggaaggaaagaagagagagaaggaggaagagagggaagkaggcacagaggtagagaggcagggagataatggagatcctggccaaaagttaatgctccgtttctagtagtccacagaaagcaccttgaccaagtgactg

SEQ ID NO: 17693 - DNA, 201 bp, Homo sapiens
ctttccattaagtgagtctttctccaagggaacagaagtcttaggttgttgatctggcggtcagaacctaggacaggcaaggcagtgggctgttgtagagkagatgaagctgatcagagcacacccacaccagtgacaaccggtcaggacctgggaagggctctgacccattcatctgagagatgtggcatgaggaacact

SEQ ID NO: 17694 - DNA, 201 bp, Homo sapiens
attgcattgcaaataatagcagttagtgggagttgagagccagctctgcaccagactcgtatcagccacttgacctccattattccttattccttggtacytctgcgccatctgtgatatcagatccttttttctgcaaggaaactgaggctcggcgatactaagaaactcagccagggtccgtcagctgtcaagtggcat

SEQ ID NO: 17695 - DNA, 201 bp, Homo sapiens
taaagtgatagagaggggctggcgaggagagcagtctaatttcaggaaagtcagaaaagtctttaaggaaactgaaggctgagctgccagggccagccacrtgggtactggagagtgggaggcccagtcacggggaatgctggcttagcacaactgaaaaatacaaaggtagaatatgaagtgtaatgacatggtttagat

SEQ ID NO: 17696 - DNA, 201 bp, Homo sapiens
cgggtgtggtggcgtgtgcctgtaatcccagttactcgggaggctgaggcaggagaatcgcttgagcctgggaggcagaggttgcagtgagctgagatcgygccactgcgctccatgctaggtgacagagcaagattccatctcaaaacaaaacaaaacaaaaaaacaagaagttaaggattgcagagcataagtatcttc

SEQ ID NO: 17697 - DNA, 201 bp, Homo sapiens
cccatataccacagtttctaatacgatattataccaagctttaatatgagcacacctcctggatgatgctgtaaattagttgcctcccaccacaccacatsaagtataatggatataatatgatttttcagaattcagctaattacctactgagctttacattttgtaacttttttgactgtccatcaaaatgtctttggg

SEQ ID NO: 17698 - DNA, 201 bp, Homo sapiens
gcagtctaatttcaggaaagtcagaaaagtctttaaggaaactgaaggctgagctgccagggccagccacatgggtactggagagtgggaggcccagtcasggggaatgctggcttagcacaactgaaaaatacaaaggtagaatatgaagtgtaatgacatggtttagattgaaatctgatgtggatggaaaggttttgt

SEQ ID NO: 17699 - DNA, 201 bp, Homo sapiens
actctaatgacataattacctcccaaagtccgcacttcctaatgttaccactctggaggttagaatttcaacatataaattttggggggacacattcagaycacaataatgttttataatgttccttttgctttaacaagagacacatgtcagatagtagacatgatctgagaagacacaaaacccagcgtggtgattttg

SEQ ID NO: 17700 - DNA, 201 bp, Homo sapiens
gtagtttaactaaaaagtggccactgtctcctggtagcggttggtaagccatccagtctctgcaggcatctacgctccaggtctccagtctgaggagtctsgctcctggggcaggtgcctctgggggtctctgccaggcttgtctggtcatgcagctacttccagactgattcctagatcttgcatttttacataggacat

SEQ ID NO: 17701 - DNA, 201 bp, Homo sapiens
taatgacatggtttagattgaaatctgatgtggatggaaaggttttgtggcctttcagcccaaggtttgaaaaagaaatggaatttctaaatggagtgggyagccacaggagggctttagacaggaccgtggccccgctggattttctgcccattgacttgggctcgaagtcacgtccatgttgctattacagatgcctcc

SEQ ID NO: 17702 - DNA, 201 bp, Homo sapiens
gaggatttgtttttgatctcataggtgtccatcttgctattttctcaactagcagaggcaactctctggggtatcttttaaaagggcactaatggccaggmgtggtggctcacacctgtaatcccagcactttgggaggccgaggcaggtgtctcggtggatcacttgaggtcaggaggtcgagaccagcctggctgacat

SEQ ID NO: 17703 - DNA, 201 bp, Homo sapiens
aactaaaaagtggccactgtctcctggtagcggttggtaagccatccagtctctgcaggcatctacgctccaggtctccagtctgaggagtctggctcctrgggcaggtgcctctgggggtctctgccaggcttgtctggtcatgcagctacttccagactgattcctagatcttgcatttttacataggacatccccagc

SEQ ID NO: 17704 - DNA, 201 bp, Homo sapiens
atgtggatggaaaggttttgtggcctttcagcccaaggtttgaaaaagaaatggaatttctaaatggagtgggcagccacaggagggctttagacaggacmgtggccccgctggattttctgcccattgacttgggctcgaagtcacgtccatgttgctattacagatgcctcccagaacagtttatataatcgtcaacgt

SEQ ID NO: 17705 - DNA, 201 bp, Homo sapiens
aagtgctgggattacaggcgtgaactactgtgcctggccaggataatctttaagaagaagataacattagctattcttctcacttcctacgtagaattccmtaccctgtgtctttggcctggaaagggtattggtagcaattgtcttcggctttccctgccatgtgtatgcattcccacggccacacaagcacacacacac

SEQ ID NO: 17706 - DNA, 201 bp, Homo sapiens
ccctagttgtatcaccttcctcccattatgtttgtaacttcagattttgtatatttcgcatatgtcaatatgtaaacattttatatatatatatatgcatkcacacacatgcatacatatatgtaatggtatatatacatgtaagtttccatttttgctcaaattgctctggacagttctttgctctgggagttctttact

SEQ ID NO: 17707 - DNA, 201 bp, Homo sapiens
acaggaccgtggccccgctggattttctgcccattgacttgggctcgaagtcacgtccatgttgctattacagatgcctcccagaacagtttatataatcrtcaacgtatattcatggagcatcttctgtctgctagacacagaattgggtgttgggctttaaagatggatgaaaggcagtacctggtctagagaggctgc

SEQ ID NO: 17708 - DNA, 201 bp, Homo sapiens
cagtgagcccagatcgcaccactgcactccagcctgggtgacagagcgagactccatctcaaacaaacaaacaaacaaacaaacaaacaaactaagaacarcaacgaaaaaactcccatgtattatctatggattgactgtaaaatatgagaagcaataaatatgttcatcactagggccatctagaaatttctaacccaa

SEQ ID NO: 17709 - DNA, 201 bp, Homo sapiens
gctagacacagaattgggtgttgggctttaaagatggatgaaaggcagtacctggtctagagaggctgctacctggatggtgtgtttgccatcctcagtartgtgtgtcccttacagatgatgcccagtgactctacaattgctgggatactttttagaattttctttttgtgcattacttttgattcttggttctttctt

SEQ ID NO: 17710 - DNA, 201 bp, Homo sapiens
gaagaaatgctgttttaggaaatcaataggataatttttttttttttttgaggcggagtctcactctgttgcccaggctggagtgcagtggcacagtctcsgctcactgtaagctccgcctcccgagttcacgccattctcctgcctcagcctcccgagtagttgggactacaggcgcccgccaccacactcagctaattt

SEQ ID NO: 17711 - DNA, 201 bp, Homo sapiens
gagaagcaataaatatgttcatcactagggccatctagaaatttctaacccaagggtcaactaatctttccctgtgttgtatttcctgctctgcggatccrgcatcatgacctttgtactacccaggaaagccagtgttctcatgggctcttctcttttttatgctctaccagatgctagcactgtggcatgccattcgct

SEQ ID NO: 17712 - DNA, 201 bp, Homo sapiens
ttaaagatggatgaaaggcagtacctggtctagagaggctgctacctggatggtgtgtttgccatcctcagtagtgtgtgtcccttacagatgatgcccartgactctacaattgctgggatactttttagaattttctttttgtgcattacttttgattcttggttctttctttggcattagctcaccagtggcaaatat

SEQ ID NO: 17713 - DNA, 201 bp, Homo sapiens
ataaataaatacataataaataaacagtagtggttgaaagaaagggaaggaagaaatgctgttttaggaaatcaataggataatttttttttttttttgargcggagtctcactctgttgcccaggctggagtgcagtggcacagtctcggctcactgtaagctccgcctcccgagttcacgccattctcctgcctcagcc

SEQ ID NO: 17714 - DNA, 201 bp, Homo sapiens
tgtctgtttatagaaagtgtcaccaagttctgtcttgggcccgtccactcggttatatgtgctggaccctgggtggaagcactttgcacgtgtgcattcaygatgggctgtgctggaggggaaaacaggcatcactcccaaattctattcatgcaattaaaaattcctttcatttttatttgtgagagggtatgggtgcac

SEQ ID NO: 17715 - DNA, 201 bp, Homo sapiens
gacataggtctggcgatctttttggcatagacgtgtggacgttgtttttgacatttgtacatgcttttgctcaagttgaaggcccaagtttacccaattcractgcccccacccagatagaatattcatggttagaccataaactacataactggaaattttaaatctatttttatatgcatacaaaaactgcaggcctga

SEQ ID NO: 17716 - DNA, 201 bp, Homo sapiens
taactgggtgtggctgtgtcctaataaaactttatttacaaagaacaggaagtggcttggatttggtatctggcctggcagctgtggtttactactccttrgacggtggcccagagaccctttaaatgaaattcattttactagcaccctttttcatcatgagaaatatattctgtttttcttagaaaatgggttatgtta

SEQ ID NO: 17717 - DNA, 201 bp, Homo sapiens
ttggattatttatttatttatttatttatttatttatttatttattgtttgagacagtctcactttgtcaccaagtctggagtgcagtggtgtgaccttgrctcactgcaacctctgcctcccaggttcaagtgattctcttgcctcagccccctgagtagctgggactacaggcacgtgccaccatgcctggctaatttt

SEQ ID NO: 17718 - DNA, 201 bp, Homo sapiens
ataaactacataactggaaattttaaatctatttttatatgcatacaaaaactgcaggcctgaagcttctaaaaataaacgttactttcatcccattatasaaaaatgcatttgaggtggtcatcattttatttgggccagggtcttccgagacttgggacaataatatattttttctactttaggcaaatgtatgcagat

SEQ ID NO: 17719 - DNA, 201 bp, Homo sapiens
ttacaaagaacaggaagtggcttggatttggtatctggcctggcagctgtggtttactactccttagacggtggcccagagaccctttaaatgaaattcaktttactagcaccctttttcatcatgagaaatatattctgtttttcttagaaaatgggttatgttaggtctggtcaaggtaaataagtgttgagagtcgat

SEQ ID NO: 17720 - DNA, 201 bp, Homo sapiens
cccctttcctttcccaaacttttactagcttcttccatcctggacttgcaatctggctgaaaacctgctaaataagggaacaattttgacatggctcctgkactccccacaaacctagttgattccagaccagtaatgtcttggggacagtgttgtcccatcttcctttctaggctgggctcagattactgacgtggaaga

SEQ ID NO: 17721 - DNA, 201 bp, Homo sapiens
gcagattcttaaagcatgaatgctgtattacacacattataaattcgagtaacagaaatgtttgtgtgtagaaatagaatacggagtatatattttgtatwaaataacctctgtggtatttgtttaccctgattttttgatttatgagtcgtcattgctcgctatagaagaagaaaaataaatatgcaaaacagtggtaga

SEQ ID NO: 17722 - DNA, 201 bp, Homo sapiens
ggggtttcaccatgttagccaggatggtctcgatctcctgacctcatgatctgtcagcctcagcctcctaaagtgctgggattacaggcgtgagccactgygcccggccggggatcttgtattaatagtagggagacagtaagcaagcaaggctcagttaatgataaattgttatcaggagacccagcagtttctgctttt

SEQ ID NO: 17723 - DNA, 201 bp, Homo sapiens
agtcttcaggcccacagtgtaggcattcaacaaacgctcttcagggagaaggaaagttaccatcaaaatccgtcgttgaaagtattgaagttccagctggyggtctgatacagcttagatgttgtccctgcccaaagctcatgtcaaaaggtaatctgcagcgttggaggtggggcatggtgggaggtgattgggtcatgg

SEQ ID NO: 17724 - DNA, 201 bp, Homo sapiens
cccacagtgtaggcattcaacaaacgctcttcagggagaaggaaagttaccatcaaaatccgtcgttgaaagtattgaagttccagctggcggtctgatayagcttagatgttgtccctgcccaaagctcatgtcaaaaggtaatctgcagcgttggaggtggggcatggtgggaggtgattgggtcatgggggtggattt

SEQ ID NO: 17725 - DNA, 201 bp, Homo sapiens
gatcacacagctagatcacagtgggggaacctgaattatggggatgctcacaaaagggcaaaacacaacggttgctgtcatttgatgctttatgttaagtrtgcatatgctcagttacagaaacctaaattgctaaattgcaaggctgtatatgatatgccaatttggcatattctgtctttttatattctgccaccccta

SEQ ID NO: 17726 - DNA, 201 bp, Homo sapiens
aatctgcagcgttggaggtggggcatggtgggaggtgattgggtcatgggggtggatttctcatgaatggtttaccaccatcctcttggtactgtcctcamgatagtgagtgagttgttgggggagctggtcatttaaaaatgtgtggcacagccccccaccctgtctcttgctcctgccctggccacatgacgtgcctgc

SEQ ID NO: 17727 - DNA, 201 bp, Homo sapiens
tctgtttttcttagaaaatgggttatgttaggtctggtcaaggtaaataagtgttgagagtcgatgttgtgtgcatagttaatttcaattctttgaagaarctcccccatgatatttcacggctgagagaagaggaaagagtttaagtggaacagtgtgctttgctgagctttggaaatattaccatatagggaagcaggt

SEQ ID NO: 17728 - DNA, 201 bp, Homo sapiens
cacagtgggggaacctgaattatggggatgctcacaaaagggcaaaacacaacggttgctgtcatttgatgctttatgttaagtatgcatatgctcagttrcagaaacctaaattgctaaattgcaaggctgtatatgatatgccaatttggcatattctgtctttttatattctgccacccctatcatacttatgaaaat

SEQ ID NO: 17729 - DNA, 201 bp, Homo sapiens
acatatgtattcattcattcattcatttattctttcattcagtcaataaatatttattgagtagtaagcacatgcaaggcattgagggtggggagggaaaragacacaaattgtccttaccctcatggattcaccatctatttaaaggccacaaatacttgtgtgagaagcaagtcttaatagtctgaagtattttcttag

SEQ ID NO: 17730 - DNA, 201 bp, Homo sapiens
atataatgatgataataattgctaatatttatcagctatttatcatgtgtcatgtacagctaagcacttacataccatcccattttatccttataatgackctaagagtgggttaaaaaatggcagaagaatggcagtgtttaatggttcagcctggtgcaatgattaaccacattttacagactaagaaattaagaacct

SEQ ID NO: 17731 - DNA, 201 bp, Homo sapiens
ttcagtcaataaatatttattgagtagtaagcacatgcaaggcattgagggtggggagggaaaaagacacaaattgtccttaccctcatggattcaccatstatttaaaggccacaaatacttgtgtgagaagcaagtcttaatagtctgaagtattttcttagattcccttgagccgcaatgctgaaaagcttatggtgg

SEQ ID NO: 17732 - DNA, 201 bp, Homo sapiens
ggagggaaaaagacacaaattgtccttaccctcatggattcaccatctatttaaaggccacaaatacttgtgtgagaagcaagtcttaatagtctgaagtrttttcttagattcccttgagccgcaatgctgaaaagcttatggtggttttgctaatgaatttgacaaggccagaaatagaccagatgaagattgatccat

SEQ ID NO: 17733 - DNA, 201 bp, Homo sapiens
ataaaaatttggtatcaattgtttggctaaattatgcacagtgggccatcctaacctgccattaacataacgtatgctaaagaatgtgttgtgtttttttsttttctctgataattatactctaaagcatcaattgcttatttgagtaaattaaactttgagttgttcttatttcttcaaactttcaaattgtcttgcctg

SEQ ID NO: 17734 - DNA, 201 bp, Homo sapiens
tgtaatcccagccacttgggaggctgaggcagagaattgcttgaacctgggaggtggaggttgcagtgagctgagatcatcccaccgcacaccagcctggscgacagagtgagactctgtctcaaaaaaaaaaaaaaaaaaagttacttctgagttaaaatatgaagagtgagcagtacccagccatgcagaaggacatgg

SEQ ID NO: 17735 - DNA, 201 bp, Homo sapiens
cctttttctggggtcttttgcctaatcgtttactggtttggagacactgttttctgtattgtttaggactgaaaatgtagacctaactgaaatcaagcackcgagtatcctaattattttaaattcataatgaatagtcatcatggtttcactttttttatgtactcttttgaaagagtacgatgggggaataaaagccag

SEQ ID NO: 17736 - DNA, 201 bp, Homo sapiens
atcattaaaatgagaacactgttattggtctttcgggattgttttgagaaatgagatatcgagacatgcctggcacaaggccttaattcttcttcatggtmaagaaatggcagattttcccccttccattcccacccttgcacatagtaggttctcagcaagtatttgtagatgtaatcgaccagcagagatcatttgtac

SEQ ID NO: 17737 - DNA, 201 bp, Homo sapiens
ggagttttgtttgcaaatgatcacctggtaatttaagagggtgagctaaacttcctccttttctagtatggacctttggggctcaggatgaggatgttcamtttgtactgctggtggagctgcctttccattaagtgagtctttctccaagggaacagaagtcttaggttgttgatctggcggtcagaacctaggacaggc

SEQ ID NO: 17738 - DNA, 201 bp, Homo sapiens
agaagcttagtctcaatttcagagagttattttggcaacatatttgggaaaatgatagttagatgctgcgttagccagcctctgcatgattttttacgcaraacaaacagttccaaatatcagtgctttcagcaactcatatatttctcacttatggtgcatgtcgctgatggttggctgctgctctgatctcactccagt

SEQ ID NO: 17739 - DNA, 201 bp, Homo sapiens
gcttctttttatttcttagagccagagctggaagacaaggcctggcatattttggcaggcctggatcagagcctaggtgtgtaaattaggaattgcatttsgctgctgctaacaaggacccaaacatggtggtaaattcttccacataaaacaacagaaaataagttgttttctggccctgggctggggtggccactccac

SEQ ID NO: 17740 - DNA, 201 bp, Homo sapiens
gggtttatgatcaagtaaagagtttaaagaagtgttttatgagggagttttgtttgcaaatgatcacctggtaatttaagagggtgagctaaacttcctcmttttctagtatggacctttggggctcaggatgaggatgttcaatttgtactgctggtggagctgcctttccattaagtgagtctttctccaagggaacag

SEQ ID NO: 17741 - DNA, 201 bp, Homo sapiens
aggacatatgtgtcttctgccaagatgtggaattttggcaaggctagcatgataacaaataaacattcaagcagtcacttaatgatattgaattgaacacmatttctcagaagttcctgtattaaattacaaccataagaacatacacaagcatgcagattgtaagtgtgatgagaatggaaacattccataggacgcaga

SEQ ID NO: 17742 - DNA, 201 bp, Homo sapiens
ttgggtaattctaatgcttacttcatcccagggctgatgtgtgttaggttagggtttatgatcaagtaaagagtttaaagaagtgttttatgagggagttytgtttgcaaatgatcacctggtaatttaagagggtgagctaaacttcctccttttctagtatggacctttggggctcaggatgaggatgttcaatttgta

SEQ ID NO: 17743 - DNA, 201 bp, Homo sapiens
actcctgtacttcaaggttttggagtgggaaagttgaggaaatgtaagagatcatctctgtctctatcacattaccgacggagaagtgggataagaactaygtgtgttttcacttcttctttctttagagaaaacaaatatcatctgccttgctaggtagttgtgagaaatgaggagataatatctttaaatctcctacgg

SEQ ID NO: 17744 - DNA, 201 bp, Homo sapiens
actagcttcttccatcctggacttgcaatctggctgaaaacctgctaaataagggaacaattttgacatggctcctgtactccccacaaacctagttgatyccagaccagtaatgtcttggggacagtgttgtcccatcttcctttctaggctgggctcagattactgacgtggaagagttgttggtcctggtgcaacatg

SEQ ID NO: 17745 - DNA, 201 bp, Homo sapiens
ggcggtgcatgcctgtaatcccagctacttgggaggctgaggcaggagaatcccttgaacctgggaggtggaggttgcagtgagctgagatcacgccattrtactccagtctaggcaacaagagtgaaactctgtctcaaaaaaattaataataataatgttacaataataataatgttagtgatacatatcattttgaaa

SEQ ID NO: 17746 - DNA, 201 bp, Homo sapiens
atagaagtttatgacggaaaaggcaaaattctctgtgtctttatggggagatattcgatatgttttttcttggcagaaataaaacatattcaataatatamttaggcaaacttgttttacttgacaagaagaccgtatctccgtctgcaagatgaaggcaagatcaagagatgtcagttaacattcttgcgaccacaggta

SEQ ID NO: 17747 - DNA, 201 bp, Homo sapiens
tatatgtctttctttcttttcttaggttaacttttttttttttttttccttttgaatgaccacaaagcatatctacccagcggggttactttttttttccytttcagtattcatgacgtcaagtccctgtttgttatcttattgtcctcttatcctggtccttagagtctttcaagagaagaggttgatcccggtgtaatg

SEQ ID NO: 17748 - DNA, 201 bp, Homo sapiens
agagaaaaacaattacactagctgctggtctgtatttactggttagaatagaatattattaccatcaagaataacattagtggccaggtgcggtggctcaygcctgtaatcccagcactttgggaggccgaggtgggtggatcacctgaggtcaggagttcaaaaccagcctggccaacatggtgaaacccccgtctctac

SEQ ID NO: 17749 - DNA, 201 bp, Homo sapiens
ggaaaaggcaaaattctctgtgtctttatggggagatattcgatatgttttttcttggcagaaataaaacatattcaataatataattaggcaaacttgtkttacttgacaagaagaccgtatctccgtctgcaagatgaaggcaagatcaagagatgtcagttaacattcttgcgaccacaggtagggaggagaactggg

SEQ ID NO: 17750 - DNA, 201 bp, Homo sapiens
ttgaccaatttttgtaaatctcttctgttactgtttatatacccggccacttctgccaaaatatgctggccttttagtcttttggttttttctctcttttkgtttgttggcttatgttcgctgcttgatctgactactggttttatttctaaggatttttttttaagttggcatctttttttctttgactttccttgtatg

SEQ ID NO: 17751 - DNA, 201 bp, Homo sapiens
aaggcaaaattctctgtgtctttatggggagatattcgatatgttttttcttggcagaaataaaacatattcaataatataattaggcaaacttgttttasttgacaagaagaccgtatctccgtctgcaagatgaaggcaagatcaagagatgtcagttaacattcttgcgaccacaggtagggaggagaactggggagg

SEQ ID NO: 17752 - DNA, 201 bp, Homo sapiens
ttactgtttatatacccggccacttctgccaaaatatgctggccttttagtcttttggttttttctctcttttggtttgttggcttatgttcgctgcttgrtctgactactggttttatttctaaggatttttttttaagttggcatctttttttctttgactttccttgtatgcccccctttctcccctgcattgtcttg

SEQ ID NO: 17753 - DNA, 201 bp, Homo sapiens
gttcaagaaggtcttgggcaagcgcgtgctagttattttcctcactggtgtggtcgtgacagatgaatcacattttactctcctccctttctcatagtatrattacataaaggagaccttccctggaaagagccctgtgcatggcttttgagagtgggcctgggctaacagtgagtgtggaagcttgctgccttgaattct

SEQ ID NO: 17754 - DNA, 201 bp, Homo sapiens
ttgtttttatttagggctcatctggtatgtgtattatgttcttggtagacagaagctgtctttagttcgtatgggttgagcatggagggaacttcatctcrtagtcactggataaggagccagtcctggctcttcctttaactgcccttgtgaccttgaacatgtcagttcatctcaccacgtagtcattttctcatccgt

SEQ ID NO: 17755 - DNA, 201 bp, Homo sapiens
gggctaacagtgagtgtggaagcttgctgccttgaattctttccaattctggagagttgatgggtaacaagtgtgtatctatagtctgcttggacatggcrgtgtggccactgacacgttgtcagccatcccctcaactccagggacaggaatggtgagaaggtggtgagggcacagtctgcccggagacgggacagtttg

SEQ ID NO: 17756 - DNA, 201 bp, Homo sapiens
gctgatctgcatagcacttcgcaatgaagctgtgctctagaaacataccacgatctactggactttcttaaataaggtggttgttcaggaaattcctccarttaattttactttaattccccctacaagaatgccgagacacctctgcctattttctctttctgtgtttgttgtttcttttgtttttgttttcgagactga

SEQ ID NO: 17757 - DNA, 201 bp, Homo sapiens
tcagaaatgcatgtcagagctacacaattctatccaaggcattaactgttgtcaagtctgttttttatgaatatgtttcaatataagaaattgtcttaggyccaaagtgaaacgtcttcctccttgactcatagcaagctcatgcaggtatttgaacattgttctgtataatatgtgcacctttgagaaatcccatgattc

SEQ ID NO: 17758 - DNA, 201 bp, Homo sapiens
ggattacagggatgcgccaccatgcccagctaattttttgtatttttagtagagacggggtttcaccatgttggccaggctggtcttgaactcctgacctsagttgatctgctcacgtcggcctcccagagtgctaggattaaaggtgtgagccaccgtgcctggcctctttctgtttcaaagaaatagtcaagaagtttc

SEQ ID NO: 17759 - DNA, 201 bp, Homo sapiens
aacttttgtagttgctgctggtctctttggaaggcaagtgctaatttacccacagttgaaacctgacacacacacgcgcgtgcacacacacagacacacastctctctctctttctctgtctctctctctttctctgtctctcataaggaactaaatcctgcgttttctcaccagagggctaatgacacactgcttagtca

SEQ ID NO: 17760 - DNA, 201 bp, Homo sapiens
tggcctctttctgtttcaaagaaatagtcaagaagtttctagatgcacacaaaatgaccaaaccagtctttccgcttatttacacaatgaagaaacatcasagttcaccctggaagacagagtttctttctgtcttcatcctagggcacaggagagatgcagtgatggcatgtctccactctgcagacatgttgcaggcct

SEQ ID NO: 17761 - DNA, 201 bp, Homo sapiens
gccacttgcagaccttggcagttgctgttgctcctgctgctgctgctgctgctgcattgtcaagactacattgatgtcttggaaatatagaaaaaagaggmtgctggactgtgtgcttagaatcagtgtgctaactctgttaccaacaccgtagagaagtggttccagaaggaagagttcagggtgagaatgaataacgga

SEQ ID NO: 17762 - DNA, 201 bp, Homo sapiens
ctgttgctcctgctgctgctgctgctgctgcattgtcaagactacattgatgtcttggaaatatagaaaaaagaggctgctggactgtgtgcttagaatcwgtgtgctaactctgttaccaacaccgtagagaagtggttccagaaggaagagttcagggtgagaatgaataacggagtggctttgcagtgggaacctggc

SEQ ID NO: 17763 - DNA, 201 bp, Homo sapiens
aggatagtttcccttcctggaagattgagatgaaataaagctttaggagttggtatcgcacgcaggcattaaatggattgtgaagagggactttgttcccsctcagtcttgtctctgcctccgtaaaggagtaagttaaaaaagaaagtttctttttttaaaaaaaagccttactgctcaataaatccctgtggaaaaaaa

SEQ ID NO: 17764 - DNA, 201 bp, Homo sapiens
tttgggttgatgagatgctggtatgtatcattcgttcagccattctttcagtaagtcatcacggaagtctgcctctgtgacagattctggggctctaaggmggaatttacttcttcaaagtacagtttcctgccttgcaagtttggagttaaggccacgcagaccagagttacgtgcacaggttgtaatactctctcttgt

SEQ ID NO: 17765 - DNA, 201 bp, Homo sapiens
gcagtcccaaagcccggggcatggatccagagaggagggtgaagaatgggcccctgacccaagactgcacttgtatttgagttgcataagaagctgctgakgaattttaagaacaggagtgacatgacttccgttacaattgaaaaaatcaatctggcgaaatgaatggggctacataggttgggggaaggaggtaagaga

SEQ ID NO: 17766 - DNA, 201 bp, Homo sapiens
ttgttaaacttcttgcactgagctttaccaggtgagctgacagttatcctctgcattcatcaatataagccccataaaaggcaaagtggttgaggagaaaygagaaattacagcccagattagcagccttgagtgctccttgtgaacacaagacactgacccaaatcacacgtcacggctcttcgcccattaacgcttata

SEQ ID NO: 17767 - DNA, 201 bp, Homo sapiens
catcaatataagccccataaaaggcaaagtggttgaggagaaacgagaaattacagcccagattagcagccttgagtgctccttgtgaacacaagacactsacccaaatcacacgtcacggctcttcgcccattaacgcttatagcaggattattcccaaggaagctgtagccattatatttgctgccatcacaacagtaa

SEQ ID NO: 17768 - DNA, 201 bp, Homo sapiens
ctcgtttttccttttttcttttcctttttttttttttttttttttttttttttttttgagatggagtctcactctgttgcccaggctggagtgcagtggcrcaatctcagctcactgcaacctctgcctcccgggttcaagtgattctcctgcctcagcctcccaagtagctgggactacaggtgcacaccaccatggctg

SEQ ID NO: 17769 - DNA, 201 bp, Homo sapiens
cacggctcttcgcccattaacgcttatagcaggattattcccaaggaagctgtagccattatatttgctgccatcacaacagtaaaataaacaggtgtgaytgcagccctactcctcgggttgtttcatgctgatcagttgttaatatatgtgtgacttgaagttggagcctgttgggagaaaaagttgtctttagaggag

SEQ ID NO: 17770 - DNA, 201 bp, Homo sapiens
caatcacttactaactgcattgtgggttaacacagtgtgtgtgtgtgcacttactaactgtgcaactgtgggcaagtgatgtaatctctctggagctcgtytttccttttttcttttcctttttttttttttttttttttttttttttttttgagatggagtctcactctgttgcccaggctggagtgcagtggcgcaatc

SEQ ID NO: 17771 - DNA, 201 bp, Homo sapiens
aggagtaaagtgttgccttgctgtgggaaggggaaactttttcttgggaagtggactcaccaataatttttgcatcatgcgcaggagaccctactaaaacstaagtgtgcaatgctttaaatcagtaagtttgtttttcattaacataaaatccaaaacaggtgctgtgatcagcaagccgctgtcctccaagtggtaatt

SEQ ID NO: 17772 - DNA, 201 bp, Homo sapiens
acagcttgcatgtgtagttaatttgttccaaatttccatcctgcattataaccctaatgtttgctaataacacacaaacccacattttattaagtaagtartttgagacatgatgatttttgtcatgtaaataggatcaggctgaccagtatagactgggcagaggaagattcataaccagggaattaatctctggatcca

SEQ ID NO: 17773 - DNA, 201 bp, Homo sapiens
ggctgcatagtattccatggtgtatatgtgccagccatcccgttactgggtgtatacccaaaggactataaatctttctgctataaagacacatgcacacrtatgtttattgcggcattattcacaatagcaaagacttggaaccaacccaaatgtccaacagtggtagactggattaagaaaatgtggcctttgcctctt

SEQ ID NO: 17774 - DNA, 201 bp, Homo sapiens
ctataaatctttctgctataaagacacatgcacacatatgtttattgcggcattattcacaatagcaaagacttggaaccaacccaaatgtccaacagtgrtagactggattaagaaaatgtggcctttgcctcttttaaaaagttctaagttgctagccagtcggaacaaatacagaatgtgaggtccctttccagccaa

SEQ ID NO: 17775 - DNA, 201 bp, Homo sapiens
aaagacttggaaccaacccaaatgtccaacagtggtagactggattaagaaaatgtggcctttgcctcttttaaaaagttctaagttgctagccagtcggracaaatacagaatgtgaggtccctttccagccaatggaaaccggacacagcagtagagtacacgtgtcaggttataaatgagcctgtctcctttgtccgg

SEQ ID NO: 17776 - DNA, 201 bp, Homo sapiens
ctcttttaaaaagttctaagttgctagccagtcggaacaaatacagaatgtgaggtccctttccagccaatggaaaccggacacagcagtagagtacacgygtcaggttataaatgagcctgtctcctttgtccggtgttctctcatggcaaaactgctggcgagtgtaccctttctgcagaaagtaaaaatggccttgct

SEQ ID NO: 17777 - DNA, 201 bp, Homo sapiens
tgctggcgagtgtaccctttctgcagaaagtaaaaatggccttgctgaggaaattaaattcctgttcgagtgctatttctttatggcactgaggagcaagyatttctaacaatcatattgcttaagaagtggatggcaagaagataattactaatatgtctgcaattgatctgaaattgacacagttgatctaactgattc

SEQ ID NO: 17778 - DNA, 201 bp, Homo sapiens
tgaatggaccctgagtatcttagaatcttctgaaataatatgcagcattatattccatttgtacctgggaagagggtacttgtctttcatcagagagtcaycaatggaccactggtccctgctgatttagtgtcacagctcaaaaccatcagtagtcctcgtgatctttcggcattgtggctccctttgtgagaagggcct

SEQ ID NO: 17779 - DNA, 201 bp, Homo sapiens
gtgaatctcccaaccataagctgtattcaggcaggcacgaagtctcttatttactcagtgtttctggagcccagcatagtgcctcgcacacagcaagtgcycagtgggtatctgttgaaccggcaaaacaaacaaatgaataaattaatgggtggtcactgtactagttttctattgcttcataaacaaactatcacaggc

SEQ ID NO: 17780 - DNA, 201 bp, Homo sapiens
cactgtactagttttctattgcttcataaacaaactatcacaggcatagtgagttggaatgatggctctcaaaaaactatgtccacatcctataaatgctrttgtacaatatatggtcttttgtgattggcctcctccacttagcgtcgtgtttttgaggttcagccacagttgtagcatgtccatctctctttgtgtggc

SEQ ID NO: 17781 - DNA, 201 bp, Homo sapiens
ttgttgtaaactcgtcctgccgcctggactagttacgcttcccttgattagctctgagaaacgaggcagcgggcactggggcagccacatagacaacatcyaaatttttgttgctttcctgggtcttgccctgtccttactgtttcccttgggcacgctgttcaccccttaggacatactacagtaaccttttcccaccac

SEQ ID NO: 17782 - DNA, 201 bp, Homo sapiens
tcttaatacaaactggcgtatgttatagttactgtcagttgttgtaaactcgtcctgccgcctggactagttacgcttcccttgattagctctgagaaacraggcagcgggcactggggcagccacatagacaacatctaaatttttgttgctttcctgggtcttgccctgtccttactgtttcccttgggcacgctgttc

SEQ ID NO: 17783 - DNA, 201 bp, Homo sapiens
cccatgtgtgtatgtctaacccagtgacaggtaaggcagccaggagctgctgttatttcagtgcaaagctgttttcacaatcacagacatgcacagctcaraaaccctcacaggtcacgcctgaataccttcaatgtgccccatgtaaaaatacactgcaagtcgattggacatgccctatgaattataccttatttatga

SEQ ID NO: 17784 - DNA, 201 bp, Homo sapiens
ctggagggtccaggagccccctgaactgagtatccggtgggaggtcagatttccgcattcagaacgagagctcatacggcatccacgcgtgtctttctcaygcatatccccagcccgagtagaagaggacttctgcatctctgttagttctttctcctcctaagaaaaagcagattttaagtaacttatcatttgttcatt

SEQ ID NO: 17785 - DNA, 201 bp, Homo sapiens
gcatgttaacatcctggtagctctatttatttgctaccatggtacataatcatgggagctctatttatttgaacatcttcttttgttattatttggtgtayttgggaaaggcatgtgggagcagcaagcaggtgagcatcctgtttggaatgcagggccgggaactgccctgcccagtccagcctcattccagaggctagc

SEQ ID NO: 17786 - DNA, 201 bp, Homo sapiens
atttgttatttttctcttcccccccttagctgtatccctgcatttattacagcgcaggtgcatcttgcttttgagtgctaactgagatgaaaggagtgagraaacgctctcttcttcttgcaggggagggctggcaaattcagtgaatgcagagtcggctgggagcctttcggctggaaagctcttcctctgatgagctgt

SEQ ID NO: 17787 - DNA, 201 bp, Homo sapiens
agctctctgcttctttggcagtctagtgctgtcacagaaggaaagctcactccatggaaaaggggggattgatttcttctctgagggcagaggctgatcartctaggctggtaggaatagatgtaacctcagaggaaacaatttgcattggcgaaagcaagtcaatggccatccccaaattcaaaaggacagggaagtgta

SEQ ID NO: 17788 - DNA, 201 bp, Homo sapiens
gtcagataacccccgatcgtaataagccggaggataatcgcttgcattgttcaataaagcaattgctttgtcccctcacttagccccttcagaaaagccaraaagaatgtgccacctagatgctatttataaccattttcacctcttgcctccaggggctaaattggaaacctaattttagatgcataaaagccaaaatat

SEQ ID NO: 17789 - DNA, 201 bp, Homo sapiens
ctcccctttccaatacatctctctctctctttctctctctctctctctctctctcacacacacaacacacacacacacacacagccaaatcagacaccaayataaactgtagagttaacattctttttccaccctcacactttttttagctccgatctgtgttcaatttctgcctgagagagtgatatattcatatattta

SEQ ID NO: 17790 - DNA, 201 bp, Homo sapiens
gagtgacaagccctggagacctgagggcttctggggcccccagggcggtttcaggaggctgtctccagacctgtccggggtgtgagcatgtcacgctgtgrcccgcgcctcccctgtacagctgcctctgctcttctaagcactgaaatgagaggtgtaacctgtgttccagagtctgcgcctcccagccactggggcagg

SEQ ID NO: 17791 - DNA, 201 bp, Homo sapiens
taattatgtcattgaaaaaaacaccagtaattaaatcattatttcttagatgtgaggtccaaggacattctagaggaagtcaaaggcagagggaggaaggrtgggacgatggaggcctgaagggctggtggagaggaaagaaggcagcctgtgccgtcagagagagttcaactccatccgtgcagctgctagcatcttgcc

SEQ ID NO: 17792 - DNA, 201 bp, Homo sapiens
agctaattcctacctgtgcgatcactagccaagtactgaacctctctgaacttcaattatctcatctgtaaaaggtggttggtttgtaattgttcctaccycttagggcttttgtgagagtttagatgataaaccaccaagcaacagtggctggcattctgtgcacaatcgaagtctgctgctgtcagctctgtggtcgct

SEQ ID NO: 17793 - DNA, 201 bp, Homo sapiens
taacacctgcctccgtggtttgtcaggacatttagaaatgcagacttgctcaagacctggatctcaggtggtaggttggtccacagacagtggcaccactmgctattatttatttgttgtcactgtttgggacccctgttgctgtctcaccaaagaacttcttgtctcccttttagaagtttccagagcgtcttcctgatg

SEQ ID NO: 17794 - DNA, 201 bp, Homo sapiens
aacatggtgaaaccctgtctctactaaaaatacaaaattttttttgtattttgggattcggtttaggtgatgtgtgtctgtaatcccagctacttgggagrctgagacaggagaatcacttgaactccagaggcagaggttgtagtgagccaaacttgcacaactgaactccagcctgggcgacagaggaagactctgtct

SEQ ID NO: 17795 - DNA, 201 bp, Homo sapiens
aatttcatcactccaaaaagaaatctcataacaattagcagttattttccatcgctacttcctccagtcccaaggcaatcagcagtctgctttctatctcyacctgtttgcctattctggacatttcatatgagtggagttagataatacatggccttttgtgactggctttcacttagcataatgttctagaggttcatt

SEQ ID NO: 17796 - DNA, 201 bp, Homo sapiens
aggtggttggtttgtaattgttcctacctcttagggcttttgtgagagtttagatgataaaccaccaagcaacagtggctggcattctgtgcacaatcgawgtctgctgctgtcagctctgtggtcgctgtctgcactcccacccctgtcatcctccaagtctgatctcctcccgaagtctcttcctggacctcagccctc

SEQ ID NO: 17797 - DNA, 201 bp, Homo sapiens
ataggaaggttatcctgggtgattagcatggatcagagttctcacaggagcccttcaaagcagaaggggaaggtggacaagagaatcggagagatgtggcrgagggtaggcagagagattgcaagcagggaaggatttcacgtactgccactggctttgaagatggagggggcacatggctagaaatatgggcggccctca

SEQ ID NO: 17798 - DNA, 201 bp, Homo sapiens
tggtattggtacaatcagtcaggaagcatttttcctggggagaaacttacaagtccacgatcaaagccaacaagagacaaggtgttacatgactcattttyggtttaagaagtgacaggctgattctaagttgggttcaattattttgttaaagcgttttgcttatttgacttctcctgacctcggaaataattctaacca

SEQ ID NO: 17799 - DNA, 201 bp, Homo sapiens
ttctcatgtacttactttaaatcagagagcccacctgtccaattctagcttctcctgggcatcctgtatttgacacagcccctcccagcattctgagtcaycgtctgctgctcttgcactgtccgttttccaaatgaggaactcatcggtaaggccagaaaggaaagggagaaaaaacaaacaaacaaacaaacaaaaaat

SEQ ID NO: 17800 - DNA, 201 bp, Homo sapiens
gtgagatctgatagttttataaatggaagtttcccctggccttcattctctttcctgctgctttgcgaagaaggtgcttgcttctgctttgccttctgccrtgattgtaagtttcctgaggcctccctagccatgcggaactgtgagtcaataaacctctttcctttatacattacccagtctcgggtagtatcttcatag

SEQ ID NO: 17801 - DNA, 201 bp, Homo sapiens
aaggctcgtgttaactccatctggacaaagccttgaggtatacgtgtggcttcttttgagcatcgtgccatagctgtccctgatctaccttgcggggcaawcacaacaagtaaaaggttttcctcttgaaggattgaacgcctcaatgcgtgcatcctacattgtctagtgggagaaatctccgttgtagattctgacatg

SEQ ID NO: 17802 - DNA, 201 bp, Homo sapiens
acaatccaagcacccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccct

SEQ ID NO: 17803 - DNA, 201 bp, Homo sapiens
tgagatattgggactgttcttattcccatttcacagatgagccactaactggctcctggcaggacagtgaataaggggcacaacagagacacaaacacatsgctaaccaatggtctcatccgtcagccacactgcctgtctcagcatgggccctgtgtggaccattccatctcaatttgtttctgattcttgtcaattcaa

SEQ ID NO: 17804 - DNA, 201 bp, Homo sapiens
cttgggctaaaatgtagttgttggcatttctttctggaggctctgggggaaggtcgttccttggccttttcccatgacgtagaggctgacacattcctctkctatggcctcttcatttttcaaagccagcaagattgcatctctctgtctttcttttgtggtcacattttaccaggactcttctcctgcttttttttttct

SEQ ID NO: 17805 - DNA, 201 bp, Homo sapiens
gcagcctgtaactcccagactgaagcgatcctcctgcctcagcctcccgagtagcttgtactgcagatgtgtgtcaccatacctggctgatttatacttayatttatgtatgtgcatgtgtgtttatatatatatatttgtagaaatgggattttgccatgtttcccaggctgggctcaaactcctgggtttaagcagtcc

SEQ ID NO: 17806 - DNA, 201 bp, Homo sapiens
caaagtagggaaagcacgactttggggccagggccctttctggttcagaatgtccctggccagtgtgcgccgtgcagtgtggaagcacgcttcggtgcgcrtgtaagtttacgtgctatctgtagggacagtgatttttattcattagagtttttgagtctaattgtttttaaactgccacttttgtttgttaaagataca

SEQ ID NO: 17807 - DNA, 201 bp, Homo sapiens
atatactgcacatgtttttgtttttgtattttggttcaaaaagagagtatgatctcacttttcccttcttgataggttgtagattccatgtctaatccatscttttccaatattccctcctaatctttcagttgaattatggtctttagctcaaatgcatgacatgatgtgtgtgcctttggagtggggcggtattagtca

SEQ ID NO: 17808 - DNA, 201 bp, Homo sapiens
ttagatgctcttagttaaagaccatgcaaaaaggatgaaatcttttgatcatgttcttcacaatattagaggtaaaacatgaactcaacgcttttaggaaraaacaactggattgcgttttctattttattgacagaaactagatggggaggccagggtgtgttttattattgcacacatacgtaattacaaagtctttgc

SEQ ID NO: 17809 - DNA, 201 bp, Homo sapiens
ataagtaagtgggaagtccaggggtagacgtgagttcaggcatagctggatccaggatccgacagcttgcatgtgtagttaatttgttccaaatttccatmctgcattataaccctaatgtttgctaataacacacaaacccacattttattaagtaagtaatttgagacatgatgatttttgtcatgtaaataggatcag

SEQ ID NO: 17810 - DNA, 201 bp, Homo sapiens
aagctgtaccttaagtttatagttatgcaaatgaaaaccattaatcctggagcctctgacttgcaaggtgtgcttcagaaatttgcagcttctatttaggyaggaagagtttgccagcccgaaaactccagtaagcaaacagctttatagtaccccagccatagaaagtgagagctttcgaagaatctgtggttagaacta

SEQ ID NO: 17811 - DNA, 201 bp, Homo sapiens
aattatagctcaaatttaattaaaatagcttttattgcttctattcatgtgtccctggattttaagtgatgcgtcagaatttcatgatgagcaaatgcctrtggatgccctcatttctcatccttcttgactgtctgctaagattcactcttggtcttgtctttgagcttttctgttcagtgatgtaatgggacaggctct

SEQ ID NO: 17812 - DNA, 201 bp, Homo sapiens
aagtaccaaaacaaaacaagaaacccagaattatagctcaaatttaattaaaatagcttttattgcttctattcatgtgtccctggattttaagtgatgcrtcagaatttcatgatgagcaaatgcctatggatgccctcatttctcatccttcttgactgtctgctaagattcactcttggtcttgtctttgagcttttc

SEQ ID NO: 17813 - DNA, 201 bp, Homo sapiens
caggacacttgctgttttctgttattttggtttatattgcttaattagccagcctttctaattaacattacattttgctgagttcacattgtgataaagawgaatatcaattcttttctactcatctcattgagagatagagttgaattcatcttcccttgtatctaggctgcacttattcgtttgcttgaccaatggaat

SEQ ID NO: 17814 - DNA, 201 bp, Homo sapiens
cttctctttatggatttccctttggaagcagggataagaagagggaaggtctcccagatgtaaatttctcataaatatttgagctccatttcagtaattcyttcattctctgatctgttgcctaatcttctatttagcaagtactttccatgaaatagaaggctttaattgatagaattactaatttgaatagcttagcac

SEQ ID NO: 17815 - DNA, 201 bp, Homo sapiens
agggtagtgtgaagtggcgttatagttctccttttaatggttgagacaagaattgcctggacctcttttaggatacatcaccagtcttccaatggcaaacktatgtttattccagctgattctccccagcatgggggcatgaattgcagtggaaatcagtggactagaatttggatgcaattgcccccaaattatcgaaga

SEQ ID NO: 17816 - DNA, 201 bp, Homo sapiens
atagtgagttggaatgatggctctcaaaaaactatgtccacatcctataaatgctattgtacaatatatggtcttttgtgattggcctcctccacttagcrtcgtgtttttgaggttcagccacagttgtagcatgtccatctctctttgtgtggctgaatatcattgcattgtatggatataccaaatatttttctcctt

SEQ ID NO: 17817 - DNA, 201 bp, Homo sapiens
gggaatagatgaagcaagctgcttctttcaaatgctcttccaatatgaagcaaaatattattgatctagactgcctgctactttcatttaccatgttactrctcgtgggattacaggcacaaaggtttcataaatttcaaatgaaatatgaacatttgttgtcaaagtactgttaaggtatgaaaaccctgctagtattag

SEQ ID NO: 17818 - DNA, 201 bp, Homo sapiens
ttggatgcaattgcccccaaattatcgaagagaaaagaagaccactgtaattcaccggccatagcatttttaccaactgtttttgctaagcattagtttcktgtgataggttcaattctcaggctccttctcattagagtctttctgtaaagaccattattatttctgttatatttcctgtggctgagctgagccgcactt

SEQ ID NO: 17819 - DNA, 201 bp, Homo sapiens
aaaagaagaccactgtaattcaccggccatagcatttttaccaactgtttttgctaagcattagtttcttgtgataggttcaattctcaggctccttctcrttagagtctttctgtaaagaccattattatttctgttatatttcctgtggctgagctgagccgcacttggagatttgatccattttaactctctcattgc

SEQ ID NO: 17820 - DNA, 201 bp, Homo sapiens
aacctcagtttcctttgccacaaaatagcaatacaaatttataattccttagattgctgtgagaatgaattgaggcaaggtaggtaaagtgcaaggaattktgtgtggccggccaggtgcagtgtggctcaagcctgtaatcccagcactttgggaggctgaggtgggtggatcacctgaggtcaggagttcgacaccagc

SEQ ID NO: 17821 - DNA, 201 bp, Homo sapiens
aagaagaccactgtaattcaccggccatagcatttttaccaactgtttttgctaagcattagtttcttgtgataggttcaattctcaggctccttctcatyagagtctttctgtaaagaccattattatttctgttatatttcctgtggctgagctgagccgcacttggagatttgatccattttaactctctcattgcct

SEQ ID NO: 17822 - DNA, 201 bp, Homo sapiens
gaggcaggagaatcacttgaactcggaaggcagagtttgcagtgagccagattgcaccaccgcactccagcctgggcgatgagtgaaactccgtctcaaaraataaacaagaattgtgtctggcctttgtgatagttactcaacaaatcatatctgtgattgttttggttttaacaataatggtttttaaaaaccgtaggt

SEQ ID NO: 17823 - DNA, 201 bp, Homo sapiens
catttttaccaactgtttttgctaagcattagtttcttgtgataggttcaattctcaggctccttctcattagagtctttctgtaaagaccattattattkctgttatatttcctgtggctgagctgagccgcacttggagatttgatccattttaactctctcattgccttcagagagttggtgattttggggggggcac

SEQ ID NO: 17824 - DNA, 201 bp, Homo sapiens
cagcctgggcgatgagtgaaactccgtctcaaagaataaacaagaattgtgtctggcctttgtgatagttactcaacaaatcatatctgtgattgttttgrttttaacaataatggtttttaaaaaccgtaggtgatcacatactacgcagaaagggaagcagttacagcattcacagcatccgtgagtcatagactcact

SEQ ID NO: 17825 - DNA, 201 bp, Homo sapiens
tactcaacaaatcatatctgtgattgttttggttttaacaataatggtttttaaaaaccgtaggtgatcacatactacgcagaaagggaagcagttacagyattcacagcatccgtgagtcatagactcactgcattgctccaaggtgcagattctagttggaaatgttaagttttttagagcaatgaaaaaattgatctc

SEQ ID NO: 17826 - DNA, 201 bp, Homo sapiens
cccgcagtttcatgaatgcctcgctgtgccaccaggattttcttggagggagccacggtcagatttcaagtggtcatttcactctttctccctctgggggmctgagacatgattaacttgcaataattgtgactccctcattaaaggagagctgtagcaagggaagaaatcattgagactgatcaagacatcccgtgctat

SEQ ID NO: 17827 - DNA, 201 bp, Homo sapiens
cactgcaactacaacatcccaggttcaagagagtctcccacctcagcctcacgagtagctgggatttcaggtgcctgccaccatgcctggctaattaagtsagtttcttaaagtcctacaactggtgagctgtgagctgtaaattgtggaactaatttttatactgccaatctgaggccttttctgacctcatcgctgcca

SEQ ID NO: 17828 - DNA, 201 bp, Homo sapiens
cctcacgagtagctgggatttcaggtgcctgccaccatgcctggctaattaagtgagtttcttaaagtcctacaactggtgagctgtgagctgtaaattgyggaactaatttttatactgccaatctgaggccttttctgacctcatcgctgccactgtaaaatgaattctagccccagaccatgacatgcctactagctt

SEQ ID NO: 17829 - DNA, 201 bp, Homo sapiens
tgaaactctatagacagcaaacagaatgatggttgcctggggctgggagtgagtggaggggattacctggaaagggtggggcaattttggggggtcaagaraatgttctaggacaagactgtggtgatggctgcacaactggataaatatactaactatcatcaaactgtatatttacaatggttaaatcatatggtatgt

SEQ ID NO: 17830 - DNA, 201 bp, Homo sapiens
gatacagatttcactatccatgaattgtggccttaactttctcatgtacttactttaaatcagagagcccacctgtccaattctagcttctcctgggcatyctgtatttgacacagcccctcccagcattctgagtcatcgtctgctgctcttgcactgtccgttttccaaatgaggaactcatcggtaaggccagaaagg

SEQ ID NO: 17831 - DNA, 201 bp, Homo sapiens
gagtaaaagtcctttatgattagcaaattgcaggtcctcccctttctgatatttacagcccttgcaaccgcctgtacaaaaatcgggaaaaggcagaagasggctgtcattaatgtaaaagcagctggttacctccccctccccagcgcacacatcacctcctagtacaattagtcaccatgtcttttcccttccgtcaag

SEQ ID NO: 17832 - DNA, 201 bp, Homo sapiens
agctgaaactgaaccaggtgggggaggcctgctaatgcccaggcagtcgaaatgacgccatctcatcactccttctcttaaaatttttttttgtctttctycttggatttccagcaacagggagctgccaccaccgtgtactgtgctgctgtcccagaactggagggtctgggagggatgtacttcaacaactgctgccgc

SEQ ID NO: 17833 - DNA, 201 bp, Homo sapiens
tcactgtccaatatggtagccacgtgtgactattaaaatgtaaattaattaaaattaaaagttcaattgctctgaaatagcagccacatttcaaatcttcwgtagccagatgtggttattggctaccatattgggtagcaccgatatagaacatttctaccatagtagaatgctcttttggatacatctgctttaaagcat

SEQ ID NO: 17834 - DNA, 201 bp, Homo sapiens
agagtaaaagtcctttatgattagcaaattgcaggtcctcccctttctgatatttacagcccttgcaaccgcctgtacaaaaatcgggaaaaggcagaagmcggctgtcattaatgtaaaagcagctggttacctccccctccccagcgcacacatcacctcctagtacaattagtcaccatgtcttttcccttccgtcaa

SEQ ID NO: 17835 - DNA, 201 bp, Homo sapiens
atgcatgacctgtgcaatgcacctgcttcggtgcctggcacagagtcgcaaagccacaaagatggtgcttgttggttgtatgtgttgtttccatctgataycaccattgaggggagcaagatgacatgtgcctaccccacgtgtccagcagcaaagccacctggcatagtgggctgctcagcgtgcctggttcatactgcg

SEQ ID NO: 17836 - DNA, 201 bp, Homo sapiens
ataaaaataaaaagtcaaaaggaaacaaacaatgttgctgagaagtgatagaatattctagtttatatctcagtcattttacagctctggcatttctgggkaacactttagaatacttccactccggttggtccataaaaagctgcctgtgtttttatgttttgaaaatacacgcagagagacccactgcatgtcctatta

SEQ ID NO: 17837 - DNA, 201 bp, Homo sapiens
aaaaaaaaaaatcactggatttgaagttggcctatgttagattactccaaggaagttagttaatatgttaatatgaatctagatgaacattgagtgttttrctcttcttgttaatttgcgccatctactaatctctggacaatggagaaaaagtcgtaggttatgagttttttatttatggacattaagcaatatctttaa

SEQ ID NO: 17838 - DNA, 201 bp, Homo sapiens
aaagagagtatgatctcacttttcccttcttgataggttgtagattccatgtctaatccatgcttttccaatattccctcctaatctttcagttgaattayggtctttagctcaaatgcatgacatgatgtgtgtgcctttggagtggggcggtattagtcagtcgatggttatttccttgaggagaaaggaaaggagaag

SEQ ID NO: 17839 - DNA, 201 bp, Homo sapiens
attttaagcaactgacccttgggataaaaataaaaagtcaaaaggaaacaaacaatgttgctgagaagtgatagaatattctagtttatatctcagtcatwttacagctctggcatttctgggtaacactttagaatacttccactccggttggtccataaaaagctgcctgtgtttttatgttttgaaaatacacgcaga

SEQ ID NO: 17840 - DNA, 201 bp, Homo sapiens
tctggacaatggagaaaaagtcgtaggttatgagttttttatttatggacattaagcaatatctttaaaatgtaaaatgaagccgacaaaatgcacagccrgataacaacaacaaatctaatctaaagtgacaggaagagactctcccagacatttttctctttaatgtaacatgactttaaattgatgcaaccccacagt

SEQ ID NO: 17841 - DNA, 201 bp, Homo sapiens
ctttcagttgaattatggtctttagctcaaatgcatgacatgatgtgtgtgcctttggagtggggcggtattagtcagtcgatggttatttccttgaggaraaaggaaaggagaagttgagtacttttcagtgtttgttactacaaaagcatggtggcatgccattgttctgagaggaagggggttttttgccttgtcagc

SEQ ID NO: 17842 - DNA, 201 bp, Homo sapiens
aattgtgatgttcagcagtttataccttgggagctggaagcgtttctccatggtgaatttgtaatattaattggccatgtcagttcatgacaaatgtagtracatctatttcaagtatttcagttttatggtgctgaagaagtgacacgcgctccagataagtaatctcacaaaagatcttcccgctcgctgtggagcgcc

SEQ ID NO: 17843 - DNA, 201 bp, Homo sapiens
gtaggacaatgagaagaggccagatgaggacagaatttttattttccattgccagtaacaaacacagccctaacttgcttagaccaaagatggggattgaytggcaactgggaagcctaagggtggatctggcgtggctggatctaagtgattaaatggcgcggtcataattctatttctctgcatctctcagctgtactt

SEQ ID NO: 17844 - DNA, 201 bp, Homo sapiens
ttcaccatgttggccatattggtcttgaactcctgacctcaagtgatcctcccgcctcagctgcccagggtgctgggatcacaggcgtgagccaccgtgcrcgacctcagggtcccttctaacctgtgctgttgtcataaaccctggaggagaagcaagatctttctagcaggagcaacatcatcccaaataaagtgatag

SEQ ID NO: 17845 - DNA, 201 bp, Homo sapiens
aacagcagcacaacaaaatagccatttacatgtcaagactatattcatagaatccatatgtctaaggtggggaagttgtcattattcctgttttatagatraggaaacagaggcccagatggagtaagtgactgctgaagtacacatgatttgtcagtagaaaggaagagaccaaaggtggcatcaactttatctttcctt

SEQ ID NO: 17846 - DNA, 201 bp, Homo sapiens
aatttttattttccattgccagtaacaaacacagccctaacttgcttagaccaaagatggggattgattggcaactgggaagcctaagggtggatctggcrtggctggatctaagtgattaaatggcgcggtcataattctatttctctgcatctctcagctgtacttccatctctgtaaacttcatttgcagacatggcc

SEQ ID NO: 17847 - DNA, 201 bp, Homo sapiens
gagcactggatacctagactctgctgggctctagagaagtgctgggctacagcgcccagtgccctacctcttggggccagccagcctcaccaaaaaatcasgcttctggcttgctccaaactcaggaagttgctgggaagtctggctagcaacaccctcattcccagtcctggccatgcctctctgctctccctagcacag

SEQ ID NO: 17848 - DNA, 201 bp, Homo sapiens
atgagtactcactctacttttttagtttatatttttattttagttcatttcatttaagacagcgtctgttacccaggctggagtgcagtgacatgatctcrgctcactgcaacctacaccttctgggttcaagtgattctgatgtctcagcctccccagtagctgggattacaggcatgtgccaccacaccggctaatttt

SEQ ID NO: 17849 - DNA, 201 bp, Homo sapiens
taagtttttaatttttgttttacttttgtcttttaattttaattctattgcaaccaaatctatcagcctgtcttctatgatctctgcttttaattgttacsctttaaaaatccttctccatggtaacattatattgactcatatgtcttactggttgaacgtgcctatgtttgactttgaaatcattaaattcattgagga

SEQ ID NO: 17850 - DNA, 201 bp, Homo sapiens
gctccatcaatacccatcccaggagacagtggcagtcttgatgtcaatcttgttttaggatcattgccagtggaattcaggactgcggttctacccggtaycggggaaccaggtgagggggttaagaggcctgggcccatggaaggggtgagagagagccacatacttacagttgtgaagggggccagccaggatggtggc

SEQ ID NO: 17851 - DNA, 201 bp, Homo sapiens
agagaataaggtgttggtttgttataaggtggtcctttataaagtttagacctattttaataaggctgacttgggttgaagataactagagccatgacttycatcttgatggacaatgagtactcactctacttttttagtttatatttttattttagttcatttcatttaagacagcgtctgttacccaggctggagtgc

SEQ ID NO: 17852 - DNA, 201 bp, Homo sapiens
atgaaatattaggttaacatggaaaaaacatggcatcccatgttttagtattttttccttatttccaagcagcacctctctttgaattatattctgttctstgtttttataatttgactcccttctattctacatctaaatagtgcattgtctgttttcactcaggactttaaaaatagttctagtactaattgtattttt

SEQ ID NO: 17853 - DNA, 201 bp, Homo sapiens
atccctcgacccagtgacctagcccccgtgtaccttccctgtctcatttctcactgttatcattgtaaccctctaccctctcttttggcttcctgcagttkccctcctgcagcagggcttttgcacatgctggtttctcccttactttgcctctactcagtctttatatttcaactcagtggtcactgtctctaggaagcc

SEQ ID NO: 17854 - DNA, 201 bp, Homo sapiens
cactggataggtaatagacgccggcatggctatgctgtggttcctgctgatgggcacactattacaggtgcatgataagtgtgtcgtacgcaggaagtacrtttcccccagccttccctacctgctgagggctgctcccagcctaaggatttcatccagatagattcatagcgcttccagtaaatgcaccccttgcctttc

SEQ ID NO: 17855 - DNA, 201 bp, Homo sapiens
ctgcattaaatccttctataagttttcatagttctgtgcatttcctcttggcagcaatgcactgagctgcagttttacatttttgtttttttgttttttgrgtttttttttttttttgagacaaaagtctcgctctgtcccccacgctggagtacagtggcacgatcttagctcactgcaacctccacctcccaggttcag

SEQ ID NO: 17856 - DNA, 201 bp, Homo sapiens
cctgctgatgggcacactattacaggtgcatgataagtgtgtcgtacgcaggaagtacgtttcccccagccttccctacctgctgagggctgctcccagcstaaggatttcatccagatagattcatagcgcttccagtaaatgcaccccttgcctttcaaagttgaaaaagaaattactttggacacaaagaggtgtttc

SEQ ID NO: 17857 - DNA, 201 bp, Homo sapiens
tcatgtgttacctgagactctccgcccataggatgtagttcctttccattggaacacatggggaccgagggaataaagaatgttttcatctctgaaaatayctctcattcttccaatcaatgctgctcttttcttgcatactgtatactgggaagcatttgtttcgatttgtggttaaatgtatgtgtccactggacttca

SEQ ID NO: 17858 - DNA, 201 bp, Homo sapiens
ctgacctcctaagttagagcccctgggaagttcagccgtggttctgaccaggcaggataactatctaagtgttcccctttggacctagactgagccaaagwttctccttggtctatataggataatagatttctaaaacaaaccaatagctcaggcacaattatagtggggggtggggggcatgtttaacctactttagag

SEQ ID NO: 17859 - DNA, 201 bp, Homo sapiens
cgatttgtggttaaatgtatgtgtccactggacttcagtatccaccctttgaaggaccgcaggagaagttgttcaggtagaaacatacaagggccggatgyggtggctcacacctgtaatcccagcactttgggaggcctaggcgggtggatcacttgaggcctggagtttgagaccagcctggccaacatggtgaaaccc

SEQ ID NO: 17860 - DNA, 201 bp, Homo sapiens
tattgaattttggcccacaggaaaaggaaactttgctgttagggtcagctggaggagagactgcaggggtcagagatcagggccatatgctagagctgcartgtgggtgctcaaatgatgttcagtgcatcttcacagatggacctccacatgtccctcatgccctaaaatagatattctccacagctgcacatacaacaa

SEQ ID NO: 17861 - DNA, 201 bp, Homo sapiens
gtcttcgtaatatagctagtttttgtccattcattttgctttgacttccttgtataggtacaaaggtgtaagtaggagagtctaccaggcagcacacagaygtggccctgtaaccacccttgtgtaaaatcagagtaatcctccctatccttgcttatttcactgggttcatgggtgatgactgtaaatgacacaggagac

SEQ ID NO: 17862 - DNA, 201 bp, Homo sapiens
gatgaatactcagggttttttttttttttttttttcttctaacttgtcctccttgatcaggatttctcaaatgcacatttgtctaatatactgttgaaccrtgcaagtaccaaaacaaaacaagaaacccagaattatagctcaaatttaattaaaatagcttttattgcttctattcatgtgtccctggattttaagtga

SEQ ID NO: 17863 - DNA, 201 bp, Homo sapiens
cccagtgtgtcacgccattacatgcttacagcctatttttacaaagtttgaatattgtaatttgcctttaaaaaattgttttaaagatctgcctaggtcarcaaattttatttactctctagaaccatttgattggggtactgccttaagaaataaagcagattccttcagtcgcatgtgggcctggagtcactggaaaat

SEQ ID NO: 17864 - DNA, 201 bp, Homo sapiens
caaggtagaagacataggtggtcaagaatttagaaagacccggactcgaatcccagctctgatccatctcagctctgccatattgccaagttccgctgagrctccatttactcacctgttgtatcatctgaattatttccatatccataatgtgcaaggatatccttccatgttattagaaatacagatacaccatcatta

SEQ ID NO: 17865 - DNA, 201 bp, Homo sapiens
gtgccagtgggcagaaggttttgcaagaatagcttcaggaagactttgtgggaagacagatgaatactcagggttttttttttttttttttttcttctaayttgtcctccttgatcaggatttctcaaatgcacatttgtctaatatactgttgaaccatgcaagtaccaaaacaaaacaagaaacccagaattatagctc

SEQ ID NO: 17866 - DNA, 201 bp, Homo sapiens
tggttttaaaagacgccatggttgccatgaggaggacaatgcgtaggaggcaggagtgaaagctaaaggatatgctgggaggtgaccctggagttaaagaragcaactaaggtgaccaggtgacaataatggagatagagaaaacaggatggattcaggaaacatgaccacactgagcatattcaaatgtaattgtcagtt

SEQ ID NO: 17867 - DNA, 201 bp, Homo sapiens
tttgcttttaaatgcccgtgttgatttcttaatattttcaacttcctcttctgaagccagttccccccgaccatcagtcatgagtccgttcttttaacctygttcaggtggcgtggggcggtgtgtttggtggggagtgatgggtgcttgcctggaagtgcgagcaattgatcagctgatgaggggtatttattatctgtc

SEQ ID NO: 17868 - DNA, 201 bp, Homo sapiens
catttactcacctgttgtatcatctgaattatttccatatccataatgtgcaaggatatccttccatgttattagaaatacagatacaccatcattatcastggccaaatcattcaaatcgctgtttgcttcttctcgggctcttattcaagctcacgatgctattctcatagtgattgcgaatctcactgcataaaggtg

SEQ ID NO: 17869 - DNA, 201 bp, Homo sapiens
aactaaacaaaatgctaacccatatgggagaaatttccaaagaattaaaaccacccaccaggaaaatgggaaagtctcccctccacacacacacacacgcrcgcgcgcacacacacacacacacacacacacacacacaaaatcaccaaatcacacctgaacaagaggaagaaaattaaactcattgaggagataccatct

SEQ ID NO: 17870 - DNA, 201 bp, Homo sapiens
tgatcctattcgcatgataaaaatcataatgtctcaaattacttactcaataaaatgtgggtttgtctattattagtgattattagggttataatgcagcrtggaaatttggagcaaattaactatacatgcaagctgttgggctcaagtgcagttaatcatacgcatacagtgccagtgggcagaaggttttgcaagaat

SEQ ID NO: 17871 - DNA, 201 bp, Homo sapiens
ttcattgttgtccttttttattaaaacaggttttgtttttttgtgtgtgtgttattttgttttttgtttttttgtttttcgggggctggagtagtgtgcaragcctggcggtgattgttctcattagaaagtatagtgtaatactcaataaattacttttgttctcaccttgggaagtggactcagaggccaagtgacttt

SEQ ID NO: 17872 - DNA, 201 bp, Homo sapiens
aacttcctcttctgaagccagttccccccgaccatcagtcatgagtccgttcttttaaccttgttcaggtggcgtggggcggtgtgtttggtggggagtgmtgggtgcttgcctggaagtgcgagcaattgatcagctgatgaggggtatttattatctgtccctgactcccgagagaggaaataaatccttggaccccag

SEQ ID NO: 17873 - DNA, 201 bp, Homo sapiens
atctcactgcataaaggtgattttgaaaacatcacttttcctccacactaatgtgtgagcttagccagagtaggagatatatcttacttaaaaaaaaaaamaacaaacaaacaaaaaaaaaaaactccttcttcatttgttatagttccaggatagagtgtgtacctggatagagagagtcaggcagatataggtgtgccc

SEQ ID NO: 17874 - DNA, 201 bp, Homo sapiens
ctaaacaaaatgctaacccatatgggagaaatttccaaagaattaaaaccacccaccaggaaaatgggaaagtctcccctccacacacacacacacgcgcrcgcgcacacacacacacacacacacacacacacacaaaatcaccaaatcacacctgaacaagaggaagaaaattaaactcattgaggagataccatcttt

SEQ ID NO: 17875 - DNA, 201 bp, Homo sapiens
tcactgcataaaggtgattttgaaaacatcacttttcctccacactaatgtgtgagcttagccagagtaggagatatatcttacttaaaaaaaaaaaaaamaaacaaacaaaaaaaaaaaactccttcttcatttgttatagttccaggatagagtgtgtacctggatagagagagtcaggcagatataggtgtgccctcc

SEQ ID NO: 17876 - DNA, 201 bp, Homo sapiens
aaacaaaatgctaacccatatgggagaaatttccaaagaattaaaaccacccaccaggaaaatgggaaagtctcccctccacacacacacacacgcgcgcrcgcacacacacacacacacacacacacacacacaaaatcaccaaatcacacctgaacaagaggaagaaaattaaactcattgaggagataccatcttttt

SEQ ID NO: 17877 - DNA, 201 bp, Homo sapiens
aggtgattttgaaaacatcacttttcctccacactaatgtgtgagcttagccagagtaggagatatatcttacttaaaaaaaaaaaaaacaaacaaacaacaaaaaaaaactccttcttcatttgttatagttccaggatagagtgtgtacctggatagagagagtcaggcagatataggtgtgccctccttccaagatgt

SEQ ID NO: 17878 - DNA, 201 bp, Homo sapiens
tagaaagattttcacccattctgtataattagacaaattctgttactatctgtccaacagtttagcaagagtcactctgagattgaagagaggaagggaaygttggaaccaatgctgatgagccattcataggctctggctcactatatatgtctaaaattcacatgcccctaaccctcaaataatgaccattaataatct

SEQ ID NO: 17879 - DNA, 201 bp, Homo sapiens
ctgcagaactgaggtgggccccaaaacttgcgtttctaaaaggtactagctgagcatgatgactcacatttgtaatcccaccactttgtgaggccgaggcsggtggatcgcttgaggccaggagtttgagaccagccttgccaacatggtgaaactccatctctactaaaaatataaaaatttgccgggtgtagtggtgca

SEQ ID NO: 17880 - DNA, 201 bp, Homo sapiens
gcttggaaggtggcgcaaataactgcttgaggctccctctcttgggccaagcttgactctggattttcattgttgtccttttttattaaaacaggttttgkttttttgtgtgtgtgttattttgttttttgtttttttgtttttcgggggctggagtagtgtgcagagcctggcggtgattgttctcattagaaagtatag

SEQ ID NO: 17881 - DNA, 201 bp, Homo sapiens
aaaaaaaaaaaaacaaacaaacaaaaaaaaaaaactccttcttcatttgttatagttccaggatagagtgtgtacctggatagagagagtcaggcagatayaggtgtgccctccttccaagatgtgtgatggtgggcaactttctttgcatctctgagcctctattttctctatataaaatgagagagaaaaaaataattc

SEQ ID NO: 17882 - DNA, 201 bp, Homo sapiens
catcgcccactctgatttagatgagcaagagctgctgagttgtagatttctagtttctaaacaacaataagtcttgcccccagatagcctcttagcagagycaaaagccagcagagagaagactcagcatttgctttggagtaagtttgtgtgtgtatgtttatctcccttttactcatgggctcttttttcccaaataac

SEQ ID NO: 17883 - DNA, 201 bp, Homo sapiens
gatgaatgtagtgagagaaggaaggaagagagagagggaagaaggggaaaaagagggatggaaaggaggaaggaaggaaaggagggaggaggcaagtatawtagtcatgatatagggaattgaaaagacattcacgttttgtggtgaatgaaaataacttgacctttatgaagctggcctaatccctggaaggaaaaaatt

SEQ ID NO: 17884 - DNA, 201 bp, Homo sapiens
actacaaatcattgatcaaagtattggtctgtcacctgtccatgtgtaaggccaggcctaagtgctctgacagggcatgactcaatcctcaaacaggaagsgggaaattgctttccatctcctaaccctaagatcctggatggcaggtaatctgcttcctcaagattctgttgatacacattcaggactctggtttctgtt

SEQ ID NO: 17885 - DNA, 201 bp, Homo sapiens
gagaaggaaggaagagagagagggaagaaggggaaaaagagggatggaaaggaggaaggaaggaaaggagggaggaggcaagtatattagtcatgatatakggaattgaaaagacattcacgttttgtggtgaatgaaaataacttgacctttatgaagctggcctaatccctggaaggaaaaaatttccttggatatgtg

SEQ ID NO: 17886 - DNA, 201 bp, Homo sapiens
caaagtattggtctgtcacctgtccatgtgtaaggccaggcctaagtgctctgacagggcatgactcaatcctcaaacaggaagggggaaattgctttccrtctcctaaccctaagatcctggatggcaggtaatctgcttcctcaagattctgttgatacacattcaggactctggtttctgttttgcttgatgacaatg

SEQ ID NO: 17887 - DNA, 201 bp, Homo sapiens
gggaagaaggggaaaaagagggatggaaaggaggaaggaaggaaaggagggaggaggcaagtatattagtcatgatatagggaattgaaaagacattcacrttttgtggtgaatgaaaataacttgacctttatgaagctggcctaatccctggaaggaaaaaatttccttggatatgtgatttatataatcaatcaacta

SEQ ID NO: 17888 - DNA, 201 bp, Homo sapiens
atacacattcaggactctggtttctgttttgcttgatgacaatgacccagtttctttgactaaataaatgtatagacacacattacttcttttcattctargaatcataagtttttcaaactttagaatcacaaggtccattaaaggacatctcccctgaccttcccattttgtagatgggaagactaaggtccaagcttg

SEQ ID NO: 17889 - DNA, 201 bp, Homo sapiens
tattttagtagagacgggttttcaccgtgttgcccagggttgtctcgaactcctgagcttaggcagtctgcccacctcagcttcccaaagtgctaggattrtaggcatgagccaccatgcccggcctaatctaatcaattcctttaaatctgaaactgtccgcctgattctggtttaccacaaccaccagagtcttaagtg

SEQ ID NO: 17890 - DNA, 201 bp, Homo sapiens
aggcagtctgcccacctcagcttcccaaagtgctaggattataggcatgagccaccatgcccggcctaatctaatcaattcctttaaatctgaaactgtcygcctgattctggtttaccacaaccaccagagtcttaagtgtcccaatagccagggtctcatagactctgcttatggttaattcttctggggaaattaatt

SEQ ID NO: 17891 - DNA, 201 bp, Homo sapiens
gtgacaagatctccaaggagccagttcacgcttggatgactctggagctgtggtgacaatctaaatcctaaattgaggcttactaggaaatgcactaggtracaggctctagagaaatggctattaccaggttgctcaggctggagtgcagtagtgcaatctcagctcactgcaacctctgccttctgggttcaagcaatt

SEQ ID NO: 17892 - DNA, 201 bp, Homo sapiens
ctctagtctagggcacaaaatttctgtcaacccttctaaccagtgtttgaagtacgtaagacgttcatttccacttctaatgaggaattagaggaacggawttataaaggaattctggttataattgcatgtacttttagagacgatgtctaacagtgcaacccatagaaccaggctgcctggattcaaatcccagctctg

SEQ ID NO: 17893 - DNA, 201 bp, Homo sapiens
agtatagacacgtggcaccacgcctgggtaatttttgtagttttagtggagacaggatttcaccatgttggccaggctagtcttgaactcctgacctcaastgatagacccacctcagcctcccaaagtgctaggattacagacatgagccgacctttttatgtattgttgatacagtatgacaagggaagagttaactga

SEQ ID NO: 17894 - DNA, 201 bp, Homo sapiens
aagagactggagaaagccaatctgtttctccctgaaaatcatcttacttttttaacgcttcgtacctagatttggcctgggcagcccagggagactgttcragcactggatacctagactctgctgggctctagagaagtgctgggctacagcgcccagtgccctacctcttggggccagccagcctcaccaaaaaatcag

SEQ ID NO: 17895 - DNA, 201 bp, Homo sapiens
gcccatcccaaatgaattctaatcctcagcctctagaatgcctggagtgagaaaacagaatattgttcttttctgtttatattatttcatactgagttaayacacttgccaagactccgaggcagcttctggcttgacaatgccttctttaactagcctagtttctagaataaagttcgggtccaccaggccctctgagtg

SEQ ID NO: 17896 - DNA, 201 bp, Homo sapiens
tcgagttcttaatctgagcagtttcgaaaccaagcccacattaattaatataaataatgactgggaaacgttgcaggactccccggaaaagaatgtataarttgatgtgtttttgtatatgcttatgtatatgcctttgtgcacgaaaggagataaatggtgtatttcacacagttccttctcctcctctaagggatatta

SEQ ID NO: 17897 - DNA, 201 bp, Homo sapiens
cttaggcatccatgctcagggctctctgtggtaggcaacagctggattatttactttctagaatatctcgagttcttaatctgagcagtttcgaaaccaarcccacattaattaatataaataatgactgggaaacgttgcaggactccccggaaaagaatgtataagttgatgtgtttttgtatatgcttatgtatatgc

SEQ ID NO: 17898 - DNA, 201 bp, Homo sapiens
tgcggtggcgcaaacctgtaatcccagctacttgggaggctgaggcaggagaatcgcttgaactcgggaggcggaggttgcagtgagtcgagtcgtgtcartgcactccagcctgggtgacagagcgaaactctgtctcaaaaaacaaacaaaaagaaacataccgggagatctggttctattgaaccccagtgcagccat

SEQ ID NO: 17899 - DNA, 201 bp, Homo sapiens
tatgctagagctgcaatgtgggtgctcaaatgatgttcagtgcatcttcacagatggacctccacatgtccctcatgccctaaaatagatattctccacasctgcacatacaacaacgtcagtgaaatccgttgagaggagcattgaggagatgagtcaggtgtgccgcagcactcaggtcagacttgaggcaagtgagag

SEQ ID NO: 17900 - DNA, 201 bp, Homo sapiens
cagtggtgtgatctcagctcactgcagccttgacctcctgggttcaagagatcctcccacctcagcctcctgagcagctgggaccacaggtgcttgccacyatgcccaactaacttttgtattttttgtagagacagggtttcaccacattgcccaggcaggtctcaaactcccgggctcaagcgatcctcccaccttggc

SEQ ID NO: 17901 - DNA, 201 bp, Homo sapiens
gagatgagtcaggtgtgccgcagcactcaggtcagacttgaggcaagtgagaggtgtgagttattcagagtcccagagagcttgggccaaaagagattctrtttttactggagcatgtgagggtggatcacaactaggatggcgcgaagttcacctcgtgtaagcacaccaggctgcagggataataactgcactttttaa

SEQ ID NO: 17902 - DNA, 201 bp, Homo sapiens
atcatattctcttcactgaaacatttcagatgacttaaaaattcaccttgtagaacttttaaaattgaaactttctggtgaacatcattagttgacagatrtgtcattgaagtttcatccttcttcatttcagagtctgctggaagacccttcatttaccactctctccttcctggaggtgtggaaatactctacctgggt

SEQ ID NO: 17903 - DNA, 201 bp, Homo sapiens
tataagcaatagtccctgaacatcatttggcctgaactaggctagagtttctcttaatcaaaataataacgatgatttttccatgccaaggagtggtgtcrtatcatgaagtagatttatgtacacattaaataaacttttacattttaatgtaccaatttgcaatttttttttctattcaccaaaatattccagataacg

SEQ ID NO: 17904 - DNA, 201 bp, Homo sapiens
catattctcttcactgaaacatttcagatgacttaaaaattcaccttgtagaacttttaaaattgaaactttctggtgaacatcattagttgacagatatrtcattgaagtttcatccttcttcatttcagagtctgctggaagacccttcatttaccactctctccttcctggaggtgtggaaatactctacctgggtga

SEQ ID NO: 17905 - DNA, 201 bp, Homo sapiens
cccaaagtgctgagattacatgcatgagccaccatgcctggcctctggccttcttttcactttagaaaaaaacaaaaaacaaaaaacaaaaaaaaacacamaaaaaacttttttttttagaactgttttagtttgggagccaaaattgagcagaaagtacagagagttcccgtatacctccggcagagccctggctcacta

SEQ ID NO: 17906 - DNA, 201 bp, Homo sapiens
caaatggggaacagtcctgtgcagtgtttctaggaagttaccagcttcatcataggaagacgttctccatcgtttggatctttttcaccagcaccttttgrttgtggtggtttgggatgtgatgatctcagaactttacatcctccatgaaatctctgcagcgatagttgaatgtcttgccttttctattattgccctttt

SEQ ID NO: 17907 - DNA, 201 bp, Homo sapiens
ttcaccttgtagaacttttaaaattgaaactttctggtgaacatcattagttgacagatatgtcattgaagtttcatccttcttcatttcagagtctgctrgaagacccttcatttaccactctctccttcctggaggtgtggaaatactctacctgggtgaggctctcgtggctttttgtgccaagtgtccgtaaacttc

SEQ ID NO: 17908 - DNA, 201 bp, Homo sapiens
atgcctggcctctggccttcttttcactttagaaaaaaacaaaaaacaaaaaacaaaaaaaaacacaaaaaaaacttttttttttagaactgttttagttkgggagccaaaattgagcagaaagtacagagagttcccgtatacctccggcagagccctggctcactatctacatccccactagatccatgtatttgttta

SEQ ID NO: 17909 - DNA, 201 bp, Homo sapiens
gaagtgggcgtcgtgatgccagtgtcttcgtaatactatctttctttcccctttagcacccagaacttatgaaatatgactcggtttatcctgaacacatstctgtgcatcagggaggatgggagaattaattccagtttctcaattgcaaaagtgaggctggtcatggggcttggaaccacgccacggacgcatgaagcc

SEQ ID NO: 17910 - DNA, 201 bp, Homo sapiens
tgaataccttttgctttctataaaatggtgtggcattgctggtattttcactcttccttcctaccctggatgctgatttgatgcttccagccttagcggtyttcttgcttctaggactgaacagggaagagggaaaagtcaaaagaatgacagaaggtcctcacgttgcagaacactgaccaatgttggcaactacaagac

SEQ ID NO: 17911 - DNA, 201 bp, Homo sapiens
gggggcctggaaggggagaaggggcaccagaaggagaaatgggaggaaagggcgagtgagatagcaaagagaactcagaaagtaataaagccctgcagtartcagagggctgaggccaggtccccagtgagcggctgaacacacagtgattcaaacccactccagacctgtgttcttaatcattaccttcacctggaggga

SEQ ID NO: 17912 - DNA, 201 bp, Homo sapiens
tctgtagcttcttccagcatgtgatcatacatctacctaacctctcccattggttgaatttaatatactagtgaattttccattgcaaagatgaggttacraatcatagtgttcatactcagaaggactttataaatattttgcctttttgaagtatatacaagaaatgaaaaaaaaaacaggaataaataaaaagaataa

SEQ ID NO: 17913 - DNA, 201 bp, Homo sapiens
atcatatattgtatcatatcatatcatgtcatatcatatcatatcataccgaataatttcattgccctaaaatacctctgttttcactttttaatctcttwgtgcacacatcaaaaattccttttgtgtttttgagtttcaaaagtgtgccacaaacaagaaatttgggatctgctgagcccagcctcagacctgtagggg

SEQ ID NO: 17914 - DNA, 201 bp, Homo sapiens
gattccagcattttgggaggccaaggtggacggatcaccagagttcaggagtttgagaccagcctggccaaaatggtgaaatgccatctctactaaaaacmcaaaaattagctgggtgtgtggtagtgtgtgcctgtagtcccagctactctggatgctgaggcacgagaattgcttgaacctgggagtaggaggctgcag

SEQ ID NO: 17915 - DNA, 201 bp, Homo sapiens
tgctctcatttcattttcactgaactgaaaataaggtaacagaccctcaggtctacctataagtaccttccaactgttccacttttgtaaatttagttcarataatacatatgctgaaattcctatatcccccccatactccagatcttcagtgtggaatttaaatataattccttattgtaaaaaaaaaaaatttttttt

SEQ ID NO: 17916 - DNA, 201 bp, Homo sapiens
ctttctagctgtgtaactttaggcaaataatgtaacctccatctgcctttgttttttcctctgtaatagaaggaacaacaacgaacaacattttttttttkgcaagattaagtgagatcttccatttgacatgcctggctaattggcagtgcccaacagatagaaactattggtattgtaaggactgcttattgggtacat

SEQ ID NO: 17917 - DNA, 201 bp, Homo sapiens
cccaggctggagtgcagtggcatgaccatggctcactgcagcctcgacctctggggctcaagcgatccttctgcaacagcctccctagtagctgggactayaggtgcatgccaccacacccagctaatttttatattttttgtagagatggggttttaccatgttgcctaggctggtctcgatctcctgggctctagcaat

SEQ ID NO: 17918 - DNA, 201 bp, Homo sapiens
gaaacaaagagggcaacaggaggtcacgaaggcatgctgtgcccacttttggaaattgtgaaggagagtgtctcaaacatgtaggcttgagccactcaaarttctgggaaataggatgttttgtaaagaaagtttgctactgtcacttctgagtagttgcagtccctcccagtacgtgggtatcttcggtgagaacaaatt

SEQ ID NO: 17919 - DNA, 201 bp, Homo sapiens
tctctcagcttctcctctctttcccatccaactgagcagcaccaataaatagataagaaacctgaaggtctacatcaaatcagcttctattgctgcaaaaytcttctagctaacttcattctaaaagctgtctgaaatatatttacttacacccgagaagattcaaaaacattaccgctgaaccccgatgctttgggaaca

SEQ ID NO: 17920 - DNA, 201 bp, Homo sapiens
tcgacctctggggctcaagcgatccttctgcaacagcctccctagtagctgggactacaggtgcatgccaccacacccagctaatttttatattttttgtrgagatggggttttaccatgttgcctaggctggtctcgatctcctgggctctagcaatcctcccacctcggcctcccaaagtgttgggattacaggcgtga

SEQ ID NO: 17921 - DNA, 201 bp, Homo sapiens
ctcatgtgactttctatatcatcctttgtgtctaagtgatttgcactgggaagatagtaaacgctcccactttatatgcagaaggttgaaaacaccatgartgttgcaatctgaggtatctgcccttaaagaagcaatatttactgaaatgcagggcacacgacttttccagcaaaccacaccgccgtccttttgtgtgac

SEQ ID NO: 17922 - DNA, 201 bp, Homo sapiens
gctcctaggttttcttacttccaaaacagtgggcaagaacagctaccttttagaagcaggaaaaaggaacataatgaataaacctaaaggatttaaaaacktggaagacactaagaaactatattgccgagaaagagaaatgtaaattccgctggataaattagcgtttgcggttacttctctctttgttgcttaagcaga

SEQ ID NO: 17923 - DNA, 201 bp, Homo sapiens
attcataactcagtcacgttactgaggtatgtctcttcggatagattctatctctaaaaactacagattctatctctaaaaacttaagtcaagggattttsaagcagttgtttgatttatgtatgtgaacctctcccttaggagaagaacttttctttggcaaacaccataggaacggagaccttaacaaaagaattagga

SEQ ID NO: 17924 - DNA, 201 bp, Homo sapiens
agtgcacctgaccctaggataatcttaattttaagtaactggtaactcataaatttttaaacactctgcagttcaaagaaaacatgtttgtggtaggtagycagtttataacctgtgtaagactgtgttattagcaaatccctcaatgtgttgaccaagagtgggtaggaatcctgcagacagaatcttttgaaggtggtt

SEQ ID NO: 17925 - DNA, 201 bp, Homo sapiens
tggacaagaggtcacattgccttttctagcttggaaggtggcgcaaataactgcttgaggctccctctcttgggccaagcttgactctggattttcattgktgtccttttttattaaaacaggttttgtttttttgtgtgtgtgttattttgttttttgtttttttgtttttcgggggctggagtagtgtgcagagcctgg

SEQ ID NO: 17926 - DNA, 201 bp, Homo sapiens
cccggccttacgtttcagcatctttcaatccatctaatacgcagtgccagggaaggtttgtgaaaacatttgaatcacagagtcacaaacagtgagaatakctgcagttatgtttgtgatgctctaatgaacttacaaaaggccaggcctagtatttcagctgtgtccatgatgtctctgatggaaatggacaggtaacat

SEQ ID NO: 17927 - DNA, 201 bp, Homo sapiens
accccatctctattaaaaatacataaattagtcgggcatggtggcatgtgcctgtagtcccagctgctcaggaggctgaggcaggagaatcactcgaaccygggaggcagaggttgcagtgagcctagactgcaccattgtactccatcctgggcgacagagcaagactccatctcaaaaaaaaaaaaaaaaaaaaaaaag

SEQ ID NO: 17928 - DNA, 201 bp, Homo sapiens
aaagtactctctatggagaggttttatggttctgaaataatttaaaaacacactttactacaatccatagcaggtagttttgccaatttgggaagttatgktgccttgcagtttccaaagtaagctgaacagtgttttttaacagtgctgcccctctctcccactagaaatgcgagtccatccttttaccaagtgtggtac

SEQ ID NO: 17929 - DNA, 201 bp, Homo sapiens
ttccttttgagcccagctctccctttgtgacccagcaacttccttccccgatgatggccaagccttgaggatgtgaaactgcccagtgccccaatctggartccaccatcctgggtctagctggggacatccttgaatcagcctctgggaatcactgaaccaacatgagtcacttgctactgtgagatctcagaacacatg

SEQ ID NO: 17930 - DNA, 201 bp, Homo sapiens
tgagcacacttcagacttccagtcttgtgtggcctgtctaccacaccatgagacttcatgtctctcctaaatgaggagaaccaaagctggaaattgtcacyccctgtcagcccacagcactggtttctaaacctactggcctctaccgcttcacttctcactgtaatctctctgaccctaccttccagcttctcttgagaa

SEQ ID NO: 17931 - DNA, 201 bp, Homo sapiens
gttattagcaaatccctcaatgtgttgaccaagagtgggtaggaatcctgcagacagaatcttttgaaggtggtttgtttttttattcctttataagtacwgttgtagatttacaaagtaattgagtatatagtacataaggtcttgtgtacccaccgatcgcaattgagcatatagtacatgctgtcctgtgtacccact

SEQ ID NO: 17932 - DNA, 201 bp, Homo sapiens
ttggatatgtgatttatataatcaatcaactagtccttattttggtagagctaaacttctgtctttgggtttactcaccgtatctgtgtgcatcctggcartgtttacgatatacttctactaaaatattattttattctatactaacaaagggatttgttgtgtgtgtaaaattcaaatttcaatgaagattgtgtattt

SEQ ID NO: 17933 - DNA, 201 bp, Homo sapiens
tgggtttactcaccgtatctgtgtgcatcctggcaatgtttacgatatacttctactaaaatattattttattctatactaacaaagggatttgttgtgtrtgtaaaattcaaatttcaatgaagattgtgtatttttatttgctaactctggaaaatgtgtttacagaagaaccagagaaggacttactcctctccgtac

SEQ ID NO: 17934 - DNA, 201 bp, Homo sapiens
aggcctgagcaaaagacacagaaaggatttctttatcgtaagcacacttctctacattacctttataatccaacaactctgctattagtaaattatagaamcaacttttgtaacactatcttgtttgcagagtatatgaaaaatttgaagttaaaattcagctccacgaatactgcagtggtgagaaaatggcgacaaaga

SEQ ID NO: 17935 - DNA, 201 bp, Homo sapiens
taggccaagaaaggggtgggagaaacgagcaaggtgttgatagaaccccttagtgtcctcctcataccacagacactctcttcccccacttacttggccawttttttttttttttttttttttttttggtggagtctcgttctgtctcccaggctggagtgcaatggtgcgatctcagctccctgcaacctctgcctccca

SEQ ID NO: 17936 - DNA, 201 bp, Homo sapiens
gaaatctctagcttctcaaactgtttcgtggtggagtgccttttgggcacaggagaaggaaataagagcctcgcgaggtttgggaatgctgcctctagctytcacactgcatgcagaattcctactctgagagctcactttatctcaaaaacccatgcatattctgcatctactctgaattccgcagtgttgtgtgttact

SEQ ID NO: 17937 - DNA, 201 bp, Homo sapiens
tactcctctccgtacactttggacatgtcaaaatctagaaatagagatcagtaaaggtaacacatagcaccttaaatctgatttaaaaggaaaacaatgaytattatacagatttatggcttcttgtcaataatactctgatttctggagattgttatcagtcataagctttataggaaatatctccttttgaaaatgaca

SEQ ID NO: 17938 - DNA, 201 bp, Homo sapiens
cacgaacaaattgccaaatgcaaggcctgagcaaaagacacagaaaggatttctttatcgtaagcacacttctctacattacctttataatccaacaactytgctattagtaaattatagaaacaacttttgtaacactatcttgtttgcagagtatatgaaaaatttgaagttaaaattcagctccacgaatactgcagt

SEQ ID NO: 17939 - DNA, 201 bp, Homo sapiens
tgcactcctgtctgggagacagagggaggagactccatcaacactaataataataaagtaaataaaagggcactaaccctactcaggaagccttcactctmatgacataattacctcccaaagtccgcacttcctaatgttaccactctggaggttagaatttcaacatataaattttggggggacacattcagaccacaa

SEQ ID NO: 17940 - DNA, 201 bp, Homo sapiens
gtgtcatacagcagagggctgtgatgctctactgaggagtggaagtgtttttctgagggcatcaaacacgccgtcaagcagggaggcaacaaatctgagtygttccacagatactttgagtgcagtacaagttggtaatgggtaacaggctaaaccatgtggcaccccttccctcttatcagcttcttgctaccatgcaga

SEQ ID NO: 17941 - DNA, 201 bp, Homo sapiens
tccgtacactttggacatgtcaaaatctagaaatagagatcagtaaaggtaacacatagcaccttaaatctgatttaaaaggaaaacaatgactattatasagatttatggcttcttgtcaataatactctgatttctggagattgttatcagtcataagctttataggaaatatctccttttgaaaatgacattttaaat

SEQ ID NO: 17942 - DNA, 201 bp, Homo sapiens
tcccatcacgaacaaattgccaaatgcaaggcctgagcaaaagacacagaaaggatttctttatcgtaagcacacttctctacattacctttataatccamcaactctgctattagtaaattatagaaacaacttttgtaacactatcttgtttgcagagtatatgaaaaatttgaagttaaaattcagctccacgaatac

SEQ ID NO: 17943 - DNA, 201 bp, Homo sapiens
ggaaaacaatgactattatacagatttatggcttcttgtcaataatactctgatttctggagattgttatcagtcataagctttataggaaatatctcctwttgaaaatgacattttaaattaatgtgaaattgtgttttaatttaattcacagggagtcataaacaggtgggagaattatggaacaataattgtgtttgc

SEQ ID NO: 17944 - DNA, 201 bp, Homo sapiens
acaatgactattatacagatttatggcttcttgtcaataatactctgatttctggagattgttatcagtcataagctttataggaaatatctccttttgamaatgacattttaaattaatgtgaaattgtgttttaatttaattcacagggagtcataaacaggtgggagaattatggaacaataattgtgtttgcaagaa

SEQ ID NO: 17945 - DNA, 201 bp, Homo sapiens
ggtctcccaccctctcttatttttataaacaggctccatggtactatatacactgcagatggacagctgccaacctgctctttttgtgctgaggaactctrgatatttcaactagtttacatgactttcttacctatgctaccttataatccttttataaattttgctttacgttttaacaacggaaaacacttaaggttt

SEQ ID NO: 17946 - DNA, 201 bp, Homo sapiens
ttataggaaatatctccttttgaaaatgacattttaaattaatgtgaaattgtgttttaatttaattcacagggagtcataaacaggtgggagaattatgkaacaataattgtgtttgcaagaaatggatttcatcctaaaactccatgaatatgctattacagtttgttgtcatcctgaaatgctctgtttaaccataaa

SEQ ID NO: 17947 - DNA, 201 bp, Homo sapiens
catggtactatatacactgcagatggacagctgccaacctgctctttttgtgctgaggaactctggatatttcaactagtttacatgactttcttacctaygctaccttataatccttttataaattttgctttacgttttaacaacggaaaacacttaaggtttttttcctttcttttttttttaattcttccgccagct

SEQ ID NO: 17948 - DNA, 201 bp, Homo sapiens
tgtacaaagctgataaataactgaaaccaaattagctcaaactggttatatttctgggtacaaaccaggtgtatagttaatccattgttgtttctgtgtcraccaccattgtcctcacctatacttgggcagtgggggtggggaggagaacataaaaacccaccaagcctcatttttcttgctaatttatttccttgaact

SEQ ID NO: 17949 - DNA, 201 bp, Homo sapiens
tcccatttcaggctgattaaaaggcaaaatcttcacagtaggacaccaaaccctctgtatgccctgcctgcctccccccctctgacccgcctgcctccccvctgtgagctttttccacctactggcctcttgttcttcttcagctgttcctcagacatgccaggtgtgttcctgtctcagacgctttgcctttgctgctcc

SEQ ID NO: 17950 - DNA, 201 bp, Homo sapiens
gcagtgtttccaaaaatagttttggaaattgcaaaaatactacaatgctgttgtgccggccacactgtgagtgctgactgtcatgcattttatagcccatstccctctccagtgaggcttttggccactggccgttaattggtaaggttcttgaaaactgaagtgatggtatcagcatggatgcccgtgctttctgatgcc

SEQ ID NO: 17951 - DNA, 201 bp, Homo sapiens
tcttcttcagctgttcctcagacatgccaggtgtgttcctgtctcagacgctttgcctttgctgctccttctgcctggagtattcttccacgtagcaccaygagctgttcttctccaaaaggctttgctcaactgacactttctcagtgaagctgtttctcaccactcactataaaatggcagcctgcctctctgagcctt

SEQ ID NO: 17952 - DNA, 201 bp, Homo sapiens
tggccatggtgctcacagtctctcaatcctttatgttgagggagaaatgataaccagatctcattttgtgtgccaacccgaaagcctgacttgactgcctmaaatgttaggaaggactctaaagccctatctggattccaaatttatggttggtgcagactggatttttacaatttgtgcttagtagtatcttattatatt

SEQ ID NO: 17953 - DNA, 201 bp, Homo sapiens
cataggtagttttatatacattttatagctaagcccagcagcccaaaaagctaaatgacttcagcgcccacagatactcctggatgagaggggattggaawccaggtctgttcaattgcaaatcccctcttgtgccttttacaggtcagatgattttgtttttataggctctagcaggtcccttctctttgcgtcaccaga

SEQ ID NO: 17954 - DNA, 201 bp, Homo sapiens
tttataggctctagcaggtcccttctctttgcgtcaccagagaggaagatcccctaagacaaagcattccctgtagtttttagcataactagtactggctsagtaagtatccactggggttcggaatacaactgccctgcctcttgagcagccatgcctgcttccgaggtggtgctgcatgctattcaggaggacagacca

SEQ ID NO: 17955 - DNA, 201 bp, Homo sapiens
ttttagcataactagtactggctcagtaagtatccactggggttcggaatacaactgccctgcctcttgagcagccatgcctgcttccgaggtggtgctgmatgctattcaggaggacagaccatggatgggaatcctgagccacaactccttagcctcatgacgttgggcagatgactgagcttgtctgagttacaataa

SEQ ID NO: 17956 - DNA, 201 bp, Homo sapiens
cggaatacaactgccctgcctcttgagcagccatgcctgcttccgaggtggtgctgcatgctattcaggaggacagaccatggatgggaatcctgagccasaactccttagcctcatgacgttgggcagatgactgagcttgtctgagttacaataaataaaaataccatgctgaatgatggcctagcatgacattgggaa

SEQ ID NO: 17957 - DNA, 201 bp, Homo sapiens
tgctattcaggaggacagaccatggatgggaatcctgagccacaactccttagcctcatgacgttgggcagatgactgagcttgtctgagttacaataaayaaaaataccatgctgaatgatggcctagcatgacattgggaagtacagactttgcaggcaggcccctgggttcaattcctgcccctgtcattgagtaaag

SEQ ID NO: 17958 - DNA, 201 bp, Homo sapiens
gcacctgcatgttgtaaaaacacaaaataaaaaaaaaataaataaaagcagaccccttggttcagatatctttgtttgtgtaaatgttttggcattctttrtgaaaatcttcagattttcaagagcttaagatgacctcctctagccggctgcagcagtgtctaggtatctgtgaatgtgtaagaaattgagacagcctgc

SEQ ID NO: 17959 - DNA, 201 bp, Homo sapiens
cgctgccattcagttttactctgcacaaaatacagccaacatttttgcatttctttcttccttcctccttttcttctttctttccttccttccttcctttytcccttcatctatctttgttccgcttttgtttgtttttttttagatcgctgcatgctgccgcgttgggttaaccatggtagcattttaccatgagaagcc

SEQ ID NO: 17960 - DNA, 201 bp, Homo sapiens
taaattgaattattcccgctgccattcagttttactctgcacaaaatacagccaacatttttgcatttctttcttccttcctccttttcttctttctttcyttccttccttcctttctcccttcatctatctttgttccgcttttgtttgtttttttttagatcgctgcatgctgccgcgttgggttaaccatggtagcat

SEQ ID NO: 17961 - DNA, 201 bp, Homo sapiens
attctccatgccactccttatctctttagtgcagaaaacggagaggaggttcagtattcttaagaaactcccatgattgctttgaggcaatggatttaacrggtatctttatcccttatttacgcactgactgtggtactgagtcatccctggtgtttctggattttattggcaatgccaagagagcaggaagactgggac

SEQ ID NO: 17962 - DNA, 201 bp, Homo sapiens
aatttaaaaacacactttactacaatccatagcaggtagttttgccaatttgggaagttatggtgccttgcagtttccaaagtaagctgaacagtgttttytaacagtgctgcccctctctcccactagaaatgcgagtccatccttttaccaagtgtggtacgacaaaggtttctctggttttcttttggtattctcaga

SEQ ID NO: 17963 - DNA, 201 bp, Homo sapiens
ccttccaacatctagcattattgtgtgttgaataaatacttgttcgattaggtctaatcactcttcatgattggatttccaaaatgtggactctcagcagkacattacagggacagtggttgggtctggagatgtcacccttagctgtttttcacaatgagaggttgttttatcataaataaatcaataaatggcagatta

SEQ ID NO: 17964 - DNA, 201 bp, Homo sapiens
caggcacgccaccacacctggctaatttttgtatttttagtagagatgggggtttcaccatgtgggccaggctggtcttgaactcctgacctcaggtgatygacctacctcggcctcccaaagtgctgggattacagtcatgagtcaccatgcccgaccagcaagaccccactgctattgtccagtgtggtaggtaccttt

SEQ ID NO: 17965 - DNA, 201 bp, Homo sapiens
aatgagggcattggaaatccgctctcaggtggccatcgaaaatagtcagcctgagtgttgctacctgttttccataattgtgtagctttgcctttccttarttaatctgttcaataaactcctctgcagaatccaaatgcttaaattcagtttctttttgtctttatggtgtttttcattgttaacgtggcatcggagtag

SEQ ID NO: 17966 - DNA, 201 bp, Homo sapiens
tggtatgtgcaggtatcaccaggatgcaattagtttgatgaaatataccaagtcgtcaatgccactttggatagtttaatctgaaaataggacatggttgkggtagtgggcacaggggaaggaaggttatgtaattttaaaattcttcctttgattcaaaagaaaaaaacatgtttgttgcattcaactccaaagggtgag

SEQ ID NO: 17967 - DNA, 201 bp, Homo sapiens
tctgttggctgcataaatgtcttcttttgagaagtgtctgatcatatccttcgcccacttgggtggatgaagctggaaaccatcattctcagcaaactgtygcaaggacaaaaaaccaaacaccgcatgttctcactcataggtgggaattgaacaatgagaacagttggacacaggaaggggaacatcacacaccggggc

SEQ ID NO: 17968 - DNA, 201 bp, Homo sapiens
attgtttgtttaaaatcactttggattctcatttaccttttccccctcaagatctttgtttttgactttggagataaccagaaataactaagcatgcttcsttccctctacgatttcatcctcatggggaagcaagaccccactcttttattttcatgtatgtatatatgtatgtatgcatgtatgtatgtatgtttgaga

SEQ ID NO: 17969 - DNA, 201 bp, Homo sapiens
taattgtgtagctttgcctttccttagttaatctgttcaataaactcctctgcagaatccaaatgcttaaattcagtttctttttgtctttatggtgtttwtcattgttaacgtggcatcggagtagctcgacttttgcatcatgataaattcataacccaagagaaggcagaaaacataattattatcaattgcctctct

SEQ ID NO: 17970 - DNA, 201 bp, Homo sapiens
taacactaacaagctaattcaggtatgataataaaaaccttcacagggttagccatccatctatctgtccatccatctattcactcatgcattcatccacstgttcatccattcatctgtccattcatccatctatccatccatctacttctaggttgtgagaacccgtagtattgactctcagtgtgataggaaggccag

SEQ ID NO: 17971 - DNA, 201 bp, Homo sapiens
tctgatggccagtgatgatgagcattgtttcatgtgtctgttggctgcataaatgtcttcttttgagaagtgtctgatcatatccttcgcccacttgggtsgatgaagctggaaaccatcattctcagcaaactgttgcaaggacaaaaaaccaaacaccgcatgttctcactcataggtgggaattgaacaatgagaaca

SEQ ID NO: 17972 - DNA, 201 bp, Homo sapiens
cactttaaacattgcatccttgagttgcatatgatgggatctcttgaatcatttacattttgaaaaaagaaagtgaaatattctttaagaagccaaagtamtccacgagaatgtatggtgtttgttcagctggatatcttatttatttgaagtactgagagagaaatcttttctgactgctcaaaacagggaataataaac

SEQ ID NO: 17973 - DNA, 201 bp, Homo sapiens
gaaattgtctctaccttcaaggttctcacagtctggagggaacagagagccatcagggacaataggtccctgtgccatcagctactgggatgtatgacttyccagtagaggtacacagcacttgttccaaaaggagcctatgtagctttgggagttctctatttagtcaccttattttttttgtcttcttgttaaactagc

SEQ ID NO: 17974 - DNA, 201 bp, Homo sapiens
ttgtctttatggtgtttttcattgttaacgtggcatcggagtagctcgacttttgcatcatgataaattcataacccaagagaaggcagaaaacataattrttatcaattgcctctctcctggaattgccattggctgagtggaacaaaatacgaacttaaggagtagctgattcagagaaatccagggtaggaacgggtc

SEQ ID NO: 17975 - DNA, 201 bp, Homo sapiens
caaagaattgtagttggatcaaatgagttggagtgggatacagcaacaatctatattctgatttcagcaacactgtgcagtgtaattccatattatattayaccacatcttctgtgggtctttctttgggggaagctaacattttaaaaggtttccctttgtaacctgtaaccccctctaccccaaaagtatattcaagag

SEQ ID NO: 17976 - DNA, 201 bp, Homo sapiens
aggctagccaatcatttcaaagcctgtgtagaatatctagactatatgtaatcctaggatttgttgttgttttgttatgattttttttaagcaggaagctwaaaaaaataaccacccgttactttgctgcttttagaaaataggtttgagattgattttgaatactaaagtatagttttcatgttataaagccaaccatgt

SEQ ID NO: 17977 - DNA, 201 bp, Homo sapiens
aaagtgagattgcttcacattgcatttaaaggcttaaataatgtattctgtcagacaattctctgaaatggttttccaagtgaatgcatcagaaagtgccyagaaagaatgcctggcacaggaagaggagggcattcagaaaatgtgagctgcttgcatcagaatctaacttgagatgtatcattcctacggtaaggtgca

SEQ ID NO: 17978 - DNA, 201 bp, Homo sapiens
tctttatggtgtttttcattgttaacgtggcatcggagtagctcgacttttgcatcatgataaattcataacccaagagaaggcagaaaacataattattrtcaattgcctctctcctggaattgccattggctgagtggaacaaaatacgaacttaaggagtagctgattcagagaaatccagggtaggaacgggtccca

SEQ ID NO: 17979 - DNA, 201 bp, Homo sapiens
aaaaactagccagaaagcgtgaactttttttttttttaagccataaagcttggtaaggctagccaatcatttcaaagcctgtgtagaatatctagactatwtgtaatcctaggatttgttgttgttttgttatgattttttttaagcaggaagctaaaaaaaataaccacccgttactttgctgcttttagaaaataggtt

SEQ ID NO: 17980 - DNA, 201 bp, Homo sapiens
atagttttctgttcctgaattcatataaatagtcacccagtacgcattctttgctgtcttgcttcttttactcctcattaggttgtgggatttgcccacgrtatttcattctttattgtcattcttctttctctgccactgccatcctaccaacagtttgtattatgaaaaattgcagacgtacacaaaagttgaaagaat

SEQ ID NO: 17981 - DNA, 201 bp, Homo sapiens
gcccttttgaagatcaaatgggatctgtaaaaactctttgaaaaatgtagactgcttcttatgtgattcttactggtctattatttatcaagaaattaaamaggaatgaatatctgtagctgtttttctttttctttcttttcttttcttttctttttttttaagatggagtctcgctctgtcaccgggctggagtgcagt

SEQ ID NO: 17982 - DNA, 201 bp, Homo sapiens
tggccatggaattgagaagcaggagcatggctcacaaattcacaaatcagcttctccactaatgaggggtgaggaagttaaaatatagactttgttgttgktgctgttttaatgaagaggctggacattaaaatcaaggggaggaataatcatgtcttctcttgaaatgggcagtgaacttcccggaaccagagtgttgcc

SEQ ID NO: 17983 - DNA, 201 bp, Homo sapiens
ttcttttcttttcttttctttttttttaagatggagtctcgctctgtcaccgggctggagtgcagtggtgctatttcggctaactgcaatctctgcctccygggttcaagcaattctcctgcctcagcctcccaagttgctgggactacaggcgtgcgccaccatgcccagctaatttgtaattgtttgtttctaaaagga

SEQ ID NO: 17984 - DNA, 201 bp, Homo sapiens
ttttaaaaataattaaggtgatgtcatgataaggctattaagagccaacatgcattgagtatggactttctgccagacattgcactatgcacttaacacayagacacatattgttttttccattttaagatacagaaagtgggccttaaaggtgctactgacttgctgatatgctttggctgtgtccccacccaaatctta

SEQ ID NO: 17985 - DNA, 201 bp, Homo sapiens
tctgtcaccgggctggagtgcagtggtgctatttcggctaactgcaatctctgcctcccgggttcaagcaattctcctgcctcagcctcccaagttgctgrgactacaggcgtgcgccaccatgcccagctaatttgtaattgtttgtttctaaaaggatattcagtgcttccactgtcttttagaagtctgtagaaggaa

SEQ ID NO: 17986 - DNA, 201 bp, Homo sapiens
tggatttgtcccattacactgctttctttagtgcataagatcttgaagggagggatgcattctatgcaccccaagtttctggtttactcgtggtttcaggwgtccctttagacaacatcactgacaactcactatgtaaaaccaaacaaattattagctttcttactgtgtgtttgcatttgctgtgcccagggaaatggg

SEQ ID NO: 17987 - DNA, 201 bp, Homo sapiens
gttttttccattttaagatacagaaagtgggccttaaaggtgctactgacttgctgatatgctttggctgtgtccccacccaaatcttaacttgaatcgtrtctcccagaattcccacgtgttgtgggagggacccagggagaggtaattgaatcatgggggctggtgtttcccatgttattcttatgaaagtgaataagt

SEQ ID NO: 17988 - DNA, 201 bp, Homo sapiens
gctgttcttaactctgaaagcagagtgggccatttgaatgctcactttgatattttttaaaggaaaaatttgaggcattgacacatgccttttgcttactygcttggattggtttgatcaactttgttgcggtctaatttatgtaaaataaattgcatccatttaaatatacaattcaatgagttttgacagatgcacatg

SEQ ID NO: 17989 - DNA, 201 bp, Homo sapiens
cgatctcggctcattgcaagctccgcctcccgggttcatgccattcttctgcctcagcctcccgagtagctgggactacaggcgcctgccactacacctgkctaatttttttgtagttttagtagagatggggtttcaccgtgttagccaggatggtctagatctcctgacctggtgatccgcctgtcttggcctcccaaa

SEQ ID NO: 17990 - DNA, 201 bp, Homo sapiens
actatgtaaaaccaaacaaattattagctttcttactgtgtgtttgcatttgctgtgcccagggaaatgggaagtgcattgaggaagaggccccaagacawggagaagtcactccaactttccgggaacaccttttgctgtgccatgtgcatggaaggagaggaatgaatgactgttgaagccagatggccttgctcattg

SEQ ID NO: 17991 - DNA, 201 bp, Homo sapiens
ggagaggtaattgaatcatgggggctggtgtttcccatgttattcttatgaaagtgaataagtttcataagatccaatgaatttatcaggggtttctgcartttttctcttgccaccaccatgtaagaagtgcctttcacctccaccatgattctgagacctccccagccatgtagaactgtaagcctgattaaacctctt

SEQ ID NO: 17992 - DNA, 201 bp, Homo sapiens
cctcccgggttcatgccattcttctgcctcagcctcccgagtagctgggactacaggcgcctgccactacacctggctaatttttttgtagttttagtagrgatggggtttcaccgtgttagccaggatggtctagatctcctgacctggtgatccgcctgtcttggcctcccaaagtgctaggattacaggcgtgagcca

SEQ ID NO: 17993 - DNA, 201 bp, Homo sapiens
agctttcttactgtgtgtttgcatttgctgtgcccagggaaatgggaagtgcattgaggaagaggccccaagacaaggagaagtcactccaactttccggraacaccttttgctgtgccatgtgcatggaaggagaggaatgaatgactgttgaagccagatggccttgctcattgattctctcctttcccgccctctcaa

SEQ ID NO: 17994 - DNA, 201 bp, Homo sapiens
cctcctaatactgcatgacggataatatgccatcacatggtgtcatttaatatattcattcctatttatagacattgaagttagatccatgtcttactatyacacatgacttagtaatgaatgttcctgcatgtatatttggtctgcttgagcaaggatattgggagggaggatttccagcagcagaagtggtggaacaaa

SEQ ID NO: 17995 - DNA, 201 bp, Homo sapiens
ttcttactgtgtgtttgcatttgctgtgcccagggaaatgggaagtgcattgaggaagaggccccaagacaaggagaagtcactccaactttccgggaacmccttttgctgtgccatgtgcatggaaggagaggaatgaatgactgttgaagccagatggccttgctcattgattctctcctttcccgccctctcaagcca

SEQ ID NO: 17996 - DNA, 201 bp, Homo sapiens
tgttgtgggcttggggaaacagaaggaaattggagacattgatatgcttcctgagaggtggaaggggccacttaacacagctttcatttttcagttgccartgggagaggagctggggtgggcatataatgagtaacattcaaagctccttctgtctttttttcagagaattcacaaaacaactcagggcctcctggtcct

SEQ ID NO: 17997 - DNA, 201 bp, Homo sapiens
tgaagccagatggccttgctcattgattctctcctttcccgccctctcaagccatccagaaggagaatgaaatgctcaaatcaagggagttaactatggcmaagatgttagtaatgggaaactttggaggaaggcaaagtcagaaattattctgcagggagatttggggatgttggatgctaaggcccaagccgtctattg

SEQ ID NO: 17998 - DNA, 201 bp, Homo sapiens
tgctcacagtctctcaatcctttatgttgagggagaaatgataaccagatctcattttgtgtgccaacccgaaagcctgacttgactgcctaaaatgttargaaggactctaaagccctatctggattccaaatttatggttggtgcagactggatttttacaatttgtgcttagtagtatcttattatattagcccggca

SEQ ID NO: 17999 - DNA, 201 bp, Homo sapiens
tttagaaatatttctaacctctggccttttttcttatctctacttaaagcttttctggaaggaattcattttccactttccttaatgttccttaaatgttstacatatcttaaaagtggattcctcataaaacaatatggactatggtcttattctgtttaacggtatgaaagctcgcctgaaaggccaagagtaagattc

SEQ ID NO: 18000 - DNA, 201 bp, Homo sapiens
gccagggaaccaaggcctttcaaagttgaggacacttcccggtgccgtgcggtgtaaatcacagtgcaaactatgcgattatcccctgcagaggaatcgastgtgactttatgggattcttcaccaagcacttaggaataatctgatataaaacagcaggggtggagagtaatgacaacttcaaattagtttaatgaatgt

SEQ ID NO: 18001 - DNA, 201 bp, Homo sapiens
ggaaggaattcattttccactttccttaatgttccttaaatgttgtacatatcttaaaagtggattcctcataaaacaatatggactatggtcttattctstttaacggtatgaaagctcgcctgaaaggccaagagtaagattcttttaaaatcatgcccaagttttaaaggaatataaaactttctctttaaaaatata

SEQ ID NO: 18002 - DNA, 201 bp, Homo sapiens
aaatgtccagctttctttcttttattcaaaatttatacttcataattgaagttcacctcccaaaagacatagcttggtttagcatagagctatgatgtgtkttctctttgttccttttgcacactttccttgtctggaggcgttgggcttggatccttcattcttcatgaggctgatgtttttccatttcggtttccttaa

SEQ ID NO: 18003 - DNA, 201 bp, Homo sapiens
aaaatgtccagctttctttcttttattcaaaatttatacttcataattgaagttcacctcccaaaagacatagcttggtttagcatagagctatgatgtgktttctctttgttccttttgcacactttccttgtctggaggcgttgggcttggatccttcattcttcatgaggctgatgtttttccatttcggtttcctta

SEQ ID NO: 18004 - DNA, 201 bp, Homo sapiens
ctcctggttttcagcctgaggaggaaggtggctttatttaactccttcagccccggaacatcacagggcccttctttgtgcattctgggttctaacagccmcttgaacagtgcttgagagtatttccattataaatgtcgaatcggcattgaaggaacatctgttttaagtcaacttagactcaatccaggaaaaaaaata

SEQ ID NO: 18005 - DNA, 201 bp, Homo sapiens
cgcctgaaaggccaagagtaagattcttttaaaatcatgcccaagttttaaaggaatataaaactttctctttaaaaatatacctttctgctttcatcccytaacccacaaagctcaagtctagtttaattcaaacttggaaatagttcttttattattgctccctgcaatgggaacagagctgaggctcctaaggtctag

SEQ ID NO: 18006 - DNA, 201 bp, Homo sapiens
ggtgcctaaagtttgagaacttctgatcaaaaatgccagataagaaaaaaaaacctttcgagacatcatttgaatcaattatcaaatgtttccaaagtgcrcttgctttgcaaaccactgtactactcatctctgcctccatcggagcgagttcaggagagttgtgtttacttttctaaaggagccttttccttcccattt

SEQ ID NO: 18007 - DNA, 201 bp, Homo sapiens
aactcctgagggatgctcaggaaaccaaaaaggatgtctgcatggaggacaagaaggcacaaatcgtctgatttcaccccatcctaagatcttgtgacttmagctttgttttggactggggcattggatctcccacatgccctctcttaagtcgtgcatttgacgcatatttaataagcacctactgtgtgccattagaga

SEQ ID NO: 18008 - DNA, 201 bp, Homo sapiens
atttcagtagaaggagtgggataggaaatgttcacattgcttgcagtatgtgaaatagacctcgaggtattttggataaaaaagcaacattcgtgttttakatatggttacccagcccaagccgcctctgctctttatagccgtgtttttgaagtgttcttattttttgttccgaaatcggaatatttcctggcgtgcgta

SEQ ID NO: 18009 - DNA, 201 bp, Homo sapiens
ccaaagtgctaggattacaggtgtcagccacagtgccatgccctgatgtgatgcttaaattcagaaattgggaaggagggtcaggtagctataagcaaaayacaagagaaatataagagaaagaaagacttgtatctgttgttagtgagtttttgtggtggtgatacattaatggaggcaacagagggtcagaaatcaggg

SEQ ID NO: 18010 - DNA, 201 bp, Homo sapiens
atatactgaatgctaagccctccccactttttttttcttttttaaattcagaaatttctagttgtgtttattcccctcgtcagcatactttatcatatcaragccttttcagacactgtaaaactactgagttatgtttgggtcatgttttgcggtatgccctttaatagtgtagctttagaaatgcaattttcagcctct

SEQ ID NO: 18011 - DNA, 201 bp, Homo sapiens
gatttagaatcagaaagtgtgagttcaaattgccttcggctcttcacctgggtgggcgatttgaatagagctcacagccctgaaaaccctggttttcagaytctttattggtaaatgaagtcagcttagtgatatgagaattatgaaacataaatccctttgtaaaaatataaaataatcttacaatcatcatcgtcatcc

SEQ ID NO: 18012 - DNA, 201 bp, Homo sapiens
ttgaggttgcagtgagctatcattgtgtcactacacttcaccctggatctggaaggaagggaggaaaggaggaagggagggaaggaggaatttactagaarcaaattaacttctgtaatcctaagtacttgttaaggcagaaaaacgcagataagaaaatcgaagttgagggcaaggagctcatctttcacggtcatagac

SEQ ID NO: 18013 - DNA, 201 bp, Homo sapiens
gtgttttagatatggttacccagcccaagccgcctctgctctttatagccgtgtttttgaagtgttcttattttttgttccgaaatcggaatatttcctgscgtgcgtatcttggccccatcacatcacaacaggctgaatgctgtccacaggttgccagtctggatatggaatattagtcaaaacgatataaactaactt

SEQ ID NO: 18014 - DNA, 201 bp, Homo sapiens
ggctgatgccttctttcactagctttatgtggctggcagttctgtcctgccactcttttcctcatcatctcagcctccctgcccatggcactcaagagtcsaccttggcagaacctgcaactcttcagcgcctccctaatgaactccttgcaagggcccttggttaagttacagtagagaagtggttgcttaagcaagtag

SEQ ID NO: 18015 - DNA, 201 bp, Homo sapiens
gttcacgcctgtaatcccagcgctttgggaggccgaggcaggcggatcacctaaggtcgggagttcgagaccagtctgatcaacatggagaaaccctgtckttactaaaaatacaaaattagccaggcatggtggcacatgcctgtaatcccagctacttgggaggctgaggcaggagagtcgcttgaacttgggaggcag

SEQ ID NO: 18016 - DNA, 201 bp, Homo sapiens
gcatttcaggttggtctttcccgcaagaaggtaaactcatctgcagctgtattcgctgtgcctatggtagtgcctggcaaatgcacagaagtgggtattastgaggactttgtggttcgaatggaatgagtgtgctgctgacagtgttgcgagtcatctgcaaatgaaaagtccttccttctcttcccttctggaaccttc

SEQ ID NO: 18017 - DNA, 201 bp, Homo sapiens
gatgaccaagaatttatagtcaaaagtagataaagtaaaagagtgaaaacagagacatgatacgagttgatgataccgtatgcaacttgtcaaacacttamatttgtgaataagaaaactggggtctatttggtggtttatttcagagatgttggatcaaatcagacatcagaaaagacaccagtaccaaacgaagatatc

SEQ ID NO: 18018 - DNA, 201 bp, Homo sapiens
acgtgtaggaagctcaagacagagacgtggctggtcacggtggctcatgcctgtaatctcaacgctttgggaggctgaagcaggaggatcacttgagcctrggagttcgagacctgggcaacatggtgagacccccatctctacaaacaacaacaacaaaaaaaaaaattagccaggcgtgggggtgcatgcctgtgctcc

SEQ ID NO: 18019 - DNA, 201 bp, Homo sapiens
ggcaccacacacgatgagattggaggcacctgggtgtcagcctcttgggctggctcattacaggccactctgtctgaggaacactcaggtttgcaaaccgkttcttaaaattacaggatacctagggacctgttggggtgggagggaagaaccctatgggcagaaatgtgactttctgtagcaaagatgtactgtttccca

SEQ ID NO: 18020 - DNA, 201 bp, Homo sapiens
aaaactcctgggctcaagcgattcacgtgcctcagcctcccaaagtgctagggttacaggcatgagccactgtgcctggccctggtaaaattttgtctacrtagttactgctgcccaggcaaaatctgaaaaatgttagtctaatttagttaagtttttcttgcagaccagaacttctaggaaactaatatacaggttttc

SEQ ID NO: 18021 - DNA, 201 bp, Homo sapiens
aacttctaggaaactaatatacaggttttctccaaaatatattttcaaggaaaatcagagaataaaagtttccaatgcatttagactagaaaattaaataytcaacaaacaatttcggagggccaactatttgccaggatccttgctggaatagtctctaacctcaaggcaattgctgtctagctttaagatcaagagtaa

SEQ ID NO: 18022 - DNA, 201 bp, Homo sapiens
gtgtcacatatttaaggatgttcaaggcaaccaattagtattcaagcatttagaattattttgaaacatcttctgtgaaaaacaatttatttcctattccwaaataaatgcagaatattcctaatatagtttgatagttcctcctcaagacttatcattcaaagattgggcaaattgacttgaaagagaaaagttaagcta

SEQ ID NO: 18023 - DNA, 201 bp, Homo sapiens
cagttgctcacactcggtcaatacttgccttcctttgaggccatctgcactcactgacaatctgatcgctcccctgaatggaggtgaaagcatgcaagctmggagttaagatctttaactcagggaagaccctgtctatggaagtgctgagctcttcagtgtcatcacagaaaagcatgagcccctccctggtacggagtc

SEQ ID NO: 18024 - DNA, 201 bp, Homo sapiens
tagtgtcaagcagtacaggctttattcaatggccatggaattgagaagcaggagcatggctcacaaattcacaaatcagcttctccactaatgaggggtgrggaagttaaaatatagactttgttgttgttgctgttttaatgaagaggctggacattaaaatcaaggggaggaataatcatgtcttctcttgaaatgggc

SEQ ID NO: 18025 - DNA, 201 bp, Homo sapiens
gggtcaacttcttaccgacaaagctggtgccccaaaagaatggggtcttatcctgttgggtgtcatgaagccaacacacaaaaccgaaagtagtgtcaagyagtacaggctttattcaatggccatggaattgagaagcaggagcatggctcacaaattcacaaatcagcttctccactaatgaggggtgaggaagttaaa

SEQ ID NO: 18026 - DNA, 201 bp, Homo sapiens
gttctgaacttgctgttataattattcacattttcttgcagtgaaaatctacaggtcaaggtcatcttcacgtctttagttcttgttttgcttcaggtcastttagaaccgaatgttaaaaggatattgtctattcgaagggtcagattgtggcacgtggaccaaatccagccccccgaggcccacttttgtaaatcaggt

SEQ ID NO: 18027 - DNA, 201 bp, Homo sapiens
ggccacaaaaatcatgtcacaagatcttgttgatgtgcatgcattcattcattcaacaaatattattgagcatctaacataagccgggtgctttgctaggkacagaatgctgtacaaggtccctgtcctcatggggaccgtatgttgggaagacagatgataggcatggaaatgaagagacaaaccactccgacttcagcc

SEQ ID NO: 18028 - DNA, 201 bp, Homo sapiens
tagagtctggattctttttatccagaagccattctttcagcctgtgcctttttgtaaataccataccccatctatttccacaaaggatttggggcattagsgagtaaagggggaatatgttctagaagaagggcgctcacctcagtaaattgatgggtgggccacaaaaatcatgtcacaagatcttgttgatgtgcatgc

SEQ ID NO: 18029 - DNA, 201 bp, Homo sapiens
acctctttttcttcccggtctcaggttatgtctttatcagcagtgtgaaaatggactaatacagtgaattggtaccagtagagtggggcattgctgaaaasatatctgaaaatgtggaagtgactttggaactgggtaacaggaagaagttagaaccgttgggaggtctcagaagaagacaggaaaatgtgggaaagtttg

SEQ ID NO: 18030 - DNA, 201 bp, Homo sapiens
gatccgcctgtcttggcctcccaaagtgctaggattacaggcgtgagccaccgtgcctggcctgatgattcagtttttaccccaagatgcagtatgcctcmgtctcactaaaatatgccaatatgttcttcttcttgaggatcagggctgatttcttctactgggaaaatgtatcccctgtgtttggccccagaggcatca

SEQ ID NO: 18031 - DNA, 201 bp, Homo sapiens
catgttaattagatatgcatgtatgtgtatgtatgatgtatatacccatatacacacagtctatatatacatgtatgcgcacatacacatattttaaggaragaattataaaatgatcaattcaagcttactatatgctagaggtgaggaatatttgaatacaagtcttatctagtagattaaaacagaaattaaagactg

SEQ ID NO: 18032 - DNA, 201 bp, Homo sapiens
ttaggagaggaatcactgtgaatgtagacctcgggttggtcattttcctagtaagatagaccagactgactggaaaagtcaccctcttgggctatcctgcrtatgtggctcggcattgcttccgtcaggataatgcatcagtttcttggacaaagggtgcatttctgctatttgaatgcagacatatttttggatataagc

SEQ ID NO: 18033 - DNA, 201 bp, Homo sapiens
cggtctcaggttatgtctttatcagcagtgtgaaaatggactaatacagtgaattggtaccagtagagtggggcattgctgaaaacatatctgaaaatgtsgaagtgactttggaactgggtaacaggaagaagttagaaccgttgggaggtctcagaagaagacaggaaaatgtgggaaagtttggagcttcctagagac

SEQ ID NO: 18034 - DNA, 201 bp, Homo sapiens
cggtggggaggagttcatattcattttttttttgagtctggattttagaataaattcactgtgtacatagctattccatctttaaaaacctttgtgaatgytaatatacagcctttataaatttgaggtataatgttcaaaatgctctaatccctaaattttccagtctaggttattatacttttatgactattaattttg

SEQ ID NO: 18035 - DNA, 201 bp, Homo sapiens
ctggcagagggcttttttctgatcaccacccatgttaattagatatgcatgtatgtgtatgtatgatgtatatacccatatacacacagtctatatatacwtgtatgcgcacatacacatattttaaggaaagaattataaaatgatcaattcaagcttactatatgctagaggtgaggaatatttgaatacaagtcttat

SEQ ID NO: 18036 - DNA, 201 bp, Homo sapiens
ggtggctcatgcctataatcctagcacgttgggaggctgaggtgggtggagcacctgaggtgaggagttcgagaccagcctggtcaacatggtgaaacccyatctgtactgtaaatacaaaaaattagctgggcatggtggcaggcacttgtaatcccagctacttgggaggctgaggcaggagaatcacttgaacccgga

SEQ ID NO: 18037 - DNA, 201 bp, Homo sapiens
tttttttctaactgagggattaaggatataaacccaacttcaaatttctttctgggtggtcttgaaaacttaacagtaggtcctgtaaagaggtgggggaraggaaaaagaaatcctttactctcatctgctggttttaaaatgagaaaaatacacacacacacgtaatgatgttcgtgatgttaatggagggaaatatca

SEQ ID NO: 18038 - DNA, 201 bp, Homo sapiens
tcccctttctggcagagggcttttttctgatcaccacccatgttaattagatatgcatgtatgtgtatgtatgatgtatatacccatatacacacagtctrtatatacatgtatgcgcacatacacatattttaaggaaagaattataaaatgatcaattcaagcttactatatgctagaggtgaggaatatttgaataca

SEQ ID NO: 18039 - DNA, 201 bp, Homo sapiens
tactggccaggtagaaagggcgtccaggtgaagggaccctggttcagtgatctccaacctgcacgtctcatttgtgaggaagccgtagggtgtggactttycttgtttctgaccttgagtgattagaaaatagcagcttttatatgtcacaaatggactttagataagcatgaagatgacgaagactgtggaatatgtagc

SEQ ID NO: 18040 - DNA, 201 bp, Homo sapiens
tctggcaaaaatggttttattgtagtttcatccttgttgagtcaataattaactgagtttgattaaagctgaattttcctaagtatgaaaaccatgtgggyccttctctttcctcgtgatgcacggtgatagtgcgtatctaacacttgaaggtgtccacgctggccctagctcagtgagatggctttgctttgggggggt

SEQ ID NO: 18041 - DNA, 201 bp, Homo sapiens
gagcaaaactccatcttaaaaaaaaaaaaaaatgcccgccttattcagatacacagtctaatgctttccactagaagattctggcactgttagcatctctrgcataaactatgttactcaacccagttctgtcgtcgtcatttttttgtgttggctttgcccttcccgcattgtgacttgatcccatttaagcagcaacct

SEQ ID NO: 18042 - DNA, 201 bp, Homo sapiens
tgggagatagtttgagatttgaggcctctgaagaataggtgtttttgtgatgattttggcttttcagtttgacagttggctttgcttttttgacagacacmttaagagcttcaagggtcatttcatggtttgtcctttccatgtcagggacacctttcacgtggccattttaagcacaggaattgccttcaagtagtttac

SEQ ID NO: 18043 - DNA, 201 bp, Homo sapiens
tagataactcaagagactcaatcaacttcgtgtttaatgttttcgtaagaatacttcagaggcagtggtgtaatcgtccaagagtacacacaggcctgatygccaaagccagttttcttcaggcccagcacgtcctgacctcctcactcctctgcccactctctgtttactcactcccattttcattcattgattctgtta

SEQ ID NO: 18044 - DNA, 201 bp, Homo sapiens
gtcgttgtgagcagtgccttggtcccgatgatgattctccaaaatgtaatctctgctgacagaacaagagtctgcaaattgggagtctggaaagggaagakaagggctttgtccctggccccaaagactcagggagaggtttactggccaggtagaaagggcgtccaggtgaagggaccctggttcagtgatctccaacct

SEQ ID NO: 18045 - DNA, 201 bp, Homo sapiens
cccctggctgtccaccagcccctttgtgatagtctcatagtcttatttgtcttttggcttgtatcccacctgttcactttttaccatagctaacctttctmagtggtcaggtgggactcatggagattttccgttctttggagactagcagcgactgcagattactcatcagctgtctccttgagtccacaatgccgggcg

SEQ ID NO: 18046 - DNA, 201 bp, Homo sapiens
tctctagcataaactatgttactcaacccagttctgtcgtcgtcatttttttgtgttggctttgcccttcccgcattgtgacttgatcccatttaagcagyaacctctgcacacacaatcttttctctgtccttcactcagtgatgttataatatctagaggcttattgattatttgtttgattctattgtgggcacagga

SEQ ID NO: 18047 - DNA, 201 bp, Homo sapiens
tagtaaccatgaacctgtatatcaaaaagcgtgactagagtttcatagttaaacatgtgctgaaatccacagtggacaccagagagggtcatggaatctgrgaatggatgacttgtcccatgatgataatatctgtgttcctacggctgggcccggtggctcacacctgtaatcccagcactttgggaggccgagatggga

SEQ ID NO: 18048 - DNA, 201 bp, Homo sapiens
tggccccccagaaattatctccagcagcagcaacagagaggactggaatgccattgacaggtcccacaagtcagcaatcagcacgccattttttaaaattwatgttgctattgtatcgtaaggttcttctgaagcgaccacttcataacactgtgtagtccaatccctaagctgggcaatttttttttcccctttcaatac

SEQ ID NO: 18049 - DNA, 201 bp, Homo sapiens
ccaagagtacacacaggcctgatcgccaaagccagttttcttcaggcccagcacgtcctgacctcctcactcctctgcccactctctgtttactcactccsattttcattcattgattctgttattctccactaagttttctgggtggtcagcccaggaagcctcagcctgcttccagatagttctcctcagagttagcgg

SEQ ID NO: 18050 - DNA, 201 bp, Homo sapiens
gcccggtggctcacacctgtaatcccagcactttgggaggccgagatgggaggatcacgaggtcaggagttgaagaccaccttgatcaatatggtgaaacsctatctctactaaaaatacaaaagttagccggtgtggtggtgcatgcctgtaatcccagctactcaggaggctgaggcaggagaatcacttgaacccagg

SEQ ID NO: 18051 - DNA, 201 bp, Homo sapiens
ttaacatgctgttagtgcatgcaaaaaaaagcccagtaattgtagggctcatcagtacattgttaattgatcctcatttcctattattttacctcaaagcmaacacatcattcaccatagtgacaccagagttgtttatcttctctgtgcaagtgtgtgctctttttagcaagctttttggatcctctgtttcagagggcc

SEQ ID NO: 18052 - DNA, 201 bp, Homo sapiens
ttaccagacacatctcactttatggagcctggggctattggtaatatgcatttctttctcatcttgatcgtaaaatgatcttagaaaggtttctgagaatwtatagagtttaagacagcaataagacaactaattaattaaacaggaaaaggggatgttgtgctcagagaggaagtgtgggtctcataagggctttcacaa

SEQ ID NO: 18053 - DNA, 201 bp, Homo sapiens
tctacctataagtaccttccaactgttccacttttgtaaatttagttcaaataatacatatgctgaaattcctatatcccccccatactccagatcttcaktgtggaatttaaatataattccttattgtaaaaaaaaaaaatttttttttgatcaaggtgattttgataaactaaatgcatctttaattttactcacagc

SEQ ID NO: 18054 - DNA, 201 bp, Homo sapiens
caagccccagctgccaaggaggctgatatcgggagaggcagaatgtgtcttttctttcttcttcctcttcttcttcttctttttgaaaccatgctcattgkttttaggaatcattagcatggtgaagattaaagctattggagatagcacagattgtttcattttattatgttcaattggattggatccgagccatttgca

SEQ ID NO: 18055 - DNA, 201 bp, Homo sapiens
ccagcactttgggaggccgagatgggaggatcacgaggtcaggagttgaagaccaccttgatcaatatggtgaaaccctatctctactaaaaatacaaaarttagccggtgtggtggtgcatgcctgtaatcccagctactcaggaggctgaggcaggagaatcacttgaacccaggaggcggaggttgcagtgagccgag

SEQ ID NO: 18056 - DNA, 201 bp, Homo sapiens
ggacccggttggctctgcaaaccgcatttccttggctgaacgccagaggagagaaatgatccggcaagaagacacaccattccccgtcagccccttcccgwcccttgcacccctggatcttctgctgagtatcggattggtctgcgtccaagagctcctcgcttggccagcaggggctgcctggagaaggggaggacaggc

SEQ ID NO: 18057 - DNA, 201 bp, Homo sapiens
cttttttccactttcaaatgtataacaaaatagaactttatatttccagatggactgcctggaacccggggagtggctcagctaccaggccccagtggccsttgtcttgttatttcctccattagagacctggcgtataattgtgggagggagaagccagtggagcagtcaggggactccctggctgtttctgtgtctggt

SEQ ID NO: 18058 - DNA, 201 bp, Homo sapiens
ttttttgaaagagactgtttaaaacacgtaattttgctaagttatggctcatatcgtatttgttattttggttttgaaaaattgagtaggaagcaattgcrttcttaaatgacttgaacatcaaaggcaagtagtgtcttgttttaggagcagccaggctcctatccctctgatccagccaagtgctttcacttggtccca

SEQ ID NO: 18059 - DNA, 201 bp, Homo sapiens
gaaagtgtcatgtcaaagataaagggagaacagcattttctttttttacaagtcactcttacttaaacacacagcatgactctccttacacatttatttcrgaagagcaaagtccgggtccccaggctcaactatcagccgccttctcatcccaagggctgtcaccaccagaaatttaacatgctgttagtgcatgcaaaa

SEQ ID NO: 18060 - DNA, 201 bp, Homo sapiens
gttcaaaagtatcctctctaggcaaataacgagatttcgccagcaggatctcccgttaaaggcgtgcatgtgtggctttgtagacacgtatgtgtgtgtgmgtgcacacctgcctgcccttgcacagtgggcactgtttccagtgtgcagtgaggccctcccttcgtgtagaacaggacaggacaatgacaaagttattca

SEQ ID NO: 18061 - DNA, 201 bp, Homo sapiens
actttatatttccagatggactgcctggaacccggggagtggctcagctaccaggccccagtggcccttgtcttgttatttcctccattagagacctggcrtataattgtgggagggagaagccagtggagcagtcaggggactccctggctgtttctgtgtctggtcttatgggtctgggcactgaattcagtcacaaac

SEQ ID NO: 18062 - DNA, 201 bp, Homo sapiens
tcagaaattgggaaggagggtcaggtagctataagcaaaatacaagagaaatataagagaaagaaagacttgtatctgttgttagtgagtttttgtggtgrtgatacattaatggaggcaacagagggtcagaaatcagggaaatcagggtggaaaatagcccagcagaggggaaaagaggaagtctgaacgagggccaca

SEQ ID NO: 18063 - DNA, 201 bp, Homo sapiens
ccctggttgacctggaatgacctagaccagcagtcacaagctcctgcccatggacaaaatacagccggtacctctttggctatggcctgcaggctcagaayagttcttacattttcaatcatctgcaaaaaagaataaagaggagaatattatttcttgaaggaggaaaatgatatggaattctgatttcagtgtcataaa

SEQ ID NO: 18064 - DNA, 201 bp, Homo sapiens
aaggaccctatgttatatgatttcatttacatgaaataccccaaagaggcaaatctgcagaaacagaaagtagagtggttgccaggggctggggatggggygtggatggaggcatttgggattaacagctaaagatagcaggattccttctaaagcaataaaaatgttgtaaagttgattgtggaaattctttcacaactc

SEQ ID NO: 18065 - DNA, 201 bp, Homo sapiens
aggcaacagagggtcagaaatcagggaaatcagggtggaaaatagcccagcagaggggaaaagaggaagtctgaacgagggccacattgcagatagaggcyggtgtactggtctgctcaggctgccataacaaaataccacaggctggatgacttgaacaacaaaaatacattttctcatagttgtggagcctagaattcc

SEQ ID NO: 18066 - DNA, 201 bp, Homo sapiens
agctggcatggtggcacatgcctgtagtcccagcttctggggatgctgcagcgagccatgattgtgccactgctctctggcctgggcaacaaagagagatyctgtctccaagtctgtctgtctgtctgtctgtctgtctgtctctctcggaaatattccttcagtgtattagtaaagaagttacttatgagtcacttatgc

SEQ ID NO: 18067 - DNA, 201 bp, Homo sapiens
ggcgcgatctccactcaccgcaagctccgcctcctgagttcaactgattctcctgcctccgcttcccaagtacctgggattatagacacccaccaccatgyacagctaatttttgtatttttagtagagatggagtttcacccttttgattggttggccagtatggtctcaaactcctgacctcaagtgatccacctgcct

SEQ ID NO: 18068 - DNA, 201 bp, Homo sapiens
tccccgattacaatatagagaggctaaattatagtccatatcacttttcctttaaatccctttacttttttgtgctacaagagtttcagaataataattcygcagaaaaaagtactgattgtccagcagttgtgtcaggtagaaaactgggatgcccgactgcattggtttagccagaactgtggccatgaaaccttgcct

SEQ ID NO: 18069 - DNA, 201 bp, Homo sapiens
aaatattttgagaactctgaaataatgcacaccagaaacgtccagctgaaaacaaaaagggaacaagatgacattttgcaatcccatgcacgttgcaggcrcgttgaatgtgaaggtcagtagtacttcagagggcaggcctgttgcccccaagcctgttgcctaagaaatgcccaggccctttgaacaaaatggattcga

SEQ ID NO: 18070 - DNA, 201 bp, Homo sapiens
cagtacttctgctacgagtgtatacaggctgaggatgggtgctttgtggcccttttcttttaccggctgactagaatgttgacgttaaagcagttagagtycgagcaggcaactccgaccccaagttggagctgtgtgttgaagatagaagagcaaatatgtagaaggaacctggatttctatttttttaaaaaatataat

SEQ ID NO: 18071 - DNA, 201 bp, Homo sapiens
tagttctgtccctggaggtgagggccagacaacacatcaaaactgactttttattttttttcaaagttgttaagactatctaagattcagatctccctaawactgttcctagttagtatttagaacgtatttgtttagaggatactagcctgaaatagccctatctccaggttgtctgatgcgatgaggatgtggtgttaa

SEQ ID NO: 18072 - DNA, 201 bp, Homo sapiens
ccggctgactagaatgttgacgttaaagcagttagagtccgagcaggcaactccgaccccaagttggagctgtgtgttgaagatagaagagcaaatatgtrgaaggaacctggatttctatttttttaaaaaatataataaatcatccagccccaaatgtcaggaacctgggtttctaatgatggttggctgtcaccccca

SEQ ID NO: 18073 - DNA, 201 bp, Homo sapiens
aatctctagcttctcaaactgtttcgtggtggagtgccttttgggcacaggagaaggaaataagagcctcgcgaggtttgggaatgctgcctctagctctyacactgcatgcagaattcctactctgagagctcactttatctcaaaaacccatgcatattctgcatctactctgaattccgcagtgttgtgtgttactat

SEQ ID NO: 18074 - DNA, 201 bp, Homo sapiens
atacgaagatttttgagaaaaactttgcatattttaattgctgtctggaatcctccttcagctgggatgagaaatcatctctgggttagttctgtccctgraggtgagggccagacaacacatcaaaactgactttttattttttttcaaagttgttaagactatctaagattcagatctccctaatactgttcctagtta

SEQ ID NO: 18075 - DNA, 201 bp, Homo sapiens
gcagttagagtccgagcaggcaactccgaccccaagttggagctgtgtgttgaagatagaagagcaaatatgtagaaggaacctggatttctatttttttwaaaaatataataaatcatccagccccaaatgtcaggaacctgggtttctaatgatggttggctgtcacccccatttcccacactttaaatgagagaagta

SEQ ID NO: 18076 - DNA, 201 bp, Homo sapiens
tttgaaaacttaccttgtttatatgtttcttctgttgcaatttcttccattacctggaatagctgctttggacggcaaaccaagcaatgccctttcacagstgtgggatgaatggggaaagaagtcttggtaaggaagcaattcagagaacatggaagcatctcatggcagcagtcacaattttgtgttgcgtaatatttc

SEQ ID NO: 18077 - DNA, 201 bp, Homo sapiens
tatttaaagctgtcatggaaagccttaaagttaaaatacgaagatttttgagaaaaactttgcatattttaattgctgtctggaatcctccttcagctggratgagaaatcatctctgggttagttctgtccctggaggtgagggccagacaacacatcaaaactgactttttattttttttcaaagttgttaagactatc

SEQ ID NO: 18078 - DNA, 201 bp, Homo sapiens
tccctttataagctaggaatactaagaacctaagagtctccatgaggattagatgaggtaatgtttgtaaagaatctgagatatagtaagttgatcagcawatgttatttatcctcttcttccctctacaaagataactaagctgagatagcctaactcccccagctcagaaaatagcaagttatttgcaaaatcaaatgc

SEQ ID NO: 18079 - DNA, 201 bp, Homo sapiens
ttctgaactcagaaaatggagataaatctcttgcaaggcttttgattttagtttttagatacagaacctttaaaaaaaaagaaaaataaacgttttgccamagtgtagtatatacaacagatgtgagggaaggacattgttttaagtgggaaacgtcagctctctcaacttctacacattcgactattccctactcctcag

SEQ ID NO: 18080 - DNA, 201 bp, Homo sapiens
tgctttcattgttgcttacatgtgttaaataattttgtctctgtataataacaacctctggcgatttttcctttctctctctctcttttttttttcttttstttagacggagtcttgctctgtcacccaggctggagtttagtggcatgatcttggctcactgcaccctccgccttctgggatcaagtgattctcctgcct

SEQ ID NO: 18081 - DNA, 201 bp, Homo sapiens
tgatttttcaagtaaggtaatggaagcaagagaggtttacatacatggtgtacatatacctcggcagcctgtttccttcccttataactatctcaaaaaamcatattaagttatttttcagaattatgttttttcctgttgcttttgactgtaaagggcagacttaaatttagttaacatctgctctaacgttggatcatg

SEQ ID NO: 18082 - DNA, 201 bp, Homo sapiens
acgaaggaggaggaggaggaaaaggtgacttgcctctagctgatgtggattatttctcttttttaatttccatgtctgcgtagcttcatcatagatctcarcttaaggacaatgaaagtcgtttattgagtacttagtatgtgctggttgcagagccaagtcttttttttttttttttttttcctccttttttgagagaga

SEQ ID NO: 18083 - DNA, 201 bp, Homo sapiens
atctcaaaaaaacatattaagttatttttcagaattatgttttttcctgttgcttttgactgtaaagggcagacttaaatttagttaacatctgctctaaygttggatcatgtgtggagtccccagttttcaacattaaaaataaagtatttgttgaagtggggtttttttcttcttacagtatatgtagaaccattttct

SEQ ID NO: 18084 - DNA, 201 bp, Homo sapiens
tgccatccacggacggcttaagtgttaacagttcagtggagggtcagcgtgacagccttttgcacccacatctgggttcttgtccagtgtccaggaggaaygaggtctcatgagcaaattttaaggatggcaaatgtgggggattttattgctgatgaaagtggctttcactgggaagataagctaaaaagaagacaaagc

SEQ ID NO: 18085 - DNA, 201 bp, Homo sapiens
cttttccttcatgagaattttctgaagctattgtgaatctatggaagactcaaggtagtatctttttcacagcattcaaaaaaatgctgctggctccttgrcttgtccggtgcatcctccgtgccagcccccgctgtcctagaaccatctaagctaactctccgatgagctctggcctctggacctcagcctatccaggcc

SEQ ID NO: 18086 - DNA, 201 bp, Homo sapiens
tttctttcttttttttttttagggagggtctggctgtattgcccaggccggagtacagtggcacgatcttggcttactatagccttgacctctctggctcmagtgatcctcccacctcagcctcctgagtcactgggactacaggtgcacactaccatgcccagctaagtttgttcattttttgtagatacagggtctgac

SEQ ID NO: 18087 - DNA, 201 bp, Homo sapiens
tcagccttttctctcgatctttttttttttttttttcctttcttaagaaagggtcttgctcttttgcccaggctgcagtgcagtggtacaatcagagatcmctgcagcctccaactcctaggctcaagcgatcctccagcctctgcctgccaagtatctgggactacaagcatgcactcctgtgcttggttaattttgact

SEQ ID NO: 18088 - DNA, 201 bp, Homo sapiens
aaaattttcccctttctggcagagggcttttttctgatcaccacccatgttaattagatatgcatgtatgtgtatgtatgatgtatatacccatatacacwcagtctatatatacatgtatgcgcacatacacatattttaaggaaagaattataaaatgatcaattcaagcttactatatgctagaggtgaggaatattt

SEQ ID NO: 18089 - DNA, 201 bp, Homo sapiens
acccaaagagatctgaaaagcaaaaacaaatttattgtatatttatagcaaatttatttggtggtgaaatttgacttcagctttagcgtccctgtttctcstttctagtgtgaatgttcattttgttttgtttgtttttttgaggcaaggtctcacttcatcacccaggctggagtgcagtagtgtgttcacagctcagag

SEQ ID NO: 18090 - DNA, 201 bp, Homo sapiens
aaagtaaacagatcttagagagggacaccgatccctaccctgcatggggttattcacagagccatggggacactaaacgtaccttatctcttgaccatgcyattgattagttatgtgtttgcctgtgttattaataatgtatacattgaaaaatctatgtgcattatagtctttgatcttgtcatgaatttcaaagccaaa

SEQ ID NO: 18091 - DNA, 201 bp, Homo sapiens
gtaatatgcagtatatgtgctaaattactttttttgttgttgttgagatggagtttcgctcttgttgcccaggctggagtgcagtggtgtgatcttggctygccgtgatctctacctcccaggttcaagcgattctcctgccgcagcctcccgagtagctgggattacagacatgtgccaccacacccggctaattttgta

SEQ ID NO: 18092 - DNA, 201 bp, Homo sapiens
agattttggaggacttgaaaggttcctgctacctttggctggggatggagggaacatggaagatgggtctttgtttagaggaagctctttatcctggtacsctggaagttggcatagtcttagcagttagtccagatgtgaatttcaggattattctgtgagtcttccaagtcctgtctcagcagtgaaataggctcagtg

SEQ ID NO: 18093 - DNA, 201 bp, Homo sapiens
tatataagacagtgccctttagaagatccctgtctcattgagaagcgttgagtaaatgggtctctctggtcattctctccagaacatgaagccaaagggcygagagggagagactccaagaatgaattagtgtccagcaaggtatcgcttgtctcaggatgacaacttgcaatttggggatctctcaacgtcctgacctcc

SEQ ID NO: 18094 - DNA, 201 bp, Homo sapiens
atgaaaagaagttgtatcaaacttgctgggcatcagaaataaagggttttagagacactggcttcaaacacaagttattccatccaagattctaaacttarcaatgcaacttgcacttaattttaaaacgctggaaaaataatgataaagattgtgtgatcaagtatagcagccctgtggtgtttcctcagaatggtgtat

SEQ ID NO: 18095 - DNA, 201 bp, Homo sapiens
tctctgccttcctttctctccctccttggtctgcttcctcctgttgctatcagagcctgcctgcctcatccttgttccagccttgatggtgatgatgattrtggttgctgttgctatttgtttttttggtttgtttgtttgttttgagagggagttttactcttgtcacccaggctggagtgcagtggcgccatctcggct

SEQ ID NO: 18096 - DNA, 201 bp, Homo sapiens
cttgggaagtggactcagaggccaagtgactttgatttttcactttatcctggagtttctcaaccttggcactattgacattttaggccaggagattcttkgttgggggggatttcctgtgagttacaagacattaagcaacatcactggcctctacccactagatgccagtagcatcttctatttcctcaagtctcaaaa

SEQ ID NO: 18097 - DNA, 201 bp, Homo sapiens
ccgatatttaatattatcaattgctggttcctgtaaatttgcatttatggatcacattataaaagcaattactcttatggattgttcatgcagaaatgcaytatgatgataatatacttttaaaagtatatttatttccagaattcaatttgtaagaggtttgagggaaaaataatactgagttttgagtgtttctgattt

SEQ ID NO: 18098 - DNA, 201 bp, Homo sapiens
ccatgcctggctaattctttgtagttttagtagagatggggtttcagcatgttgtccaggctggtcttgaactcctcagctcaaatgatctgcccacctcrgcttcccaaagtgttgggattacaggcgtgaaccaccacgcccctcacgcgcagccactgttgctattgatgattattatgacatcattgctcagattca

SEQ ID NO: 18099 - DNA, 201 bp, Homo sapiens
tacttttgttctcaccttgggaagtggactcagaggccaagtgactttgatttttcactttatcctggagtttctcaaccttggcactattgacattttargccaggagattctttgttgggggggatttcctgtgagttacaagacattaagcaacatcactggcctctacccactagatgccagtagcatcttctattt

SEQ ID NO: 18100 - DNA, 201 bp, Homo sapiens
tattatcaattgctggttcctgtaaatttgcatttatggatcacattataaaagcaattactcttatggattgttcatgcagaaatgcattatgatgatamtatacttttaaaagtatatttatttccagaattcaatttgtaagaggtttgagggaaaaataatactgagttttgagtgtttctgattttaaaaatgtgt

SEQ ID NO: 18101 - DNA, 201 bp, Homo sapiens
ttaacacaacttctccgtgtgtgggctaaataaatattcgggcaacactgattgagcactgccttgggtaaataattctctctccacacatttcctagttyataatgaggagttttcttcgtggtctgaccaaatgtaacattccattgaaaatgagacataaatccttgagtgagggagacgtggaaccagggtttgagg

SEQ ID NO: 18102 - DNA, 201 bp, Homo sapiens
cttttcaagtatcttactgtatgatggttgcttttgggttgaattccaccttgggttcaattcaacatgaaagttaaccttttggtgaaggaatgatccasgggaaatagtaaaatattagcctgtcctccaatacaaattgcctgtgagtcccactgatacttacaaatatacagaggtggtgtaaaaggattctgtgtc

SEQ ID NO: 18103 - DNA, 201 bp, Homo sapiens
gcccctctgaaagcccttcactgcggctcagcctgtggtggaaggtgtccaaggtggctggaacacctcctgctgggggtgtcagtcttggctctcctgtkttctgcctgtgcaatggtgggtaggtcccttgatacctcgtaacctcagcatccctgtgggtgataaggagatgataatagtctcttcccgatgggggtt

SEQ ID NO: 18104 - DNA, 201 bp, Homo sapiens
ggctggagtagtgtgcagagcctggcggtgattgttctcattagaaagtatagtgtaatactcaataaattacttttgttctcaccttgggaagtggactmagaggccaagtgactttgatttttcactttatcctggagtttctcaaccttggcactattgacattttaggccaggagattctttgttgggggggatttc

SEQ ID NO: 18105 - DNA, 201 bp, Homo sapiens
ggtggtgtaaaaggattctgtgtcaaaactattaatatttgagaaatacaatacttatcagagcctttgtatgtaaatgtctcatatacccctctaagaasgggagcgaatagtattttccaaacttacgtcaccacttaccatccacctgcatactttacacgtcttggaatcaaccttacagggaacacttggtcgaaa

SEQ ID NO: 18106 - DNA, 201 bp, Homo sapiens
cctttgtatgtaaatgtctcatatacccctctaagaacgggagcgaatagtattttccaaacttacgtcaccacttaccatccacctgcatactttacacrtcttggaatcaaccttacagggaacacttggtcgaaaaacagtgttttctaaatttatattacagttcccactccccccgcccccacttgtatcactttg

SEQ ID NO: 18107 - DNA, 201 bp, Homo sapiens
tccacctgcatactttacacgtcttggaatcaaccttacagggaacacttggtcgaaaaacagtgttttctaaatttatattacagttcccactccccccscccccacttgtatcactttgtatgacagtcttcttgggaacatccattgggaaactcttcccttgcaggtgtctgttacaagtcctggttcacacagtgt

SEQ ID NO: 18108 - DNA, 201 bp, Homo sapiens
gatcacctgaagtcaggacatcaagaccagcctggccagtgtggcaaaaccccacctctactaaaaatacaaaaaaaaattagctgaacctggtggttcaygcctgtaattgcagctactcaggaggctgaggcaggagaatcacttgaacccgggaggcggaggttacagtgaaccgagatcgtgtcactgcactccagc

SEQ ID NO: 18109 - DNA, 201 bp, Homo sapiens
cgcctgtaattgcagctactcaggaggctgaggcaggagaatcacttgaacccgggaggcggaggttacagtgaaccgagatcgtgtcactgcactccagmctaggcgacagagcgagaccctgtctcagaaacagaaaataaaacaaacaaaaaaatactattccatagctgactattttctgaaatgattttgttactt

SEQ ID NO: 18110 - DNA, 201 bp, Homo sapiens
tatatatttaaagctgtcatggaaagccttaaagttaaaatacgaagatttttgagaaaaactttgcatattttaattgctgtctggaatcctccttcagmtgggatgagaaatcatctctgggttagttctgtccctggaggtgagggccagacaacacatcaaaactgactttttattttttttcaaagttgttaagac

SEQ ID NO: 18111 - DNA, 201 bp, Homo sapiens
gcaaggtagaaagacacctgaaggtgaacatctttggcccatgtgaaattttgttacgtgttgttaggtttcatttgtctctcagtcaatcagtcaatcartcagtctctctccttccatccccccttgtcccccttttctcttctctccccttccctgctccctctactttaaggttttctcacagattaagagagtagc

SEQ ID NO: 18112 - DNA, 201 bp, Homo sapiens
gacccagtcacagtgattctatctgtacctaccacagctaggtaggcggtatgggaagaccacaaacttgagagtcagacggatcgaacttcgtctttagycccccacttaggtgttatgtgactgtggtcgggttattggtaacatcttcttgctcagcttcctgacctgcagaatgggaataagaatacctagcacata

SEQ ID NO: 18113 - DNA, 201 bp, Homo sapiens
caggttttgtttttttgtgtgtgtgttattttgttttttgtttttttgtttttcgggggctggagtagtgtgcagagcctggcggtgattgttctcattaraaagtatagtgtaatactcaataaattacttttgttctcaccttgggaagtggactcagaggccaagtgactttgatttttcactttatcctggagtttc

SEQ ID NO: 18114 - DNA, 201 bp, Homo sapiens
gtgttatgtgactgtggtcgggttattggtaacatcttcttgctcagcttcctgacctgcagaatgggaataagaatacctagcacatagggttataatgragatgaaactgcttaacgcatgtgaataacaacaatggctaacatgtatcagacgcttgtcttagtgtttattgttttatgcgtattgtcctgtttcatc

SEQ ID NO: 18115 - DNA, 201 bp, Homo sapiens
aaaagaaaagtagagaggatagtataatgaggttcctgtctgccagtcactctatagtaactattaggaaacccctttttttctctgaagtcattgctccggtgtgtgtgtgtctgtatataaaaaaaagtatgtatacatatacgtatatgtatgtgtatagataaaaatgcatgtatggtgctgggcgcagtggctcac

SEQ ID NO: 18116 - DNA, 201 bp, Homo sapiens
agaaacttggacagaggaaaatgaaaatgttctattaattccactagcatgagataatcactcttaatattttgttgcatgttcttttctttcttctgagkgatagcatttttttcaacaaattgggctcgtaatatataggcacatagatatataattaaaaaaacaagaatttctcatgtcattaaacattgcttgaaa

SEQ ID NO: 18117 - DNA, 201 bp, Homo sapiens
taagccctgaagtctggacactgagagaattctaggcttgacttctctgtacagccatcttgggagtgctcaaccctttgaatcggatgtctagaatggaytcagatgtcactgtgcaggtgactcacgcctagaatcctctgcctatcgtgacagggagaagcctgtgtgaccctgtggccatctcagtctctgcagggc

SEQ ID NO: 18118 - DNA, 201 bp, Homo sapiens
aagatcctcaagctgttccttccaccccctgggatgctgattaagttaagatttcagattttatttattctacgggtatttgttgaatatttatttcttamgataccacgcactgctttaggcactgggaatatagcaggatatacaaaacagaaaaatcatggccctcatggattattggttgtgagtaataggaacctt

SEQ ID NO: 18119 - DNA, 201 bp, Homo sapiens
gtataatgaggttcctgtctgccagtcactctatagtaactattaggaaacccctttttttctctgaagtcattgctcctgtgtgtgtgtgtctgtatataaaaaaaagtatgtatacatatacgtatatgtatgtgtatagataaaaatgcatgtatggtgctgggcgcagtggctcacgcctgtaatcccagcactttg

SEQ ID NO: 18120 - DNA, 201 bp, Homo sapiens
tctatgtaacctcagccatcttggattcccagcttactcacatcatagatggagagtcagttgtttagaaaaaaactttcttttttttttctttccttttkcttttcttttctttctttctttcttttttttttttagggagggtctggctgtattgcccaggccggagtacagtggcacgatcttggcttactatagcct

SEQ ID NO: 18121 - DNA, 201 bp, Homo sapiens
tcctcaagctgttccttccaccccctgggatgctgattaagttaagatttcagattttatttattctacgggtatttgttgaatatttatttcttacgatrccacgcactgctttaggcactgggaatatagcaggatatacaaaacagaaaaatcatggccctcatggattattggttgtgagtaataggaacctttcaa

SEQ ID NO: 18122 - DNA, 201 bp, Homo sapiens
agcaacacacaaggattgggagatgttcatggcaagaaaaattcagaagggacattgttgtttcactaattctgtaaaggagagcagcggcatttacttakgccgattccccattctctctttctgtttttaaacagagacagatcttgctctgttgcccaggctggagtgcagtggcatgatggcatgatcatagttcac

SEQ ID NO: 18123 - DNA, 201 bp, Homo sapiens
cactgggaatatagcaggatatacaaaacagaaaaatcatggccctcatggattattggttgtgagtaataggaacctttcaatctaacttaggaaaaaasgttagggagccaaggaggaagagtgggtgtgatgatgcatcaggataccagagaatcccgtggaatcccacagtgacacagccaagccttgggaggggtg

SEQ ID NO: 18124 - DNA, 201 bp, Homo sapiens
cccacagtgacacagccaagccttgggaggggtgacactagcgatagagacagaaacccacacaggagtccttttctctgtctctcatctctgcttttctytgtacatctggttcaattattctcttgccacgaatcagctatttgtattcctctgtgcacgtcgcagaagatcaggaatttgcacattatagtcacaacc

SEQ ID NO: 18125 - DNA, 201 bp, Homo sapiens
caaggcgagtggatcacgaggtcagcagttgaagaccagcctggccagcatggtgaaaccccgtctctactaaaaatagaaaaaattagccgggcatagtrgcatgagcctgtaatcccagcgactcgggaggctgaagcaggagaatttctggaacctgggaggtggaggttgaagtgagctgagatggcaccattgcac

SEQ ID NO: 18126 - DNA, 201 bp, Homo sapiens
gaggtggtagatgcttttaaacaaacagatctcaggagaactctttcacaagacagcactagggggatggtgattagaaagcacctcatgatcccgtctasttcctgcagagaacagactagccccctatgcagcacacacctttgtgaggtccctcctccaacacagggattacaattcaacctgagacgtgggtgggga

SEQ ID NO: 18127 - DNA, 201 bp, Homo sapiens
tgcacattatagtcacaaccatacctagaaccaaattgcctaacactgaatcccaaatccaaattcctgggagatagaattcaattcttctcttgccacamatcagctgtttatactcctctttgcacgttgcagaagatcaggaatttgcacattatagccacaaccatacccagaaccagattgtctaacactgaatct

SEQ ID NO: 18128 - DNA, 201 bp, Homo sapiens
aaggtttggcttaactgcaaaggggtggttgatatcagattcatacgccagaaccagaagaccactcgtgagaaattctgtaagcacaggagtgtggtttrtgtcaaaatcaatctgatggagtgaagccattccttgccaagcgaaaatacagcatcatcaactacatccttgagcctagaacctcttcactcagcacca

SEQ ID NO: 18129 - DNA, 201 bp, Homo sapiens
atatgtcgccttgggaaacagaggcagaggagaacaggaaagagtcagatggactttgatttgagacccgtttctgcttcttcccagggtgtgacctcagyggagttccagagcatccatctcctttgtaagacacagataataccaactgcatggatttgttatgagagttacatcaggggagggtcatgaggtcacctt

SEQ ID NO: 18130 - DNA, 201 bp, Homo sapiens
ccgtttctgcttcttcccagggtgtgacctcagcggagttccagagcatccatctcctttgtaagacacagataataccaactgcatggatttgttatgasagttacatcaggggagggtcatgaggtcaccttcccatggccaggagaagcaggtactcaggaatggctacttctctggccactttatagacctatggag

SEQ ID NO: 18131 - DNA, 201 bp, Homo sapiens
tataatttttttcttcttttctatctgctagcaaagtgggtaagttgacccatgacatggtccactggagggaccacatttgtgactctagcaattaagcytcccttctcatctgtggataaaactgacctcccagtgtgctggagtcaaacatattcagcatccaatccacattggactgtttgcatgtaacgtacagaa

SEQ ID NO: 18132 - DNA, 201 bp, Homo sapiens
caaatgcagcatcgcttgaagctgtgataaaatatcacacctttggaaatcaaggctcttcttgtttatttatttaactcacattaattagccttaatttwaaaaaaatgagaagagccagcatcatgatgcaagcattgactttgctcacaaaaacatcttgtggtcaacagtggggcttagggggcaggttttgtggct

SEQ ID NO: 18133 - DNA, 201 bp, Homo sapiens
agttccattaggtgacagtgtgtgcacagtttatggaggatgaagcggaaaacctgagccacaaggcagtagaggttggacgagacactcattccgaaggsgggtgtgtatgtgcaaactgtataatttttttcttcttttctatctgctagcaaagtgggtaagttgacccatgacatggtccactggagggaccacatt

SEQ ID NO: 18134 - DNA, 201 bp, Homo sapiens
taagtgtgtaagcagggaacagaaagtactgtgatttaaaatatgttaatttttctactgtacagatgagagccagcttggagatgggctgtagctcaagyatcttacctacctctgatttcttaatgccacgttataaggctgctgcttatagctcttgaagtcactccaaaaacagatgagtgagaccctgttgctaaa

SEQ ID NO: 18135 - DNA, 201 bp, Homo sapiens
ggaggccaaggtgggtgggtcacctgaggtcaggacttcgagaccagcctggccaacatggtgaaaccgcatctctactaaaaataaaaaaaaaaaaaaaattagccaggcatggtggtgcatgtctgttatcccagctacttgggaggctaaggcaggagaatcacttgaacctgggaggcagcggttgcagtgagccga

SEQ ID NO: 18136 - DNA, 201 bp, Homo sapiens
agaaaggaagagtttcctgagtcacctttgggaggtaggaagggtttgacatgtaggctgggcatctgggaacgagtgagggattctgtgagccccatctyagtggaccactcaaggaaggtgggtaagccctgggtataagtgtgtaagcagggaacagaaagtactgtgatttaaaatatgttaatttttctactgtac

SEQ ID NO: 18137 - DNA, 201 bp, Homo sapiens
tgtgtcattccgttgtgcctgtcgtcttgaccttgtaaaaggtcttgggtaagcatgcaagaagttttgaagagggagatacagctaatttgcagataaaragcaagggaagaattcctggagaaaggaagagtttcctgagtcacctttgggaggtaggaagggtttgacatgtaggctgggcatctgggaacgagtgag

SEQ ID NO: 18138 - DNA, 201 bp, Homo sapiens
acttgtgtcattccgttgtgcctgtcgtcttgaccttgtaaaaggtcttgggtaagcatgcaagaagttttgaagagggagatacagctaatttgcagatraagagcaagggaagaattcctggagaaaggaagagtttcctgagtcacctttgggaggtaggaagggtttgacatgtaggctgggcatctgggaacgagt

SEQ ID NO: 18139 - DNA, 201 bp, Homo sapiens
cagcactttgggaggccaaggtgggtgggtcacctgaggtcaggacttcgagaccagcctggccaacatggtgaaaccgcatctctactaaaaataaaaawaaaaaaaaaattagccaggcatggtggtgcatgtctgttatcccagctacttgggaggctaaggcaggagaatcacttgaacctgggaggcagcggttgc

SEQ ID NO: 18140 - DNA, 201 bp, Homo sapiens
gctggagtgcagcagtgtgatcttggctcactgcaaactccacctcccaggttcaagggattctcctgcctcagtctcccaagtagctgagattacaggcscccaccaccaagcccagctaatttttttggttttttttgtattttagtagagacgggatttcaccatgttggccaggctggtctcaaactctggacctca

SEQ ID NO: 18141 - DNA, 201 bp, Homo sapiens
tactagtgagtggcagatatgtgtggaccacagagatggactgaaaagagaagtaacagtccttggtttgtattccagcccccaccttcctatgtctttgrgcttggtaattagatgcttggagcttcagtttccccatctgttggatcagaacggcagtatgtgctctccagtattttcataagagtcacatgaaatatg

SEQ ID NO: 18142 - DNA, 201 bp, Homo sapiens
agtattttcataagagtcacatgaaatatgtacctacagagtctatcactgtgctttttaagttggggcttaatatgtggtagttgttgctgtttttgttrttattattattaatgttattttttgtttgtttgttttttgagatggagtcttgctctgtcacccaggctgaagtgcagtggcgtgatctcaactcaccgc

SEQ ID NO: 18143 - DNA, 201 bp, Homo sapiens
taatataattaatgtaaaaacacatacttcttttcaacaaaaactggctctctttgtagtctcttttttaatttggtgcaatcacttaaaaagtttagcasatttaaaattttacatcattttaaaattgtttctcttttataagaaggatgctatttactattaatgtagaagtacaaaggaaacggttactttggattt

SEQ ID NO: 18144 - DNA, 201 bp, Homo sapiens
tgttattattattaatgttattttttgtttgtttgttttttgagatggagtcttgctctgtcacccaggctgaagtgcagtggcgtgatctcaactcacckcagcctccgcctcctgggatcaagtgattctcctgcctcagcctcccgagtagctgggactataggcacctggctaatttttgtattttatattagagat

SEQ ID NO: 18145 - DNA, 201 bp, Homo sapiens
acgtgagtgaccacgcctggcccataaatgttatctttatataacatactcacagctcccttaggagtacttttgtccatttctacacaatggaaacttayaattttagccttagcaacatgtatttactgggcatctagatttcatttatttaagaactttttattgaatgccgattgttcagcagccaccatgcaaggt

SEQ ID NO: 18146 - DNA, 201 bp, Homo sapiens
gaaaaaaacttgcttgtttactgtcttctgagctgatttctcacctactggcaagtggataggtctactttttgtttagctgtttttctaatttaatcttrtacatgagacagctatagatggatgtatagtctttgaagtggggccagttggctccgtctattagctgtgtggcttttgtgcaggtgacttgtggccccc

SEQ ID NO: 18147 - DNA, 201 bp, Homo sapiens
caacactaataagtaattgagcagatgagatgctcttgctagctttggtaaaaagtcggggcaaggttacaacagaggagctctgatgagacttgggatgrtaaagtcaagtcgaatatctggtagggttaaaaatctaacagtgggccaggcgcagtggctcacgcctgtaatcacggcactttgggaggccaaggcagg

SEQ ID NO: 18148 - DNA, 201 bp, Homo sapiens
tcctgggctcaagcaatccgcccacctcggcctcccaaagtgctgggattacaggcatgagccactgtacctggactccactatgccttcccctccccttycctcccttccccaccctaaagagtctcgctcttttccccaggctggagtgcagtggcactatctgggctcactgcaacctgtgcctcccggattcaagag

SEQ ID NO: 18149 - DNA, 201 bp, Homo sapiens
ctctcctcggccttgcaaagtgctgggattataggtaccccgcctggctgatactttccttagttgttttcagtgtaataacctgtcttcagtctactctwtgtccttttctctcctttcctccctgaatactcaagcttccagtgcacagatttctccaaccctgaatgtgactgataccaacaccatactagctcttcc

SEQ ID NO: 18150 - DNA, 201 bp, Homo sapiens
agcctggccagcatggtgaaaccccgtctctactaaaaatagaaaaaattagccgggcatagtggcatgagcctgtaatcccagcgactcgggaggctgargcaggagaatttctggaacctgggaggtggaggttgaagtgagctgagatggcaccattgcactccagcctggcagacagagtgagactccatctcaaaa

SEQ ID NO: 18151 - DNA, 201 bp, Homo sapiens
tgggattacaggcgtgagccactgtgcccagccaaacctcggcacttttatccaacaaatatttatttcgtgactattatgagtcaggcttaagaatacaytagtaggtacagcaggagagcatgtagaagaggatagatgtagaaaatcgggacggcatgttaggaatatagataggaattactaaggaaaattgtattt

SEQ ID NO: 18152 - DNA, 201 bp, Homo sapiens
atgtgtggccaatctcacaagatactaattctttttttcaaatgcagcatcgcttgaagctgtgataaaatatcacacctttggaaatcaaggctcttctkgtttatttatttaactcacattaattagccttaatttaaaaaaaatgagaagagccagcatcatgatgcaagcattgactttgctcacaaaaacatcttg

SEQ ID NO: 18153 - DNA, 201 bp, Homo sapiens
tttgctctgttacgtgaggacacatcacttgcacctcagtgtgagtttgaaagtgttttctctggagaataattctgaagaaataggccctccagatatcrgtagtgacaggggtatcagtaatgttgattactaagttcttgccacaggtagaagccatgctactgcacaagtttcatacttgaagagtggacatctgac

SEQ ID NO: 18154 - DNA, 201 bp, Homo sapiens
agatgtgcataataagttcaggaggggctcggttttgggaggccggggatactagaagataaccctaaaatgtggaaatctacatcagagagtggtgtgartggttcccaaaatgcctacctggcactcctaccaaagacacagcagagaacttggggcctcttgtttcagccattttcatcttcactgtaaatctagaca

SEQ ID NO: 18155 - DNA, 201 bp, Homo sapiens
gtgaaaccccgtctctactaaaaatagaaaaaattagccgggcatagtggcatgagcctgtaatcccagcgactcgggaggctgaagcaggagaatttctkgaacctgggaggtggaggttgaagtgagctgagatggcaccattgcactccagcctggcagacagagtgagactccatctcaaaaaacaaacaaaaaaaa

SEQ ID NO: 18156 - DNA, 201 bp, Homo sapiens
ttcctccccttttatcaagagccgtaagtccttggaaaatgcaaagagggggaaaaagaagaaaaacagcaacgagtttattggagagttaacacttaaakactccagtacattgagtgtgacatgcctgtgtaggagactgtctgtcccccaaataattgacaatttctctccatctaacaagaaaatatatggcacttt

SEQ ID NO: 18157 - DNA, 201 bp, Homo sapiens
ttttttttttaatacttttctttttgccggcatctgcgtagaatttttttttttttttttggtagtttcttaatggtctttagcaaaggaagtaagtgacrctgatcggtgaaggcagacagtaagatttataatgtatttgtgctagctgattgccaacagaaccggcctttcccagtggtgctgtacgcagactcggaa

SEQ ID NO: 18158 - DNA, 201 bp, Homo sapiens
caggctctaatgcacgataagacagttaggttcgaaggaaaacaaagacaattgcacggcacagagggaatatactgctacggtaaaccgatcactaacayccggccctgaatttgcttcaaagttttcactaaggcacaaagggagccgtgtggagctccggagttcccatctgaggtcttgtctaactccttggcaact

SEQ ID NO: 18159 - DNA, 201 bp, Homo sapiens
atacacaatatgttatatgagatcttcacccaatcaaggattaaatggccaattcctaaatgatgcctacctttttatggccatgtatacctttgcctcartactactggcatttgctgacatccatttatcaagatacagggatggatttctagaaggcccaggcaggggtgctggccaggagacaccaggcatagacct

SEQ ID NO: 18160 - DNA, 201 bp, Homo sapiens
tcgcagacacggaaaaaaggattattcctccccttttatcaagagccgtaagtccttggaaaatgcaaagagggggaaaaagaagaaaaacagcaacgagkttattggagagttaacacttaaatactccagtacattgagtgtgacatgcctgtgtaggagactgtctgtcccccaaataattgacaatttctctccatc

SEQ ID NO: 18161 - DNA, 201 bp, Homo sapiens
tgatgcacccgcatcggcctcccaaagtgctgggattacaggcatgagccaccgcacctggaggacaagtaatttctaagtattatttcttttaatcctcrcagtgactccttgttagggtttgctgcattttatacaaagaagaaaggagtctgtggaagtgacataaagtaggacatgtattcatttactgattcaacc

SEQ ID NO: 18162 - DNA, 201 bp, Homo sapiens
gtggcgtttccacacacagggaagcagatagttccattaggtgacagtgtgtgcacagtttatggaggatgaagcggaaaacctgagccacaaggcagtakaggttggacgagacactcattccgaaggcgggtgtgtatgtgcaaactgtataatttttttcttcttttctatctgctagcaaagtgggtaagttgaccc

SEQ ID NO: 18163 - DNA, 201 bp, Homo sapiens
cccaaagtgctgggattacaggcatgagccaccgcacctggaggacaagtaatttctaagtattatttcttttaatcctcacagtgactccttgttagggwttgctgcattttatacaaagaagaaaggagtctgtggaagtgacataaagtaggacatgtattcatttactgattcaacctttcatttgtacatatatgt

SEQ ID NO: 18164 - DNA, 201 bp, Homo sapiens
aagatgagtggcgtttccacacacagggaagcagatagttccattaggtgacagtgtgtgcacagtttatggaggatgaagcggaaaacctgagccacaakgcagtagaggttggacgagacactcattccgaaggcgggtgtgtatgtgcaaactgtataatttttttcttcttttctatctgctagcaaagtgggtaag

SEQ ID NO: 18165 - DNA, 201 bp, Homo sapiens
gctggacaagaagtcctgagcactggggagttgacttcatattggaggcagagaagaattacctgccgatggctgttggcccatggcaacaccctagatcsttgcatttgtggtcctgctgaaagaggagacttaagttatagagttattggtacttgcaacactttctctggaatttggccatttctctgctcttttagt

SEQ ID NO: 18166 - DNA, 201 bp, Homo sapiens
tggagatttcaaggatcatcagggaagctagtgtggctggagatgaatggagtgggtaggagaggtgctgttgggggatgggtatctggtagactctgagrtagcggtgaggaagacattagagggtttgagctagagagtgatgcgagctgtttgatttttgaaacatcgctggatttcagaatgaagtccagactgcat

SEQ ID NO: 18167 - DNA, 201 bp, Homo sapiens
ccactttttaaacatgacattcgatccacgtggcatagcaaggatgggatccacaagatggagtgatctttacgccatcctcctgaccataaatactaaaygaatactctatttcagttgagtttttagtttgctctgttacgtgaggacacatcacttgcacctcagtgtgagtttgaaagtgttttctctggagaataa

SEQ ID NO: 18168 - DNA, 201 bp, Homo sapiens
tgaaattcagtatatttgaaatgagcccttatcttgagctcactgagcttattattttgggttaaataaaaaagaaaacagagtcttactttttctgatcmttttattgtctttctgactaatgttaaaaagtagtaacctctagtaggtgggatagtagcaatttttagggatgtattgagaagagtacaaatgggaata

SEQ ID NO: 18169 - DNA, 201 bp, Homo sapiens
tgacagggagatggagggaggcaaaaagaaaaagggagaaggaaagagaggaaagaggggaagggaggaaggaaagaagagagagaaggaggaagagaggraaggaggcacagaggtagagaggcagggagataatggagatcctggccaaaagttaatgctccgtttctagtagtccacagaaagcaccttgaccaagtg

SEQ ID NO: 18170 - DNA, 201 bp, Homo sapiens
gctatgtcagaagcaagtcaggatttgaaggcagatctgtctgcttttgcccctctgtaaatccagagctgctgcctcatttcttacgttgcccccacccrtgcagcaattcttcctgggaggcctcattgttcatattcataaagggccccattcagtctcctttttggagaaatggccactgcaactctctgttctgac

SEQ ID NO: 18171 - DNA, 201 bp, Homo sapiens
gctggccaggagacaccaggcatagaccttcctttctcagagccttcgtggcccctagtttgaatctttgagtcactgcagtaaagttcctgatgtttgasagtactccttatgaagggagtcatatgagttgctagctgggttctctggatggtggtgtcatgccaacatgggagccactagcacaaagaacatgctagg

SEQ ID NO: 18172 - DNA, 201 bp, Homo sapiens
cgcagattgccagtgactccgggaatgcctaggtttatgtatggattaacacagtgatagaccctgagtagcaaaagacgaagactaattacctgacagarctcccctccactcgcctgggtcattgaaattaatttctgctttcaagcttggcagaaagcagctgcagaatttcagttcaatacttaaattaacggggag

SEQ ID NO: 18173 - DNA, 201 bp, Homo sapiens
ggattaagttagggagacagtaatggtattgttagcaggctatttcaatgattttctctgcggaagagtagggaaaggtgacattccaactgggaatattmgactctgcagatccctactcggagtttttcagccctgttttaagtgccgagctgggttttgcctcatgatccaattgttttattagcgaaatcatcatct

SEQ ID NO: 18174 - DNA, 201 bp, Homo sapiens
tccttctttctgatcttgagaccttgatttgtccagtattttctcatcattagctgagtgtaagcattttttggcaagaacattataaaaatgatgtggtrtctttcttagtatattatctcaggtagaacataatgttgatctgtctcatccctggtaatgttaaccttgatcacttggttaaggtgatgtctgctgagt

SEQ ID NO: 18175 - DNA, 201 bp, Homo sapiens
tacagaccccaaagcttgctgtcccctgggcaggtgcatgagggggtcccaggcaatcaggctcttctcaaacctgaattatacccggcctcagggtatargggtcaggcagctgtttgacaggattcttgcaaatgtttttggtttctctgtctactcattacgtacactctgccagaggttgaaaactcaatgttgaga

SEQ ID NO: 18176 - DNA, 201 bp, Homo sapiens
tgttgaaggtcatttgaaaaatactctgtctttattctttgaaatggatttactctcaagaaagttgcatgtcactttacttggaagagacgggtctcagkgaggtgtgcctccgctttcatgaaaagtctcccgtctgcagaagcattggctgacatggaagattttttttttttttaatacttttctttttgccggcat

SEQ ID NO: 18177 - DNA, 201 bp, Homo sapiens
ggtgatgtctgctgagtttttccaatgtaatgttattaatttttcctttgaaattcataattatttgaagggagatgttttgagatgatgctggcagcccygttttccttaaactttcacatgctgactttctattgttggatcttgcctgcagcagtgtttaccatgatgcttggctagtggtgactatgtatttccctt

SEQ ID NO: 18178 - DNA, 201 bp, Homo sapiens
gcaaagtcaagttggagatggctctcgatatgcatgagtgtgttagactgcttttcttctattttttaaaaatgcacccaaatgtaaaagacacttttacstttttgatttgatgttgaaggtcatttgaaaaatactctgtctttattctttgaaatggatttactctcaagaaagttgcatgtcactttacttggaaga

SEQ ID NO: 18179 - DNA, 201 bp, Homo sapiens
taatttttgtatttttagttagacaccaggtttcaccatgttagccatgctggcctcgaactcctcacttcaggtgatctgactgccttggcctccgaaartgctgggatgacaggcgtgagctgccttgcctagccaaataactccattatttaagaaaaattaaccagtatttattgaatacttactgggccctgtgct

SEQ ID NO: 18180 - DNA, 201 bp, Homo sapiens
tcttgcttgtaggaagaacaagagacgagacacagcaaggtgatgatgggtatgtgaagcaggataaagaaaaaaacaggacaggcattacaggcttaagyctgtaatcccagcactttggaaggccaatgcgggtggatcacctgatgataggagttcaagaccagcctcaccaacatggtgaaaccctatccctattaa

SEQ ID NO: 18181 - DNA, 201 bp, Homo sapiens
ttcacagtgtttctagctcccctttccaatacatctctctctctctttctctctctctctctctctctctcacacacacaacacacacacacacacacagscaaatcagacaccaacataaactgtagagttaacattctttttccaccctcacactttttttagctccgatctgtgttcaatttctgcctgagagagtga

SEQ ID NO: 18182 - DNA, 201 bp, Homo sapiens
cagcccaacacaaatgtataaacttgcttaaaacatgatgagatattttttgccattttttttcaactcatcagctatcattagggttagtgtattaataytttatgcacagcccaagataattctttgtccagtgtcacccagggaagccaaaagattggacaccctgggaataaaacagaaaaaaggtgtaaaaggctt

SEQ ID NO: 18183 - DNA, 201 bp, Homo sapiens
aagtacatcctcttaatttgtttctggaaggcagagttaagagttaattccttcccatgatgtggccccagcggagaccttgtgttttttttttttttttycttcagtgctttttcaggactatgttatagaatacttatggggcatacgtgtaaatgaactgtcaaccttaaaatctaaacaaacagcttgtttgtggtt

SEQ ID NO: 18184 - DNA, 201 bp, Homo sapiens
agctgacttccctctccttcattcccaaccaagtttgaccccgccgcagtggagattgtggcagatgggtcagatagcatgtgtcctgtcgctgtcacaastttttaataagggctgggggtcctcttgaagagcccaggaactgcagtccctcctctatgccttcccctgaacacagtgcgccctcactaataaattctg

SEQ ID NO: 18185 - DNA, 201 bp, Homo sapiens
aatcgcttgaacccgggaggcagaggttgcagtgagccgagatcacgccactgcactccagcttggcgacagagtgagtctccatctcaaagaaaaaaaamaaaaaacaaaaacctgccctgcccagccatgcccaaacagagtggccagcagtcagcttagtgtgggcagagctcagggaattattctgcagtgcagcta

SEQ ID NO: 18186 - DNA, 201 bp, Homo sapiens
agatgcctccagcaattataattgaatcttgaagctagagtttcttggctatcctatttcccttttgtttccaccatgaagaagtggagagccgtgtgacstcagtggtagagctgatgtagaagcgccctctctgttcctggcagtgcctgtcctgctaacctcgtgtctcttgctggggtcttcatcagtaagagacct

SEQ ID NO: 18187 - DNA, 201 bp, Homo sapiens
ttttttgcccttttgggggacaaaatgtctttatgttaaattgttttattattgttatctttatggagttaagggcacataaaatattcttacagagagarattctgtagtttccacaagtaaccagagaattgttcatggcagagaattattttttcaatgcctattttctcctgaattttctgacggagttagagatag

SEQ ID NO: 18188 - DNA, 201 bp, Homo sapiens
tttctgttttcttcttccatttttatgttttgctatgccattcattcattctattcttttcatttctttttctttttgtaaaaattgtacagagtttaaarttagtcaggtatgtctattaaatttttacgtaaaaagttaaagcagccctcagcatcaacttcttcttcatttctaactcatttagtgaattcagttggt

SEQ ID NO: 18189 - DNA, 201 bp, Homo sapiens
aggcagcagaattgcctgaactcgggaggtggaggtagcagtgagctgagatggcaccactgcactccagcctgggcaatggagcaagactctatctaccmcccaccctgcaaaaaaagaaaagaaaggaaaaaaaatcttggtgcttgtaggagaggcatttatttcttttaggactggacggggcttggagggtttcca

SEQ ID NO: 18190 - DNA, 201 bp, Homo sapiens
taaacaagaacaaatggagaatctttcactatgactgcaactgaaaagaggagtaatggaaggacatgtactcttcccatatatttttaaacaattactgkatctgatttttcatttttcattttttttttttctggaagaaagagcagatctggataaagtcagtatacaatgtggtctttggtgacagacccaagttca

SEQ ID NO: 18191 - DNA, 201 bp, Homo sapiens
ttgataactccctggcaggttctcttcatcgggcctccacatagggtatgcgaacctcttcatgtttttaaaagggagagatttaataaaggcaatttggkacttaaaaattgttagaagagctaaaagagtagttttgaggttgaccttcagaacggcttcctgaataatacagaagtgaccctccaggaaggcccttcc

SEQ ID NO: 18192 - DNA, 201 bp, Homo sapiens
gtgacaataatggagatagagaaaacaggatggattcaggaaacatgaccacactgagcatattcaaatgtaattgtcagttttcgtgtctccctcccackggaccacaagcccctaactcttcatgtacacaccctgactcccagtgtgggctggccacccaggaggcacccagtttatgtgtgctgcgtgagtgatgtg

SEQ ID NO: 18193 - DNA, 201 bp, Homo sapiens
ttgtgatttattaaccatttacttggctttggagaaggcagcatttttagtagtactgttgagcctgcatgtagcttttccaggagggcagggtgcctggatatctgatcttacagttattactttgtgtcatatataattttgttttctccctgcaacaaataaatctttgggactccggaagaaaaaaaaatgggaaag

SEQ ID NO: 18194 - DNA, 201 bp, Homo sapiens
gcaacctctgtcgattctccttcctcggcctccgtagtagtcaggactacaggcatgcaccaccatagctggctaatttttgtatttttagttagacaccrggtttcaccatgttagccatgctggcctcgaactcctcacttcaggtgatctgactgccttggcctccgaaagtgctgggatgacaggcgtgagctgcct

SEQ ID NO: 18195 - DNA, 201 bp, Homo sapiens
gggaaagaaaaaaaaaatttgtggttacagtataataaaaataaactgtttgtcgtgactgcagctgacatttatcagcctgtttgtgggtgatctttctctctctctataatacagaacataatttgtcactttgtaaatacattccagtctaaatccctgccagcatctgttagtgtttgaaggattaatgtgctaccc

SEQ ID NO: 18196 - DNA, 201 bp, Homo sapiens
attagtgaagcagaggttgaaggaggtcacttgctttttatcccaatgtcaaataactccataattttttttattattttttgagacagagtcttgctctkttggccaggctagagtgcagtggcgcgatcttggctcactgcaacctctgtcgattctccttcctcggcctccgtagtagtcaggactacaggcatgcac

SEQ ID NO: 18197 - DNA, 201 bp, Homo sapiens
gaaagaaaaaaaaaatttgtggttacagtataataaaaataaactgtttgtcgtgactgcagctgacatttatcagcctgtttgtgggtgatctttctctctctctataatacagaacataatttgtcactttgtaaatacattccagtctaaatccctgccagcatctgttagtgtttgaaggattaatgtgctaccctg

SEQ ID NO: 18198 - DNA, 201 bp, Homo sapiens
gtcattgattgaaagagtcatggcatagatgctgaagttttgatgggaactttgcaggatgttcgtttgtttatcattagccctgggagagtcatccctcrcctcccaccaccccttaatttaaagggatttaaaatattttcaagtacatcctgatatcagcacgtggtacactgagcctagttgatggaattgtgaaaa

SEQ ID NO: 18199 - DNA, 201 bp, Homo sapiens
cttagatcagacgtgcttttgaaatatccagatatatacaacacaaagagcgaagtttgttttatattttgtttgtttaggttttttttttttttttttttggctggtgtttactgaatgcgtgcaaggctttctgtcacaggctctgtgttaagatatttaacgggtgtttcattttcccagcaatgctataggacacag

SEQ ID NO: 18200 - DNA, 201 bp, Homo sapiens
caacactcagtctgatagtttagaaagcttttgcaaggcattccccaatataaccattaagcatcaaactctcaaatggaagtttcgaaaaacagaaaaaagtgagcataaatgcaaactatcaccccatgtaatagtttatttatttcatgctccacttttctgggcagttttgttgtcattctctctctacctcttttt

SEQ ID NO: 18201 - DNA, 201 bp, Homo sapiens
attataaaaatgtattaaaactgagaaggagaaaaaatatggcggtagatgcgattttaatgattgtgtaaatgttcattgttccatggcaaaaaaaaaaagtcgagcttttcagccacagtatttcagacaaatgccagggcctgtttttctgtaaatgtgtaccgtgtgcttttaacacaaagacaaatatgttgcttt

SEQ ID NO: 18202 - DNA, 201 bp, Homo sapiens
tttaatccaaactgaagttatgctttgggcttccagaatctgggtcaaaaagagtagaagtcaggctcagattgacgcttttcaagagagagaaaaaaaaagaaaaaaatcttgcctttccctagctagaggtcagatgtcaaaaaagctaataacacaacccaaggatgtcatcgacaaatgaaaaaactggtgcgatgc

SEQ ID NO: 18203 - DNA, 201 bp, Homo sapiens
caagcacctatcgttttcctgtgtattccaagaggccagtgtggctggtggaataagatgttttcctgttttcaagatgcagtggactctcttttatttarcagcagtgtctatgtgttaggaatccatgtgagttctctaagtctgggacaacgataggtgtgtctgagtcctgcattaccatggtttattctttccttt

SEQ ID NO: 18204 - DNA, 201 bp, Homo sapiens
ttctttttctttttgtaaaaattgtacagagtttaaagttagtcaggtatgtctattaaatttttacgtaaaaagttaaagcagccctcagcatcaacttyttcttcatttctaactcatttagtgaattcagttggtctttatatatgtagctttaagtaattgcatgtaaactgttacttcttcattttctagtcttag

SEQ ID NO: 18205 - DNA, 201 bp, Homo sapiens
ttccttctactttggtgccccatgatgatgtgcatcttttttatttctgcatcatatccatatagtgatatcatgtataatgatgtttaagaagacagttwtttttgtttaaattgttataaataagtaagtgtatgcaccactatgccatgtagcatatcaagattatttttctttcctgcaccttattttttccctgga

SEQ ID NO: 18206 - DNA, 201 bp, Homo sapiens
tatttgtaacaaacaaataaacaaaaaacaaaataaataaaagctacccagcttagattattttgtcataaaagccccaaaagactatgacaaatccttcyatctatgtgtccttaggcaaaatacccaaactctctgaataccaattttctcatccaaaaaaatgggtgaataatatctaagaggtaataaccctaatac

SEQ ID NO: 18207 - DNA, 201 bp, Homo sapiens
agaagacagttttttttgtttaaattgttataaataagtaagtgtatgcaccactatgccatgtagcatatcaagattatttttctttcctgcaccttatwttttccctggagttaatactcatctttttttagaaatttgctgagtttgtgatgtacctatcattcaacctcaaactttcatgtgattgtctaaatctca

SEQ ID NO: 18208 - DNA, 201 bp, Homo sapiens
tatcattcaacctcaaactttcatgtgattgtctaaatctcagttccttttattagaaaaaaaaaaaaaaacaactcccctggagcctttgtaccttctgyagtttggggttgttgtcctttttgcttggtgcacaggaatacttggtgatgttctttttaaaactgccctcacattgtatcctggaaagttcatttacct

SEQ ID NO: 18209 - DNA, 201 bp, Homo sapiens
ttaaaggtagaaacagaaaaaaacaggcagaaacataaaaagctcggagatggcttcctattgcttcttcattctgggccagagcaaatcatatggtcgtrctccagggtgaggaagtatgtcccacttacagactgaaaaggtgctgcaagtctgcacggcagagggcatggataaggggttcgtaaaaacttagggcca

SEQ ID NO: 18210 - DNA, 201 bp, Homo sapiens
tcttaacttctttaaacctcagtttcttcatctgtaaaatgcacatcataatatctctattcagagatacaggtggttctattaaacacatcaactctgtgtatataaagtcttaacccattgtggaataaattaagtgctcaattaaatgttagctgctgctattaataacaacaataataatattttcttcacgcatga

SEQ ID NO: 18211 - DNA, 201 bp, Homo sapiens
ttaacttctttaaacctcagtttcttcatctgtaaaatgcacatcataatatctctattcagagatacaggtggttctattaaacacatcaactctgtgtatataaagtcttaacccattgtggaataaattaagtgctcaattaaatgttagctgctgctattaataacaacaataataatattttcttcacgcatgaaa

SEQ ID NO: 18212 - DNA, 201 bp, Homo sapiens
acacatgtgcagccactgtatgacgtctggattttccttgacttatggtgatcactattgggaggtggtaagcaaacaggtgacataatttgaatcatggktttaaaagacgccatggttgccatgaggaggacaatgcgtaggaggcaggagtgaaagctaaaggatatgctgggaggtgaccctggagttaaagagagc

SEQ ID NO: 18213 - DNA, 201 bp, Homo sapiens
tgcaaaggccctggggtggaaacacactcgatgtgttcaagggagagtaagtggtgaatgggtttggagccaacagggataatagacaacgctatcaagargggggccaaccacacatgtgcagccactgtatgacgtctggattttccttgacttatggtgatcactattgggaggtggtaagcaaacaggtgacataat

SEQ ID NO: 18214 - DNA, 201 bp, Homo sapiens
tctaaatccctgccagcatctgttagtgtttgaaggattaatgtgctaccctgtgtatgtctgcacttccagggaacagtgtagcatctgattacagatcktgggagagcaggagggaacaaggtgttttctgtgctttttcctacatgcagtcgttttggcctttttctgatttttcttgtctttatcccattctgtcta

SEQ ID NO: 18215 - DNA, 201 bp, Homo sapiens
aaatctcaagcacaggtgcagcaagtgcaaaggccctggggtggaaacacactcgatgtgttcaagggagagtaagtggtgaatgggtttggagccaacarggataatagacaacgctatcaagaggggggccaaccacacatgtgcagccactgtatgacgtctggattttccttgacttatggtgatcactattgggag

SEQ ID NO: 18216 - DNA, 201 bp, Homo sapiens
ccagatgtggaagaaatagcctcattagtaacttttctgtaagcaatctccttatttcttgttttttgttcttttgttttttgtgtgtgcttctgcgtgcmcctcctctatggctccccccaccaaatttctgtgtcttcatttgcaactctcttttctccagtaaagaggaaagtgtatagttctcctttccttacagaa

SEQ ID NO: 18217 - DNA, 201 bp, Homo sapiens
atagaatgatccaagtttataatttgtaaataagtagacatcttttgaggcgtatgcccttaatttttctaactgatgaaagcgtacttccatcaactcargacagttcaaagcagcttggagcctcttggattttaaaaagactctgtggcctctgtctctcttggttttcagtgctcagctgaggtctactctgtttat

SEQ ID NO: 18218 - DNA, 201 bp, Homo sapiens
ggactattgttgtccatatttcacagatgaggaaagagatgtgctaagaaaagaggtggcagagtagggattccagctcagtagccactttcagggtcccrtacttttcaatgtaagcatattggctctcaatttaaaaatgttattttttacagatagtacacagatgcactgacacaggtaccctctccagtcctctga

SEQ ID NO: 18219 - DNA, 201 bp, Homo sapiens
tatagaacatttctaccatagtagaatgctcttttggatacatctgctttaaagcattagtccccaaagtgtgaaggatgaaccacttgggttccgagagraaacattataacttctgtttatccattaaactctttcatttattattaaacatctcaacacatttattgggtggcaggtactgttttaagtgttttgcat

SEQ ID NO: 18220 - DNA, 201 bp, Homo sapiens
aggctcattgcttacataccgacagcatacaaattgtcaagtacttaaagttccattgttgctgaaagggcctccacccaatgtccttaaatggtcccccytttttttttttttttcaaaccacaggatttacatctctcgtagcatctaatgaaataccagcaagaattgtgtgttggtgtaagaaataataatctttcc

SEQ ID NO: 18221 - DNA, 201 bp, Homo sapiens
cagtctattgttacaatattgcgtgtgttaggcatcaggaaacagaatctctttgtctcctgtccttctttcacctgccccaaggcaggactctaatcttycccacctttttgattgtgagtcttcagaccctccccagagagtcagtcctgccttatgccctggggaaaggaatgctgacctcatgaagctcccataaaa

SEQ ID NO: 18222 - DNA, 201 bp, Homo sapiens
tatatattttgaggtataaaaagtacgtgctcaaggtattggtcactcctcaatttgttttccttgaaacaaaatgaaggtataaatatttcagccgggcrcggtggctcacgcctgtaatcccagcactttgagaggccgaggcgggtggatcatgaggtcaggagatcgagaccatcctggctaacaaggtgaaacccc

SEQ ID NO: 18223 - DNA, 201 bp, Homo sapiens
ttgacactaaaagcttaagtcccatgatttgcctttgtggatggaaggccttggccttcttttatgatatatgtgttggggggaggcatgtggtatgtggrgcgggtaaaatacgagcctcatgcctgtctaagctggtgacttggcttggaaaagatgatcattcgtcaacgcatcacaagtcacagggcttatctccat

SEQ ID NO: 18224 - DNA, 201 bp, Homo sapiens
ttctaaatactctcccagagtagggaggaaaaatcatccaaactacttggtaattgaattcaagagtgatggaccaaaaattattaatgcattcccttccstccaccagccaaagaggattccatctttattctcctcccaaatgcaggctccattaaccttttacctttctttctttccggtctttcttttctatatctt

SEQ ID NO: 18225 - DNA, 201 bp, Homo sapiens
tgaggcaggagaatcccttgaacctgggaggcagaggttgcagtgagccaaggtggtgccactgcattccagcctgggcgacagagcgagattccgtctcaaaaaaaaaaaaaaaagtaatcattttagaattgctttctcttcgggatggtttacctcgtgtttagtctgtaaacgcggataaccgagagctggtcaaat

SEQ ID NO: 18226 - DNA, 201 bp, Homo sapiens
aagaaatggagcaagggaggggtttcatcccgccgtgttcatttgcttggctgtcctgaaattgcgaatacgcagttgttacctgctcccggtgggagggrggggatatttatttggcatcttgcaattgataggagctgagtgattttagtaggtagtttaactccttaaaaacttccagtggtttcatattctacctag

SEQ ID NO: 18227 - DNA, 201 bp, Homo sapiens
tgaaacgccttacataaactgaccaggaatctggggcattcgcgttagagacaattttcttctcctcaagataagggatggggaattagtcatagggtatytccagataatgtagttaacacctcgtgtaatattaggtgggcagggagctctgctctcaggaccaaaattgctcctgccagctctaatagggaatgtgtg

SEQ ID NO: 18228 - DNA, 201 bp, Homo sapiens
agtagtagtgaatgccctgactttggggtttgcagtaagctaggattaagtgcttcacagtgaggcacagtggggagctactctgaggatgaattgcctartaaataagtgaggtttgtataaccgaggccagatcttagaacctcctgctatctgtacatagaagaatgttttagtcagaggcaaggcaaggtcaccagg

SEQ ID NO: 18229 - DNA, 201 bp, Homo sapiens
gtacaatggctgacgcccgtaatcccagcgctttgagaggccgaggccggtgtatcgcctgagtccaggagttagagaccagcctgggcaaacagcctgargcaaaacctcatctctacaaaaaatacaaaaaatcagctgggcgtggtgatatgcatctgtggtctgagctactcaggaggataaggtgggaggatcatt

SEQ ID NO: 18230 - DNA, 201 bp, Homo sapiens
acactctaaggaatggcatgacattctcctttcttctcctgcattcattggaacctgaatgtagtattaattataagactgttagacttcaggggactacmctcttattctaaaatagtggtcaactaactgtgcccttcagacagaattcctgcccagcacctggctttgtaattaaagttttactggaacagaggaata

SEQ ID NO: 18231 - DNA, 201 bp, Homo sapiens
ttgctgagaggtggggagggggtgggggctctgtgcatggaatggggggaaaagcttcagggaagggcagtgcaaattgtttctggactgatgccatcttytaataatagtagttaatagactgggtacaatggctgacgcccgtaatcccagcgctttgagaggccgaggccggtgtatcgcctgagtccaggagttaga

SEQ ID NO: 18232 - DNA, 201 bp, Homo sapiens
agaggaataccagttaatttatatctcgtctgttgccacttttgctttcatgctattaaagctgagtatttgggagatacttgaaaaatctaaaatgcttmctatctggccctttagagaaaaggttttccaatctctgttctagaggattcgtggtcatttggaaagaaaagtatgttaagacaaaatgagcaggtggtt

SEQ ID NO: 18233 - DNA, 201 bp, Homo sapiens
gaaaagtatgttaagacaaaatgagcaggtggttggattagtattttctttctacacatatagaaactgttcctatcatacctgactcagttttcaaactkgcttaatccaaagcctggggggtggatgtaggagagaagttgaaattagctggggttttttttttgtatcacaaaagttacatttttttttttttttttt

SEQ ID NO: 18234 - DNA, 201 bp, Homo sapiens
gcaaccaaagggagcataactctgataagaataataaaaagaaacaattcagcaactctcttacagatttttatcatcatcccattcataattgattccaracgtgcatgaatctttcaagataagtgtcttattgattatcctgaaaacaagcgatcacttggtgtcctgagattcgctcactgccctcccctgattacc

SEQ ID NO: 18235 - DNA, 201 bp, Homo sapiens
tggaactacaggtgcccgccaccaggcctggctaattttttttgtattattagtagagatggggtttcaccgtgttagccaggatggtcttgatctcctgwccttgtggtccgtctgcctcggcctcccaaagtgctaagattacaggcacgagtctccgcacccggccctgtttttgcatttttagtagagacgggtttt

SEQ ID NO: 18236 - DNA, 201 bp, Homo sapiens
gacgggttttcaccaggttggccagcctggtctcaaactgttgaccttaggtgatctgcctacctcggcctcccaaagtgctgggataacaggcgtgagcmactgcgcctgtctacattttctgtctttactggtattatggtgggaacccataaaccactgcgaggcagataccattttaagcaggaaaccttatttttt

SEQ ID NO: 18237 - DNA, 201 bp, Homo sapiens
aattctacattcctaagaagctcctaacaggctgataatccatggatcgcattttgaatagaaaggattatgcaaaaagccagagtttttttttcccttgycttataccagtggtgcctagcatggtgtcaggtttatagaggactaatacatataagaaggagaaagggagggaggaggaattccagttgtttttttttt

SEQ ID NO: 18238 - DNA, 201 bp, Homo sapiens
attgggtagcaccgatatagaacatttctaccatagtagaatgctcttttggatacatctgctttaaagcattagtccccaaagtgtgaaggatgaaccamttgggttccgagaggaaacattataacttctgtttatccattaaactctttcatttattattaaacatctcaacacatttattgggtggcaggtactgtt

SEQ ID NO: 18239 - DNA, 201 bp, Homo sapiens
acatggttggctggatttggccaagttgacatagagagccaatccctcatctccagcagggcttttactcaatgatacagtgcgcatgaattgcttgggggattgtgtacaaagtgcagatttggttataggaggtcagggaggggcctcaattctacattcctaagaagctcctaacaggctgataatccatggatcgca

SEQ ID NO: 18240 - DNA, 201 bp, Homo sapiens
tatggagtgtcagaaatagtgaagcttctggagcttcactgtccaatatggtagccacgtgtgactattaaaatgtaaattaattaaaattaaaagttcarttgctctgaaatagcagccacatttcaaatcttcagtagccagatgtggttattggctaccatattgggtagcaccgatatagaacatttctaccatagt

SEQ ID NO: 18241 - DNA, 201 bp, Homo sapiens
aaaacagcaggaaaaactacatggttggctggatttggccaagttgacatagagagccaatccctcatctccagcagggcttttactcaatgatacagtgygcatgaattgcttgggggattgtgtacaaagtgcagatttggttataggaggtcagggaggggcctcaattctacattcctaagaagctcctaacaggct

SEQ ID NO: 18242 - DNA, 201 bp, Homo sapiens
atcactgtgtaacttcatccaatacgtattgaatacctactatgtgtctggcaccacttcagacagtaaggatatggatatgaatttgtatcagtcaagcyttccaggatcttattatctagagagaaagattaaaacatatgcaaataattttgatagaagcaaagacctaactcagcctgagaggaggttgggtttaga

SEQ ID NO: 18243 - DNA, 201 bp, Homo sapiens
cttcttccccctacttccttcttatatctggctatctgggagagaaaaaatttaatacaattgattactttttagaagagttaatttttacttattactgkggattttttgttttttaacagtcacaccgaggagaagactcagtgggaacatccaaaaactggaaaaagaaaacgagtggcaggaggtttgtatgttgtt

SEQ ID NO: 18244 - DNA, 201 bp, Homo sapiens
ctgagtagctgggactacaggtgcatgccaccacacctggctaacttttatttatttttagtagagaggcagttttgctgtgttgcccagactggtcttgractcttgagctcaagaaatccttccacctcagcttgacattacaggtaagagccaccgtgtccggcccccctttcttcttttttaaagtggggtattaag

SEQ ID NO: 18245 - DNA, 201 bp, Homo sapiens
atctgataggaaggattcacagctttccccaagaatacaccacagtgcatacaaatcctcgaagccgcagaactttttcaagttgaactgtgaactgtgatttttttttttttttaagtaagtttacatgtagaagctcattggtagagagctttagatatattacttcccagggtggtgcatcctgtcaccatgaagtag

SEQ ID NO: 18246 - DNA, 201 bp, Homo sapiens
agtaagcacagtggctgggataggaccttggcatctcgtgcgaagcccctctgcctggagtcctgcctctgtgacacttgcttactgtgtgacctgggtcractcatacctactgttcgtcagttttctcatctgtaaaatggggattccagtggttattatgagaattaaatatgacgatacataaatagcacctggaaa

SEQ ID NO: 18247 - DNA, 201 bp, Homo sapiens
tcccaggttcaagtgattctcccgtctcagcctccagagtagctgggattacaggcacccaccatcacgcccagctaatttttgtatttttagtagagatgggtttcaccatgttggccaggctggtcttgaactcttgacctcaagtgatccacccgcctcggcctccgaaagcgttgggattacaggtgtgagtcagag

SEQ ID NO: 18248 - DNA, 201 bp, Homo sapiens
aattaacatttttatattagttccatgctgaaataatatttgagacatactaggttaaataaaatatcattgaagttcatttaatctgtttctttttacctttttttttttttgacacggctcctggaaaggttaacaatatgtaggtgaccctttattttcatcagacattgccgacctagagggtaaccactggagagg

SEQ ID NO: 18249 - DNA, 201 bp, Homo sapiens
atgtaagtgtagctccaatgtgagttgttacttgtagagaacagctatgtcaaaaccacaccaaaaacgatttggaaaggaaataatttgactggtcattktgtttatccatcaactgagttggattgatatatttttcctttggccttcaaaggaaatttgagcattcattcattcatccttttagagaaatattctcta

SEQ ID NO: 18250 - DNA, 201 bp, Homo sapiens
ggaacatgtgctctgtgtgctggaagctcctggaggccccagggttatctctgctcacttaggtttgtgatgttgggcaaaaggagaaaatgctgagtctrttcggacccaacttccattaatgcctgagaaataatttaaatcgcaagatttccaatcccataagcagccctagcctctcttctcctgatactccacata

SEQ ID NO: 18251 - DNA, 201 bp, Homo sapiens
gttgctgagaggtggggagggggtgggggctctgtgcatggaatggggggaaaagcttcagggaagggcagtgcaaattgtttctggactgatgccatctyttaataatagtagttaatagactgggtacaatggctgacgcccgtaatcccagcgctttgagaggccgaggccggtgtatcgcctgagtccaggagttag

SEQ ID NO: 18252 - DNA, 201 bp, Homo sapiens
aggtgtttcttatttttatcattttccgtaaaggtaggattgtgttgacagccctgtaataaatgtctcttggaagagatgtgttgctgagaggtggggarggggtgggggctctgtgcatggaatggggggaaaagcttcagggaagggcagtgcaaattgtttctggactgatgccatcttttaataatagtagttaat

SEQ ID NO: 18253 - DNA, 201 bp, Homo sapiens
tcttcttgtaaggtgtttcttatttttatcattttccgtaaaggtaggattgtgttgacagccctgtaataaatgtctcttggaagagatgtgttgctgaraggtggggagggggtgggggctctgtgcatggaatggggggaaaagcttcagggaagggcagtgcaaattgtttctggactgatgccatcttttaataat

SEQ ID NO: 18254 - DNA, 201 bp, Homo sapiens
ccatgcccaccttgctgttgcaccccccaccccaaggaaagccttcccacctttggaagctgcattaattcttccaggccacaagggggccgttgagttastggttcactgcactggctggcaggaaagagttttaatgcaggctccaaaggtgcttaatttcctgtggtccttatgaatatgcatacagtatgtgctcag

SEQ ID NO: 18255 - DNA, 201 bp, Homo sapiens
atagagttgtgtattgttgggaactaattatatgtattataaatccaagaattaatttaaatgacccagtttccacagagaaaaagccacattgtttttamatagctaactaaacaaaatgctaacccatatgggagaaatttccaaagaattaaaaccacccaccaggaaaatgggaaagtctcccctccacacacacac

SEQ ID NO: 18256 - DNA, 201 bp, Homo sapiens
acatcgcataaagatgcagatttgattccccctttactcacactataaaaacaaagtttttaaagtggttagccatacctggaaatgtaaatgcattcgcstaatgtaatgccaaagaaaaattaagacaaatgataccacatcgctgccacaaactgcggctcgtacaaaattcactttagttattatgctgtgaatacg

SEQ ID NO: 18257 - DNA, 201 bp, Homo sapiens
agaatacatacttcataagcaggaggcatatatgtttgtatatatgtatgtacatagacttcatacacatgaaataaaatttcaaatggttcctctgttcmgcaaacgtgacccaaagttttggcttatttggcgttttgttttcttgaagacatacttgaattttaaatagttaatccatttaagaagtttcatttaagg

SEQ ID NO: 18258 - DNA, 201 bp, Homo sapiens
gatgttaattgagatataggagtacttcattaagtctccagaatacatacttcataagcaggaggcatatatgtttgtatatatgtatgtacatagacttsatacacatgaaataaaatttcaaatggttcctctgttcagcaaacgtgacccaaagttttggcttatttggcgttttgttttcttgaagacatacttgaa

SEQ ID NO: 18259 - DNA, 201 bp, Homo sapiens
tattgtgaaataccatttgacccagcaatcccattactgggtatgtaaccaaaggaatagaaatgattgtattataaaggtacatgcacatgtatgttgaytgcagcagttttcacagtagaaaagacatggaattcacccaatccgaattttaacaagtcttccatgtgattctgagacagactcatgttcgtgtggttc

SEQ ID NO: 18260 - DNA, 201 bp, Homo sapiens
tttcaccatgtttgtcaggttagaccggaactcctgacctcaagtgatccacccacctcggcctcccaaagtgctgggattacaggaatgagccaccacgcccggctcaaatccttcttacttttcctcaagaactcacttcccacccaaacctttcctattgtggcagctgttatcttgtccagcacatgtgtccacact

SEQ ID NO: 18261 - DNA, 201 bp, Homo sapiens
cacccaatccgaattttaacaagtcttccatgtgattctgagacagactcatgttcgtgtggttctggctctgcagaactgaggtgggccccaaaacttgmgtttctaaaaggtactagctgagcatgatgactcacatttgtaatcccaccactttgtgaggccgaggcgggtggatcgcttgaggccaggagtttgaga

SEQ ID NO: 18262 - DNA, 201 bp, Homo sapiens
gaaggcctaggaggtgcagggatgtttatatgggctgctagcgcttagtttcctgccacagggagacagtaagaaaggtgacgtcaatctgagatgagagrgagagcaaaacagttcttttgaccaccttgaccccgaccttgaaataaggtggaactaataaatcccgctttgtgctggagcaagttttggctgagtttc

SEQ ID NO: 18263 - DNA, 201 bp, Homo sapiens
ttgaagattttgtgttcaagatttggaagagaatcttcttcccaagccagcattttatattttgcattaaaaaaaaccacaaaagacaaaaaaaaaaaaaacaaaaaaccttcacagacaaaacccagggcatattttaggtgtgtttaattcgaagctcctgatgtctagcaggaacctggaacttccctttctattttt

SEQ ID NO: 18264 - DNA, 201 bp, Homo sapiens
gccaccttttgccgcagtaacaaacaatcccagactctcaaggcttgcaaaaataaatgtgtgtttgtttgctcataacacatgtggctgagggttggccrtggctccacagtcacaggtgggctttcctgggctcagcttctcacagcgtctccttgcagggcccaggctgtaggagatgtcatcagggcctgcagaggg

SEQ ID NO: 18265 - DNA, 201 bp, Homo sapiens
caggactgaagagatgatattgattctcacttgatagaggttagaaagggcctctcccttccctagctgaatagagagggtttcctttttcttttcttttytttttttttttttaaatgggaaacttacagggaataagatctgtttcttcatttgctttgcaagagagttggatttgtacacgatgcctgagctggctcg

SEQ ID NO: 18266 - DNA, 201 bp, Homo sapiens
ttgctcagttacttttttcctgtttttttttcacttttgtcttcctgacttttttcttccatccctatttatgaaaacaaaaagataactaaattgaaacsttgacaatgtaatttgtcagaggaaggcagcctgttttataagctcaggtgatttcatttttgttcacctgtttatttcatgacacttgcaggaaaaaga

SEQ ID NO: 18267 - DNA, 201 bp, Homo sapiens
tttatgttgctattgtatcgtaaggttcttctgaagcgaccacttcataacactgtgtagtccaatccctaagctgggcaatttttttttcccctttcaawacatcacattgattttctgtatgactttatctgcttaatacaaagtgggattgaacagttatttgtctggatttgatcattccttattaaacatttatga

SEQ ID NO: 18268 - DNA, 201 bp, Homo sapiens
aggcaaacaaaagaagccacaacagtctaggaagaaatctttaatttctattcagctttaaagagtttgagagcgttttttcccctctgttaacaaacgasttcaagtacatgccttcatattataaaagtacctgaaattgcctagaatagcagcatgcatagcttgttagtatttacatatatttacatagggaaacaa

SEQ ID NO: 18269 - DNA, 201 bp, Homo sapiens
gctctctgagccaataaaagaagctatattcagcactggctgtataagatctttaatgttttaggctgtcaatgttggctgtggttaggctgacataattrtgagctgcatgtaccaatatatagctctttacccacaaaagcatgctgcaacggggaatctttcagagataataaaaggattcatcaagtgtctatacga

SEQ ID NO: 18270 - DNA, 201 bp, Homo sapiens
agcctctgacttgcaaggtgtgcttcagaaatttgcagcttctatttaggtaggaagagtttgccagcccgaaaactccagtaagcaaacagctttatagyaccccagccatagaaagtgagagctttcgaagaatctgtggttagaactaagaggatttttctttctcctttttctgctgttattatctcaaggagagag

SEQ ID NO: 18271 - DNA, 201 bp, Homo sapiens
aaagatagtgtgcatgcctcatctctaaggggcagccattattgacgtccagctgaatgttgccacgtggaaattagctataaacttgccagaacctccartttttctggagagattagattagaaattcatatatttttaaatattaaatcatccctttttcttgagatggtgtcacgtcgttgcccaggccaccgttta

SEQ ID NO: 18272 - DNA, 201 bp, Homo sapiens
gctaaatctatgtccccaatatagggaagacaggagaaagtgccaaagatagtgtgcatgcctcatctctaaggggcagccattattgacgtccagctgartgttgccacgtggaaattagctataaacttgccagaacctccagtttttctggagagattagattagaaattcatatatttttaaatattaaatcatccc

SEQ ID NO: 18273 - DNA, 201 bp, Homo sapiens
gccctgttaataattcataattatatagcatagcatagggcagtttcagatgcttcaactaccaggtaggtagaataaaggaatgaagttgctgtgtatasgatgataaatggtgctaaatctatgtccccaatatagggaagacaggagaaagtgccaaagatagtgtgcatgcctcatctctaaggggcagccattatt

SEQ ID NO: 18274 - DNA, 201 bp, Homo sapiens
cctttcccaaaccatagattcatggaactgtcaaagagcagcactgaactttgtactcaatgccttaatttttccagttgaggataattcacactaaacawgggatttcacctctctgactcatgcatcaggaacttggagataaagccctgttaataattcataattatatagcatagcatagggcagtttcagatgctt

SEQ ID NO: 18275 - DNA, 201 bp, Homo sapiens
ttggccattgcccactaagaaaatttaggtggtttttattgggattagtggatgaacttaggattagtgtggcccttccttgagatataatgacaaccttsgtgaaagcaagaccacagggcctatcttcagggaagtgccttgcattttaataccaaccatgccacgtgtatgtgtttcctgggcctgccataacaaatt

SEQ ID NO: 18276 - DNA, 201 bp, Homo sapiens
ttcgtcctgaaatcctccctgctcacaaaacagccagctacttggttttctaaaagacgtaattttgcaggcagacttcgtagagccattctgtgcagaasaagggaagggagaagctgtttgttttacctgtagtatgaagatattctttgcgctgttagaactgagctcattaattctgcctggcaataatttcaaagg

SEQ ID NO: 18277 - DNA, 201 bp, Homo sapiens
tattaaataaaatgaacactggggtatttcgctccaagtttggtgttcattatttatctctaaattatgatattcatagaacaactccttgctttttcacsaagaatctagaatctagaattatctgagcgttcgcatcagataactaggaagaaatcagagtcattttctctctaaggcaggctcgatgatacctgcaca

SEQ ID NO: 18278 - DNA, 201 bp, Homo sapiens
tttttcttttttttttttttttttttgagatggagtcttgttcttatgccgaggctggagtgaagtggcaccatctctgctcactacaacatctgcccccygggttcaagcgattctcctgcctcagcctctcgagtagctgggattctgggtgccccccgcaaccatgtcccacgaatttttgtattgttagtagagttg

SEQ ID NO: 18279 - DNA, 201 bp, Homo sapiens
ggaaaatgtgatatgacagactggaaccagcacagggacgcagcccctcacctgctgggggtctttgggtgggtcctgtagccccagagcctctcgatgasctatgaacaggaacagaaccagcaccccgagtggtgacagtgacaaaagggtcctcagtaacagcagtctgctattgttttgaatcattcaaaggaattt

SEQ ID NO: 18280 - DNA, 201 bp, Homo sapiens
caatttcctcatgatactggaaggcagtctccggtcagcacggggctgggtctagagttttcagttcacaaaagtggaaaatgtgatatgacagactggawccagcacagggacgcagcccctcacctgctgggggtctttgggtgggtcctgtagccccagagcctctcgatgacctatgaacaggaacagaaccagcac

SEQ ID NO: 18281 - DNA, 201 bp, Homo sapiens
gcgctgttagaactgagctcattaattctgcctggcaataatttcaaaggtttattttggtgtagatggcgaatacagatgcatacatttatacgcagtayacgagctagctataaccataacagaggttaaagaagtagagtaaaaatgtaaaatgtttcaaataaacacacactaaatatcttcttttatatcttataa

SEQ ID NO: 18282 - DNA, 201 bp, Homo sapiens
ggggtcagggggagggtgcacctgtccgccaccccaatttcctcatgatactggaaggcagtctccggtcagcacggggctgggtctagagttttcagttyacaaaagtggaaaatgtgatatgacagactggaaccagcacagggacgcagcccctcacctgctgggggtctttgggtgggtcctgtagccccagagcct

SEQ ID NO: 18283 - DNA, 201 bp, Homo sapiens
tgaggctaaaataagctgcttttagtatcacatttggcaagtagtaaactctggataaatatacttttgaattgtgtgattattgttgttaccatttattraaagggaatgatgaatgtagtgagagaaggaaggaagagagagagggaagaaggggaaaaagagggatggaaaggaggaaggaaggaaaggagggaggag

SEQ ID NO: 18284 - DNA, 201 bp, Homo sapiens
acctacagaaaaaaatgccaagaatgcacgctgggaattcattaagagatttcaggacgttgaaatactgtgtgtacttgcaatccccacttgaccaaagstgtccaaacctcgacagacagcggccagagaaggccccatcatagactctgcgcctggctaattactcaggagcaaagcaggtcgttaggggtcaggggg

SEQ ID NO: 18285 - DNA, 201 bp, Homo sapiens
gtcagtagcaggccaccaagagccatcccacctcagaaagacagaagccatcactgcaaatggcaagggcatgaggcagtttgaaactggcaaaactggasctttcatggaatccagggcttgagctttaatgctttacacttttgttttttcattccatacgcttttgctttagcttcctggcaaaattcagacaaacct

SEQ ID NO: 18286 - DNA, 201 bp, Homo sapiens
acagttgatctaactgattcatggggaccctgggagtatgtttgtgtatttgggggttgggatgggggggtgggtggagggtcagagaggtggcaaaagcrggtgggaacagggttacagagcaaagtaattagatgccctttagatgctcttagttaaagaccatgcaaaaaggatgaaatcttttgatcatgttcttca

SEQ ID NO: 18287 - DNA, 201 bp, Homo sapiens
ttggagacctacagaaaaaaatgccaagaatgcacgctgggaattcattaagagatttcaggacgttgaaatactgtgtgtacttgcaatccccacttgascaaaggtgtccaaacctcgacagacagcggccagagaaggccccatcatagactctgcgcctggctaattactcaggagcaaagcaggtcgttaggggtc

SEQ ID NO: 18288 - DNA, 201 bp, Homo sapiens
gccttgctgaggaaattaaattcctgttcgagtgctatttctttatggcactgaggagcaagcatttctaacaatcatattgcttaagaagtggatggcargaagataattactaatatgtctgcaattgatctgaaattgacacagttgatctaactgattcatggggaccctgggagtatgtttgtgtatttgggggtt

SEQ ID NO: 18289 - DNA, 201 bp, Homo sapiens
tgagtccttttcagagagtcatttggagacctacagaaaaaaatgccaagaatgcacgctgggaattcattaagagatttcaggacgttgaaatactgtgygtacttgcaatccccacttgaccaaaggtgtccaaacctcgacagacagcggccagagaaggccccatcatagactctgcgcctggctaattactcagga

SEQ ID NO: 18290 - DNA, 201 bp, Homo sapiens
tgtgctgacaactataaattgatggctagcagttatcaaatgaatgttgatgaaaagcagctacttaacattttcatcccaacaccgagttttggaaggayggataatttagatctgagggcctcaactataaataaacagcaactgctttctaaatcccacctttctgtagttgaagattgtgctgcaaatctgacagat

SEQ ID NO: 18291 - DNA, 201 bp, Homo sapiens
atcaaagttgaaagaattttacagcgaaccaccattaacattttgctataatggctttatcatatatccattcatccgtctatcatatttgtaaaacaaayaatattttaatgccaaacatatacaaaggatagatcagtaatttccgagaaatattagttgacaacttgacatcaaattatgtacggttaagtattgata

SEQ ID NO: 18292 - DNA, 201 bp, Homo sapiens
aagggaggctgggaaatatagtttgctgtgtgctgggtgggtgggagggagcgtccacattagtgaacagccaggcagtcgctgcctcaaatttctttagkgttatcctttcattccagcaattgaatttgatttgcactgtttcacttctctacaagggtgtaaaaagtagaggttcctcttgaaagaatttcctcccca

SEQ ID NO: 18293 - DNA, 201 bp, Homo sapiens
caacttctacatatatctagaaatatgattgagttttgtgtgttgatcttgatcctatgagcttgctgattgcatttattataaagttccaggagttttttatttttgtttgtatttgttagtttttttgagatttcttgggattttctatctagcctgtcatgtcatatgcaaatagagaattttatttcttcctttata

SEQ ID NO: 18294 - DNA, 201 bp, Homo sapiens
tggccattgcccactaagaaaatttaggtggtttttattgggattagtggatgaacttaggattagtgtggcccttccttgagatataatgacaaccttgstgaaagcaagaccacagggcctatcttcagggaagtgccttgcattttaataccaaccatgccacgtgtatgtgtttcctgggcctgccataacaaatta

SEQ ID NO: 18295 - DNA, 201 bp, Homo sapiens
ccttggcttggaaacaccacattctaatctctacttcctcccttacatcaccttctcctctggctttgtgtcctttctgtctcttacaaggacaccagtcrttggacttaggacccacctaattgagtatgatctcatctcattccttatcttaattacatttgcaaagaccctgtttccaaataaagtcacattcgttgg

SEQ ID NO: 18296 - DNA, 201 bp, Homo sapiens
ttttagtcagggtacataagtgtcagctgctacgacaaacaacttgcaacgtctcattatcttcatacaacaaacgctgatttgttcctttcattacatayccagtgtgagttggctggaaggtccaccctacacaaccactcgtgaaggcagacttgaaggggactccactgtcttggagctacactctaaaacaaatag

SEQ ID NO: 18297 - DNA, 201 bp, Homo sapiens
ttatgagggaggctgagatgtgagaagcacatgggtgttgggagagcactaaaggtctctagcccagaagcatgacttccagccaagtgagacagggaagsccagaaaaatgtgtcacagaacttatggcatcagaatctgattcccaggcatgctttccaccatatgcatagacatttgcaccccagggatagcaccatt

SEQ ID NO: 18298 - DNA, 201 bp, Homo sapiens
ttgtacaattatttgagtatactaaaacagctgtacagtatacataggtagattttatggtatgtgcattatatttcagtaaagttctttaataaattagytaatgcttattgtagaaaagttggaaaataccaaaaaccataaacaggaaataggaaaaaaagtaatcctgactgtatatctggaaatcttttcgtgggg

SEQ ID NO: 18299 - DNA, 201 bp, Homo sapiens
ttctaggcacattaaacggtcagtgcacaggtcctcatttttctcatgcttccatttccatattctcaatcaatcactgatggccagctgtcaacaggcaycatttttggtgggacctgaagatgtatatcccttgttttcagattcctcgcctctcatcatgtaaggtgatgctctgagctgggtcttaaagcttctggg

SEQ ID NO: 18300 - DNA, 201 bp, Homo sapiens
gtacactgatggtgttttgggaataagagtgtaggtagatagagggtggctagtgattgctaatttttttttttttttttgagttaaaaaagtgctataawattagaatgtagttatggttgtacaattatttgagtatactaaaacagctgtacagtatacataggtagattttatggtatgtgcattatatttcagtaa

SEQ ID NO: 18301 - DNA, 201 bp, Homo sapiens
atatgcacccggctagggacctctttaatggtcattcatttgggagatgacctttggttcctaaactggtggacataccaaggactaaaggagtgacttgytctcagttctttgtcattcagctgctttaatattaatatgacacccgttttgggcttgaaaagttttccttctgctgagaaatgatgatggtgacaatga

SEQ ID NO: 18302 - DNA, 201 bp, Homo sapiens
taaaatgtccggaataggcgaatctataggacagaaagtacactgatggtgttttgggaataagagtgtaggtagatagagggtggctagtgattgctaagttttttttttttttttgagttaaaaaagtgctataaaattagaatgtagttatggttgtacaattatttgagtatactaaaacagctgtacagtatacat

SEQ ID NO: 18303 - DNA, 201 bp, Homo sapiens
acgtattgtatggttccatttagtatataaaatgtccggaataggcgaatctataggacagaaagtacactgatggtgttttgggaataagagtgtaggtrgatagagggtggctagtgattgctaatttttttttttttttttgagttaaaaaagtgctataaaattagaatgtagttatggttgtacaattatttgagt

SEQ ID NO: 18304 - DNA, 201 bp, Homo sapiens
ctgttcctgaggcccccactgggaacccttagctggagaacacccgtttcattatggaacatggagaaaagggtgattgtcagctccaatttattccatamtatctgattcaatctgtagtttgactttgctaaaggaattaatttttaagatcttaacaaatccagtaacatttaaaatgacctatccagtccatgcata

SEQ ID NO: 18305 - DNA, 201 bp, Homo sapiens
gaaaacagtttggccattattcaaaaagttaaacattgaattaccatatgacccaataatcccactcctagatgtatcttgaagagaaatgaaaacatgcrtttccatagcatcttacaaatgaatgtacatagtagtgatattcctaatagccaataaatggaaacaatccaaatatccatcattggtgaatggataaac

SEQ ID NO: 18306 - DNA, 201 bp, Homo sapiens
gggaaatacttacaaattaaatattaaataagggatttgtatctagaataaagaacttttacaattcaataatgaaaactcatttaaaaaatgagcataaratctaaatagatattcctccaaatatgatacacaaattgccaatgaatacataaaagatgttcaatctcattagggaaatgcaaatgaaagccacaatga

SEQ ID NO: 18307 - DNA, 201 bp, Homo sapiens
ctttctctgttaccttcggaggaagccttctctagataccatctttaaaacagcaatcttccttctccatccccagcagcacctctgacccccttcacctsctttatttttctccatattatcattgccatcaatccaagcacaatttccagttacttacccattttgctttctccccgctctttgagaatgctggctcca

SEQ ID NO: 18308 - DNA, 201 bp, Homo sapiens
aagtccctttgaggtgatttctggtccacaaattgaggcaaaataatcctcacaatttcttggatattctctgccccagccccgttctattgcaaaggagscttctctaaaaggcttcccaatgccttagaatctacttaagggtatttttgctggagaaagagctgctgtctttgtccacctgtcgttttcctttctacc

SEQ ID NO: 18309 - DNA, 201 bp, Homo sapiens
agttaaacttgttcctcttctccaatcattgatacttttctctcttgcttcccctccccctgcccttcgacacagagtgacaggcctgaagtaaaaagggwaaaggggaaccgagtgactcagcccagagtgggcctcaccgcagcttcctggccactttctcgctctctccttccaagagagaaaggggaggaagcccag

SEQ ID NO: 18310 - DNA, 201 bp, Homo sapiens
ggtatttcctggcaacctttggtgtttggggcatgttgtcacctcattgccatctctgcctctgtcttctcaccaccatcttccttgtccatgtctctctrtgtcttcaatgttcttcttataaggacaccagtccttggatttagagtccaccctaattcactgtaatcacatcttacctaagtccatctgcaaagaccc

SEQ ID NO: 18311 - DNA, 201 bp, Homo sapiens; identical to SEQ ID NO: 3291

SEQ ID NO: 18312 - DNA, 201 bp, Homo sapiens
aaacaaaacaaatgtcacggtgtggttgggaggaggtggggagagaggcagattttggaggcgaaagatacacagaaacactaaatacctgtctattaatrctgacagtagttgcgtttaggggatgagactctaaatttgtttatttaaattttctcattttaaaaaatgagtcctttcaattatgagatcaaaaagaaa

SEQ ID NO: 18313 - DNA, 201 bp, Homo sapiens
acagagacagatgtatgtacctttcatggacataatttccccaagactgaacacaaaaatgagggtttttggagatctctctggaattaatgtaaacgttrttgaaaacatattattctatggctccttcataaaccctaggccatcccgaggctgtctcactcaggcccctcagccctcataaccccccagctccatagg

SEQ ID NO: 18314 - DNA, 201 bp, Homo sapiens
tcattacatgtgtgtttagcccaccgattattaaggctttaacaatattaaaacctaaagagataacagaggggaagcctttgggagctaggaatcaatcrtgctgggtggcttgaaaacagggcagtaaaatggcagccgcctagcctgtggtctttaatattaataaagccagaggcgatatcacttagttgttccaac

SEQ ID NO: 18315 - DNA, 201 bp, Homo sapiens; identical to SEQ ID NO: 3295

SEQ ID NO: 18316 - DNA, 201 bp, Homo sapiens
ttggtgtctaaagccatgctcagtatatagttatatatttcattcattcatccgttcattcagttatctcacgtttctggagggccctctatgtgcaatasctagtgatacagcagtgaacaaaggaaatccctgccctcagggagctttcattctacttggggaaagagacgtgaaagaaatcaagacatgcaagcaagg

SEQ ID NO: 18317 - DNA, 201 bp, Homo sapiens
gagctattttggaaattctgcacctcaatttctaaaaagttggaaggacaggaaaggggagctgtgtttgagatctcagaaatctgcaccccaccttgctrtccaccactggtattccgtcagtcttactaccccctcccacctctagcccaccctctaccatcctcaccaggaaggaggctgcattcatttcaagaactg

SEQ ID NO: 18318 - DNA, 201 bp, Homo sapiens
gtgtgtgtggaaaaaaggggctttaatcaagctataaatatctgtttctttgaagttttatgaccaacaattaatgttactggaaggcccataaaaagggytgtttcttgacttggtgggtctgagtgggccagggtcgggttaagatgctagcctcgtggggtgccatcctgacagattctactgtgtgcgtgtgtgtgt

SEQ ID NO: 18319 - DNA, 201 bp, Homo sapiens
actggtgtggccgaaggagtgccgtgactcctctgccacctctccacatttggaagattgttttgcagctgcaacctcaaaacagaagcctcctaattacsaggtagctttctagagccaaacaaatgctgttgtttctgacaggtaaatcaagacagggaaatgatgacacattcaccacaactgaagtgttgatggggt

SEQ ID NO: 18320 - DNA, 201 bp, Homo sapiens
ggtgatgtttgaacttaagaatcaaaaacagtgcaagcgctgcatgggggagaacagtctaggcaaggtgaacggaagtgcagggtccctgaggcagaaargagctcagcctctttgttagctagaacaagaaaggggcccgtatggctagcataggatgggataggggatcgtggtggataccagctaggatttcactgt

SEQ ID NO: 18321 - DNA, 201 bp, Homo sapiens
aaactggtccttgtggaagcaacttcgggggaggaggaaagacagggaagaccattttaaggaggtgatgtttgaacttaagaatcaaaaacagtgcaagygctgcatgggggagaacagtctaggcaaggtgaacggaagtgcagggtccctgaggcagaaaggagctcagcctctttgttagctagaacaagaaagggg

SEQ ID NO: 18322 - DNA, 201 bp, Homo sapiens
aaggcctctgacttaacaggacttccgtgatgcgggggaagaagacaataggcaagtaagcaagtaaatatacaagataaatagaaactgtgatgagggarttaaagaaattaaactggtccttgtggaagcaacttcgggggaggaggaaagacagggaagaccattttaaggaggtgatgtttgaacttaagaatcaaa

SEQ ID NO: 18323 - DNA, 201 bp, Homo sapiens
tcatgtcatcctttggatgtcttgcagagctgagtgctgaaataaaatgataaacaagtcaaaaacaaaaaggcctctgacttaacaggacttccgtgatkcgggggaagaagacaataggcaagtaagcaagtaaatatacaagataaatagaaactgtgatgagggagttaaagaaattaaactggtccttgtggaagc

SEQ ID NO: 18324 - DNA, 201 bp, Homo sapiens
ttctcttctccttccaagaaaaaacacccataccattcttaacatctctggaagctgggggtcaggagagggagatccataaagttcttgtcttccccgaytcaagaagcttaagggtacattcactcactcatgaattgactggtttattcattcactggttgattaattcattcattcactggttaattaattaattca

SEQ ID NO: 18325 - DNA, 201 bp, Homo sapiens
tcccctcctctccagccctcacctggttttctcttctccttccaagaaaaaacacccataccattcttaacatctctggaagctgggggtcaggagagggrgatccataaagttcttgtcttccccgactcaagaagcttaagggtacattcactcactcatgaattgactggtttattcattcactggttgattaattca

SEQ ID NO: 18326 - DNA, 201 bp, Homo sapiens
tggtgtggccatggttctcgtacttcaggtccctgtgagcccctggggtcctacacaacttggggtaatgctatggtcacctgcatcccctcctctccagycctcacctggttttctcttctccttccaagaaaaaacacccataccattcttaacatctctggaagctgggggtcaggagagggagatccataaagttct

SEQ ID NO: 18327 - DNA, 201 bp, Homo sapiens
tgcatagacatttgcaccccagggatagcaccattactcccaaaaattgcaggtttgaaagggtacctaaaaacaagccaccagattgtcccattccactrtcattctgccatcaacaccgaggtgtcggagtagcaggagagccacatatttcttagtgaggggacccagaatgatcccttttgtgctagaggatctgag

SEQ ID NO: 18328 - DNA, 201 bp, Homo sapiens
gggaaggagaagggcctttgggactgggtggatgtaacactttctgccacctctactcttcctgctatagattaaaacagaagctctgaattgcagccacwaatcaataatgaaaagctaccagaccaagccctttcttgtttagtgttgtgtcttctgtgtcaacatctctggaacatagtcaatggcagtacccagtag

SEQ ID NO: 18329 - DNA, 201 bp, Homo sapiens
tcatttcaagtcttcctacctttgctctgagttgtcccacctttccagaccgaacgagtgttcatcttgcatatgttgattgatgtctcatgtctccctagaatgtgtacaaccaaactgtgctctgaccactttgggcatgtgtcatcaggccctcctgaggctgtgtcacaggtgcacatcctcaaccttggcaaaata

SEQ ID NO: 18330 - DNA, 201 bp, Homo sapiens
ctggaagccccctcctcatttcaagtcttcctacctttgctctgagttgtcccacctttccagaccgaacgagtgttcatcttgcatatgttgattgatgkctcatgtctccctagaatgtgtacaaccaaactgtgctctgaccactttgggcatgtgtcatcaggccctcctgaggctgtgtcacaggtgcacatcctc

SEQ ID NO: 18331 - DNA, 201 bp, Homo sapiens
atgaaagccagccgggcacagtggctcacgcctgtaatcctagcactttgggaggccgaggcaggcagatcacttgaggtcaggagttcgagaccagcctrgccaacatggtgaaaccctatctctactaaaaataacaaaattagctgggtatggtggtgtgcgcctgtaattccagctacttgggaggctgaggcatga

SEQ ID NO: 18332 - DNA, 201 bp, Homo sapiens
gcctgggaataggatggcaggtcgtgggaccagcattttaattacctaaagggaacttattgattttagtccagaacacggtggggaggagttcatattcwttttttttttgagtctggattttagaataaattcactgtgtacatagctattccatctttaaaaacctttgtgaatgctaatatacagcctttataaatt

SEQ ID NO: 18333 - DNA, 201 bp, Homo sapiens
cctaaccaggatgtgagagacattcttgtcctaggcagcacgttggtggcagaggtgggatctagactgaggctctcattctgtaccctctctggccccarggaaggaaaggggaaggagaagggcctttgggactgggtggatgtaacactttctgccacctctactcttcctgctatagattaaaacagaagctctgaa

SEQ ID NO: 18334 - DNA, 201 bp, Homo sapiens
tcacaagtctatgaatagagtatattacccacttcattttaagtaggaaattgaagctcagggaatcgtagcagagggccccagttcacactgctgatcartgatgcgactgggatcaccacagcccatctggttcagaagcttgttctcctaaccaggatgtgagagacattcttgtcctaggcagcacgttggtggcag

SEQ ID NO: 18335 - DNA, 201 bp, Homo sapiens
cccaaaaattgcaggtttgaaagggtacctaaaaacaagccaccagattgtcccattccactatcattctgccatcaacaccgaggtgtcggagtagcagkagagccacatatttcttagtgaggggacccagaatgatcccttttgtgctagaggatctgagttcatttcatgaaactgaagcatcttcttggagatata

SEQ ID NO: 18336 - DNA, 201 bp, Homo sapiens
tcccaggctggagtgcagtggcatgatcttggctcagtacaacatctgcctccctggctcaagggatcctcccatctcagcctcctgagtagctgggactrcaggtgcatgccaccacacctggctaacttttatttatttttagtagagaggcagttttgctgtgttgcccagactggtcttgaactcttgagctcaaga

SEQ ID NO: 18337 - DNA, 201 bp, Homo sapiens
gcaggagagccacatatttcttagtgaggggacccagaatgatcccttttgtgctagaggatctgagttcatttcatgaaactgaagcatcttcttggagmtataagctcaccttgggataggcccttgcagatgacaataaaggtattttggcacataaaaaaactgctcagcacaccttgtatttgtatttcctttgac

SEQ ID NO: 18338 - DNA, 201 bp, Homo sapiens
aataaaaccaatgagcttaatctacttgtggaatgttatagccggaagggattcatagagatcactctatcgcctaaaattctctcttctacatatctcastgttggaaaacataaatgtgactccaacttgtcttttttgttgtttgtttttgagacagggtctttgtttcccaggctggagtgcagtggcatgatcttg

SEQ ID NO: 18339 - DNA, 201 bp, Homo sapiens
ttagtgaggggacccagaatgatcccttttgtgctagaggatctgagttcatttcatgaaactgaagcatcttcttggagatataagctcaccttgggatrggcccttgcagatgacaataaaggtattttggcacataaaaaaactgctcagcacaccttgtatttgtatttcctttgacgtgaaccatggccatccagt

SEQ ID NO: 18340 - DNA, 201 bp, Homo sapiens
tccatctatttcaggggatgaccagtctgaataaaaccaatgagcttaatctacttgtggaatgttatagccggaagggattcatagagatcactctatcrcctaaaattctctcttctacatatctcactgttggaaaacataaatgtgactccaacttgtcttttttgttgtttgtttttgagacagggtctttgtttc

SEQ ID NO: 18341 - DNA, 201 bp, Homo sapiens
tgtgaaatgggaacatgacttaccatctactcacctcctgtttgagttcaagggaaggtttgcagattggcctgaaggaagacttctcttgaaaaactcawaccaaagagcacaccgccgtccccaaccctgagccatttctgtccttttcatggaaagggaactgtgttcgccagctcgtaaagccccggcgtctcctcc

SEQ ID NO: 18342 - DNA, 201 bp, Homo sapiens
agttttctcatctgtaaaatggagatcgcagtatctaactcatgggtgtgtttaaggattcagtgatggagaaaatagctgaaaagtgaccgtatgaaatragcagcagttgtcaagtacttggcatagttcctgtcacataggaagcatccagtaagtagtggtatctgttgtgattatgatcatattttatttcatgga

SEQ ID NO: 18343 - DNA, 201 bp, Homo sapiens
ccgcagctcctgtagtagttatggtcactgactccgggttcagacggacttggggttcagtcctagctctggcgcttaccagttttctcaagtgactttgrgcatctttactcaaggctcttggtctcagttttctcatctgtaaaatggagatcgcagtatctaactcatgggtgtgtttaaggattcagtgatggagaa

SEQ ID NO: 18344 - DNA, 201 bp, Homo sapiens
gccacgcaacattcccactgccatgttggcttgtttttcttttgttttcttgtcaacataagcctcatgagacaacagcaggatgcaagattgtacaatgrcaccatgactctgctttctgggtgtcctctgtgggctctcagcagtgtccccgatgtggagggtcttcttattctgtgtgtgtgccctctgctgttgaaa

SEQ ID NO: 18345 - DNA, 201 bp, Homo sapiens
ccaaggaaatgaccagcacgtggctcactccctgtctgtccagtagaggacaccaaggcacgatgaccgcagctcctgtagtagttatggtcactgactcygggttcagacggacttggggttcagtcctagctctggcgcttaccagttttctcaagtgactttgagcatctttactcaaggctcttggtctcagttttc

SEQ ID NO: 18346 - DNA, 201 bp, Homo sapiens
gttgattctcttcaaaaacttggcagtagcccttggatcccattaattgcattcaacagtcatgtattttattaatttttgttcctaaagaaaaaaaaaaatccagattgcttagaaaataaatgtgactcacgcagagcagaatccgaattttctaagtgatgaacatgttaacatattattttaatctaaagacatcct

SEQ ID NO: 18347 - DNA, 201 bp, Homo sapiens
ggtggaggttgcagtgagctgagatcacaccactgcactccagcctgggtgacagagcaagactgtctcaaaaaaaaaaaaaaaaaaaaaaaaattcaacwtacgaattttgcgaggacgcaaacatttaatccgtagtactgatgtggatatgatttgagctaagactctgctgttgattctcttcaaaaacttggcagt

SEQ ID NO: 18348 - DNA, 201 bp, Homo sapiens
atttcacagtgtttctagctcccctttccaatacatctctctctctctttctctctctctctctctctctctcacacacacaacacacacacacacacaccgccaaatcagacaccaacataaactgtagagttaacattctttttccaccctcacactttttttagctccgatctgtgttcaatttctgcctgagagagt

SEQ ID NO: 18349 - DNA, 201 bp, Homo sapiens
aaccacacttacatttaaatacaggcctttcccatttcacagtgtttctagctcccctttccaatacatctctctctctctttctctctctctctctctcwctctcacacacacaacacacacacacacacacagccaaatcagacaccaacataaactgtagagttaacattctttttccaccctcacactttttttagc

SEQ ID NO: 18350 - DNA, 201 bp, Homo sapiens
aaaaccacacttacatttaaatacaggcctttcccatttcacagtgtttctagctcccctttccaatacatctctctctctctttctctctctctctctcwctctctcacacacacaacacacacacacacacacagccaaatcagacaccaacataaactgtagagttaacattctttttccaccctcacacttttttta

SEQ ID NO: 18351 - DNA, 201 bp, Homo sapiens
ttgaaattttttatactatgttctattgggaaccatttcagggttttgagatatagtatgatataataacagctatgctaaattctttgaagttattggtrgtggaatatcaatccagaatgaaaataaataattttggaaatgagcctgtcattgaaatatactttatttctcgttaaatgtcccagcaaaagtattttg

SEQ ID NO: 18352 - DNA, 201 bp, Homo sapiens
ctttattattttaatggagtgcaaggtgcagtctttttgaagatgtagaatgtggccttataaaagctaagtgctactttatatttctgctgtccttgccsgtggcctgcactggggagttgtatattgtatcagtaattttaaaagccagcaagtgttctaccagctgaagaagttttcctaatggtggctggtcaaacg

SEQ ID NO: 18353 - DNA, 201 bp, Homo sapiens
tgaactgaagtgctaatgtgaaatgttcatgatggtacccgagtacttgcggtggtacctagcgtgtgctttccaagtgctggcaaagaaaagaaaagaawtgcttggggctctgcctacctgtctaggctcctgtctggccattctctttcttgttccaaccatatcaaactcactgctgttgctaaaccttcctgtctc

SEQ ID NO: 18354 - DNA, 201 bp, Homo sapiens
ttaatatcctcaaattaaaacatacgtttttaaagaaagattttgcagacttttaagctgggcaactgtctgccttacaagatgcgtctggaaaccccagygccatcctccttttttagtcttgtatatttatgtatccccggccagagttggctggggcacagtctaacagtgtcaccgtgtaagctgacccagtgacct

SEQ ID NO: 18355 - DNA, 201 bp, Homo sapiens
ggaatttattttaaattacagctttttctattggaagcattcatttatgttggattattgttccctgagtgaaatttcactgatgctgtataattaaatayagatttttttagagatagtatatattttagatgtataagtggataaactggaggtatggaaggtctttatttaaggagaataaatagcccaccccatcaa

SEQ ID NO: 18356 - DNA, 201 bp, Homo sapiens
ggctgggcacggtggctcactcctgtaatcccagcactttgggaggccaaggcagatgggtcacctgaggtctggagttccagaccagcctgaccaatatwgtgaaaccccatctctactaaaaatacaaaaagttagccgggcgtggtagcacacacctgtaatcccagcaactcgggaggctgagacaggagaattgct

SEQ ID NO: 18357 - DNA, 201 bp, Homo sapiens
tgactttaagccttaatgaaactaaggccggagcgggtggcacactccgtggctgggatccacagtgaaatctacgctgggagaggaggaatttagggtgrtaatttggttctttgctattgacgaaattttctaattgactggggttacttaataccagataatatttttttcttgctataaagagagtaaatttgtttt

SEQ ID NO: 18358 - DNA, 201 bp, Homo sapiens
agggtcattcatgttgtagcatgtatcagtacttctttttttagggctgagtaatattccatttacggatatgccacatttcatctatgcattcagttcayggacatgtgggttgtttccacattttggctattgtgcataatgcttccaggtacacttgtctacacatttttgtgtggatataggttttccttttttggg

SEQ ID NO: 18359 - DNA, 201 bp, Homo sapiens
ccactgccatgttggcttgtttttcttttgttttcttgtcaacataagcctcatgagacaacagcaggatgcaagattgtacaatgacaccatgactctgytttctgggtgtcctctgtgggctctcagcagtgtccccgatgtggagggtcttcttattctgtgtgtgtgccctctgctgttgaaagttgcctgtcaccc

SEQ ID NO: 18360 - DNA, 201 bp, Homo sapiens
ttttctagaaggtggtattttgcatattaatacttgcttaaatcaagaagctaagactttgtattatattttgctttacgtgccttgattaaggtcatgaycctgacattccagtcccaaaggagaccaaggaaatgaccagcacgtggctcactccctgtctgtccagtagaggacaccaaggcacgatgaccgcagctc

SEQ ID NO: 18361 - DNA, 201 bp, Homo sapiens
caacagcaggatgcaagattgtacaatgacaccatgactctgctttctgggtgtcctctgtgggctctcagcagtgtccccgatgtggagggtcttcttaytctgtgtgtgtgccctctgctgttgaaagttgcctgtcacccatgatgctgtgctgattgagcaaactaatccataacccaccgccacgttcctcgccta

SEQ ID NO: 18362 - DNA, 201 bp, Homo sapiens
tcttctttagaagtcatcaatggtaagcctagggcagcctgaaccacttgtgttagaaatattttttataaagcaggacatgtgctttgaaatttgattcstccgtcactggctgtgtgaccttaaagaaataaattgacctgcctgagcctctcggaaatattggctggccagtagcatcctcacagagtttttctggga

SEQ ID NO: 18363 - DNA, 201 bp, Homo sapiens
atgctaaggtaggagaatcgcttgaacccaggaggtggaagttgtagtgagccaagatcgcatcactgcactccagcctgggtgacagagtgagactccakctgaaaaaaaaaaaaaaaaaaagacatttacattttatctttactgtagctatggctgcctatcccaaggatgggaagtctgaagttcaaactggtgatg

SEQ ID NO: 18364 - DNA, 201 bp, Homo sapiens
ctgtacaaaaaatataaaaatgagctgggtgtggtggcacatacctgtagttccaactgctcagaatgctaaggtaggagaatcgcttgaacccaggaggyggaagttgtagtgagccaagatcgcatcactgcactccagcctgggtgacagagtgagactccatctgaaaaaaaaaaaaaaaaaaagacatttacattt

SEQ ID NO: 18365 - DNA, 201 bp, Homo sapiens
ggtggctcacgcctgtaatcccagcactttgggaggccggggcaggcagatcatgaggtcaagagatcaagagcatcccggccagcatggtgaaaccctgyctgtacaaaaaatataaaaatgagctgggtgtggtggcacatacctgtagttccaactgctcagaatgctaaggtaggagaatcgcttgaacccaggagg

SEQ ID NO: 18366 - DNA, 201 bp, Homo sapiens
ctaaaaaggtaatcattttataagtacctattatgtgccagatactaggataggcactttgcatagaaactcacatttcgactgggcctggtggctcacgyctgtaatcccagcactttgggaggccggggcaggcagatcatgaggtcaagagatcaagagcatcccggccagcatggtgaaaccctgtctgtacaaaaa

SEQ ID NO: 18367 - DNA, 201 bp, Homo sapiens
ccaaaccataccactcatggcatctcgtttttacagagtatatgtgttttcagattttgcatgacattttaggataaatgtgatgaaaatgaggaaaattrggaatgaagtttaggtcagaaaagtttcagtgattattttttcagaatcattgtttcttggtttctagggtccaacatgccattgttcaatggctgtatt

SEQ ID NO: 18368 - DNA, 201 bp, Homo sapiens
gcatttatctttgatgctgggaatgcgttcattttctttatcttgccattactgtacctctattgggaaatttactctctcttcatagataggatccgathcagtacatatttataaaaccacacttacatttaaatacaggcctttcccatttcacagtgtttctagctcccctttccaatacatctctctctctctttc

SEQ ID NO: 18369 - DNA, 201 bp, Homo sapiens
aaaaaaaatccccaaaaaatctcataatgttttaagaaagtttatgaatttgtgttgggccagattcaaagttgtcctgggccgcatgtggcccaccagcyatggtttggacaagcttagtctacaggttcttcaagaggggcttgagcatttgaaagacttctagtgggagagatcacaaggtacaagtagaaaatcctg

SEQ ID NO: 18370 - DNA, 201 bp, Homo sapiens
atgctttgtaattttttttaaggattgatactagctagggtgttgataagaaacagcaggcatagttactgggtgattgagaagagtttaacaaaagactrtattagtctgttttcatgctactgataaaggcatacccaatactaggtcatttacaaaagaaaaaggtttattggacttacagttccttgtggctgggga

SEQ ID NO: 18371 - DNA, 201 bp, Homo sapiens
gcaatctatggtctttatcacttctccattaactgtccttgttttattaatgctgattactttttgatttggtttggttctttggagttgtttgcatttcrtgagtcttggcatctttttggtagagaaccttgctaggttctcacaatgtagaaattaagcagaaaacagaggtctcaatttgccttttcagcgtgaatg

SEQ ID NO: 18372 - DNA, 201 bp, Homo sapiens
ttcattctgtttctttattattttaatggagtgcaaggtgcagtctttttgaagatgtagaatgtggccttataaaagctaagtgctactttatatttctrctgtccttgccggtggcctgcactggggagttgtatattgtatcagtaattttaaaagccagcaagtgttctaccagctgaagaagttttcctaatggtg

SEQ ID NO: 18373 - DNA, 201 bp, Homo sapiens
ttataagttacattttacataaaaaggcagcagtggtgaagctggaagagggcacctagactttgatttcaggcaagattttgttaggtcccagtattggracttccggttggtggattttgctcaagaatagttttctctttgtctaacgcttcatgagagacaacctaaataaagccacagccagtgttacagaaatag

SEQ ID NO: 18374 - DNA, 201 bp, Homo sapiens
caatcatatttaaatcattgctgctggaactttagttgactttataagttacattttacataaaaaggcagcagtggtgaagctggaagagggcacctagrctttgatttcaggcaagattttgttaggtcccagtattggaacttccggttggtggattttgctcaagaatagttttctctttgtctaacgcttcatgag

SEQ ID NO: 18375 - DNA, 201 bp, Homo sapiens
aaacagggttagtaaaggcctcagagagaagatgtcctttgagctgagtcttgagactccagagatcaggactcaaggactgtggaacctgtacattcacrtcctggtaatcttacattgctcagaagactccagggacattgaggttgcccccatggagttgaaactcctatgctgatcacttaggaagccaagaacaaa

SEQ ID NO: 18376 - DNA, 201 bp, Homo sapiens
tgatgattaatacaactaataaatagtgcattagtattataggcacaaaagacagtatgaagtacagcacagatcatgaggagggtagggtcagttctacrtaaaaacagggttagtaaaggcctcagagagaagatgtcctttgagctgagtcttgagactccagagatcaggactcaaggactgtggaacctgtacatt

SEQ ID NO: 18377 - DNA, 201 bp, Homo sapiens
atggactgcattccatgcctggcactgtgcctatgatttattaaaatctaaagccattaataaataaattattcaatccatgcattgaattatctagctcwttcaaagacagtcacagtccatccctcaaagagctcatggaccagtcgaaggagggtgacagcctgggtcaaattggtgctgagcacacaggcaggggtc

SEQ ID NO: 18378 - DNA, 201 bp, Homo sapiens
tctttgaaagttgtccttctgcacccattttccccagacctaacctcgatttgtgctccaggtctgagcagaaatgttattccctccagaaagccttcccyggatgttgagggatgaagttgtagccccctcccgaatgcgtcctcagaactcgctggttctcgtcctcgccctcagcatacttgctcattgtttgtttcc

SEQ ID NO: 18379 - DNA, 201 bp, Homo sapiens
tgattattttgctctttgaaagttgtccttctgcacccattttccccagacctaacctcgatttgtgctccaggtctgagcagaaatgttattccctccaraaagccttccctggatgttgagggatgaagttgtagccccctcccgaatgcgtcctcagaactcgctggttctcgtcctcgccctcagcatacttgctca

SEQ ID NO: 18380 - DNA, 201 bp, Homo sapiens
tggcccaccagccatggtttggacaagcttagtctacaggttcttcaagaggggcttgagcatttgaaagacttctagtgggagagatcacaaggtacaastagaaaatcctgggctggcctgagaggcagacctgtgattattttgctctttgaaagttgtccttctgcacccattttccccagacctaacctcgatttg

SEQ ID NO: 18381 - DNA, 201 bp, Homo sapiens
tcaagatgagtgttatttggcagaggaagatgatgcactgcttattttaggggatgccctcacttttgggtccctatgtcacctgtgtgtactccatgccrgtgtcttcccagcccctgccaggcaagttcgtgtggttctgtgataaccctcatctctataggttctgtgataacgctcctctcactgtgctgctccttg

SEQ ID NO: 18382 - DNA, 201 bp, Homo sapiens
gttttaagccagagagagattgataagacatggaatgatatggtgtgatatatgaaatgacatgtttgaaatgatagatgacgtgattgtgatataatatsatgcggctgaggacaacactataactgctcggtagagaatggattgtcatggcctgggtgtggtggctcataatcccagcactttgagagctccaggtgg

SEQ ID NO: 18383 - DNA, 201 bp, Homo sapiens
attggcttggctcggtggttgggatggtttggctcttactgggcagtaagcacagtggctgggataggaccttggcatctcgtgcgaagcccctctgcctkgagtcctgcctctgtgacacttgcttactgtgtgacctgggtcaactcatacctactgttcgtcagttttctcatctgtaaaatggggattccagtggtt

SEQ ID NO: 18384 - DNA, 201 bp, Homo sapiens
ctgctccaatgaggatgaaaatgtctttcttatagatgggacaggagccttagtaatatggtgcgagcaatggttcacataggggacaggtgttcattcartggtgggtattattataataatcattagcatcattgctagtgactttatttttcctttagccaatggagcagtggcttttggcccactactttcgactga

SEQ ID NO: 18385 - DNA, 201 bp, Homo sapiens
gagaagaagagtgacagagtcaccaactcactccatcaaatgtggctgtatttttagaagtgtctggttcctgaaatacctcaattccttttgcctgcctrgctcctctcctctcttctgcctgttcattgaactgaaagattatcaggactgtattcagcccggccaataatatcacaaaacaaaaatatcttgtgggtt

SEQ ID NO: 18386 - DNA, 201 bp, Homo sapiens
tgtgatctgtctacatatgtagctgtttgtattcatggtgattaaatagttgggtgctagacatgcccttagcgagcagctcatgagagcagattttgccwgtttcttccaaaatctggattcagtgacatcgtgttggtagcttgaaactgaccgtggtgagaatatttacaccatggaaagtggcaaatgctactaata

SEQ ID NO: 18387 - DNA, 201 bp, Homo sapiens
ggtagaattcacaaagctggttttatgtctccttctcttcctcttccagtgttgtcttttccctgcattgagatagcattgcatggagatccttgtactcytcgaacagaggctgcagatggacacaggatctgctcagggagataagatcacctgctaattctgctttctccatcagagtctgaatgatcagtgatgggg

SEQ ID NO: 18388 - DNA, 201 bp, Homo sapiens
cttgctatgctgcccaggctggtctggagctcctggcctcaagcagtcctcctgctttggcctcctgaagtactgagattacgggtgtaagtcaccacacscagcccagaggccttctttaaatgctagtcctttttctcttcctccatctgggtcttggttccatgcgtattcagtttgtgaaaaatttgagtcgtgcac

SEQ ID NO: 18389 - DNA, 201 bp, Homo sapiens
tgtagtggtgtgatctcagctcagtgcaggcttggcctccagggctcaagcagtcctcccatgttgacctcctttgtatctgggaccacaggtatatttcmccatgcctggctaatctttgtgtttctgtaaagatgaggtcttgctatgctgcccaggctggtctggagctcctggcctcaagcagtcctcctgctttgg

SEQ ID NO: 18390 - DNA, 201 bp, Homo sapiens
tcagtggagggtcagcgtgacagccttttgcacccacatctgggttcttgtccagtgtccaggaggaatgaggtctcatgagcaaattttaaggatggcaratgtgggggattttattgctgatgaaagtggctttcactgggaagataagctaaaaagaagacaaagcaggaaggtaattttcccctggagctatgccat

SEQ ID NO: 18391 - DNA, 201 bp, Homo sapiens
cctcacatttgcttgcagccagtgctcaaaaccatagacaggcagtgtccccaaccactccctgcgtttctctttctttgccttccgaagctgccatcttrgtggtttttgaagcatcaacacttacttcacatgcagaggccccttttatttatttatttttaatttttttgagacagggtctcgctctcttgctcaggc

SEQ ID NO: 18392 - DNA, 201 bp, Homo sapiens
gtgagccctcttactgaattatgtggctggggttcttgggtatgttttgttctattttctggttggtggttttctttctgtcgggtcccgtgggctctttytggacctcttctcagaatgtttttcgttttttttattttttgagatggagtcttgcactgtgtcctgggctggaatgcaatggcaagatccctgctcact

SEQ ID NO: 18393 - DNA, 201 bp, Homo sapiens
ttaacattctttggcagttgtaatttattaattgatttttaaatttggccggtgaaaatgaactttaggtaggggtttgaggaaaatgaaaaggcctattkgtttttcagtggctggttcttcgtgttcagcattaaggattggtagaaatcaggcaacctctatgtaacctcagccatcttggattcccagcttactcac

SEQ ID NO: 18394 - DNA, 201 bp, Homo sapiens
atgaaggttgtgattcagttgcccaagcagtaaggcctgactggtgtcacgatcccacaacccgcacaaaggcgccattgttgcccagtgtgaagggagctgaggcatcaccaaagggggccaagcgtcccttctctgggttagaaatgttgttttccatttgctggtaaacaacagtccaagttcattgtcctgacacag

SEQ ID NO: 18395 - DNA, 201 bp, Homo sapiens
atactacatttcatcaggtagtgttagaaatttaggctgagccaaaaaagaaaagggaggaggtgggagggaggaagcaacgagtcccttgttcaggcggyattaacccccttaccctggctattggaacaatagcgcttctaaaagccgcacaaaatcctccaatattaagaacggagaaaaggagtgtggaaaaggtgt

SEQ ID NO: 18396 - DNA, 201 bp, Homo sapiens
agccccagtaaccctaagattgaacaaaaccctacttacgtgctacggatttaatatagcgtcaggctcctctaggtacaataaaataccaagttaagagyattaattccttacaaccctgatgggtcccagctgtgcacacgcatgtagggtgtgagggtgtgtgctcagcgggcacaggtgctgacggggctgttccac

SEQ ID NO: 18397 - DNA, 201 bp, Homo sapiens
atcagaaaagaggtcgtgtgtgtgtttgtgtttttttaatatcccatccagcccccagccccagtaaccctaagattgaacaaaaccctacttacgtgctwcggatttaatatagcgtcaggctcctctaggtacaataaaataccaagttaagagcattaattccttacaaccctgatgggtcccagctgtgcacacgca

SEQ ID NO: 18398 - DNA, 201 bp, Homo sapiens
ctgaagcttcaaatatgaacccttgccaccagctgcataaatatgatagccaaagggtttcaaatttgtgatttgtcataaacgctcctattgcaggctgrgtctagtccttcttgactttgtggaaggagaaggcttgaggaagtattcacaattggagaagggcgccttctgttatgttcttagctcactaaaagtggt

SEQ ID NO: 18399 - DNA, 201 bp, Homo sapiens
aacttgtgtagggaaactctcccttatgataccgtcagattccttgagacttatttgctattgtgagaacaccttgggaaagacctgcctccatgattcarttacctcccacctggtccctcctgcaacatgtgggaattcaagaagagatttgggtgggtacacagccaaaccatatcaaaaaccatttacaaaactcta

SEQ ID NO: 18400 - DNA, 201 bp, Homo sapiens
ttcagcagtctgcctttccctttctgttataaaatcatgtttttattgaattacattttaatattggtatcactttaaaatgaaaatgagtacttgcaaamtgtatttttgaaggagttgggtggtggtggggggatgccattttggcaacagatgacttcggttcaagtcctctctctgtctcttacttgctttgtggct

SEQ ID NO: 18401 - DNA, 201 bp, Homo sapiens
cttctaagcacttcttaggtgcctctgggctttttaacattctttggcagttgtaatttattaattgatttttaaatttggccggtgaaaatgaactttargtaggggtttgaggaaaatgaaaaggcctatttgtttttcagtggctggttcttcgtgttcagcattaaggattggtagaaatcaggcaacctctatgta

SEQ ID NO: 18402 - DNA, 201 bp, Homo sapiens
ccatgtatgtgtcagtcctactatgcaccttacagctcactaaccctgtttaataatgtatgttgctacatttaatctttatggtagcctcatgaacaggytcttatttagttcagtggttcttgatcaggagtgatattgcctgccagggaatgcatgtcaatgtctggagacatctggggttgtcagttcaggagggta

SEQ ID NO: 18403 - DNA, 201 bp, Homo sapiens
aaaaaacaaacaaacaaacaaacaaaaaataggaaaaaaagaaagagcgtatttatagatggtagagaattctgggcatgagaaacccagccaaacaagtrgaatgtgtgcataggtgggactgctgatcttgttttatgaaagaaataaaggcaagtcaaacagatcctttcgcaaggatccccatgtgtgtatgtctaa

SEQ ID NO: 18404 - DNA, 201 bp, Homo sapiens
actgtaaatgcacgagtattgatcacaattattccgtaaacacatcttacaaattccctcagtgcacgcgccatctaaattaatccaaattcagaacaaasctctcttggaaaaggaaagagcatctctttcaggagcttccctcttggacattaaatcttccataatctgtgctagttcggcaaagaagccccaacgtcc

SEQ ID NO: 18405 - DNA, 201 bp, Homo sapiens
cgcttaaaaatgtgtttttatagtgccattcctatataacatcgtctgataaatgtatttgagacgaacaggccaaatgaaagaaccttccataaggggaygcagcacagtttgaatataagtgttccctccaattcccatgttagtgctttactatgagtattgaccagtgttaaagagtgagcgcacaggagccttctc

SEQ ID NO: 18406 - DNA, 201 bp, Homo sapiens
gcactttgggaatacgaggtgggccaatcactgaggtcaggagttcgagaccagcctggccaacatggtgaaaccccgtctctactaaaaatacaaaagtkagtcggggttggtggtgtgctcctgtagttccagctacttgggaggctgaggcaggagaatcacttgaatccgggagccagcggttgcagtgagcttaga

SEQ ID NO: 18407 - DNA, 201 bp, Homo sapiens
tggtgggtcatgcatgtaatcccagcactttgggaatacgaggtgggccaatcactgaggtcaggagttcgagaccagcctggccaacatggtgaaacccygtctctactaaaaatacaaaagttagtcggggttggtggtgtgctcctgtagttccagctacttgggaggctgaggcaggagaatcacttgaatccggga

SEQ ID NO: 18408 - DNA, 201 bp, Homo sapiens
aataaaaaataaaataaaaaaataaaaataaaaataaataaaaagtagttgggcgtgtgttgtggagcatgtgggggtcccagctacttggcaggctgaascaggaggatcgcttgagctcaagaggttgaggctgctgtgagctatgatctcacctctgtactacagcctgggtgacagagtgagaccgtgtctttaagt

SEQ ID NO: 18409 - DNA, 201 bp, Homo sapiens
atcagtgtggacaacatagggaggtcctgtctctacaaaaaataaaaaataaaataaaaaaataaaaataaaaataaataaaaagtagttgggcgtgtgtkgtggagcatgtgggggtcccagctacttggcaggctgaagcaggaggatcgcttgagctcaagaggttgaggctgctgtgagctatgatctcacctctgt

SEQ ID NO: 18410 - DNA, 201 bp, Homo sapiens
ttgcctaggctggagtacaatggcgcgatctcagctcacagcaatctctgcctcctgggttcaagcgattctcctgcctcagcctcccgagtagctgggawtacaggcatgcgccaccatacctagctaattttgtgtttttagtaaagacagggtttctccctgttgttcagggtggtcttgaactcctgacctcaggtg

SEQ ID NO: 18411 - DNA, 201 bp, Homo sapiens
gctgagaaaggattcccagtccccctggtaaaaagtctgaaggatgccgaggagttcactgtgcccttagataataacagtttgtcttggctctgatcacycctttttgtgacttagctggctgggaagtagcaaaagtatcttccaagctcagcttctctctgcttgcattctttccaaatacgtgattccaaagcccat

SEQ ID NO: 18412 - DNA, 201 bp, Homo sapiens
caaagccagcaacagaaactctcttgtgcatggagtcccctcctgctttgaatctctctgactttccttgactttgatgtctaggtctggatttcaagggytcagaaactctctcatgcatgtagttccctcctgctttgaatctctctgactttccttgattttgatgtctaggtctggatttcaagggctcacgtgatg

SEQ ID NO: 18413 - DNA, 201 bp, Homo sapiens
ttttttttttttttttttgtttttcctcccagcctctctcctttcccattatgcacaatgcgctgagaaaggattcccagtccccctggtaaaaagtctgraggatgccgaggagttcactgtgcccttagataataacagtttgtcttggctctgatcacccctttttgtgacttagctggctgggaagtagcaaaagta

SEQ ID NO: 18414 - DNA, 201 bp, Homo sapiens
tccccactttcaggctctcctttcacacgcatgcattaattcgttcattcttggaatctacccacctgtgatgtgctagttactaaagatgcagcaatgartgaaaggtaatcctgtccttgaggcattcacaggtaaagaagcctgcttgggacattgggccgtgagctccaacaatgtcactattcttctaggctttgt

SEQ ID NO: 18415 - DNA, 201 bp, Homo sapiens
tattcctttccaacttccacttgccccaaataggtagaagttagcctttatttttggtgtcatgtcttctttccctcctcctatcagtttttcagaaactscagaaatttaacctagtacacaggggccccccacccctgtttccagatgccttctagaaagaggactgggagtgtgaatgaggccatgtgggctttgttt

SEQ ID NO: 18416 - DNA, 201 bp, Homo sapiens
atttatgacttggcttacaatccgttgcagaaagcctagctccccagcttctcctgaatctacgtttttctattttgtctgaactagccaaggtctctggwgtttgctgttatattgcttcagagaaattagtgacattgaaaggctgttgtcttttttagtgtacttttggttgttaggagaaatttacaaggccatttt

SEQ ID NO: 18417 - DNA, 201 bp, Homo sapiens
caccacccaagttgtaagatggtagagcgaacaggccagaatgtgataaagtaaaatgaaagaagaaaaaggaggaaggaaaaagagagagggagaagcasatagaggaaagaaggaagaaggaaggaggaaggagggagggagggagacagggaaggaaggaagtctggcaagagggcacagtcagacctgccaggatcc

SEQ ID NO: 18418 - DNA, 201 bp, Homo sapiens
aaagcaaagccaatagagatcttgaaaaaaaaaaaaaaaagaaaaaaccaccgtggtattctaggaagaaaaaagcatttttcgaatgaaaactttttatkatatttgatatattctgcttcccttccctagtatgtattaatgagatgaaatcacttcttaattttcaggttaatattaaagttgaagcccatccctcta

SEQ ID NO: 18419 - DNA, 201 bp, Homo sapiens
tcctcctcaagggaaacattcttctcacaatagcttcctggtagaaagttctaactaatgactttaatcgtgtgaatgtattgcagaaatggacaggacarttctcagcccattcatcttacagacctcaagtgaacaggcacaaaacaacaggctccaccctccttcccccctctatctcatactttacctcaatttatg

SEQ ID NO: 18420 - DNA, 201 bp, Homo sapiens
cattctatcaatgccaaaatgcacatcacactgacaacagctctttgtttacaccggggagcccccaaagccccagggtaattccatcaccacccaagttktaagatggtagagcgaacaggccagaatgtgataaagtaaaatgaaagaagaaaaaggaggaaggaaaaagagagagggagaagcacatagaggaaagaa

SEQ ID NO: 18421 - DNA, 201 bp, Homo sapiens
caactgttctctgcacgacctagttctgggctagggaatggctgtctagcttcagtggatttccagggtccggagctactaaaggtcaacagctgtgttaytgcaaactctgtggcctgcattctatcaatgccaaaatgcacatcacactgacaacagctctttgtttacaccggggagcccccaaagccccagggtaat

SEQ ID NO: 18422 - DNA, 201 bp, Homo sapiens
tttcctgcatcagctaagcatttatttcatgtagtcctcacactagattgagtggttccatattaatatcctacgtcaaagatgagtaaattgagatgcgkaggttctaatttgcccagtgtcgtggtgtgtgatcttgaccactagcctaaactgctattttatgtccacccatcaacctctacggctgcccctcatttg

SEQ ID NO: 18423 - DNA, 201 bp, Homo sapiens
ccagcccgttatgtcgcaagggctttgggaaatctcaatttattgctagcctggtagatattgagcagggtgtgatcctgttattgggctttcagactttmgcttagcaacctcattgcacccaggacccccatttaatcagcgactcctatggctgtttgggggctctctttcaaataattcttctcacccatgaacatc

SEQ ID NO: 18424 - DNA, 201 bp, Homo sapiens
cagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatga

SEQ ID NO: 18425 - DNA, 201 bp, Homo sapiens
tgacctcaggcagtctgcccacctcggcctcccaaagtgctgggatgacgggtgtgagccaccgcaccaggccatttcctcagttttaaaaagcaaataasaaacaacaacaaactgcatcagagtaaccgtttcaaaaacccatctcaggtctgttttttcttttttttttaagttagcattttctagaagttttggtat

SEQ ID NO: 18426 - DNA, 201 bp, Homo sapiens
tggcataatttagccagataaagtgcccacctagcactcatcccacctcctcactcctctatcctgtgaatgcagaaatacaattcctcatttacaaacarctgtgcatgtagggttgcttgcaaaagttcgtcgtgtgccgatatttcattaccacttttgccagcgctctcgtctgcatttcctgaggtttttcttttt

SEQ ID NO: 18427 - DNA, 201 bp, Homo sapiens
ggatcgcttgcatccaggaggttgaggctgcagtgagccatgactgtggcactgcacttcaacgtgggcaacagtgtgagaccccatctccaaaaaaaaaagcagtatagtcagtaagaaagaaaacaaactaacagtcaatattgtggctgctctcaatgttctttaaacggatcacattgccacttttttctctttgta

SEQ ID NO: 18428 - DNA, 201 bp, Homo sapiens
tttggttctttaacattctcttcttcactaaacccaaattaataattccttactattgtcattaaaagttctcactggatcattccatttatactcagagkaacaaagcaaacccaattatttgagagacactgaaatgaattttgagtctagaacagcatctgcaaactttgcaaaggttcacatgataaatattttctg

SEQ ID NO: 18429 - DNA, 201 bp, Homo sapiens
gagataaaatgggtaattaacaaatgtaatccctcccacccaccccccacattatttatttatttatttatttatttatttatttatttatttttaccatrtctgttactccatcagtcaggatccagttaggagacagaaactatatcataattttaacagggaagatttaatattaagaattattagctacaacagggt

SEQ ID NO: 18430 - DNA, 201 bp, Homo sapiens
ctttggttctttaacattctcttcttcactaaacccaaattaataattccttactattgtcattaaaagttctcactggatcattccatttatactcagartaacaaagcaaacccaattatttgagagacactgaaatgaattttgagtctagaacagcatctgcaaactttgcaaaggttcacatgataaatattttct

SEQ ID NO: 18431 - DNA, 201 bp, Homo sapiens
tctttatttcaaaaagagtggctgtgaatctttaaaaatttctttggttctttaacattctcttcttcactaaacccaaattaataattccttactattgkcattaaaagttctcactggatcattccatttatactcagagtaacaaagcaaacccaattatttgagagacactgaaatgaattttgagtctagaacagc

SEQ ID NO: 18432 - DNA, 201 bp, Homo sapiens
attaaaaagatacatgacgttgaaatcagtgacagaggcataaggctccttgagggaagaaaccaggtgttggccataaaaaaattatttttcacagcgcycagcaaagggcttgtatgcaaaggaccctcagtataagctggttgttgactgatgtgtttcaagagtaagtcagaaaaataaaaagaaggcagggaaaga

SEQ ID NO: 18433 - DNA, 201 bp, Homo sapiens
cgtagtactgatgtggatatgatttgagctaagactctgctgttgattctcttcaaaaacttggcagtagcccttggatcccattaattgcattcaacagkcatgtattttattaatttttgttcctaaagaaaaaaaaaaatccagattgcttagaaaataaatgtgactcacgcagagcagaatccgaattttctaagt

SEQ ID NO: 18434 - DNA, 201 bp, Homo sapiens
actaccttgggaaatgactctgtatcaagcgtttaccatctgctgaaagctttgcatactctgttgcttatcatgacaactgccctgaaagttgggtgtamttgttacccctttccagattaaaaaacctaggggtcagagaggttaagtaacttgctcaagacctcacagtgaactgtggtggaccactgggattagaac

SEQ ID NO: 18435 - DNA, 201 bp, Homo sapiens
tagtcattaaatatattcacaatgttgtgtaaccatcagcattacctatacctaaaatattttcatcacatcttttaaaaaataactgccccttcctcacwtccccaagcttgtggtctctggtaacccctactttactttctgcatctatgaaattgttttcaaggtcaatccatattgtagcatatatcaaaatttctt

SEQ ID NO: 18436 - DNA, 201 bp, Homo sapiens
cctcacacgtttgctaatgtaagaagtgctggctctgctcttagcctgcagtggtgcagcttaaaaattctgggagggtttcatgcagtaaatacttaaartaacagaaaaggactggggaaaagctgatgttgtagctgtatgatcacccatgtaaaactgtttatttagttatttatttatttatttgcttttttactt

SEQ ID NO: 18437 - DNA, 201 bp, Homo sapiens
ggaaggggcactcagctgttacctcctgtcataggaccattcctcactgtgccatcatattatacttccatatcgtgtgtcttgtggcattcctgggcctrcagtgagcctgtggccacctcatagtcttgttggccacagcctctagaaccagggattggaggaacagccatcgctagcatggtgcttggcactgagcgg

SEQ ID NO: 18438 - DNA, 201 bp, Homo sapiens
ggatgccatgcttggtgagaaatgaattcgtaagtgtgcactgtctgccataaagagccaggcaaggcacagaaaatattcttctgtttctttttctattstaccctctctctgctttttcttctctcactgctgctgaagcagtgagagcctgttgagttaaaataagccagtgaggattttggtggtgtttgcccttga

SEQ ID NO: 18439 - DNA, 201 bp, Homo sapiens
ttgagaagggccctgtccgcagcctgaggagcctcaactgttctctgcacgacctagttctgggctagggaatggctgtctagcttcagtggatttccagrgtccggagctactaaaggtcaacagctgtgttattgcaaactctgtggcctgcattctatcaatgccaaaatgcacatcacactgacaacagctctttgt

SEQ ID NO: 18440 - DNA, 201 bp, Homo sapiens
gaaaattcaaaaaattgcaacctgaggcataaatgggttttaagctccatacagtaaaacctagcatatgaaaacagttctggctgatgggttggtagaartgatagatatagatacatatatacacatatatgcacagtaatagatataggtaaagaccttgatatatgtacatatattgtatgatacatatccatgcat

SEQ ID NO: 18441 - DNA, 201 bp, Homo sapiens
tatatcctaccgctcaaagccatcaccaaggtctgatcgtgaaaattcaaaaaattgcaacctgaggcataaatgggttttaagctccatacagtaaaacytagcatatgaaaacagttctggctgatgggttggtagaagtgatagatatagatacatatatacacatatatgcacagtaatagatataggtaaagacct

SEQ ID NO: 18442 - DNA, 201 bp, Homo sapiens
gatattttctactatggatgaatgctcctcttttgaattttcatttttgtctgacataactcaaagtgcttgctttgggagttcttgttaaccctgacaawtcttgtcaaatatcttactcctgggctgtgctggggatggcagcagagtggggtggttggatgggaaggcgggaaagagctagcttggagatgatacgct

SEQ ID NO: 18443 - DNA, 201 bp, Homo sapiens
aacctttttgatgcctccaggcaatttcctacaagctctaatatcttcctctttactcccatatgtggtatctctggtaccctatatatcattcactcaastgtttgttttgaaccacttattttggcaagacttcttcagacaggagagccctgagagctcttcaaaggctgggcctgatggtgtttgtcagagaggttc

SEQ ID NO: 18444 - DNA, 201 bp, Homo sapiens
aaagttaccttgatagttcaggtgtgcagagaaaattcacagccatcaatagaaaagaaaaaaaaatcctgtttataccttaggcattctgtgatccttasgatgtagccatgacagtattacgggttttaaaagccacccaagtaatctaaatttcctccaaactaacaattcctgaaagattgaaatattgctaccaat

SEQ ID NO: 18445 - DNA, 201 bp, Homo sapiens
tgtcctgtcgctgtcacaagtttttaataagggctgggggtcctcttgaagagcccaggaactgcagtccctcctctatgccttcccctgaacacagtgcrccctcactaataaattctgagggctgacactgcctgagccggctggtctttgccctcaatttcattgagatgggccattgaaaactcattacaagctgtt

SEQ ID NO: 18446 - DNA, 201 bp, Homo sapiens
tggaagaaggaaggcgcccctccttcttagctgattgatgatgagatagaaagatagaaacagccccatcactatgagatggaaacccttctttccttcakctgacttccctctccttcattcccaaccaagtttgaccccgccgcagtggagattgtggcagatgggtcagatagcatgtgtcctgtcgctgtcacaagt

SEQ ID NO: 18447 - DNA, 201 bp, Homo sapiens
gggtgtccaaacttttggcttccctgggccacattggaagaaaaagaattgtctttggctgcacataatatacaattgttgatgagctaaaaaaaaaaaaatccccaaaaaatctcataatgttttaagaaagtttatgaatttgtgttgggccagattcaaagttgtcctgggccgcatgtggcccaccagccatggttt

SEQ ID NO: 18448 - DNA, 201 bp, Homo sapiens
ttcttaaccctttaagaaatatgacttgttctaattgccttttcttatttacattatacttaggctggtgttaggatgccgtggctgccaagtttacacartgcactttctctctctctttcttcttttggtttatgatgtttttcaatagtgtcatggaactcacttaatctgatttcatcaagtaaatatatgggaagt

SEQ ID NO: 18449 - DNA, 201 bp, Homo sapiens
gctgggaagtccaagatcaagctgctggcagattgagtgtttggcaacggcccactttctggttcctagatgttcacctccttgctatgtcctcatatcgkgggaggggcaaagggtctctctatctggcctcttttaagcccttaacccattcatgaaggctttgcctcaatgacctaatcacctcccaaaggccctacc

SEQ ID NO: 18450 - DNA, 201 bp, Homo sapiens
cttatggtcaccattctgtaatgattatcatttgtacatttaaaatagaaactgttaggccaatgtgttattctagaataggacttgacagactttttttwaaataaaatgccagatagtgtttctagctttgcagttcagatggtgtgtgttacaactgttcagctctaactttgtatgaaagtagccataggcaataca

SEQ ID NO: 18451 - DNA, 201 bp, Homo sapiens
gggtgagatgaacattgattgagcctttacatcggagacactataacaaatgctttgtgtacatcagctctttcaaattaatacaattctactagaggggrcactattagtatccccaatttacagatgaaaaaaatgagggacagagaggttagatgtgtatctaaggtcacatagctcacaaacgacacagcatgcacc

SEQ ID NO: 18452 - DNA, 201 bp, Homo sapiens
agatgaggttcttgagtactttcaattaggtttaccactgaccccatcagtgtgcagacgaagggagatgagagatacagatggttaatgggatttttggrgtatcttccagcctttgtgagcacagaggtttcgctacattttgaaaattaaaattcatttcattcgcattacagattttaaatcctagctcctttttaa

SEQ ID NO: 18453 - DNA, 201 bp, Homo sapiens
caaggcctgttggaatgtctgccagtttcaacccacggggatagggtgagatgaacattgattgagcctttacatcggagacactataacaaatgctttgygtacatcagctctttcaaattaatacaattctactagaggggacactattagtatccccaatttacagatgaaaaaaatgagggacagagaggttagatg

SEQ ID NO: 18454 - DNA, 201 bp, Homo sapiens
cagatgaggttcttgagtactttcaattaggtttaccactgaccccatcagtgtgcagacgaagggagatgagagatacagatggttaatgggatttttgkggtatcttccagcctttgtgagcacagaggtttcgctacattttgaaaattaaaattcatttcattcgcattacagattttaaatcctagctccttttta

SEQ ID NO: 18455 - DNA, 201 bp, Homo sapiens
tcctgctatgtccttacatgacagaggaagagatcatctttcttcagcctcttctgacaagtccaccagtctcattcatgagggttccactctcatgactkaagtacctcctaaaggctccccctcctaataatatcaccttggagattagggtttccaaatatgagtttggggggacacattgattccacaacactgacc

SEQ ID NO: 18456 - DNA, 201 bp, Homo sapiens
atcaaatggtagttctacttttagttcttcaagaactctccacactgttttccatagtggttgtactagtttacattcccaccagcagtgtagaagtgttscctgttcaccgcattcacgccaatatctattattttttgcatttttggtaatggccattcttgcaggagtaagatggtatcgcaaatgcaacaaaaacaa

SEQ ID NO: 18457 - DNA, 201 bp, Homo sapiens
gccgtgtctcttttctgtgattcgggagcacattgatacccttcttttggagcagagaagcttgtctttcatgatagaagtaggtcatgggggcggttagytgacttcatcagagagtagcatgcagatcccacctgtgaggctatggtctgccaaggagagttcagcgggctggatcagagagagcagagccatgctggc

SEQ ID NO: 18458 - DNA, 201 bp, Homo sapiens
aggagagagttactattagctcccagtttataggtgagtgatatggtttggatgtgtccccacccaaatctcaacttgaattgtatctgccagaattcccrcatgttgtgggagggacccagggggaggtaattgaatcatggggcccagcctttcccatgctattctcataatagtgaataagtctcatgagatctgatg

SEQ ID NO: 18459 - DNA, 201 bp, Homo sapiens
ctcccgagtagctgggattacaggggcacatgccaccatgcccagctaattttgtatttctagtacagacagggtttcaccgtgttggccaggctggtctsaaactcctgacctcaagtgatccaaccgcctcagcctcccaaagtgctgggatgacaggtgtgagccaccacacccagccactctctttcaactagaaca

SEQ ID NO: 18460 - DNA, 201 bp, Homo sapiens
tctctctctctcttttttttttttttctttttgaggaagggtctctctctgtcacctggctggaatacaatggtgctatcttggcccactgcaccctccayctccctggttcaagggattctcgtgcctcagcctcccgagtagctgggattacaggggcacatgccaccatgcccagctaattttgtatttctagtacag

SEQ ID NO: 18461 - DNA, 201 bp, Homo sapiens
ctgggcaaggaaacaaaactgaacaacattagcaaaatcactacatattataggaatcaagtacattctgaacggcttaatcctacagtttagatatgaascctaagggtaagatgaacgtcttagatgatctgagatatccaaatacctgtaacaaacatttgtatggtgtatgtagggcaggaaccccatcagaattgg

SEQ ID NO: 18462 - DNA, 201 bp, Homo sapiens
taataaacaaataagttttgggttgggcgggagattagttagagacaggatctgtaggtcagaagtggtatttgggggagtagggagttttttttttttttctttttcccttatgcatttgggagtggaagagctgtcagattctgaatttagttagatttataatgctagagacattcagcagtctgcctttccctttct

SEQ ID NO: 18463 - DNA, 201 bp, Homo sapiens
catgctatctcgacttctgtgtgtctcctttttgtccatctcttaaatcagtcacttggcagcagcaagacatgtggccactccagaccatttgatcgaaragctcttgttaggagattaggctgctaatctgcaagcgagctaatggaaatcattctgggcaaggaaacaaaactgaacaacattagcaaaatcactaca

SEQ ID NO: 18464 - DNA, 201 bp, Homo sapiens
tccattagagacctggcgtataattgtgggagggagaagccagtggagcagtcaggggactccctggctgtttctgtgtctggtcttatgggtctgggcaytgaattcagtcacaaaccctagcatgctcctttgctacctcaggggacaaagtcaagaaaataacactaggattgccaccctgctctctctctctctctc

SEQ ID NO: 18465 - DNA, 201 bp, Homo sapiens
aaagtaaagtaataaacaaataagttttgggttgggcgggagattagttagagacaggatctgtaggtcagaagtggtatttgggggagtagggagttttktttttttttctttttcccttatgcatttgggagtggaagagctgtcagattctgaatttagttagatttataatgctagagacattcagcagtctgcctt

SEQ ID NO: 18466 - DNA, 201 bp, Homo sapiens
gaccattaatcatgctatctcgacttctgtgtgtctcctttttgtccatctcttaaatcagtcacttggcagcagcaagacatgtggccactccagaccawttgatcgaagagctcttgttaggagattaggctgctaatctgcaagcgagctaatggaaatcattctgggcaaggaaacaaaactgaacaacattagcaa

SEQ ID NO: 18467 - DNA, 201 bp, Homo sapiens
aatagcacagcttttttccactttcaaatgtataacaaaatagaactttatatttccagatggactgcctggaacccggggagtggctcagctaccaggcyccagtggcccttgtcttgttatttcctccattagagacctggcgtataattgtgggagggagaagccagtggagcagtcaggggactccctggctgtttc

SEQ ID NO: 18468 - DNA, 201 bp, Homo sapiens
gtatgtgtttaatctaccattccttgtggcacagtgcatggtctgcatggcacagtgtgtggtctgtatggcacagtgcatggtccgcatggcacagcgcrtggtccgcgtggcacagcgcgtggtccgcgtggcacagcgcgtggtccgcgtggcacagcgcgtggtctgcgtggcacagtgcgtggtctgcatggcaca

SEQ ID NO: 18469 - DNA, 201 bp, Homo sapiens
atagttctctctgtgaccctgtagaatgcactgaagcaaaaataacaggtaatgctaatcataaagttttacaaatctcctgaagagtcttgttggtttcygtgttgatgaagcaggaaatttccctgacccctttgcaggcaggaagtggagtgcggatgctggaactagctggctgctttggtgccagtagaggtgaac

SEQ ID NO: 18470 - DNA, 201 bp, Homo sapiens
agttctgtgtttatacttctcatttagcccataccccactatattaaaagaagatgtataagtgtatgtgtttaatctaccattccttgtggcacagtgcrtggtctgcatggcacagtgtgtggtctgtatggcacagtgcatggtccgcatggcacagcgcgtggtccgcgtggcacagcgcgtggtccgcgtggcaca

SEQ ID NO: 18471 - DNA, 201 bp, Homo sapiens
acctggctaatttttgtattttttgtagaggtggagtttcgccatgttggccaggctggtcttgaattcctgacttcaagtgatgagactgcctcagccasccaaagtgctgggattacaggcatgagccatcgcgcccagccagacttgtatctcttaatgagtttaactacatttaaccatgtatgtgtcagtcctact

SEQ ID NO: 18472 - DNA, 201 bp, Homo sapiens
acatggtgaaaccccatctctactaacaatacaaaattagctgggtgtggtgatgcacacctgtaatccctgctacacaggaagctgaggcaggagaatcrcttgaacccaggaggtgaggttgtggtgagccgagatcatgccattgcactccagcctgggcaaaaagagcggggtaaaaaaacaacaaaaaaatgatgt

SEQ ID NO: 18473 - DNA, 201 bp, Homo sapiens
ttggcctcccagagtgctgggattacaggtgtgagccactatgcccaataccccctatgtagacttttaaagaaatacaggaaacagccaagactggtgtsattcagatttagcttgggagagtctagtgggtgttaggttcccacaggatgaaggatcaccatgaacggtcaggacctgacttaggaggactcagaagct

SEQ ID NO: 18474 - DNA, 201 bp, Homo sapiens
gagggtggcagtgatcttgaggggggtctgggagggaggagccagcctggcctggtctggcctggcccagtgtgccagctagggcaggtgcaatggctcaygcctataatcccagcactttgggaggccgaggcaggtggatcacctgaggtcaggagttcaagaccagcctgaccaacatggtgaaaccccatctctact

SEQ ID NO: 18475 - DNA, 201 bp, Homo sapiens
cctgcttaggaaatttgggttgagggtggcagtgatcttgaggggggtctgggagggaggagccagcctggcctggtctggcctggcccagtgtgccagckagggcaggtgcaatggctcacgcctataatcccagcactttgggaggccgaggcaggtggatcacctgaggtcaggagttcaagaccagcctgaccaaca

SEQ ID NO: 18476 - DNA, 201 bp, Homo sapiens
aaaaaaaaaaaaaaaaacaactacccaaggcctgttggaatgtctgccagtttcaacccacggggatagggtgagatgaacattgattgagcctttacatyggagacactataacaaatgctttgtgtacatcagctctttcaaattaatacaattctactagaggggacactattagtatccccaatttacagatgaaaa

SEQ ID NO: 18477 - DNA, 201 bp, Homo sapiens
cataccatatgctgaaagacttggaatgcaaaaacctaaggccaagggcacttctcaatattaaaccctcagttgtaatggaggcatcaagactataagayccaagaccttaacttttgtgctccttgtcttgtggagggaacatccatcctcaaaacagaaacctgtgagatcccttgaatatactgacaatacactgat

SEQ ID NO: 18478 - DNA, 201 bp, Homo sapiens
agtagatattggaaatatgaacccaatatgttcttaacatctccatgtcgtaattctaatttaaaatcaaaatctcatcaaattacattttagattaaagsattgtacctatcgaaagaagagaatcgaaaatgcgaaagtccttcattttcagtgtggcctgagattgttgaaggatttgttctattgcatgctgataaa

SEQ ID NO: 18479 - DNA, 201 bp, Homo sapiens
ttagaagaaaaccagaggtctgtgcacactatggatttttactacaatgatgccctttcacatacagcgagaaggattaagaggtactgtattgttggttrataaagtcaaacttgtgaacagagcaaaagggcattgcttggtcattgcagcttccacccatgcaccttacacagaagtttgggccctaacatggaaact

SEQ ID NO: 18480 - DNA, 201 bp, Homo sapiens
ttcaacacagttctcttgtctctgttcatgatataacagtaaatccaagttgctttaagtagatattggaaatatgaacccaatatgttcttaacatctcyatgtcgtaattctaatttaaaatcaaaatctcatcaaattacattttagattaaagcattgtacctatcgaaagaagagaatcgaaaatgcgaaagtcct

SEQ ID NO: 18481 - DNA, 201 bp, Homo sapiens
ttttccaatgagagtactgatgacataaaaggttatacattgaataaccacccaaattagcagtgtttcatatttacactgttcaacacagttctcttgtstctgttcatgatataacagtaaatccaagttgctttaagtagatattggaaatatgaacccaatatgttcttaacatctccatgtcgtaattctaattta

SEQ ID NO: 18482 - DNA, 201 bp, Homo sapiens
aaaagaaatctgttagaaatgcatattttctgttttcaccccagaaatcctgaataagaaacactaaaggggagtgggcccagctatttgtgtttttggargaactcctgttttaatttgttttttcggaagtcctccagtttgagaaccaatgataaggacatttttccgggaatccagttgttttaggaaaggcccagt

SEQ ID NO: 18483 - DNA, 201 bp, Homo sapiens
tttaatcacataattacttaaatggcctggcgagccgccttacctagctggccaggaattccaggagtcaggcttcctgatctaaatctgtcctggtcccrtcttggctgggtgccaccagcagcaacggcacactccagcttaaatatcagtggggataattctaggccgtttgtctgcctggttcttccaggatagagg

SEQ ID NO: 18484 - DNA, 201 bp, Homo sapiens
agatcttgcttttcagtctactggtatctccacttctctctgcagcgtgatgtctagtcagagtttccattctgtttttatgaccctgggaggactgggasagatctgtgaggtcatcttgtccaccctcagccagggcaggagtattccctaatggtagagtcaagtgtttggtttggtcttgtttctaatgactcaagt

SEQ ID NO: 18485 - DNA, 201 bp, Homo sapiens
agcagctttagataatgcattgtaggtgttttgcaaaaacatactttcgtgactaaacatcataagctccaagtgagtgatttccccgcgtaaatgaatgwttctgtgaggataacacttctaagatgtgagatttcaataaatgaatctgtaggctgctgtgatggatacctttggtggggtaggaaggatcgtcattta

SEQ ID NO: 18486 - DNA, 201 bp, Homo sapiens
tatgtatttttgataaatacctaggtgtgaaattattgactcttagtgtttaacttgtaagaatgctgccaaacagttgtctaaagtaattgtatcattttaacccctcgctagaagtgtgtaagagtttatgttgcttcacatcctcatcagcactttgtaatttcagtctttttaattatagcctttttgtgggtgaga

SEQ ID NO: 18487 - DNA, 201 bp, Homo sapiens
cctagagcaggttgggcaagaggcttttctctcagtcaccagccccaaaccctgtggtcttgccagcccaggacgtgtcaagactgcagcctttgctgacytgtgaccatctccaagtccatgcccaggcccctactaggagttgagggcaacaggggcagtgggtctctcctgcttaggaaatttgggttgagggtggca

SEQ ID NO: 18488 - DNA, 201 bp, Homo sapiens
agaagatccattgcaaaatgaaaatatggggttctagccaggggcagggaacttaatctcccttttccatgggcccaacacctgaatctagggcaaacagstgtcccccagattggatcctctgctctaggacacattcttgtcctagagcaggttgggcaagaggcttttctctcagtcaccagccccaaaccctgtggt

SEQ ID NO: 18489 - DNA, 201 bp, Homo sapiens
gtttttagacagaatatcacttttttatattattcatggtaatgtaattcccccctttaatctcttcagggtttcccattcagtcatgatatgcggttcaragaaagttggatcgaccattaatcatgctatctcgacttctgtgtgtctcctttttgtccatctcttaaatcagtcacttggcagcagcaagacatgtgg

SEQ ID NO: 18490 - DNA, 201 bp, Homo sapiens
ggttatttccttgaggagaaaggaaaggagaagttgagtacttttcagtgtttgttactacaaaagcatggtggcatgccattgttctgagaggaaggggsttttttgccttgtcagctcctgatgaaaaagatgttgggttggaaagctaagttacagcaggtgaacttgaatttgaggaaagacaaagcaaaccctggc

SEQ ID NO: 18491 - DNA, 201 bp, Homo sapiens
ggagggacaatagaacctctgtagaatcaaaggcagaattaaaatctgcatgttaatagctttcctgccagccacgaatagattcattcttcacgtctcaratatataaagcttatttcaaaataaattctggggagcgttcaacctgattgaatctgctgtaagctctgttaatatatttgttcgagtcacttgcactca

SEQ ID NO: 18492 - DNA, 201 bp, Homo sapiens
ttttcccttcttgataggttgtagattccatgtctaatccatgcttttccaatattccctcctaatctttcagttgaattatggtctttagctcaaatgcrtgacatgatgtgtgtgcctttggagtggggcggtattagtcagtcgatggttatttccttgaggagaaaggaaaggagaagttgagtacttttcagtgtt

SEQ ID NO: 18493 - DNA, 201 bp, Homo sapiens
caggtttgtcccatttgtactgactctgacccaggttgtcatgacttgagactcactagaagtttcagaaagatgcagactgctttaaaaaaaaaaaaaaagggcaaggggaggtgtgagaagaaagtataattctttttcttctaactggagatataaaaatcatataagcatgatttatgatttgattggaacattgta

SEQ ID NO: 18494 - DNA, 201 bp, Homo sapiens
gtgggcttagaagaaaaccagaggtctgtgcacactatggatttttactacaatgatgccctttcacatacagcgagaaggattaagaggtactgtattgktggttgataaagtcaaacttgtgaacagagcaaaagggcattgcttggtcattgcagcttccacccatgcaccttacacagaagtttgggccctaacatg

SEQ ID NO: 18495 - DNA, 201 bp, Homo sapiens
ttattacagcgcaggtgcatcttgcttttgagtgctaactgagatgaaaggagtgaggaaacgctctcttcttcttgcaggggagggctggcaaattcagygaatgcagagtcggctgggagcctttcggctggaaagctcttcctctgatgagctgtctgttacagattttcagggatggcccttgataaggcaggggtg

SEQ ID NO: 18496 - DNA, 201 bp, Homo sapiens
catgatctcggctcactgcaagctctgcctcctaggctcatgccattctcctccctcagcctcctgagtagctgggactgcaggcgccagccaccacgccyggctaattttttatatttttagtagagacggggtttcaccatgctaaccaggatggtctcgatctcctgacctcgtgatccaccagccttggcctcccaa

SEQ ID NO: 18497 - DNA, 201 bp, Homo sapiens
gctccaggtaaccactcatctactttctgtctctatatagatttgcctattctagacttttcatataaataaatcagatactgtgtggccctttgtgtctygatccttacacttagcatcatgttttcaagggtcattcatgttgtagcatgtatcagtacttctttttttagggctgagtaatattccatttacggatat

SEQ ID NO: 18498 - DNA, 201 bp, Homo sapiens
tcttttttttttttttttttgaaatggagtcttgccctgtcccccaggctggtgtgcagtggcatgatctcggctcactgcaagctctgcctcctaggctyatgccattctcctccctcagcctcctgagtagctgggactgcaggcgccagccaccacgcccggctaattttttatatttttagtagagacggggtttca

SEQ ID NO: 18499 - DNA, 201 bp, Homo sapiens
ggaatgcagtggcacgatgttggctcactgcaaaccctgcctcccaggttcaagcgattctcctctcccagcctcccgagtctctgggattacagacgtgyatcaccaggcccagctaatttttatatttttactcgagacgtagtttcaccatgttggccaggctggtctcaaactcgtgaccttaggtgatatgcgccc

SEQ ID NO: 18500 - DNA, 201 bp, Homo sapiens
tctaaaccaaaggacctaaataaaatattaatttttcatagtgtttaatatgtgccagtatatataaattcaaggtaaggtagacagctgtaaactggatsccctgctgtacccagcaaatgctgagagccctgcttcccctcttgtattcaaatggctctataagagaggaagtagtacagctatcagtaacaatgccat

SEQ ID NO: 18501 - DNA, 201 bp, Homo sapiens
tcaagcgattctcctctcccagcctcccgagtctctgggattacagacgtgcatcaccaggcccagctaatttttatatttttactcgagacgtagtttcrccatgttggccaggctggtctcaaactcgtgaccttaggtgatatgcgcccctcagcctcccaaagtgctgggattataggcatgagccaccacgcccag

SEQ ID NO: 18502 - DNA, 201 bp, Homo sapiens
gtacttcatgatcttggaagaaggaaggcgcccctccttcttagctgattgatgatgagatagaaagatagaaacagccccatcactatgagatggaaacmcttctttccttcagctgacttccctctccttcattcccaaccaagtttgaccccgccgcagtggagattgtggcagatgggtcagatagcatgtgtcctg

SEQ ID NO: 18503 - DNA, 201 bp, Homo sapiens
ccttctcagagtcagtaggatagtttcccttcctggaagattgagatgaaataaagctttaggagttggtatcgcacgcaggcattaaatggattgtgaasagggactttgttccccctcagtcttgtctctgcctccgtaaaggagtaagttaaaaaagaaagtttctttttttaaaaaaaagccttactgctcaataaa

SEQ ID NO: 18504 - DNA, 201 bp, Homo sapiens
tgatgatccagagctttggagtcagcgagacagtagagagtggtggagatggtggcgcacaagagggtcagtgccccatctcaaggaacagctgcacctcrgcctacgcgattgtgaaaatgtgagcatatgcaggccagaccttggcttctctgtcttcatttttcacaggagccagaagtttggatgtgcaatgtgaaa

SEQ ID NO: 18505 - DNA, 201 bp, Homo sapiens
aagtaaaaccacaggggatctgttggaagtggcatgatggaggaattttaaaagaattgaacaaataaaatagtcagagctcaaaaattgagtactgcttygtttctcccaaataaccatcaccagacaaacaggtgtgtgtgtgggtgggggaggtggcctggtggtacttcatgatcttggaagaaggaaggcgcccct

SEQ ID NO: 18506 - DNA, 201 bp, Homo sapiens
tccagagctttggagtcagcgagacagtagagagtggtggagatggtggcgcacaagagggtcagtgccccatctcaaggaacagctgcacctcggcctaygcgattgtgaaaatgtgagcatatgcaggccagaccttggcttctctgtcttcatttttcacaggagccagaagtttggatgtgcaatgtgaaatctcac

SEQ ID NO: 18507 - DNA, 201 bp, Homo sapiens
agcaaaatggggtaagaacagaatctgccttgcagagaattaaccgagatgatgtgtggaaagggcctatcccagaggctggtgtaccatggtggcttctyctggctctgctggttattattattagcattattgtcattgtgaaagtgacaaggaatgtgcctgtgcgtgaatctcactcttagatcagacgtgcttttg

SEQ ID NO: 18508 - DNA, 201 bp, Homo sapiens
ttgaaggaatgtttcacttccaaatccagatctctgacttcccttgaaaatttggagtgccactcaagtcggccgctctgagctagaatcctggtgttcaraattggcaggaagggcacaggggcaaggtataggctcacgtctccacattctgcacctcccaggctcctgccattgatgtgagcgggttcctgtactgca

SEQ ID NO: 18509 - DNA, 201 bp, Homo sapiens
ggatcttcaggtttggagggaggccgatagagagtgtctggagttgccaacgtcctctccttgggtcatgggtgtgtgtgtgtgtgttttcttcttgttgktgggtttttttttttttttttttttttttttggcttttgcgcctatggtgacttttagcgaatggatactattgaaggaatgtttcacttccaaatccag

SEQ ID NO: 18510 - DNA, 201 bp, Homo sapiens
aatggatcttcaggtttggagggaggccgatagagagtgtctggagttgccaacgtcctctccttgggtcatgggtgtgtgtgtgtgtgttttcttcttgktgttgggtttttttttttttttttttttttttttggcttttgcgcctatggtgacttttagcgaatggatactattgaaggaatgtttcacttccaaatc

SEQ ID NO: 18511 - DNA, 201 bp, Homo sapiens
cccctgtgggcttagaagaaaaccagaggtctgtgcacactatggatttttactacaatgatgccctttcacatacagcgagaaggattaagaggtactgwattgttggttgataaagtcaaacttgtgaacagagcaaaagggcattgcttggtcattgcagcttccacccatgcaccttacacagaagtttgggcccta

SEQ ID NO: 18512 - DNA, 201 bp, Homo sapiens
gtgggaatgtctcatccccctgtgggcttagaagaaaaccagaggtctgtgcacactatggatttttactacaatgatgccctttcacatacagcgagaargattaagaggtactgtattgttggttgataaagtcaaacttgtgaacagagcaaaagggcattgcttggtcattgcagcttccacccatgcaccttacac

SEQ ID NO: 18513 - DNA, 201 bp, Homo sapiens
cctgggaaatatagcaagatcccaaccctattaaaaaattaaaaatgaaaataaaattttaaagaaaggtatttctccccttcacggtaatttggagccartacttcttgcaccattcatttgtccacagcatgggacaaaggataatgccttaatgcctgctgcaaatagaacagtggtgcttagcagctttagataatg

SEQ ID NO: 18514 - DNA, 201 bp, Homo sapiens
atacttgaaggtagccagtggacacgtggggccatttcaagctaaattaaattttaaataaaattaaagattcaatctctcactcacacattacaagtgckaaacatccggacacatctagtggctcccactgtgggtagcacatacagaaagaacgtttccgtgacagtagagtgtcccattgcacagtttgggtatgga

SEQ ID NO: 18515 - DNA, 201 bp, Homo sapiens
ttagccaggtgtggtggcatgcatctgcagtcctggctactcagaaggctgaggtgggaggattgcgtgagcccaggagttcaagaccagcctgaacgacrtaaaaagacctatctctacaaaaattagctgggcatggtgtcacgtgcctgtagtcctagctactcgggaggctgaggtgggaggatcgcttgagccccg

SEQ ID NO: 18516 - DNA, 201 bp, Homo sapiens
taatgaaaagtgagtgaatgggctgggtgtggtgggtcacacctgtaatcctggctactcaggaggctgagacaggaggatcgcttgagcccaggaggtcraggctgcagtagggtatgagcgggccactgcacttcagcctgggcaacagagcgagaccttctgtctaaaaatatttatctatattgagtgaataaatga

SEQ ID NO: 18517 - DNA, 201 bp, Homo sapiens
cacaggtcaaacatcctgagcctgttctgtggtcagttactcattagcagcctctgctctaggaggaatagttatgggtcctttcagacatgcaacccccmaaactccatgttgtttacagtgtgggacacctgactttcaccttttatgatacctgcctggggcatgcatgtggtgactttttccatctctggtctctat

SEQ ID NO: 18518 - DNA, 201 bp, Homo sapiens
ggtcaggcagctgtttgacaggattcttgcaaatgtttttggtttctctgtctactcattacgtacactctgccagaggttgaaaactcaatgttgagatyacatacatcctgaaaacactgtttaaataaaattttggcctgcatcctgtttttgaaaacttgcaatggcttgccaacgttttcaagttgagaagtttca

SEQ ID NO: 18519 - DNA, 201 bp, Homo sapiens
gttttcgagactgagtcttgctctgtcgcccaggatggagtacagcagtgcaatctcggctcactgcagcctccaactcccggctccagtgattctcctgyctcagtctcccaagtagctgggattacagggatgcgccaccatgcccagctaattttttgtatttttagtagagacggggtttcaccatgttggccaggc

SEQ ID NO: 18520 - DNA, 201 bp, Homo sapiens
ttaaaaaaaataaattaaatttttaaaaacatgactttctggccaggcgcagtggctcatgcctataaccctgcacttagagagggcaagacagaaggatygcttgaggccaggagtttgagaccagcctgggcaacatagcgagaccttgtctgtactaaaaaattattaaaagaaaatatatatatttttttaaatcat

SEQ ID NO: 18521 - DNA, 201 bp, Homo sapiens
caggagccagaagtttggatgtgcaatgtgaaatctcacaaattaaacatgttacataactgtattttgtttcctatctctgctgtaataaattttctcawtgttagtgacttagaaccacacaaaagttacactttacagttttggaggtcagtggtccaaaataggtctcagtgggctaaaatcgatgtgtcagcagga

SEQ ID NO: 18522 - DNA, 201 bp, Homo sapiens
ttgtttgtaagaatcagttgaggacagatgggactatttgcatggattggtgtcatgtttgaagtcagttaccagagggtttctttcaacagagtataccmaaaaaaaaaaaaaaaaaaaaaaaaaaaaagtaaattgcacagaccccagcttaggacctggacttaatcttcatgatgtttgtaaagtaatacttcttgg

SEQ ID NO: 18523 - DNA, 201 bp, Homo sapiens
acttagaaccacacaaaagttacactttacagttttggaggtcagtggtccaaaataggtctcagtgggctaaaatcgatgtgtcagcaggacaccatttytttctgtaggttctagaagagaacccacttccttgctgtttccagcttccagggactgcccaaatcctttggctcatggccccttcctctatcttcaaag

SEQ ID NO: 18524 - DNA, 201 bp, Homo sapiens
agcaatttacaaaattgcacatactctataaatacacttctgttataaaaatagacacgtacggccgggcgcggtggctcacgcctgtaatcccagcactytgggaggccgaggcgggcggatcacgaggtcaggagatcgagaccatcccggctaaaacggtgaaaccccgtctctactaaaaatacaaaaaattagccg

SEQ ID NO: 18525 - DNA, 201 bp, Homo sapiens
cccaaatcctttggctcatggccccttcctctatcttcaaagccagggatggctgctcaagtccttctcaaactgccctgttcctggttctctctcttctkcttctgcttttaaggaaccttgtaacttcagggagtctaccctgataatctgcgataatctgcctatttgaaggtcagccaattagcaatcttaatgcca

SEQ ID NO: 18526 - DNA, 201 bp, Homo sapiens
aaactcctgagggatgctcaggaaaccaaaaaggatgtctgcatggaggacaagaaggcacaaatcgtctgatttcaccccatcctaagatcttgtgactycagctttgttttggactggggcattggatctcccacatgccctctcttaagtcgtgcatttgacgcatatttaataagcacctactgtgtgccattagag

SEQ ID NO: 18527 - DNA, 201 bp, Homo sapiens
ccgctgatctgcatagcacttcgcaatgaagctgtgctctagaaacataccacgatctactggactttcttaaataaggtggttgttcaggaaattcctcyagttaattttactttaattccccctacaagaatgccgagacacctctgcctattttctctttctgtgtttgttgtttcttttgtttttgttttcgagact

SEQ ID NO: 18528 - DNA, 201 bp, Homo sapiens
tgctcaagtccttctcaaactgccctgttcctggttctctctcttctgcttctgcttttaaggaaccttgtaacttcagggagtctaccctgataatctgsgataatctgcctatttgaaggtcagccaattagcaatcttaatgccatctacaaccttaattaccatttgctatgtaacatatttatagatatcagggat

SEQ ID NO: 18529 - DNA, 201 bp, Homo sapiens
cctaaggtattgctgtcctcaccgtcctatggggagataggtcactttcccaagtctgggcagccagcagcagggctaagatcaccactcagaccctgtgwttttatttttcatctcctcacatctggcgctgaatgtcaggaccttcctggcctctgggaaagacacaggatggctgttttgagaggagtgtgaaataca

SEQ ID NO: 18530 - DNA, 201 bp, Homo sapiens
ctcaaactgccctgttcctggttctctctcttctgcttctgcttttaaggaaccttgtaacttcagggagtctaccctgataatctgcgataatctgcctrtttgaaggtcagccaattagcaatcttaatgccatctacaaccttaattaccatttgctatgtaacatatttatagatatcagggattagttcatgaaca

SEQ ID NO: 18531 - DNA, 201 bp, Homo sapiens
ttgaaggtcagccaattagcaatcttaatgccatctacaaccttaattaccatttgctatgtaacatatttatagatatcagggattagttcatgaacatmttggggtagagggcattccacatacagcagtacctataatgtatatgcttcttaaagaatgcatgagtcttatttattttatgtccttggagtgtatagc

SEQ ID NO: 18532 - DNA, 201 bp, Homo sapiens
ctcaaatttctggctggtacaccctgggtaaggtccacaggctggatgggttttggaacatgtcttgattgtactttttcctcttggtttggaaagcaacrtaccctaggtaaggagagatttctgacaacagctcagcaatcacagtttccagaaaatggctccagtggatcaactatgagttaagtaaaaaaaaagtca

SEQ ID NO: 18533 - DNA, 201 bp, Homo sapiens
cactttgggaggccgaggcaggaggatcacttgagcctgggagttggaaaccagcccaggcaacatagtgagacctcatctctttaaaaaaaaaaaaaaaagaaagaaaaattagctggcatggtggcacatgcctgtagtcccagcttctggggatgctgcagcgagccatgattgtgccactgctctctggcctgggca

SEQ ID NO: 18534 - DNA, 201 bp, Homo sapiens
gccaggggtggtggtgcatgcctataatcccaacacttttggaggccaaggtgaggagaccacctgaggtcaggaattcaagactactgggcaacatggtraagctctgtctatcctaaaaatgcaaaaattagccgggagtggtggtgcatgtctgtagtcacagctacttgggaggctgaggcaggcgaactgcttgaa

SEQ ID NO: 18535 - DNA, 201 bp, Homo sapiens
gggcttagcttgggtatcatcgtggttattccaagcagtcttccagctggactagcttttcgggaacacgtgtgtgtttgtgctggaagccccagtaatatcatttaattcgaaagcttttttctatgatgaattattcaggcagtgtttaccaaaattgtcattgatcagtacagacccagagagcatgtacaacagcgc

SEQ ID NO: 18536 - DNA, 201 bp, Homo sapiens
tggtggtgcatgcctataatcccaacacttttggaggccaaggtgaggagaccacctgaggtcaggaattcaagactactgggcaacatggtgaagctctstctatcctaaaaatgcaaaaattagccgggagtggtggtgcatgtctgtagtcacagctacttgggaggctgaggcaggcgaactgcttgaacctgggag

SEQ ID NO: 18537 - DNA, 201 bp, Homo sapiens
ggaggagactttgactctagatgacatgatgtaccctgtgttctgcaagctggagaacatcatgtagaatctgaaaattaggagagagaggcaatcagaaraagacagagtggtgttgcagggacctgcagtcagcctagtcccccagtttgcgtttgaatttggtcccagattttttttgtttttgttttttagtagtta

SEQ ID NO: 18538 - DNA, 201 bp, Homo sapiens
ggtgccattttcctgactgtagatacttgggtaaggaggagactttgactctagatgacatgatgtaccctgtgttctgcaagctggagaacatcatgtaraatctgaaaattaggagagagaggcaatcagaagaagacagagtggtgttgcagggacctgcagtcagcctagtcccccagtttgcgtttgaatttggtc

SEQ ID NO: 18539 - DNA, 201 bp, Homo sapiens
aagcacgggggtttatgtgatggctccacagagcagtgaaaagactcccgccctactgctcgcaacctcagatgtccctgggcactagcccatctgtatgkctttaaaaaaaataaattaaatttttaaaaacatgactttctggccaggcgcagtggctcatgcctataaccctgcacttagagagggcaagacagaagg

SEQ ID NO: 18540 - DNA, 201 bp, Homo sapiens
gtcaggagatcgagaccatcccggctaaaacggtgaaaccccgtctctactaaaaatacaaaaaattagccgggcgtagtggcgggcacctgtagtcccarctacttgggaggctgaggcaggagaatggcgtgaacccgggaggcggagcttgcagtgagccgagagcccgccactgcactccagcctgggcgacagagc

SEQ ID NO: 18541 - DNA, 201 bp, Homo sapiens
gtgaggtgagatcagtagaagagtacaataaaacaggaattttcagagcatgtaatttcttcttggaagtgaaaggcactggagaatggtgcagaataagyactagccttagagagaggatgccctgccccagtctctttctctgagtagcagagagctggctgtgctaggaaactcttcgcctctctaacaccacgttta

SEQ ID NO: 18542 - DNA, 201 bp, Homo sapiens
ttctatggattttcactaaaatagaatcatcgccttggtgatggatagaaaaagtaaagcaatacatcctgataaatgctgtgccttcctccttcgtctcyctggcggtgaccttgtgcaatccataagagggcaaggctgagagccccggccaccgccgccgtgtgtcagaacttggaaatttaagtagctttgaaaccc

SEQ ID NO: 18543 - DNA, 201 bp, Homo sapiens
gatagcatgagactgtgtctcaaaaattaaaaaataaaacataaataaatttctattgttttaagacaatttgcctgtggccctaggaaaccagtatagayaacttgtgatggtttagcttatttagtacaacaaccctgccccttctagtttttatgataacctcattaattgccggtactctcagagccctgattttct

SEQ ID NO: 18544 - DNA, 201 bp, Homo sapiens
gggaggctgaggcaggtggatcacttcaacccaggagttcgagaccagcctgggcaacaaggcgagaccccgtctctacaaaaaataccaaaaaatgagcygggtgtggtggggcatgcctgtagtcccagctacttgggaggctgggatggaagcatcatttgagcctgggaggtggaggttgccgtcagctgagattgt

SEQ ID NO: 18545 - DNA, 201 bp, Homo sapiens
aacagagcctgcaagcatttctcctgcagaacccccagaagggactcagcctgcagacactcagatttcaaacctctggcttcctgaactgtgaaagaatraattgctgttgggccaggtacagtggctcatgcctgtaatcccagcactttgggaggctgaggcaggtggatcacttcaacccaggagttcgagaccagc

SEQ ID NO: 18546 - DNA, 201 bp, Homo sapiens
gaagctttacccctgagaagagcaggcatcagatgggctttggaatctacatgggtgtttgtaggtagaccatcctggaagttgagtgatggggaataaarggaagaaagtgcattctgaacagagggaatagcaggtacagcagctcagacatgggcaccttcagagcgtgtctgagtcttcctgatgagacacgtggtg

SEQ ID NO: 18547 - DNA, 201 bp, Homo sapiens
gacagcagggggtgaggataagaaggaggaagctttacccctgagaagagcaggcatcagatgggctttggaatctacatgggtgtttgtaggtagaccaycctggaagttgagtgatggggaataaaaggaagaaagtgcattctgaacagagggaatagcaggtacagcagctcagacatgggcaccttcagagcgtgt

SEQ ID NO: 18548 - DNA, 201 bp, Homo sapiens
gtgttaatcttacacctacccattagtctataaaactcctgagggatgctcaggaaaccaaaaaggatgtctgcatggaggacaagaaggcacaaatcgtytgatttcaccccatcctaagatcttgtgacttcagctttgttttggactggggcattggatctcccacatgccctctcttaagtcgtgcatttgacgcat

SEQ ID NO: 18549 - DNA, 201 bp, Homo sapiens
tcaggtgggactcatggagattttccgttctttggagactagcagcgactgcagattactcatcagctgtctccttgagtccacaatgccgggcggtggaygggcttcctgcctcctggcccagggcccctttgccggctcttagtgtagagcactagttgtaccatctggtagttgtttgtgcctgcgactctcttccct

SEQ ID NO: 18550 - DNA, 201 bp, Homo sapiens
ctgtagtcacagctacttgggaggctgaggcaggcgaactgcttgaacctgggaggtggaggttgcagtgagctgagatggagccactgcactccagcctrggtcacagagggagactctgtctcaaaagaaaagaaaagtagagaggatagtataatgaggttcctgtctgccagtcactctatagtaactattaggaaa

SEQ ID NO: 18551 - DNA, 201 bp, Homo sapiens
gggagggaagaaccctatgggcagaaatgtgactttctgtagcaaagatgtactgtttcccactgagaagaatcaaaaatagaaaagtgcttccttgtctytctatattgttattaaaacaagtagatgcattttcattgaatcaaggcagttttcctttataaaatgtcctatttcatatcactgttcaaacttgacatc

SEQ ID NO: 18552 - DNA, 201 bp, Homo sapiens
ttacaggatacctagggacctgttggggtgggagggaagaaccctatgggcagaaatgtgactttctgtagcaaagatgtactgtttcccactgagaagawtcaaaaatagaaaagtgcttccttgtctctctatattgttattaaaacaagtagatgcattttcattgaatcaaggcagttttcctttataaaatgtcct

SEQ ID NO: 18553 - DNA, 201 bp, Homo sapiens
atctgtaaagtaaaaataaccgtcgtcgtcatttctcaagcgtgacgatactgttacacgtttactgcatattctgcataccaagcacatatccgtcacaygcagtgtggccaacttccgagaggccggcattcagccaaacagcctgaagaaccaggagaaatgcctgagtttccaaatggcttatggtaagttgttgct

SEQ ID NO: 18554 - DNA, 201 bp, Homo sapiens
ccagtcactctatagtaactattaggaaacccctttttttctctgaagtcattgctcctgtgtgtgtgtgtctgtatataaaaaaaagtatgtatacatayacgtatatgtatgtgtatagataaaaatgcatgtatggtgctgggcgcagtggctcacgcctgtaatcccagcactttgggaggctgaggcgggcgaatc

SEQ ID NO: 18555 - DNA, 201 bp, Homo sapiens
taaactcccactgtttataagtcacccaaattgttggtattaaattagatgtgtaccatcttatgtctcttctttcagaaaatgaatctctgtttttttttctctttctcctaaatgttaggaattttctgaagtttgaaaccaagtggcacaaaaacattgcatttattacataattgctcctagggaaatacacataca

SEQ ID NO: 18556 - DNA, 201 bp, Homo sapiens
gtgtgtgtgtctgtatataaaaaaaagtatgtatacatatacgtatatgtatgtgtatagataaaaatgcatgtatggtgctgggcgcagtggctcacgcytgtaatcccagcactttgggaggctgaggcgggcgaatcacgaggtcaggagatcgagaccatcctggctaacacggtgaaaccgtgtctctactaaaag

SEQ ID NO: 18557 - DNA, 201 bp, Homo sapiens
tgctgggcgcagtggctcacgcctgtaatcccagcactttgggaggctgaggcgggcgaatcacgaggtcaggagatcgagaccatcctggctaacacggygaaaccgtgtctctactaaaagtacaaaaaattagcctggcgtggtggcgggcacctgtagtcccagctactcgggaggctgagaccgaagaattacttg

SEQ ID NO: 18558 - DNA, 201 bp, Homo sapiens
actaccttgcttgcctatgggacatgttcccatttcagtgcatacttgacctttaccataaatcacatatttgtaaactgtaccctcctgctgttttattrggcatggagaagcagtcttttctttttcttgatggcctgggttgaccagatcctgacttttgtggagacattaaagtgctagaaatgataatggtgaaag

SEQ ID NO: 18559 - DNA, 201 bp, Homo sapiens
tggctaacacggtgaaaccgtgtctctactaaaagtacaaaaaattagcctggcgtggtggcgggcacctgtagtcccagctactcgggaggctgagaccsaagaattacttgatgaaacatggcagacgacatagaccagcagcaaactaccaacactgtggaggaccccctggatcttaggctcagcccagaggagcga

SEQ ID NO: 18560 - DNA, 201 bp, Homo sapiens
acaagggccctgacagccttttctggacttgtagtatgtgcaagaattaagctttttctgtatcaagtcaccgtgttatgggggttgttcctcactgcagsagaaccttgttcatccgtattagaacagtgtggtgtttcatgttagcagagtgtatcaggatcttttgtttttttttttttttaaattaaggatgctgta

SEQ ID NO: 18561 - DNA, 201 bp, Homo sapiens
tgtagtcccagctactcgggaggctgagaccgaagaattacttgatgaaacatggcagacgacatagaccagcagcaaactaccaacactgtggaggaccycctggatcttaggctcagcccagaggagcgaatttgtgtgaaaatgagaaacgaccgagagcttcgaggcagattacatacttatgatcaacatttaaat

SEQ ID NO: 18562 - DNA, 201 bp, Homo sapiens
tactatagaaattgatgaggaaacatatgaagagacatatgaatcaacaaaacagaatattccagtgttctttctccggggagatggcattttcctggttscccctccactgagagttggctgaaacaaagaatttgtcctgtatggaaaacaggagactttgtacagtggcctctctaaatgtgcaagatattcaaaaga

SEQ ID NO: 18563 - DNA, 201 bp, Homo sapiens
aactctctcattgccttcagagagttggtgattttggggggggcaccagtgtgagtcctttgatccttgaatgacaatttggatttgtctcaaggtcctgmtaaatgggaactggaggaactggcctactatggtattacaggctagcacatggtttgcattctgagggagctcagaataggcaaggtagaagacataggt

SEQ ID NO: 18564 - DNA, 201 bp, Homo sapiens
agccaagggatggctcagaagggtgaaggaactcacccgaattgcacagctggtgagctcagagtcaggctccttgcttggtccatctggcttccaaactscaagtctgtctgctccaccccatggcccatctttttaccatgtttagtatcaatgttcatactttgcagattttgctttcaaactctctagctgcggttt

SEQ ID NO: 18565 - DNA, 201 bp, Homo sapiens
tatatttcctgtggctgagctgagccgcacttggagatttgatccattttaactctctcattgccttcagagagttggtgattttggggggggcaccagtktgagtcctttgatccttgaatgacaatttggatttgtctcaaggtcctgataaatgggaactggaggaactggcctactatggtattacaggctagcaca

SEQ ID NO: 18566 - DNA, 201 bp, Homo sapiens
gattttttttttcataaaaccagtctaaaaaagccatgggttattttgtcatggcacgttttgatatgaatatttccacccccattatttgcataacaaaktacagattatccagaacaggtgggctgtacataaacaggctggtgggctggatttgtcctgtggactgtagtttgctgacatccaggctagatccttaat

SEQ ID NO: 18567 - DNA, 201 bp, Homo sapiens
acgaggtcaggagatcgagaccatcccggctaaaacggtgaaaccccgtctctactaaaaatacaaaaaattagccgggcgtagtggcgggcacctgtagkcccagctacttgggaggctgaggcaggagaatggcgtgaacccgggaggcggagcttgcagtgagccgagagcccgccactgcactccagcctgggcgac

SEQ ID NO: 18568 - DNA, 201 bp, Homo sapiens
attcatatatttaggtatagttagaaaaagcaaaatggtaacaatagaatcttgatgggattgatctcctgcagcaaggagcaacagaaaaaaaaaaaaakggaatcaagaacccaggtgctttttataggttaattgtgcagggttatcatgtatctctttaaaatcaccatcttgattctgagctttggttctacacat

SEQ ID NO: 18569 - DNA, 201 bp, Homo sapiens
caaatcagacaccaacataaactgtagagttaacattctttttccaccctcacactttttttagctccgatctgtgttcaatttctgcctgagagagtgawatattcatatatttaggtatagttagaaaaagcaaaatggtaacaatagaatcttgatgggattgatctcctgcagcaaggagcaacagaaaaaaaaaaa

SEQ ID NO: 18570 - DNA, 201 bp, Homo sapiens
tcttacacgttttacgggctatcagtagatgcatctaataatcctaacactgtcatccttatacttgaggtcttattgtccacttctaccttagctatgtwaacagatgagtaacctactctggatttacccagatagtgctgttaggcaccacacacgatgagattggaggcacctgggtgtcagcctcttgggctggct

SEQ ID NO: 18571 - DNA, 201 bp, Homo sapiens
ctggagtgacagagtgtgtcaagcctgcagctcgtcccgtgtctaatggaacagaaacaagcaccctgctgcccttgttttccagtggctcaccggggctytgcgaggtttattaatcttagcgtataatggaaaatgtgttgccatgtgaaatctagagcctctgttcactactccgcgaattgaaggcggcaggagtct

SEQ ID NO: 18572 - DNA, 201 bp, Homo sapiens
ctgtgtgtcaccttctctctgagctcaccctctctaggaagccttccttgctggaatgcccattccctgatataaggattccacccaccacgccccttgcrgttccttgccggtgtcctgtcctgggcagacataagccctgtgggttccagtttctcattaggaacctggatgatggagcagggatcatgctcattaagt

SEQ ID NO: 18573 - DNA, 201 bp, Homo sapiens
ccagccagggtggtctcgaggaggcccattaccggctggagtgacagagtgtgtcaagcctgcagctcgtcccgtgtctaatggaacagaaacaagcaccytgctgcccttgttttccagtggctcaccggggctctgcgaggtttattaatcttagcgtataatggaaaatgtgttgccatgtgaaatctagagcctctg

SEQ ID NO: 18574 - DNA, 201 bp, Homo sapiens
attagcatcaccctgctgtgcctcagtgtttccatctataaactgggtataataatcattcctaccccataggttgctgtgaagattggctcacatcagtmatgtacttggaatggatcctggcataaaaagagcccttggaaaatgatagcgttcatccttggtatgacctccaagttctttgaacctcaaagagccaag

SEQ ID NO: 18575 - DNA, 201 bp, Homo sapiens
acacaggctggagtgcaatggtgcaatctcagctcactgcaatgtctgcctcccagattcaagcaattttcctgcctcaggctcccaagtagctgggattrcaggcacccaccaccacacccaactaatttttgtgtttttagtagagacagggtttcaccatattggccagactgctcttgaattcctaacttcaggtga

SEQ ID NO: 18576 - DNA, 201 bp, Homo sapiens
agtgggagaacatggtatcagaaccaggagagggtcctctggctttctgagttctgccaaaaaccaagttttgctgccttgggcctgtggcttctcctccytgattgtcgctggccttgctgtaaattgtgaggcatccatgtgaggcacaggatggttccaaggaccaactgaggctgtctgtgctgaggctgggagggt

SEQ ID NO: 18577 - DNA, 201 bp, Homo sapiens
ttcagtgacatgccatcagatttgttccatgtagaaggacgacactatcagttagatgcttattttgttggcaaatttctatggcacttctgcttggccayttcaaaccaaccatggaagaatagataccccaatgcgatgtttcatccctattcataaagaaactgtactttgagcaatgtaggtatcccaggcagcatc

SEQ ID NO: 18578 - DNA, 201 bp, Homo sapiens
atttcagtgacatgccatcagatttgttccatgtagaaggacgacactatcagttagatgcttattttgttggcaaatttctatggcacttctgcttggcyacttcaaaccaaccatggaagaatagataccccaatgcgatgtttcatccctattcataaagaaactgtactttgagcaatgtaggtatcccaggcagca

SEQ ID NO: 18579 - DNA, 201 bp, Homo sapiens
taaaaatgtaaaatgtttcaaataaacacacactaaatatcttcttttatatcttataaacacccagcagtcctttagcacgggcatcaaggtggcccagytggaaaatttcagtgacatgccatcagatttgttccatgtagaaggacgacactatcagttagatgcttattttgttggcaaatttctatggcacttctg

SEQ ID NO: 18580 - DNA, 201 bp, Homo sapiens
gcatagaatgtttatatggtggccaaaaaagcagattggtatcatgctttatgtgtgttcattctagtcctgcacgtgtagaaatgtaagattttaatgtrtggtaaggtagatagatagatacatacatacatacatacatacatacatacatacatataaaattaggtaagaggatacttttaatgtatggtaagctat

SEQ ID NO: 18581 - DNA, 201 bp, Homo sapiens
ggtgcccgccaccaggcctggctaattttttttgtattattagtagagatggggtttcaccgtgttagccaggatggtcttgatctcctgtccttgtggtycgtctgcctcggcctcccaaagtgctaagattacaggcacgagtctccgcacccggccctgtttttgcatttttagtagagacgggttttcaccaggttg

SEQ ID NO: 18582 - DNA, 201 bp, Homo sapiens
caaaaaagcagattggtatcatgctttatgtgtgttcattctagtcctgcacgtgtagaaatgtaagattttaatgtatggtaaggtagatagatagatasatacatacatacatacatacatacatacatacatataaaattaggtaagaggatacttttaatgtatggtaagctatgattgcaccactgcattctagcc

SEQ ID NO: 18583 - DNA, 201 bp, Homo sapiens
gtatagtagtgggagaacatggtatcagaaccaggagagggtcctctggctttctgagttctgccaaaaaccaagttttgctgccttgggcctgtggcttytcctccctgattgtcgctggccttgctgtaaattgtgaggcatccatgtgaggcacaggatggttccaaggaccaactgaggctgtctgtgctgaggctg

SEQ ID NO: 18584 - DNA, 201 bp, Homo sapiens
gtcgcttgaacttgggaggcagaggttgccgtgagctgagatcatgtcattgtactccagcctgggcaacaacagcaaaactctgtctcaaaaaaaaaaaagaagaagaagaagtaattcctaacagtctggaatctctagggtctctggtattatcctttagtttaagcctcacatttttctaaacattttgaaatctgg

SEQ ID NO: 18585 - DNA, 201 bp, Homo sapiens
agtgattcagaaaatagcaagtatagtagtgggagaacatggtatcagaaccaggagagggtcctctggctttctgagttctgccaaaaaccaagttttgytgccttgggcctgtggcttctcctccctgattgtcgctggccttgctgtaaattgtgaggcatccatgtgaggcacaggatggttccaaggaccaactga

SEQ ID NO: 18586 - DNA, 201 bp, Homo sapiens
ctgatgtactcttgctggcggtccatctgagagttcacataagtgtgagtgactattttttgacaacactacctttgggagaagatggtttcaaagaactwactgtatcaaatggaaagacaatgtgttttcccaacatgggagtatgtttctaagttgggatcagttcacgattcagagaaatgctctgccttcttgtct

SEQ ID NO: 18587 - DNA, 201 bp, Homo sapiens
tgggggaaaaaaccaatagaataatgttttattacatgtaaaaattgtatgaaattcaaatttcagtgttcataactaaattttaaaaacttttattgaarttccagagagatctgaagtagttttattggaacacagccctacacaccttcatttataagctatctgtggctacttttgcactatgccagcaaagttgag

SEQ ID NO: 18588 - DNA, 201 bp, Homo sapiens
caaacatgtaataccaccctggtcttcaagtccactctcaaaaaaaaaaaaaaatttggcctttggcctcgtgaccaccaaatctgatttccatccaagargcaacattgtttgtgcttagaaggaattcctggctgggcatgatggttcacgcctgtaatcccagcgctttgggaggccgaggcaggcggatcacctaag

SEQ ID NO: 18589 - DNA, 201 bp, Homo sapiens
gtagttttattggaacacagccctacacaccttcatttataagctatctgtggctacttttgcactatgccagcaaagttgagtagttgggatggagactrtatggcccataaagcctaaaatactctctgctcctttccagaaagcttggcaacccctactatcatctccacgtctgcctttgttcttcttatttgtccc

SEQ ID NO: 18590 - DNA, 201 bp, Homo sapiens
taggtagaaatttttatgtcacaggtgggcctaattaaccttgattaatgttctgcaaacccggatagactggagactcagaaagggacgcaaaagctagyctggttcccatgttagtccctgctctgtgagcagctgccacacagtcatgctgatggctcctgcagcagccattctggtttgactgtgctcgtgctgccc

SEQ ID NO: 18591 - DNA, 201 bp, Homo sapiens
agaatccctatggtctcttgagtccaggagtttgagaccagcctgggcaagatagcaaaatactatctctacaaaaaaatgaaaaaaaaaaaaaaaaaaaagcctgtcatagtggtacatgcctatagtcttagctattcaggaggctgaggtgggaggatcgcttgagcccaggaatttgaggttgcagtgagctatcat

SEQ ID NO: 18592 - DNA, 201 bp, Homo sapiens
tcccaattagtttcttcatgccataaggacaaaatccacatctcatactttttcaggatctgctctcacttccccaaacatgtaataccaccctggtcttmaagtccactctcaaaaaaaaaaaaaaatttggcctttggcctcgtgaccaccaaatctgatttccatccaagaggcaacattgtttgtgcttagaaggaa

SEQ ID NO: 18593 - DNA, 201 bp, Homo sapiens
tgtggagtatgcatttaattcacatttacaaattggtttctgtttttaactaaaggtactttttcagcagaaatgatgtgtatgatgtcatatctaacttktgatctcactggtatttgatgttaagcctcaaaatcatcaaattttttttacggcactgaaaaaaatacataaatctgcttgattggttcatagaaaaag

SEQ ID NO: 18594 - DNA, 201 bp, Homo sapiens
ggcaggagaatccctatggtctcttgagtccaggagtttgagaccagcctgggcaagatagcaaaatactatctctacaaaaaaatgaaaaaaaaaaaaaraaaaaagcctgtcatagtggtacatgcctatagtcttagctattcaggaggctgaggtgggaggatcgcttgagcccaggaatttgaggttgcagtgagc

SEQ ID NO: 18595 - DNA, 201 bp, Homo sapiens
tttctaaaactttaagtttcagggtacatgtgtaagatgtgcaagtttgttacataggtaatcatctgccacggtggtttgctgcagagatcaacttatcrcctggatatgaagcccagcgtccattagctgttgttgctgatgctcttcccaccacctgcaagccccagtgtgtgttatccgcctccaccgtgtgtccat

SEQ ID NO: 18596 - DNA, 201 bp, Homo sapiens
atgcctttgtgtgtcctctcatggcagagagaggaaggggtctggaacctttctcttataaggatactaatcccatcgtaccccgtcccccatgatctcawttgaaattagtcacctcccaaagccccacctccaagtactgtcacactggggcatagggcttcagcatatgaatttgggggagctggggagaggaacaca

SEQ ID NO: 18597 - DNA, 201 bp, Homo sapiens
catagactgggcaggttaaacagcagacctctattcctcacagtctagaggctgggaagtccaaggtgaagccatgggcacattctgtgcctgcctgaggstctctttctggttcccagatggatgcctttgtgtgtcctctcatggcagagagaggaaggggtctggaacctttctcttataaggatactaatcccatcg

SEQ ID NO: 18598 - DNA, 201 bp, Homo sapiens
gcattacctggggctccctctggaaagaaaatggtggagaggttactggcctgatgacccagggacccaggcagtccttacagggacccagaatttcacawgcaaatgtgacctccaattaaagctggacttgattaaccccatttcccctcaaaagatgatacttgtaatgccgttccgatgaggccgtctcactccgta

SEQ ID NO: 18599 - DNA, 201 bp, Homo sapiens
tgtggaaaagggacatggcccagggaaccagagtggtttgggaaagcactttgtcaagaggcttggggaccccagggtggaagctgccatgcgcatgaggytgtgttagcagaggcagtggcagaagaagacattgcaaacctgcaaaagcaacctctgaggatgggtagacatatacttcattgcaggcagctgctgctg

SEQ ID NO: 18600 - DNA, 201 bp, Homo sapiens
catcttacaaatgaatcaatatttagtggtttgaaaatatgttgtttaatttggggcgattcaatatcaaattaagatttttaggtttatttatcgatctytagaattacatcaacattaagctaattactttaaattgtgtttttaagtaaccaagaatacatctgtggacgctgttctgtgccatcttgagtcacgttt

SEQ ID NO: 18601 - DNA, 201 bp, Homo sapiens
taaaacgtggatgttccaatttatgtatagccgcataatacattaccccaaaacttagaggcttaaaacaacaaccattttgttttatcttgtgatttctstaagttagggctcagtggagtgactcttctgccccttgtggtgttgactggggtcagtcagtggtgctatgctggaggatgaattggactggcacttcag

SEQ ID NO: 18602 - DNA, 201 bp, Homo sapiens
tggatgttccaatttatgtatagccgcataatacattaccccaaaacttagaggcttaaaacaacaaccattttgttttatcttgtgatttctctaagttrgggctcagtggagtgactcttctgccccttgtggtgttgactggggtcagtcagtggtgctatgctggaggatgaattggactggcacttcagctggtcc

SEQ ID NO: 18603 - DNA, 201 bp, Homo sapiens
atgaattggactggcacttcagctggtccaggatggtcacccatgggtctggcactttcacgaggatgactgggatgcttggctcagctgagggactcttrcccagagccctacacatggcctttcctgcatggcagatatagggccatcagatttcttacatggtggctcagggctcccagaggattccaaaagaaagta

SEQ ID NO: 18604 - DNA, 201 bp, Homo sapiens
gtgtagctccaattgccttcatccttagaagacctttaatgatatcctatgccaaacttcctagcctccacctgtaccctgaattggccctagcctagttktccaaactttatccccaggtggttgaactttctaagtttccccaagctgatcagtgttttggggtggtatggaactcagaatagatcactttttttattg

SEQ ID NO: 18605 - DNA, 201 bp, Homo sapiens
cttctctttgcgtcaccagagaggaagatcccctaagacaaagcattccctgtagtttttagcataactagtactggctcagtaagtatccactggggttsggaatacaactgccctgcctcttgagcagccatgcctgcttccgaggtggtgctgcatgctattcaggaggacagaccatggatgggaatcctgagccac

SEQ ID NO: 18606 - DNA, 201 bp, Homo sapiens
tggaccctctgatgttgacaacatgatgtcaaagatggtgtttgctgttgtttcaaatgtcttatttcaaattcccaattagtttcttcatgccataaggrcaaaatccacatctcatactttttcaggatctgctctcacttccccaaacatgtaataccaccctggtcttcaagtccactctcaaaaaaaaaaaaaaat

SEQ ID NO: 18607 - DNA, 201 bp, Homo sapiens
gcactttttctgtttttgatgggatttatcacttgaaaatgcatattatagtaatttctgaattcatcctgattctcctactggtttctaaactcttcagkttagaattcctgttggatatccctctggcccgaaattcctgaatgagttaagcaggacacctagaactatgcagaggtaataccttccttgacctgtccc

SEQ ID NO: 18608 - DNA, 201 bp, Homo sapiens
ggtttagaaataggtatgtgacccagttctgaccaatggatatggagggtgcttatgaggaaggtttcctactcctaaaagagatacacaggaagagagamcttctgcttcctctggacactggcgcagcctggactagcagttgccagcttgggtttggacaacctccgaccttagttgaaaatgaccctgtgtaggaca

SEQ ID NO: 18609 - DNA, 201 bp, Homo sapiens
gggcaaggagctcatctttcacggtcatagacctcagttgcaacatctggaaaaagagctggttgggcatgccgggcaggcttttgtgacaatgtaagagsaagtgaagattgcatctcagtatgagacaccgtaagagcttgataaatggtggaccctctgatgttgacaacatgatgtcaaagatggtgtttgctgttg

SEQ ID NO: 18610 - DNA, 201 bp, Homo sapiens
tgatgggatttatcacttgaaaatgcatattatagtaatttctgaattcatcctgattctcctactggtttctaaactcttcaggttagaattcctgttgratatccctctggcccgaaattcctgaatgagttaagcaggacacctagaactatgcagaggtaataccttccttgacctgtcccttttctgggtcagttt

SEQ ID NO: 18611 - DNA, 201 bp, Homo sapiens
tttgagaaacatggatgtaaatctgattttcagcatctgggaaactttttttgtaagagcctttttctgggccccacttccagagggtttttctttttttkttttcttttgagacggagtcttgctctgtcgcccaggctggagtgcagcggcgcgatctcggctcactgcaacctccgcctcccgggttcacgccattct

SEQ ID NO: 18612 - DNA, 201 bp, Homo sapiens
catgtaaatgaattgtattttatgtaaccattccctagtgttggatagctaggccatttataatttggacactattttaaaaaataactcaggcttatttwactatttatttttgccttacactttttgtaaaagtaatcagagcagtaataatagatgactccccaaaatccttttgcctctaatgattagtctaagccc

SEQ ID NO: 18613 - DNA, 201 bp, Homo sapiens
aggtcttgtgtacccaccgatcgcaattgagcatatagtacatgctgtcctgtgtacccactgatccctggtcctgcccctggtatgagggtattaacatyttgcattagtgtggcacatttgctacaattaataaaccaatatcgatacattattaactagtctatagtttacatgaggggctgctgcttgtgttgtaca

SEQ ID NO: 18614 - DNA, 201 bp, Homo sapiens
cttgaaaatgcatattatagtaatttctgaattcatcctgattctcctactggtttctaaactcttcaggttagaattcctgttggatatccctctggccygaaattcctgaatgagttaagcaggacacctagaactatgcagaggtaataccttccttgacctgtcccttttctgggtcagtttgcccttcatgatttc

SEQ ID NO: 18615 - DNA, 201 bp, Homo sapiens
ctgtaatcccagctactcgggagcctgaggcaggagaatcacttgaacccgggaggtggaggttgcagcgagtcaaggtcacgccagtgtactccagcctsggtgacagagcgagactccgtctcaaaaaaaaaaaaaaaaagaaaaagaaaaagaaaaaggtgtttggaagccatgtcccatgaattccaaatacaattg

SEQ ID NO: 18616 - DNA, 201 bp, Homo sapiens
cctgacaatgttagtgaagttgcttgcttgaaatttaccaggccaggcttatggctgtaatcccagaaactcaagaagctgaggcaggagaatccctatgrtctcttgagtccaggagtttgagaccagcctgggcaagatagcaaaatactatctctacaaaaaaatgaaaaaaaaaaaaaaaaaaaagcctgtcatagt

SEQ ID NO: 18617 - DNA, 201 bp, Homo sapiens
agacatagaaattcttgggctttattccacacataatgaatcagaagcttatggggtggggcctgcagtctgacgtttattttttctaaaactttaagttycagggtacatgtgtaagatgtgcaagtttgttacataggtaatcatctgccacggtggtttgctgcagagatcaacttatcacctggatatgaagcccag

SEQ ID NO: 18618 - DNA, 201 bp, Homo sapiens
tctggctctgcagctgaaattgggatcgcatggagaaaatagaaagtccagtgtttgtagctgtgatctctcagttgcttgcatgaattgtgctttaagaytgtaaaattttagcccattaaaaataaaatctgttgctttccacccacacctggcaatttggtgagggacgggggctaggatatttaatgtctgaaagtt

SEQ ID NO: 18619 - DNA, 201 bp, Homo sapiens
tgtgtttttagtagagacggggtttcaccgtgttagccaggatggtctcgatctcctgacctcgtgatcctcccgcctcggcctctcaaagtgctgggatyacaggcgtgagctaccgctcccggccttttttttttttttttttttttttttaaagacagggtctcgctccgtcgcccaaactggagtgccgtggtgcga

SEQ ID NO: 18620 - DNA, 201 bp, Homo sapiens
aagctccgattttcttgttgaatagccgtgtttcctcagcattctgtagatttttggccaggtttgtgtaagggatgaacgactctctataaaatgatgtmaggatcctttctttcctgcccattgccatttctagcattctctccttgagggaagttgcagttttctccctctgtgtattcatccttctgacctgtgctc

SEQ ID NO: 18621 - DNA, 201 bp, Homo sapiens
agtagctggtactacaggtgcctgccaccacgcccggctaattttttatatttttagtagagacagggtttcaccatgttagccactttggtctcaatctmctgacctcgtgattcaactgcctcgccctcccaaagtgctgggattacaggcgtgagccaccgcacccagccgaaaagttataattttaatggtctaaat

SEQ ID NO: 18622 - DNA, 201 bp, Homo sapiens
tcctgacctcgtgatcctcccgcctcggcctctcaaagtgctgggattacaggcgtgagctaccgctcccggcctttttttttttttttttttttttttttaagacagggtctcgctccgtcgcccaaactggagtgccgtggtgcgatctcggctcactgcaacctctgcatgccgagttcaagcgattctcgtgtctca

SEQ ID NO: 18623 - DNA, 201 bp, Homo sapiens
tcttgagcagccatgcctgcttccgaggtggtgctgcatgctattcaggaggacagaccatggatgggaatcctgagccacaactccttagcctcatgacrttgggcagatgactgagcttgtctgagttacaataaataaaaataccatgctgaatgatggcctagcatgacattgggaagtacagactttgcaggcagg

SEQ ID NO: 18624 - DNA, 201 bp, Homo sapiens
actttgaacactttaaatgggtgaattgtatggtatatgaatcatatctcaacaaagctgttaaaaaattgtatgaaaactgtgatgggattcaagtagtstaacgctcaaatttcccaagtgccctcatttaagtctggaccacgacaggaacccagatgtggcctgagtagcacatcgtggaatgggcctgtcacctct

SEQ ID NO: 18625 - DNA, 201 bp, Homo sapiens
tgaacactttaaatgggtgaattgtatggtatatgaatcatatctcaacaaagctgttaaaaaattgtatgaaaactgtgatgggattcaagtagtctaaygctcaaatttcccaagtgccctcatttaagtctggaccacgacaggaacccagatgtggcctgagtagcacatcgtggaatgggcctgtcacctctaccc

SEQ ID NO: 18626 - DNA, 201 bp, Homo sapiens
cggtgttggctctcagttagagactcagatttatccctgcccgaatcattttctttgattctctgcccttccccactacagtgtaaactccatttggactytctctagttcactgtgaatggtttttgaataacatcaattagcataacctcatgcccagcatcgtccttattgttgagagcacagcagtgacaaaggtgc

SEQ ID NO: 18627 - DNA, 201 bp, Homo sapiens
caaaagggagtatgttggttcatgtaccaggaagtcttggagtgatggcttcaggcacggctggatccaggggctcaaaaatataatcagatgatttgttygcttctgtcttttgctatggtggtctctgttttgcttacttctgcagcagattttctctacctggtgggagaaacagctgccagaaaatccagattccca

SEQ ID NO: 18628 - DNA, 201 bp, Homo sapiens
taaagacagtgcctccttccaggacaacggtttggcagatttgcttgataaaggttggggtttgtaagcttggggctcctcagccatgactgaaacgtacyatgagcacggcatctaccgggctgttccacatcctccctgtgggactaggggccagggcaatgggaatcagtgcagaaataaagctcatgctgtttgctc

SEQ ID NO: 18629 - DNA, 201 bp, Homo sapiens
agatctcactcactatggtgaagacagcgccaagccatgagggctccgccccagtgattcaaatacctcccattacggacatgtttcaacatgagatttgrgcggggacaaatatccaaactatatcaggatcccagcagactgggtgggtggaggttcagggatatctgggaaggactaagaatagctttttcttttagt

SEQ ID NO: 18630 - DNA, 201 bp, Homo sapiens
tctcactcactatggtgaagacagcgccaagccatgagggctccgccccagtgattcaaatacctcccattacggacatgtttcaacatgagatttgagcrgggacaaatatccaaactatatcaggatcccagcagactgggtgggtggaggttcagggatatctgggaaggactaagaatagctttttcttttagtaga

SEQ ID NO: 18631 - DNA, 201 bp, Homo sapiens
tagggttcctttttttcaagttaaagcattgagtcatgtctctgataaatcgcccccccaccccgatccccaccctctgccgccccggccttctttttgtrctgttgggttccaaactttacctgaggattttcacatgcacatctgttaaatgccatttaaagagaacactaacaagagaaagctagttcatttttcttc

SEQ ID NO: 18632 - DNA, 201 bp, Homo sapiens
atgaattttccgagactctgttatgacagaaactcaccagttctctgttgttaatcaacaaatagattgtgaatgcttgactcttctttttttttttttttaaaggagtttcaagggtaagatctgctgtcttgtgaatgtcaaagaagtttctcattcgcccctttcttctctctcccagtgtctttaatttgttaatgc

SEQ ID NO: 18633 - DNA, 201 bp, Homo sapiens
tgcaagagtcagcaaagtttctctgtgatgggatatttaataaatattttggggccttgtagtgtttgttgccaactactcaactctgccctcatagtgcraaaacaggcataaacgatatgtaaaggagcaggcatggctgcgagaaactttatttatggatactggaatttgaatttcatatacattttcatgtgtcac

SEQ ID NO: 18634 - DNA, 201 bp, Homo sapiens
tttgtgctgttgggttccaaactttacctgaggattttcacatgcacatctgttaaatgccatttaaagagaacactaacaagagaaagctagttcatttytcttcctgggacctcagtttcctcatcagcagaatcgggatattagtgcagaccttgcaggctctttatgaggatccatcgggagcctcaggcgcacact

SEQ ID NO: 18635 - DNA, 201 bp, Homo sapiens
tttgtgaaaaaggatgaattttccgagactctgttatgacagaaactcaccagttctctgttgttaatcaacaaatagattgtgaatgcttgactcttctctttttttttttttaaaggagtttcaagggtaagatctgctgtcttgtgaatgtcaaagaagtttctcattcgcccctttcttctctctcccagtgtcttt

SEQ ID NO: 18636 - DNA, 201 bp, Homo sapiens
ttctctgtgatgggatatttaataaatattttggggccttgtagtgtttgttgccaactactcaactctgccctcatagtgcaaaaacaggcataaacgayatgtaaaggagcaggcatggctgcgagaaactttatttatggatactggaatttgaatttcatatacattttcatgtgtcacaaaatattattctttccc

SEQ ID NO: 18637 - DNA, 201 bp, Homo sapiens
tgtttgtaacattgaatacttaagacatctgctcagagtctcgcattataaatgaatggaaaggatccaggagggctttattggatgggagccgtgaagtsagcgccgtgtatttcaaagcaggatcttaatcagacattatttatatctataatattttacaaattaaaagcagtagaaatagtcactggaaggaagtca

SEQ ID NO: 18638 - DNA, 201 bp, Homo sapiens
atccactggggttcggaatacaactgccctgcctcttgagcagccatgcctgcttccgaggtggtgctgcatgctattcaggaggacagaccatggatggraatcctgagccacaactccttagcctcatgacgttgggcagatgactgagcttgtctgagttacaataaataaaaataccatgctgaatgatggcctagc

SEQ ID NO: 18639 - DNA, 201 bp, Homo sapiens
acagccgtgtttggcccagcggttatagtttgccaacccctgcttagagtctagctttattcagagcttaaatatgtcatcgaggtcccctctttatttawtcccttagttttgatgatcttttatgggttatattcttcaaagggaaaattctctccgaatggggctgccactggcagacgagcactgtcccatcttggc

SEQ ID NO: 18640 - DNA, 201 bp, Homo sapiens
aacattgaatacttaagacatctgctcagagtctcgcattataaatgaatggaaaggatccaggagggctttattggatgggagccgtgaagtgagcgccrtgtatttcaaagcaggatcttaatcagacattatttatatctataatattttacaaattaaaagcagtagaaatagtcactggaaggaagtcagcaagca

SEQ ID NO: 18641 - DNA, 201 bp, Homo sapiens
gtttaaaaatttgttttagatagaggtttgaatgtcactaattaccaacgtgtagctcctaattggaattaagaagggactagctcctattatcagagatctggtcatcacccttcaagttgactatctccttatgctgattttttttttcttttaaatagcagcacaaatatttaccatctagcagatgtggtaagaatg

SEQ ID NO: 18642 - DNA, 201 bp, Homo sapiens
tagagaaaaggtggcttggctgtttggtttatgtcctaaaaccttatcgtaatgtgattctccttaacagagggattcgtaagcttaggactgatagagawttggcttttctgctgttggattgatagctccttgactgctgaagccattgcccatctgttcaactgttgtattcacgaggaggttagacccctgacccaa

SEQ ID NO: 18643 - DNA, 201 bp, Homo sapiens
ggcctcttgttcttcttcagctgttcctcagacatgccaggtgtgttcctgtctcagacgctttgcctttgctgctccttctgcctggagtattcttccaygtagcaccatgagctgttcttctccaaaaggctttgctcaactgacactttctcagtgaagctgtttctcaccactcactataaaatggcagcctgcctc

SEQ ID NO: 18644 - DNA, 201 bp, Homo sapiens
attcagagcttaaatatgtcatcgaggtcccctctttatttattcccttagttttgatgatcttttatgggttatattcttcaaagggaaaattctctccraatggggctgccactggcagacgagcactgtcccatcttggcttgttcccccagtgacaagaagctgttttccccactacccttggcccaaaagccacag

SEQ ID NO: 18645 - DNA, 201 bp, Homo sapiens
ctattcatgtgttcttgaattaaattttcatggcaagcctaagaggccatgactgtccacattttgcctctgagagacgcaaggcttggaggcaggaaatsactcactgaaggccacagcacaaagtggggacttgagtcccgatctcactgattctaaagtccttgctctccaacctctgtccatctgaaatggaaaagc

SEQ ID NO: 18646 - DNA, 201 bp, Homo sapiens
tcgaggtcccctctttatttattcccttagttttgatgatcttttatgggttatattcttcaaagggaaaattctctccgaatggggctgccactggcagrcgagcactgtcccatcttggcttgttcccccagtgacaagaagctgttttccccactacccttggcccaaaagccacagggagaaccaggattggcctag

SEQ ID NO: 18647 - DNA, 201 bp, Homo sapiens
tttaggcagacacctatccctgaatcagtcatgtccccggatgatgcggttctctgcagcctgggcagtcaaggctggagataattctctgcttctccacrgagtctgagaggccccgttccctaatggaaaaatgaggtccaattttgcaaaaggaggcacctggggaaacattctggacacacaaatctatagcttcta

SEQ ID NO: 18648 - DNA, 201 bp, Homo sapiens
catgtccccggatgatgcggttctctgcagcctgggcagtcaaggctggagataattctctgcttctccacagagtctgagaggccccgttccctaatggwaaaatgaggtccaattttgcaaaaggaggcacctggggaaacattctggacacacaaatctatagcttctaccgtcaatctgctatgatccttttatggt

SEQ ID NO: 18649 - DNA, 201 bp, Homo sapiens
aattttgcaaaaggaggcacctggggaaacattctggacacacaaatctatagcttctaccgtcaatctgctatgatccttttatggttctgacgttgcarttttatttttgcatgtttctagagacatcaggaggggatcttttcgggatgtggcttcagaaaggagcctgttggatggtctcttactagtggtcagcaa

SEQ ID NO: 18650 - DNA, 201 bp, Homo sapiens
ctttgccactcagccccagaggtgcttctgcttccctgcaggcttgccctggagcctggcgctagggccctggggctcccttgctcctgcgtgccccctgygcctgccttcctgctgcctggcctttctcccatctgctttcttcctgagtggcccctggccaggggactcgggtgcatacatggtttccaaacgcctttc

SEQ ID NO: 18651 - DNA, 201 bp, Homo sapiens
cccctgcgcctgccttcctgctgcctggcctttctcccatctgctttcttcctgagtggcccctggccaggggactcgggtgcatacatggtttccaaacrcctttcctccagccctcccgactagtgtcttaaatctcaagctggcctctctggctccgctgttttttttttttttttttttttaatttaatttaacttt

SEQ ID NO: 18652 - DNA, 201 bp, Homo sapiens
tgacagtccacttcattaagtggaggacagtgttttgattgctatttaatctgtttttccttctgtctgttcttggctatatggaattcactttgcctctsttcccgactcttcatatcccttatctcaaggtgagtatcgtcagaatcccggtacatttcaccagccaccttttatagaagcttagaaagatggaggcaa

SEQ ID NO: 18653 - DNA, 201 bp, Homo sapiens
ttaaagcgatagtcctattttctaagtaaaagtccaggcatgtgacttaaaaaagaaaaaaaaaaatgttttctggtcaagtcacatgcctctgaggtttktttttttctttctttcttttctttttttttctttttcccagactcctcatacccctcctaggagacagtgattccctggcttcaccaggcaggctcttgg

SEQ ID NO: 18654 - DNA, 201 bp, Homo sapiens
ctttgggaggccggggtgggcggatcacaaggtcaggagtttgaaaccagcctgaccaaccctgtctctactaaaattatttaaaaaaaaaatagctgggyatggtggcacacgtctgtaatcccagctactcgagtggctgaggcaggagaatcgcttgaacccaggaggtgaaggttgcagtgagctgagatggcgccg

SEQ ID NO: 18655 - DNA, 201 bp, Homo sapiens
gactcgggtgcatacatggtttccaaacgcctttcctccagccctcccgactagtgtcttaaatctcaagctggcctctctggctccgctgtttttttttkttttttttttttaatttaatttaactttaaattccgggatacatgtgcaggatgtgcaggtttgttacataagtaaacctgtgccatggtgacttgctgc

SEQ ID NO: 18656 - DNA, 201 bp, Homo sapiens
ttgcctgtcatctgttgtttttctaatcttctagtaaacatttggaaagtgaaggtttaggcatgtatgtttctcttatgtaggaaggggaaataaggccwtgagattgcatgagttttctttccaagtttgtgcagatctgcacaatgattgaaatatttgcaacctgtagagcagcagggtatttatttggcagcaaac

SEQ ID NO: 18657 - DNA, 201 bp, Homo sapiens
taatcagacattatttatatctataatattttacaaattaaaagcagtagaaatagtcactggaaggaagtcagcaagcaggggtgaaaaaaaaaaaaaakaaaagaacctgaagccgccaagagaggctcactgaccatctctgggggaggaagggtgaagagtagcaaatttaccgtcatcagcaggtgtgtaaatgtt

SEQ ID NO: 18658 - DNA, 201 bp, Homo sapiens
aaaaaaaataaaagaacctgaagccgccaagagaggctcactgaccatctctgggggaggaagggtgaagagtagcaaatttaccgtcatcagcaggtgtstaaatgttccatttacattgaatggcacatgtcataaagtacataccgctgcacatcccaccctctgtttctgtttcaactgcagagcctatttttcttt

SEQ ID NO: 18659 - DNA, 201 bp, Homo sapiens
cctgaagccgccaagagaggctcactgaccatctctgggggaggaagggtgaagagtagcaaatttaccgtcatcagcaggtgtgtaaatgttccatttamattgaatggcacatgtcataaagtacataccgctgcacatcccaccctctgtttctgtttcaactgcagagcctatttttctttcccttccagctcagct

SEQ ID NO: 18660 - DNA, 201 bp, Homo sapiens
ataaagtacataccgctgcacatcccaccctctgtttctgtttcaactgcagagcctatttttctttcccttccagctcagctgccttctcctccctgacytcaggtcacccaagactcccactttatgatttccttttacttttagttcattattctctgtgattcagtggaaacataaaaaatggtttttaattttaat

SEQ ID NO: 18661 - DNA, 201 bp, Homo sapiens
cgtctccccgccttgtaagggctgcctgtcattttattagcgctggagcctcccgaccgaagggctgagtaattgacaaaaactgcaggtaaggcaagagrcccgtaattgattcataagatcccttcctccgatcgcattgaagagttaattatttttcctgcagttgggactcagctgttgtttccactgggattaaac

SEQ ID NO: 18662 - DNA, 201 bp, Homo sapiens
ctccccgccttgtaagggctgcctgtcattttattagcgctggagcctcccgaccgaagggctgagtaattgacaaaaactgcaggtaaggcaagagaccygtaattgattcataagatcccttcctccgatcgcattgaagagttaattatttttcctgcagttgggactcagctgttgtttccactgggattaaacagc

SEQ ID NO: 18663 - DNA, 201 bp, Homo sapiens
agaccctgtctctgaaaaataaaaataaaaaaaaaaattaagttagaagggagggattacgaccctcatgtgtatcaagaaacaagctccatgaagccccrtaggatggctcagcaccagaacgaggtctgactgttaagcaaagtcaagtgcatgatggctgaacattgctgggggaagattttgcaattatgcattgtt

SEQ ID NO: 18664 - DNA, 201 bp, Homo sapiens
ttgtttgctttgctttgccttgtctggtttttcaaagtgctcttttaacaaatgaaagtttaaagcttgagttcaatttgagtaatttgttcccagagaaraagtaaatgaaaagtatttctgggtatttttaatgacacaagtttctgtgctgatatgcgggcaggggttcgggagtgggggcaccagggctcatgagcc

SEQ ID NO: 18665 - DNA, 201 bp, Homo sapiens
gcacacacacacttttaagcatttttgatttatatatccctctgcatattttgtgccttgtgatgtgtttaacgaatgacagtgtctttagtgcattgctrcttggggtttctacactggaagtgtaatccgaggccttggaattggtcaaacaaaactcacttggcaacatttacttagagagcactctgcgagcactct

SEQ ID NO: 18666 - DNA, 201 bp, Homo sapiens
tcaatttgagtaatttgttcccagagaaaaagtaaatgaaaagtatttctgggtatttttaatgacacaagtttctgtgctgatatgcgggcaggggttcrggagtgggggcaccagggctcatgagccgagagcccctgcttcccttggaaaacggaaatttctatctccaactagggaaaaatttgcatgtgtagaatt

SEQ ID NO: 18667 - DNA, 201 bp, Homo sapiens
cacacataattcaaaggtaatgtaacttgccgtgtcggactttagtccattccgttaaatggagaaaaatgactgacgtgaagaatgacttattgattctyggtgggaaaatgacttctgtaatatgggaagtatggtaaaaggaatagcttaattatttagggagcacttttcaaaatgtgcttttacagcagtacaaat

SEQ ID NO: 18668 - DNA, 201 bp, Homo sapiens
cactgtttccagccacgggctatccagggaattggggacagtctgtaatgtatcttgagctaggaccatatccaaattactggcctttccagtttttcttwaaatagtagggtcagtaggtgaccacactcagaagccaagcctgcagcatcagggctgaggagcaaactctttctttggtctgaagcttcaaatatgaac

SEQ ID NO: 18669 - DNA, 201 bp, Homo sapiens
caccagggctcatgagccgagagcccctgcttcccttggaaaacggaaatttctatctccaactagggaaaaatttgcatgtgtagaattttggttttttsttcggcgtgtttatttaatttaacattacctatcctacgattatttcaaggtgattttattactagtcagctttcttttccctagcacaaaactcatgca

SEQ ID NO: 18670 - DNA, 201 bp, Homo sapiens
tttacattatacttaggctggtgttaggatgccgtggctgccaagtttacacaatgcactttctctctctctttcttcttttggtttatgatgtttttcartagtgtcatggaactcacttaatctgatttcatcaagtaaatatatgggaagttgagatgacatatttttatctgacatttgaagaaatattcataaaat

SEQ ID NO: 18671 - DNA, 201 bp, Homo sapiens
tctcaccagactgatggtgccatgagggcaggggcaactcctatcctaaggcgtggcccatagtaaggggtattggttagaagaatgaaagattgaatacrtcaaagtgatgagtacagagctgtctgtcattttcttatctttggcctaacaactgaacacattttatgaaatttgcaaatctgtttccaaacatgtttg

SEQ ID NO: 18672 - DNA, 201 bp, Homo sapiens
actttacattttgagtttcgatttttttttttcacctgggctagtaatacgtggtaggatactctctcacaatgctaggccacagcagcgagctgcagctyccagtgatcacaagggcaaagaatcgatattctaccaggcacggtgttgcctgataaccttgcccagctgtaggctaatgtaagtgttcttttttatatt

SEQ ID NO: 18673 - DNA, 201 bp, Homo sapiens
tgctaaataaggcaggaaattccattaagtttaaatgtgctgcccttaccctaaagtgtttggagggcttcgtagaagagccaaatagattcacacagatyttatttgtagagctgaatgtgcacttcattaaaatactttgtaaggtattcaaggatgggctaggagggtgaggattccaaatcagaatcttcaagccag

SEQ ID NO: 18674 - DNA, 201 bp, Homo sapiens
caaatgaatgaatgtatgagtgggtcaagaacaagattcggccccaaggagatacgcgactttctactttgttttctatttggatttcacacaaaggctckaaggtctcctggtaggccatgctcagaagtctgggttgtcccctgcccaggacaggctcaccctggcctgtgtcctaggtattgtggggccgctgtagga

SEQ ID NO: 18675 - DNA, 201 bp, Homo sapiens
gcagtcagaggcctcaatggtgcctgtgtccacagggctggctgtcctcaccgtgaagtctagatctccctgctaacttacactgtgctcaaaacacacacacacacacacacacacacacacacacacacacacacactggctgtcctcactgtcaactctagatctccctgctaacttacactgtgctcaaaaaacaca

SEQ ID NO: 18676 - DNA, 201 bp, Homo sapiens
tgaaggagaagcaggagttggtataccaatattcccactgtgccagcagagagcgggttatccttactagagagccagagagtcagaacggtttttttttkttttttttttttttttttgagatggagtttcacaattgttgcccaggctggagtgcacgatctcagctcaccgcagcctctgcctgccgggttgaagcaa

SEQ ID NO: 18677 - DNA, 201 bp, Homo sapiens
ttgcccgttgacctccatataagtatctgcatttgctgcatcattcatgacatgtgaggcctttgacaaaccctcctatggtgcagcttcctccgagcagstcctaaggaagtgccagagtcagggctttcctctgcctgaattatcggagctcttggcttaatgtgggagaagagatgaatgatctgtccttctatgaaa

SEQ ID NO: 18678 - DNA, 201 bp, Homo sapiens
atctgatgggtgtatcaggagtttccgcttttgcttcttcctcattttctcttgccactgccatgtaagaagtgccttttgcctaccaccatgtttctgargcctccccagccatgtggaactgtaagtccagttaaacctctttttcttcccagtctcaggtatgtctttatcagcagcgtgaaaacggactaatacagt

SEQ ID NO: 18679 - DNA, 201 bp, Homo sapiens
ttcctacattcaacattgtactctaatatccagtaaagtgaaacaaacaaacaaataaatacacttttttcaagaaaaaataaatatctgtgatctcatcrtttgaccgtcagtattttcatttttgcatgtgccactttaatttccctaggcaacactagctagtggcccacaataagacgtagaaaacaagaccacgta

SEQ ID NO: 18680 - DNA, 201 bp, Homo sapiens
ttcagtgttggatgttcaccgcttctttagggttctaccactcccagtaaatcaagtaataggtttctgttaaaaaccccagtgtgctgatctcagtggcrgccatcttgctttgtaagccttctctagctttatgatgctcccagtatataagacatttccagtgtctagtccaaattagtatttctctaattctcgagt

SEQ ID NO: 18681 - DNA, 201 bp, Homo sapiens
gcctgggtgatagagcgagaccctgtctctgaagatacaagaaggccacatgtggtggttcacccctgtaatcccagcagtctgtgagactgaggcagaargattgcttgagaagtttgagattggcctgggaaatatagcaagatcccaaccctattaaaaaattaaaaatgaaaataaaattttaaagaaaggtatttc

SEQ ID NO: 18682 - DNA, 201 bp, Homo sapiens
acccacagaacactggctcctcatcacctccccaagcccagcccctggcaaccaccattctcccctactttgtctatgaattcgactactcttggtacctyatataagtggaatcacacagtgtgtgatgtgttcttttgtggctgacttatttatgatactggattctcagcatcatgggagttaggactgtctgtcgca

SEQ ID NO: 18683 - DNA, 201 bp, Homo sapiens
ctcccagtatataagacatttccagtgtctagtccaaattagtatttctctaattctcgagtgtctgatctgcctggctagaatgattaaaacaaaaaaayagcaaatcagtttgacagtccacttcattaagtggaggacagtgttttgattgctatttaatctgtttttccttctgtctgttcttggctatatggaatt

SEQ ID NO: 18684 - DNA, 201 bp, Homo sapiens
ttttaaatagttaatccatttaagaagtttcatttaaggtactgttaaaaagaaaaaacacagaacaacacagtgagagcagaaaaggtatcatctcctcyccctcttcttctcttttagaaaccttgctgcgtgatccactgatggtaaatatttcatgtactttgcatatcagcctgagttccttttgtgaagtcaggt

SEQ ID NO: 18685 - DNA, 201 bp, Homo sapiens
taagtgatggctgcttatggccatgccctttcttctgcactttgggtgttttgtctggaattttctctcctttccttttgtgaaaaaggatgaattttccragactctgttatgacagaaactcaccagttctctgttgttaatcaacaaatagattgtgaatgcttgactcttctttttttttttttttaaaggagtttc

SEQ ID NO: 18686 - DNA, 201 bp, Homo sapiens
cccagattgatcttttctggatattgggtcaaccataagatggtacctttccctgtgtaacaaagtcagattctgtgaaacacctgttttttgtatggctyatgagatgaggatgatttttacctttttttttttttttttcccttgagacagtgtcattctattgtccaggctggagtgcagtggtgcaatctcagctca

SEQ ID NO: 18687 - DNA, 201 bp, Homo sapiens
agagctgcaggcattaatgcaaagctgcactgcctcacgaggtcgctgatgcactctcattccttttcctccagggactcctgcactttgccaggcgtggrccagaatgccactcgtattgtttatcttaatgcttagtgatagtagctacctccagtgcacgccgcattagcctctccaatgagtttctcctttatttta

SEQ ID NO: 18688 - DNA, 201 bp, Homo sapiens
tcaggaaaattcaatctcgttaatacttttggagggaaaagaaggcaagcgtactcttcagagaacggattcttttggatttgtgttagagaaaaactgtstctaatgaccgcacagcacaaagcaaagcagttaaatgaataaccgccttccagtacagataataaagcaggagaattttgtgtgtcacatcaataaaca

SEQ ID NO: 18689 - DNA, 201 bp, Homo sapiens
tgcagggaattattgcagttttgttttttatttagcacaaacctaaatattacacgtagcaaatgtcacccgatgcaactgtctgtcctgaagaggaggayagattattctgtggctacctaatggtgtttacagagttgccactttgccaaaccccaagacccacacttggtctctggtgttgggtccgccagctctcca

SEQ ID NO: 18690 - DNA, 201 bp, Homo sapiens
aatgtcacccgatgcaactgtctgtcctgaagaggaggacagattattctgtggctacctaatggtgtttacagagttgccactttgccaaaccccaagasccacacttggtctctggtgttgggtccgccagctctccacccttcagaatgggatgtttagggcgtaatcttctgagacccacaacctaagccgggaagc

SEQ ID NO: 18691 - DNA, 201 bp, Homo sapiens
ggatgtttagggcgtaatcttctgagacccacaacctaagccgggaagcagaggcaatttattaccccagcttcctgtccactggaggcccggggagaccktgaaatgctcagctgcaagtcagggtccaccgatgcagcctcggaatttaatgaggcctctccggacccaaagggagatggacatttctaggcttgtgga

SEQ ID NO: 18692 - DNA, 201 bp, Homo sapiens
ccctcttctctcctggtgagaccgttgttggatgtgaaaaggccttcactattgtcaaggctgggcccctgcttttgccttgttactctgcattttaactstggaccagaattgattgccaccaataaaagatactccagtccttaaaaagtcaacattgttatgttttacttagttatgacttagtgaacacctatacga

SEQ ID NO: 18693 - DNA, 201 bp, Homo sapiens; identical to SEQ ID NO: 3292

SEQ ID NO: 18694 - DNA, 201 bp, Homo sapiens
cagacccttgcaacaaaatcttacgtggtcctggatgaaaataacactggaggtaagaaaccttggcctagagggttccccaacctttttttttttttcaktatggccccctcccccaggagccttttgagatacgactttcctaatggtctttgcccatgaaatctgaataccacagatgtgctgaatgcctgttcgtgt

SEQ ID NO: 18695 - DNA, 201 bp, Homo sapiens
acatggcaaccaaataagagtagctggagcagagactttctcttcttcagattattaagatttgagcaattcattttttttggatggtgtttattaaagtmaagaaatcttttgcttatttgctaatgattctctcccctttctcttcttatatttttgaaggctgaattggtaaaattatctggcccaataaaaatatgt

SEQ ID NO: 18696 - DNA, 201 bp, Homo sapiens
tggatgtattgtcacccctgttgggaatacaccgctcagagaagggttttgtccataggcaacacagagccaattgaggcctttgggcaagcggaggtcawgatggaattcagcctttcagacaattctgccaggcccttggagggtgggaggaaacaggcaagacctctggctcctagaaccgtaaggacccttgccatt

SEQ ID NO: 18697 - DNA, 201 bp, Homo sapiens
atctggcccaataaaaatatgtcctgggttggaaaagagcacaagtttctttttctagccctggagtgaggtggctctctggcctctgggttcgtttggtrtcctggggagtcattgacacccacacactcctagtcacaagacctttccctcccatccagattgtgtttattttacggctctcgcacggagcatgcagct

SEQ ID NO: 18698 - DNA, 201 bp, Homo sapiens
tgggcaagcggaggtcaagatggaattcagcctttcagacaattctgccaggcccttggagggtgggaggaaacaggcaagacctctggctcctagaaccrtaaggacccttgccattaggaccaaacctcttccagctttctcagcagccacatgtcaccccctcttccaccctttgccctgccaccctccatcccctga

SEQ ID NO: 18699 - DNA, 201 bp, Homo sapiens
ctttcctttataaaccacccagtcttgggtatttcttcttagcagcatgagaagggactaatacaggggtgatcacaaacagcctgcagactgggccatckttcttaggcaggatctcgagctaggagatgagaagagctctataggcaaaaagaatgacttggaaggccacatatggcagagtagctaagactttggggt

SEQ ID NO: 18700 - DNA, 201 bp, Homo sapiens
gaattcagcctttcagacaattctgccaggcccttggagggtgggaggaaacaggcaagacctctggctcctagaaccgtaaggacccttgccattaggascaaacctcttccagctttctcagcagccacatgtcaccccctcttccaccctttgccctgccaccctccatcccctgataccctcctgccttttagttgc

SEQ ID NO: 18701 - DNA, 201 bp, Homo sapiens
ttttgtcagttcatctatctgtccatctctttgtccatccatccaactacccacttacccatccatccatacatttatccatccatctacccacccatccrtccatccatccatccatgcatccatccatccatccatcatccatccatgcatgtaagttgcagacatcaacaaactttacccttaaggactttggctggc

SEQ ID NO: 18702 - DNA, 201 bp, Homo sapiens
ccaaagtatgcacgccgcactccacctcccatgcccttttctttttctcagggccatcagaaaggaagtaactggcttagatttgacacctctttttttgktcgttttatgtttttgaatctagcatgtataagctcatcagagagctttcccctggcctgggacaatcaggtttcaactgaggctcacgcacacgtcaac

SEQ ID NO: 18703 - DNA, 201 bp, Homo sapiens
gccactgtgcccggccttagatgaggtttgtagatgtgtttttcatattcccaaagccatgaaatttgacaggtaaatatatcagttataaaagttttagsattaattatcaactaactcccagaagttgcctcagcctctctttttcagccttgtcttgccccagcccagagacaagccacagctataggttttatttct

SEQ ID NO: 18704 - DNA, 201 bp, Homo sapiens
ctggagtgcagtggtgcagtcatggttcactgcagcctcgatctcctggggctcaagccatcctcccacctcagcctcctgagtagatgggaccacaggcrcatgccaccacacccagctaagttttgtatttttttgtagaggcaaggtttctccatgttgccaaggctgatcttacactcctgggatcaggagatccgc

SEQ ID NO: 18705 - DNA, 201 bp, Homo sapiens
tcttattggaacagctggttttccctttaaaacagggagtccagcagcttctaggatgcttagaatcagaattgttgctcactttttaaggtatagagtakttgtcttattcttaactacattttatatctttgcccttttttcccctactttaaataaaatctatctctaatttatgttacttaagcaatgacaaattct

SEQ ID NO: 18706 - DNA, 201 bp, Homo sapiens
ttctttccttccctttttccttttctttccttctttccttgccatttaaaacatactgataacttggcagcacagggcagtgattaaactcaggcactcaycccaccctacctgggaatctgaattctgtcttttctgctgctgtggattctcagtccccaagttgtgtaaatcaaagcttctcctgccacactagtgtgt

SEQ ID NO: 18707 - DNA, 201 bp, Homo sapiens
aggaagaactcttccaaatgatggcagggatatttggaatctttccccctgagttccctctggaagttaaagcccagatcccgtgaactgattaaaaagcyccagaccattcccgttccagtcatcttgaaactgagcaagaccgtgtcatccatggagcttgaacataggagcactttaaaaaaaaaaagaatgaaaagc

SEQ ID NO: 18708 - DNA, 201 bp, Homo sapiens
tcttagaatcttctgaaataatatgcagcattatattccatttgtacctgggaagagggtacttgtctttcatcagagagtcaccaatggaccactggtcyctgctgatttagtgtcacagctcaaaaccatcagtagtcctcgtgatctttcggcattgtggctccctttgtgagaagggcctaagagtgaatctcccaa

SEQ ID NO: 18709 - DNA, 201 bp, Homo sapiens
ggaagaactcttccaaatgatggcagggatatttggaatctttccccctgagttccctctggaagttaaagcccagatcccgtgaactgattaaaaagccscagaccattcccgttccagtcatcttgaaactgagcaagaccgtgtcatccatggagcttgaacataggagcactttaaaaaaaaaaagaatgaaaagcc

SEQ ID NO: 18710 - DNA, 201 bp, Homo sapiens
caaagttacacaacggctgtaaaaaataaataaaaaaaaagcaaaattagcactttatcaagtttggggcatatttccaaggccaccagggagcagggaargtcaccaaaagaccgctccttgaaaccaggcaagaagccatctttgcagtgagctgagaggtctgatggccgccagctgagggagggaattccccttttg

SEQ ID NO: 18711 - DNA, 201 bp, Homo sapiens
caagggtaagatctgctgtcttgtgaatgtcaaagaagtttctcattcgcccctttcttctctctcccagtgtctttaatttgttaatgctttcgacttaytttgctttggataattttcaaagtactgctttctctagagatctctaaaaggcagaagttctggctattaaagatttgccattctcagaacagcccagtt

SEQ ID NO: 18712 - DNA, 201 bp, Homo sapiens
acccattgtacacatttggtattttttctttaaaaaaaaaaagcatttactttttgcctcatgaatctctgagtacattttgtgcattctgtattctactktatttactcaatattaattatatgagaaataaatcctaaatgtaattttgaatggtggcttcacaaaagaacatttcctcttcttttggacatttgctcc

SEQ ID NO: 18713 - DNA, 201 bp, Homo sapiens
gacagctctaggcagaaagcctttctcaggatcccagcttccctgtcttccagaactcaaagacggcttttgtttgttagttttgaggatggagacagctrtcattctaatgaggacttaaatgtgtccctgctgaccgagccagaacttatttttatgttgccactaggagtcttctgagatgctcttgtggctggatgt

SEQ ID NO: 18714 - DNA, 201 bp, Homo sapiens; identical to SEQ ID NO: 3304

SEQ ID NO: 18715 - DNA, 201 bp, Homo sapiens
agcacaggaaagacttgccctcatgattcagttacgttccaccggggccctcccacaacacatgggaattgtgggagcgacagttcaagatgagatttggrtagggacacagccaaaccatatcacagggtcacctgtaggttaccgtaaataagagaaacagaccaagtagagactcagcatagctggagggggggcccc

SEQ ID NO: 18716 - DNA, 201 bp, Homo sapiens
cctgaggcataaatgggttttaagctccatacagtaaaacctagcatatgaaaacagttctggctgatgggttggtagaagtgatagatatagatacatayatacacatatatgcacagtaatagatataggtaaagaccttgatatatgtacatatattgtatgatacatatccatgcatatacgtgggtgtacacacac

SEQ ID NO: 18717 - DNA, 201 bp, Homo sapiens
ctgcctcctaggctcatgccattctcctccctcagcctcctgagtagctgggactgcaggcgccagccaccacgcccggctaattttttatatttttagtmgagacggggtttcaccatgctaaccaggatggtctcgatctcctgacctcgtgatccaccagccttggcctcccaaagtgctgggattacaggcattagc

SEQ ID NO: 18718 - DNA, 201 bp, Homo sapiens
ctgtttgttttgaaccacttattttggcaagacttcttcagacaggagagccctgagagctcttcaaaggctgggcctgatggtgtttgtcagagaggttygagctcttaaatttaaatggcctcccacagggaagcagaagtccttttggatcctccagaggactgagatcctccagatgctgttcatttgccttattcg

SEQ ID NO: 18719 - DNA, 201 bp, Homo sapiens
aaagtctgtaccaattaagcagctactacccattcctcttccctaccattctaccttctgtctcagtaggtttgcctatttgggatattttatttaagtgsgatcatacaatagcatcatgtgttcaaggttgacccacattgtggcatgtatcagtacttcattcccttttatcactgaatagtattccactgtatattg

SEQ ID NO: 18720 - DNA, 201 bp, Homo sapiens
tgggtaatggctgaagaaaagaggtttaattggctcatgattctgcaggctgcacaggaagcatagaagcttctgctactgggggcgcctcaggaaacttrtaatcatggcagaaggtaaaggggaagcaggcacatcttacatcgccagagcaggagcaacagagagcgactggggaggcgctacacacttttcaaccac

SEQ ID NO: 18721 - DNA, 201 bp, Homo sapiens
atgaagggttcatcctcatgactcagtcacctcccaccaggccccacctccaacactggggattacaattcaacatgagatttcggcggggacacagatcyaaaccttatcaccagcgcttgttatttcctcaggtacattttgatgtccctccccactttactctcccctacaccttgaagcaggtgcaatcattttagg

SEQ ID NO: 18722 - DNA, 201 bp, Homo sapiens
agttaggcattggtttggctccaagtgaaaactgcttctgttattaacatcagcagcagcaacaagaagagagaagtttatgtctgtctcggaatacgtaygtgacaggctcccccatcgaggtgctcagatatggtggccactgcatgattttgctcaggactgaattagaggcaggtgaaaggccctcactccctggaa

SEQ ID NO: 18723 - DNA, 201 bp, Homo sapiens
tcacaattaattgtgccgcagttaattaaattgactgcctggcaatccagtctcaattaaaatactaatagtttatttatttattttgtcttttacgaagygttttcttttaccatctctcaggatcctatgtaggtatcctgatggtaagaatgataataccatgactgattattccatagttgcaggaaccccacatgg

SEQ ID NO: 18724 - DNA, 201 bp, Homo sapiens
cttcccacaattcccagtgagcccaactccttaccacaattcccaccccatgccttccccaaattcctgatgagccctatgccttcccacaattccctgtraattttgctccttcccacaaccccagtgagccccactctgtcccataattccctgtaaatctcactccttcccacaatccccactgagtcccattccttc

SEQ ID NO: 18725 - DNA, 201 bp, Homo sapiens
gaataagtattttgcagggcttattttcatcatctggaaaggaggaatagatagggttatcttgaaagtcctctcttggaagggattatggttctgtaatsctgtaggactggactcagtgggtaaatgtagaggtgatggtatctccgtttttattgtcttcagaaatgttgagatcgagtgatataaagtcacagggtt

SEQ ID NO: 18726 - DNA, 201 bp, Homo sapiens
ccactccttcccacaattcccagtgaaccccacttgtgtagtgtgtctgtgagtagtctgcccactctccttatgacaggtttccagtattatctgtttcmtaacccatttccaaccttctgggttttttccttcaacgttttcctgtgacagttctccattatatctttgttagataatagttagcaacccattaataac

SEQ ID NO: 18727 - DNA, 201 bp, Homo sapiens
ctttgcagacccctgggagcctcattcgagttcttcctgtggagtcccatgccttggtgttgaaccagtgtcctagctgggaggaccgttgtactgcagcrctttcctaaactctgcatgtggtctccatgatgtcctggctgtgttagcatcagaaatggctttgcccacatctcccaactctgccctcttattaggatt

SEQ ID NO: 18728 - DNA, 201 bp, Homo sapiens
tgttagaaaaggtattttttttatgaagtaagtagggaactaactacctgttcactgctgcccgttcattgctagcacaatgccaagtgtcaaataaatgyttcttgaacaagtgaatagagtacgcttctaggcttctggaaacggtgaatgttgctttatgtggcaaaaagggactttggagatgtgatcaagttcagg

SEQ ID NO: 18729 - DNA, 201 bp, Homo sapiens
ctgggaactagctaaaattagggagttaaaatgatccagcttagctcaggctatagggaggatttctctcccaggtgtttgttttgttttgtttttgagawagggtctcactctgtcacccaggctagagtgcagtggcctcaacctcccaggcccaggtgatcctcccacttcagccccctgagtagctgggactacagg

SEQ ID NO: 18730 - DNA, 201 bp, Homo sapiens
tatgtagtcatatatatatatgtgtgtgtgtgtgtgtgtatgtatatatatgtgtgtgtatgtatatatatgtatgtatctgtatatgtataatggctgtmcatgatataattttgagttggaaaaagcaaattgaagaataatacatgtattatcatgtctttaaaaaaaaactatacacatagctgaatgtttttgtgt

SEQ ID NO: 18731 - DNA, 201 bp, Homo sapiens
tgaccatccatctccagaatgattttcatcgtgcaaaactgaaacgctgtacccacagaacactggctcctcatcacctccccaagcccagcccctggcarccaccattctcccctactttgtctatgaattcgactactcttggtacctcatataagtggaatcacacagtgtgtgatgtgttcttttgtggctgactta

SEQ ID NO: 18732 - DNA, 201 bp, Homo sapiens
ttattttaagttcaggggtccatgtgcaggtttgttatataggtaaactggcgtgatgggggtttgttgtacagatgatttcatcacccaggtattaagcmtagtgcccattagttatttttcctgctcttctccctcctgccaccctccaccctttggtaggccccagtgtcttttgttcccctctttgtgtctatgtgc

SEQ ID NO: 18733 - DNA, 201 bp, Homo sapiens
atcacttttaaagaatctgggcttacccagttaacagaaatagaacctgcctgtttatcagtgggtttgcctcacttttctgtgggtttcttttcttttcytaattatgcattaagaaaataacttaagtttctgtgcatacaacatcttcctttctcattcccagtaccctagaaacacagccgttcactgaagaggatt

SEQ ID NO: 18734 - DNA, 201 bp, Homo sapiens
gggaagagatcacttcacagtttcctgaaccactagaaaaaaaaaatgttcataaatttatagccgctgacattgaagttggagaaaagagcatatctagyacctatgctatgtggagaacactctccatgtctttgaaaaataagcacaatacaaattatatttgaggatgacctgccaaagggttgattatcctggaaa

SEQ ID NO: 18735 - DNA, 201 bp, Homo sapiens
atatgtagtcatatatatatatgtgtgtgtgtgtgtgtgtatgtatatatatgtgtgtgtatgtatatatatgtatgtatctgtatatgtataatggctgkacatgatataattttgagttggaaaaagcaaattgaagaataatacatgtattatcatgtctttaaaaaaaaactatacacatagctgaatgtttttgtg

SEQ ID NO: 18736 - DNA, 201 bp, Homo sapiens
ttctttagtggcgatttatcagatttcagtgtacccatctgagcagcatatgctgtacccaatatgtagtcatatatatatatgtgtgtgtgtgtgtgtggatgtatatatatgtgtgtgtatgtatatatatgtatgtatctgtatatgtataatggctgtacatgatataattttgagttggaaaaagcaaattgaaga

SEQ ID NO: 18737 - DNA, 201 bp, Homo sapiens
caggggactgttgttattcctcctttacagaggtgggtctgaaggtacagagtggataagtcattttctccgggccagccacacagcgaatgaatggagaytccttgtgtgtagtaaatggctgcagccctataagctataatcatatatcatcaacacctttaccctgttattaacgtgtctgaaattagggaacaccac

SEQ ID NO: 18738 - DNA, 201 bp, Homo sapiens
ccacctttctgaagaaaactgcagagcttttgcagttattaaactagcaacagatgtaaagtccaactgttagagtttttctttaaagcagaagttagcarttacaggtgcttgtgatgtcatcacttagatgatcttataaatgccttttttttttttttttttttttttagtcggagtctcactctgtcgccaggctgg

SEQ ID NO: 18739 - DNA, 201 bp, Homo sapiens
gccaggagggtttctctgaggagatcccatttcaacagatctagaaatgtaatggagccagtcctagggaaacaggactaccaggaatcctcaccagcccsgcaaagacgagggagcagcaagttccaaagcccgtggcatgtcaagggtcgatgaattcaccaactgcaaggggctttggtgaccccagtgaacagatga

SEQ ID NO: 18740 - DNA, 201 bp, Homo sapiens
gatggctttctttccagtataataaagacagtgcctccttccaggacaacggtttggcagatttgcttgataaaggttggggtttgtaagcttggggctcytcagccatgactgaaacgtactatgagcacggcatctaccgggctgttccacatcctccctgtgggactaggggccagggcaatgggaatcagtgcagaa

SEQ ID NO: 18741 - DNA, 201 bp, Homo sapiens
tacagcttttaaggagaactaacttgccactttgatagcagtataggactccaatatttctcatttgtaattttcagaagcacacgggaggtctttgaaayttaatgtctccctgcatcacaaaccaaaagacgagtcagtttataagtaggctgtgcttattaactcagtcctggctttattgattgctttaggttccat

SEQ ID NO: 18742 - DNA, 201 bp, Homo sapiens
tccctcatgtttcaagtggcttttttgcatgatggtgcatatgtctttgtttctgtacagggccctccatgttcagaggcagagtaacgtgaattcatttygcgctaatgagagttgcgatatgtcggcccaaactctctgtgtccttttcttcttgggctgatgaacttgtcaacttttaaaaaatgtgctctccaaaaa

SEQ ID NO: 18743 - DNA, 201 bp, Homo sapiens
aggagtttgagaccagtctggccaacatggtgaaaccccgtctctactaaaaatacaaaaacttagctgggcatggtgacaggcatctgtaatctcagctmctcgggaggctgaggctggagaatcacttgaacccgggaggcagaggttgcagtgagccaagatcacgctattgcactccagcccaggcaacaagagcaa

SEQ ID NO: 18744 - DNA, 201 bp, Homo sapiens
ccccaatcgatcagtggagaaacgagctctggtgggcagtcaggcaaagcagatacacgtgcttcttttcagctttgttggaaggtttcattttgcttcasgaactaggcaggagaattcctgagttcctgtacaacctgagttctctgttaaaacaaggaggaagtaatcatcctgagttcgatgattcagagtaagcca

SEQ ID NO: 18745 - DNA, 201 bp, Homo sapiens
tcagagtaagccatttaacttgtagagctttgggactaacaatgatccctttttggagtccttaattactaaaattatcagcatatttagagttctgaagwtgctgaacccttattgtatctccccagggttagtgagtaattgggaatagtgttccatcttggatgcccccatccactaaccagctttcctcttcgggtg

SEQ ID NO: 18746 - DNA, 201 bp, Homo sapiens
aaacttctttccacaagagtaggtttataatttattttctttacattatctggataattacatttggtttgcttacatagatggaggcgaatggttttccratcttcaaaccaacctatatcacaaaagcattctgaaaactgggaagagatcacttcacagtttcctgaaccactagaaaaaaaaaatgttcataaattt

SEQ ID NO: 18747 - DNA, 201 bp, Homo sapiens
acagatctagaaatgtaatggagccagtcctagggaaacaggactaccaggaatcctcaccagccccgcaaagacgagggagcagcaagttccaaagcccrtggcatgtcaagggtcgatgaattcaccaactgcaaggggctttggtgaccccagtgaacagatgagaaaggggaggaggctgggatcagtgcacagctt

SEQ ID NO: 18748 - DNA, 201 bp, Homo sapiens
cggggtttcaccgtgttacccaggatggtctcgatctcctgacctcatgatccacctgccttggcctcccaaagtgctgggattacaggcgtgagccaccrcgcccgactgctttattttcctttgtgttcctaatacctggcccagtgtctggcaaatggaaagttcccctggatgtagttgggtgacactatgagtgta

SEQ ID NO: 18749 - DNA, 201 bp, Homo sapiens
agccccagttgttttgaagcatgtcctatcattaacacaggtaatcaggatatattcattgaagtctcactgtgtgccaggcactatgctatgcaccttaygtgtgttattttatttcatccttccagctctgggaggtgatgactgtcatctgcattttgcacatgacaaatctgagggtcagagaacttgcccagggtc

SEQ ID NO: 18750 - DNA, 201 bp, Homo sapiens
tccccgttctggagagcctttgattataacatcagcctgtcatttggacctctgacctgaattatatgaatctgaaaaatctcttcctttcctatcgtgarttcggtcattgttataagccaagctttgcaaaggtggaacaccttggagatacttatctcctccttactctacccaagtaatgactcatccttttataca

SEQ ID NO: 18751 - DNA, 201 bp, Homo sapiens
agaatttggggagattctgctctaaagggaaaagctttgtaaaggagaattaccagtagagtgaccttataatttaccatccaatggattttgaatacttytgagagagaaatgagatactgataataattataccaagacaacagacataaattgggattggcctagacgagcaaagatgaatggtcattctgtctgtta

SEQ ID NO: 18752 - DNA, 201 bp, Homo sapiens
ggtgcaatcttggctcactgcagcctccacctctgcctcccaggttcaagtgatactcatctcaagtggtttctacctcattaaaacaaacaaacaaacascactcaccatttttgtggtgggcatggtggctcatgcctgtaatcccagctctttgggaggccaacgcaggtagatcccctgaggttgggagtttgagac

SEQ ID NO: 18753 - DNA, 201 bp, Homo sapiens
gcagctgacggccaaaggggaagctgagaacagcaaagattcaactgaaaacattttagggggttcctgacttcaggcctcttttcagaatgagggaattrtctaaaatcccaaatgcattcttagctaaggtcagtgtgtctgggtctgtgtcaggcatgtagcagccacagcaaacttctcttgagatagcatctcctc

SEQ ID NO: 18754 - DNA, 201 bp, Homo sapiens
agggatggttctgtggtgtcccacactcaaataaacatcctttaaatacctctagatgcttataattcctgttgcagccttagtcagtgggagccactgasctgcattcgtgtaggaactgagcaaggttcatctagtctcggtagctagctaccccgagagctggctgattttttttttcttaaatttaattcaagactt

SEQ ID NO: 18755 - DNA, 201 bp, Homo sapiens
tcactggctatgaaaatggccccaaataaagtggtatccacacttcttctttctcctacgaatttggaggtctaggaacgggggtaagcctatatggtcakaattagcctgcaaacgtgaattaatatgcagaatctgtccccactgtgatagaatttgccattcgcttcctttgctaaatggcttgcagtggcagctgac

SEQ ID NO: 18756 - DNA, 201 bp, Homo sapiens
ctctagatgcttataattcctgttgcagccttagtcagtgggagccactgacctgcattcgtgtaggaactgagcaaggttcatctagtctcggtagctasctaccccgagagctggctgattttttttttcttaaatttaattcaagacttcatgaagtcaacaaaatggtctgttggaaattattcctaacccccaacc

SEQ ID NO: 18757 - DNA, 201 bp, Homo sapiens
ttagtcagtgggagccactgacctgcattcgtgtaggaactgagcaaggttcatctagtctcggtagctagctaccccgagagctggctgatttttttttycttaaatttaattcaagacttcatgaagtcaacaaaatggtctgttggaaattattcctaacccccaaccactgtcactgccacaatcaaacatattttc

SEQ ID NO: 18758 - DNA, 201 bp, Homo sapiens
aagaaagtacacaaatggagagagggggaattggacatgccattgggagaacaaatttatttagatatctttggctgtgttgacagaagctgcccaattawacccaatatacaaattttaaatgcatattagtcaaagttccagttatgtagctttagaaaaatttctatgtgaatgactacttttccctgaaatacgtcc

SEQ ID NO: 18759 - DNA, 201 bp, Homo sapiens
cgcctgccttggccttccaaagtgctgggatatacattttttttttttttttgagagatggagtgtcactctgttgccgaggctggagtgtagtggcgcartctcggctcactgcaacctcctcctccggggttcaagcgattctcctgcctcagcctccccagtagctgggattacagtcgtgtgccaccacgcctggtt

SEQ ID NO: 18760 - DNA, 201 bp, Homo sapiens
tctacaaaaaatacaaaaattagctgggcttggtgacagacgcttgtagtctcagctactcgggaggctgaagtgggaggatctttagagcccaggaagtytaggctgcagtgagccatgaccttgccactgcacaccagcctgggtgacagagggagaccttgtctcaccaaaaaaaaaaaaaaaagagagagaggttga

SEQ ID NO: 18761 - DNA, 201 bp, Homo sapiens
agcttcccaaagaagagttgtggagaaggaaaagtgaaggaaagtaccttactaagtcattgatggcacattcagcccttgtcaaagtcaaagaagaaatytggagaaattctcaccactgtgcttaggagtcaccctgaactatttcttggatgaaattaccaccctcccacttttggcaatgagacagcaagcttggaa

SEQ ID NO: 18762 - DNA, 201 bp, Homo sapiens
gtgttctgcgaatcccggtctctactaaaaatacgaaaaaaattagccaggtgtggtggtgggtgcctgcaatcccagctactctggaggctgaggcaggrgaattgcttgaacccgggaggcagaggttgcagtgaacccagattgcgcctctgcactccagcctgggcaaaagagtgacactctatctcaaaaaaacaa

SEQ ID NO: 18763 - DNA, 201 bp, Homo sapiens
agagtgacactctatctcaaaaaaacaaaacaaaacaaaaacaatttggctccagtgagctcattttacgttgtatgtaccagtatgcaagtgttgtatgsatgtgagcgtctgcgtaggtttttatttttctctctcagaatgaaaggtttgattcgtaccagctccccatcccttcccacgatcccatcttaatgtctg

SEQ ID NO: 18764 - DNA, 201 bp, Homo sapiens
aatactcccttctggacactggaagggcaaatgaggtgcaagccttttttttttctttcttttcttcttcttcttcttcttttttttttttttttttttgkttttcctcccagcctctctcctttcccattatgcacaatgcgctgagaaaggattcccagtccccctggtaaaaagtctgaaggatgccgaggagttcac

SEQ ID NO: 18765 - DNA, 201 bp, Homo sapiens
aaaatcacttttaaaaaatgtatggtgtccatctgggttagcaaacacatgctcacacgtctgtgcttgctggatttttaagaacttaccagcatttaagrttttcttatgaaactgattttactcaccagggatagagtctcaaagttggaggtattttatgttgttttaaataatatcgtcatcacatgtcattttaga

SEQ ID NO: 18766 - DNA, 201 bp, Homo sapiens
taaaactctgcctttctaaagaaacagggacacggtgcagaaaagttcatctggagttaggcttgtgtcttgctgtctctttaacggagagttcatgggcwgggtacagtctgtgagaaggaatgaaaaccccagggtagatgctaacaaaaatcacttttaaaaaatgtatggtgtccatctgggttagcaaacacatgc

SEQ ID NO: 18767 - DNA, 201 bp, Homo sapiens
caagtgattctcctgcctcaccctcccgagtagctgggataataggtgcctatcaccacgccgagctaatgtttttggatttttagtagagatgggttttmgccatgttgtgcaggctggtctcaaattcctggtcccaggcgatctgcctgtcttggcctcccaaaatgctgggattacaggcatgagtccccatgccca

SEQ ID NO: 18768 - DNA, 201 bp, Homo sapiens
aataaatatctgctagtttttaaagtttgagaaaaacccgtattgtggaatgaaaatgatactgacaagggaatacatctagatcagaaatactgatatcstaagtgagatcttgttttttaaaacaaaaaaaagtttaagaaattgtcatataggctgggcgtggtggctcacacacataatcttagcactttgggaagt

SEQ ID NO: 18769 - DNA, 201 bp, Homo sapiens
gcactgttccaactccagtctggctgctttttcaacctggggctttagtcatgtcaatattcctgagcttccatgtgcttatttgaaaaataggaagattygtccagtctcaaggaactatgataagtagcaaacaatatcccagaaaaatctccagtcaaaaatccactggaggccaggtgcgttagctcatgcctgtaa

SEQ ID NO: 18770 - DNA, 201 bp, Homo sapiens
ctgatgtctcagcttgaagtcaggcatagagaggcaattctttctcactcagccttttattttattcaggccttcaacagattgtatgaagccacccacaytgggaagggcagtctgctttactcatagtactaatcgaaacgttaatgtcctccagaaacgccttcatggacacactagagataatgtttaacataatat

SEQ ID NO: 18771 - DNA, 201 bp, Homo sapiens
tgagatcttgttttttaaaacaaaaaaaagtttaagaaattgtcatataggctgggcgtggtggctcacacacataatcttagcactttgggaagttgagkcaggagggccacttgaggccaggagtttgaaaccagactgggcaacacagtgagaccccacctctacaaaatattttaaaattagccaggcgtggtggtg

SEQ ID NO: 18772 - DNA, 201 bp, Homo sapiens
gcatcattgcaaagtattagaaagggccctgcctgggctaggagccagaagcattcttcagttcccaacggccatccagccactcattgctgtgtgagctstggctggtcagtaagaacctttgatcccatgtttctttatcttcttctttttttttttttttttagccatagtctcactctgtcacctaggctggagtgc

SEQ ID NO: 18773 - DNA, 201 bp, Homo sapiens
gtgtctgtctgtatctttacacacctatgggtgtgtctgtctgtatctatacacacctatgggtgtgtctgtctgtacctatacacacctatgggtgtgtstttctgtatctatacacacctatgggtgtgtctttctatatctatacattatatgtactaaataatatatataaacactatagtatatagagtatacata

SEQ ID NO: 18774 - DNA, 201 bp, Homo sapiens
gatcaagcagagggcaagtggtagattctagaatttgcatccaggcagttgagtctagaattgtctttgtgtattttgctccatggtctagcacaggatcmccattggtagatcatcacttagaatgccatcactaccttctaacagcaatcagtccccttaagtggctttcttctcttttttttcttttatctttttgtt

SEQ ID NO: 18775 - DNA, 201 bp, Homo sapiens
cacctgcttcccattggccagaattcagtcacatgatcacaaccaactgcaagggattctgggaaatgtagtctggtgatgcctcgaggaggcaagagaartgttttcagtgaacacattgccttctcaggcttgctttctattgtagattgcttacaatattgcttttaaattgcatggtcttgtacaaatgatacgagt

SEQ ID NO: 18776 - DNA, 201 bp, Homo sapiens
tatatctgtatctatatctaatctattttttgagaaaggctctcactctgttgctcaggctggagtgaagtgatgcaatctcaggtcactgcaactgctgyctcatgggatcaagtgatcttcacacctcagcctcccaagtaactgggaccacaatgcccagctaatttttatatttttttgtagagacggtgttttgcc

SEQ ID NO: 18777 - DNA, 201 bp, Homo sapiens
ctcttctttttttttttttttaaaggagtttcaagggtaagatctgctgtcttgtgaatgtcaaagaagtttctcattcgcccctttcttctctctcccastgtctttaatttgttaatgctttcgacttattttgctttggataattttcaaagtactgctttctctagagatctctaaaaggcagaagttctggctatt

SEQ ID NO: 18778 - DNA, 201 bp, Homo sapiens
tgcaataggaaatctctttatttcgttggtgctcaagtgataccattaagtcccttaagatgcggaatttccttgcccccgctgccccctttctttctttyatcttatctatatatctgtatctatatctaatctattttttgagaaaggctctcactctgttgctcaggctggagtgaagtgatgcaatctcaggtcact

SEQ ID NO: 18779 - DNA, 201 bp, Homo sapiens
tgttaatttagtcagacgaggaaggaaacgagaaaagttattcctatttcatccatctaagactttatatcccatttcaggctgattaaaaggcaaaatcktcacagtaggacaccaaaccctctgtatgccctgcctgcctccccccctctgacccgcctgcctcccccctgtgagctttttccacctactggcctcttg

SEQ ID NO: 18780 - DNA, 201 bp, Homo sapiens
gattgtccacagctctgctctctgctcaccccggggatttagcagtaacagaatccacactagaaggacagagtgctgtacagacagaaggaaagacgcasacccaaaccttgataaccatggcaatgcaataggaaatctctttatttcgttggtgctcaagtgataccattaagtcccttaagatgcggaatttccttg

SEQ ID NO: 18781 - DNA, 201 bp, Homo sapiens
agtcacgtagaaagcagttattgtttccaagttccctgcccttgttaaatgtcagctttgagtgaaaatgttcctaattttactcagagtgcaaagaacayccaggtcaggtacctgacctgcttgattcatgtcttggaaacactcctttgtctttcagagaaagtaaagagtgatggagacagagagagaaagtgtgac

SEQ ID NO: 18782 - DNA, 201 bp, Homo sapiens
taatctttcccacctttttgattgtgagtcttcagaccctccccagagagtcagtcctgccttatgccctggggaaaggaatgctgacctcatgaagctcycataaaaacccaagagggctgggtttgggagcttccagatagctgaagacaaggaggttcctggagcgtggctgcctaggaagggctggaaagctccatg

SEQ ID NO: 18783 - DNA, 201 bp, Homo sapiens
ttcagagaaagtaaagagtgatggagacagagagagaaagtgtgacctactttttattatcagcaccatttcatctgcaaaacacgacttttctcttcttrttacgctgagcatgaaaataaaatgttttccaaaagacctggctttggctgttgtgaggaaggccagggacttgttcaaaactctgatgagctcgatgag

SEQ ID NO: 18784 - DNA, 201 bp, Homo sapiens
agggctggctgtcctcaccgtgaagtctagatctccctgctaacttacactgtgctcaaaacacacacacacacacacacacacacacacacacacacacmcacactggctgtcctcactgtcaactctagatctccctgctaacttacactgtgctcaaaaaacacacgcacgcacgcacgcatgcacgcacatacacac

SEQ ID NO: 18785 - DNA, 201 bp, Homo sapiens; identical to SEQ ID NO: 3307

SEQ ID NO: 18786 - DNA, 201 bp, Homo sapiens
tttcatagataccactgacactatttttcacctcccatgttatcagtttgtgtaatagtagcttgctggtaatgtagttacagtaacaagttcaaatgacwtgtgtgttttttgagcaaacctggtgaacttttggtgcaaaactgatattgagagcaaataggccaaagcttgcttgagagaagtctcccaggccaccat

SEQ ID NO: 18787 - DNA, 201 bp, Homo sapiens
acgaaactcacatcttctttaaataaaatctccatttagaaatttttgaagacttgtggatagaagaagtaaccttgaaaagggcagagctgagccagacmccttttcagctgggtgctccctggaagatggatcttgccttgtggatgtttttctaccgtgacagaagatagaaaggatgaaatagaaagagtgtgagtg

SEQ ID NO: 18788 - DNA, 201 bp, Homo sapiens
cgaaactcacatcttctttaaataaaatctccatttagaaatttttgaagacttgtggatagaagaagtaaccttgaaaagggcagagctgagccagaccmcttttcagctgggtgctccctggaagatggatcttgccttgtggatgtttttctaccgtgacagaagatagaaaggatgaaatagaaagagtgtgagtga

SEQ ID NO: 18789 - DNA, 201 bp, Homo sapiens
tattcagttgcccagctcttttcattccctgtcctttccccctctggctgggtctgcctttccaaccgctaccaccttccaccaccattttttttttgttkcctctgcaagcaacatctgaaaggcccagacccagcttgttggccttgggctctgataagatctgtctgcactccttttgtctggcctgtacctgccttt

SEQ ID NO: 18790 - DNA, 201 bp, Homo sapiens
tgcctcagcctcccgagtagctgggattacaggcatgcgccaccatacctagctaattttgtgtttttagtaaagacagggtttctccctgttgttcaggstggtcttgaactcctgacctcaggtgatcccgcccgcctcggcctcccaaagtgctgggattacaggcatgagccatcgcgcccggcctagcctccaaca

SEQ ID NO: 18791 - DNA, 201 bp, Homo sapiens
tgttgcaaatttccagtggctagttcagggacagtgccggggcttgaacccctgtctctgtgtctcccagctcataaggtgtgctaccaagtcacccatgwgtagcaattaggcgacttctaacatgtccagctttaaacctgtgacctcaaggcaaatgacttccacatctcattagcactccccagagccttccagccc

SEQ ID NO: 18792 - DNA, 201 bp, Homo sapiens
cagagccagctcaagaacccagcgccagtggctgatgcttcttctttttttttttttttaatggattcttctaaggatggctgcatcagccaggggcagcrggtcatacctgtaatcccagcactttgggaggccaatgcaggcggatcatctgaggtcgggagttcgagaccagcctgaccaacatggagaaaccccgtc

SEQ ID NO: 18793 - DNA, 201 bp, Homo sapiens
gattcctccccattctataaaataacagctaccatttcctgagggcatactgagtgctgacaggcacatcaacatcagaccatcaccttcttatacctcaraatagtctgcagggtgactcagaagctcctggctggtaagtggcagatccagagatgaaacccagatctaactggacccaagacagaaatttctagaaca

SEQ ID NO: 18794 - DNA, 201 bp, Homo sapiens
gcaccattgcactccagcctgggcagcaggagcgaaactccttctcaagaaagaaggaatagctgcatcacttatgctcttgatggtacagaaaatgatcygcatggaggaaatctagacatcagcgattcagagtcaaaatgttattcaggggagagagacccttcatgtgaagaaattttaggaatactttaattattt

SEQ ID NO: 18795 - DNA, 201 bp, Homo sapiens
cttggcctgatgttaccagctttaaagagggaggaagcgtccaggagccaaggaattcaggcagcgtctagaagccagaagaggcaaggaaagagattctstcccagaacttccagaaaggcacgaagccctgctgacctttgattttagcacagtgatacccattgtggccttctgaccttcagaaaataaatttgtttt

SEQ ID NO: 18796 - DNA, 201 bp, Homo sapiens
aagagggaggaagcgtccaggagccaaggaattcaggcagcgtctagaagccagaagaggcaaggaaagagattctctcccagaacttccagaaaggcacraagccctgctgacctttgattttagcacagtgatacccattgtggccttctgaccttcagaaaataaatttgttttaagccactaatttgggggtaattt

SEQ ID NO: 18797 - DNA, 201 bp, Homo sapiens
gaccttaggtgatctgcctacctcggcctcccaaagtgctgggataacaggcgtgagccactgcgcctgtctacattttctgtctttactggtattatggygggaacccataaaccactgcgaggcagataccattttaagcaggaaaccttatttttttccgaagcacatttaaaaatattttccagtttatctattaaa

SEQ ID NO: 18798 - DNA, 201 bp, Homo sapiens
gcgatttaatttgctgctgaatgcacttttgaataaagggcctagaagatgcagtctcgaggaaccgaggccggttagagacaggctggcagctttgcctyctctcccaagacaaaggcctccccgcccccctaaatccagcacacaatcagctgctctccctccccctattctcagcaggagagtcaggatgcatatttc

SEQ ID NO: 18799 - DNA, 201 bp, Homo sapiens
tcgctgcaggctacttggttgtacttgagtaatttactcaagattctcttcagcccagtttccttatctgtaaaatccttccactgttgttaggaggatargaaagccagtattggtaaaaacatatatcagagtccttttgactgtttagaaagtgttaatttactccacgattatccattcaacatttattagttggct

SEQ ID NO: 18800 - DNA, 201 bp, Homo sapiens
tgcagcctctacttcctgggctcaagtgatcctcccacctcagcttcctaagtagctgggagcacaggcaccagcaatgacacctgcctaattttgtattktctgtagagatggggttttggcatgtttcccaggctggttttaaactcttgagctcaagccatccacccgccttggcctcccaaattgctggaattatag

SEQ ID NO: 18801 - DNA, 201 bp, Homo sapiens
ctctgaaagatttatctctttcgattcatctgtaaagtaaaaataaccgtcgtcgtcatttctcaagcgtgacgatactgttacacgtttactgcatattstgcataccaagcacatatccgtcacacgcagtgtggccaacttccgagaggccggcattcagccaaacagcctgaagaaccaggagaaatgcctgagttt

SEQ ID NO: 18802 - DNA, 201 bp, Homo sapiens
ttcagccaaacagcctgaagaaccaggagaaatgcctgagtttccaaatggcttatggtaagttgttgctgccactatgagtagcctacttgcatttctayttaatggcttttccccatatttgatggtatgttaaacagtcaatcattcattttctaaattaaagcctgtcctgaaaacgtgctcagtgctattgactgt

SEQ ID NO: 18803 - DNA, 201 bp, Homo sapiens
ctgcatgctgcagccagctcaggaaagatttcaggaagagcgtttaggaaggcagctttgaaaagaaaatggaaagatgaggttgcagagggtcagtccawggtgaccagaatctgacctggggcaatgccataaatccaagaaagactgggtttcaggtgcaggaaatgcgattgtgcacggacccttgcctttttaccc

SEQ ID NO: 18804 - DNA, 201 bp, Homo sapiens
aaaataatattaccggagaaacaatgagtaacatgtataggattttttttttttttttttgacggagtcttgctctgttgcccaggctccagtgcagtggygtgatgttggctcactgcaactccgcatcctggtttcaagtggttcttctgcctcagccttccaattagcggggactaccagcgcatgtcaccatgcctg

SEQ ID NO: 18805 - DNA, 201 bp, Homo sapiens
caggtgggaacagggttacagagcaaagtaattagatgccctttagatgctcttagttaaagaccatgcaaaaaggatgaaatcttttgatcatgttcttyacaatattagaggtaaaacatgaactcaacgcttttaggaagaaacaactggattgcgttttctattttattgacagaaactagatggggaggccagggt

SEQ ID NO: 18806 - DNA, 201 bp, Homo sapiens
aggtgaccagaatctgacctggggcaatgccataaatccaagaaagactgggtttcaggtgcaggaaatgcgattgtgcacggacccttgcctttttaccmagtatctagcccatccttctttcttagaagcagaattttctaagaggtacacggtagttcaggataaaaattccctgtgctaactgcccttgcagctagc

SEQ ID NO: 18807 - DNA, 201 bp, Homo sapiens
tggtctttgctttcataggttatttctcctcttccatagcaacacatgtcaaggcaaggaccatatcttattcagttcctagtcatcttttctttcttttsctttttcttttttaaattgttaagatctgccataaaaatgtctgtcagagtaggcatgattgcatattctttagatggatgggtggatggatggatggat

SEQ ID NO: 18808 - DNA, 201 bp, Homo sapiens
tgtaactcgagtgttctgtgaagccagatattggtgccaagctaaatttgtgcgtgcagcttctgtttaaggcaattatatagtgtgtaatacccagtagmgaaattaagtcgaagtacattttgcccatagagattatcctctcagttggatttattttaaacaagttttgccccttatacattaaggtgcatgcaataa

SEQ ID NO: 18809 - DNA, 201 bp, Homo sapiens
ttttttttttttttttttgagatggagtttcactcttcttgcccaggctggagtgcaatggcgtgatctcagctcactgcagcctccaccttccaagttcragtgattctcctgcctcagcctcctgagtagctgggataacaggtgcacaccaccatgcccggctagtttttgtatttttagtagagacagggttttgac

SEQ ID NO: 18810 - DNA, 201 bp, Homo sapiens
caggtgcacaccaccatgcccggctagtttttgtatttttagtagagacagggttttgacatgttgccaggctgctctcgaactcctgacctcaggtgatycacctgccttggcctcccaaagtgctgggattacaggtgtgagccaccgcacccggcccctgcctttttattttgctaaacctgatgacccttgccatag

SEQ ID NO: 18811 - DNA, 201 bp, Homo sapiens
tttgacatgttgccaggctgctctcgaactcctgacctcaggtgattcacctgccttggcctcccaaagtgctgggattacaggtgtgagccaccgcaccyggcccctgcctttttattttgctaaacctgatgacccttgccatagcagaactaaagtgatgatgatgattacagcagatcagttattttgagctctgac

SEQ ID NO: 18812 - DNA, 201 bp, Homo sapiens
gtgtgagccaccgcacccggcccctgcctttttattttgctaaacctgatgacccttgccatagcagaactaaagtgatgatgatgattacagcagatcarttattttgagctctgactttgcatgaggccctttattaagtgcttcacttgtgtgatctgatttaatcttcacaagcaaactgggacagagggactgtgc

SEQ ID NO: 18813 - DNA, 201 bp, Homo sapiens
cggcccctgcctttttattttgctaaacctgatgacccttgccatagcagaactaaagtgatgatgatgattacagcagatcagttattttgagctctgastttgcatgaggccctttattaagtgcttcacttgtgtgatctgatttaatcttcacaagcaaactgggacagagggactgtgcctattcccatttcacag

SEQ ID NO: 18814 - DNA, 201 bp, Homo sapiens
aggagcagaggacaggatggctttctttccagtataataaagacagtgcctccttccaggacaacggtttggcagatttgcttgataaaggttggggtttstaagcttggggctcctcagccatgactgaaacgtactatgagcacggcatctaccgggctgttccacatcctccctgtgggactaggggccagggcaatg

SEQ ID NO: 18815 - DNA, 201 bp, Homo sapiens
ttttcacccgggttctccctgtctataaggggaaaagacagggttcacaccaaggcctgtctggatccaaaacccatgctcataatcactaagttatactmcctcttcgagatgctgatttggaaaataactccatgatgaaacatgtcaagggagactgcctgtactccgtaatgcagaaatgcattagagctcaaaaat

SEQ ID NO: 18816 - DNA, 201 bp, Homo sapiens
gttccctgtactctgcaatgctgagtacttctcatccttcaggtctactgcaagtgtcacctggccaacacaccatgccttcccagtctctggtgttactstctgcatactgtagaccatcatcttgtttgcatacttgtctgttatctctttatcatccgtctacccacatcaggcaattccaagagagaagaccactgg

SEQ ID NO: 18817 - DNA, 201 bp, Homo sapiens
agtccctgtgcaccttcagaaccacatctagcaatagaaggcgctgcacggggaattctggaatgaataaaaacgcttggcagtaccgcatggcgagccaktacccgtgaatgctacttcctccaaagagaattcctgggataacagagaatccattcatggctgccaggaggacttggatatttctcattttccattggc

SEQ ID NO: 18818 - DNA, 201 bp, Homo sapiens
tttccattggccctggagtggaggaacagagccgaaaagtacgtggggggcaggcaaagctgcggtcagaggcagaccctgttggtgttggccgtgtcaascagctttgctggtttctattatagccctggtgtggcaaaggacactgtgtgactgtgagctcaggtcagcattgcgatcccttcaggcctctggcttgca

SEQ ID NO: 18819 - DNA, 201 bp, Homo sapiens
gaaggcaatactattatgctcattcataattaaggcaattgaagcccagacccttccagtagctttcctgaagtcaagttgccagtgcattggacatactrggctgtagttccagggcagcctggctctggtgtctttgctgcaatgacaatatctccccatttctctgtttaaataccacacactccccatatggtttct

SEQ ID NO: 18820 - DNA, 201 bp, Homo sapiens
taaagaaatattcgtaatcaataagaacacaaaatatggaatatattaactgagttataaaaatgtttgtagtatagcacagaatgaaaaacacagcaagktatgtacggtttaaagtgtaatcaattttgaggttgtatacaaggatatacatgataaatacaagtagtagcatttttagtaaaggctgttacaaaatac

SEQ ID NO: 18821 - DNA, 201 bp, Homo sapiens
cctcccttcctgatttcccatcttcttcctccctcttctctcccctctcccccttctcctttccgtccttcctccttcagttccctctttcctctttttcrcccttttatttaacattataaatacgatgggattgtgtctgcgcttttgttggtaattaaataaattatttatacatttaacacaatcttgaattaccag

SEQ ID NO: 18822 - DNA, 201 bp, Homo sapiens
tgttctatttatttatttgttattattatgttttttgagacagagtctcgttctgtcactcaggctggagtgcggtggcatgattgtagctcactccagtsttgagctcctggactcaagagatcctcctgcctcagtttcctgagtagctgagaccacaggcacgggacaccatgccagtctaatttttaaattttttgt

SEQ ID NO: 18823 - DNA, 201 bp, Homo sapiens
ctcagtttcctgagtagctgagaccacaggcacgggacaccatgccagtctaatttttaaattttttgtagggacagggcctcactgtgttgcccaggctyatctcaaactcctggcttcaagtgatccttctgcattgtcccccacaaagtattgggaatgtattctttcctgatcaggaaactccgcagagagaaagtg

SEQ ID NO: 18824 - DNA, 201 bp, Homo sapiens
ttttttttttttttttttgagactcactctgtcacccaggctggagtgcagtggcatgatcatggctcactgcagcctcccgggctcaagctttccacccmcctcagcctcctgagttgctgggaccacaagtatgcaccaacatgcctggttaatttttgtggttttttttttttttttttttttcctgctgagatgggg

SEQ ID NO: 18825 - DNA, 201 bp, Homo sapiens
ggggatttcaccatgttctccaggctggtttcaaactcctgagtccaggtgatccacccatcttggcctcccagagtgctgggattacaggtgtgagccaytatgcccaataccccctatgtagacttttaaagaaatacaggaaacagccaagactggtgtcattcagatttagcttgggagagtctagtgggtgttagg

SEQ ID NO: 18826 - DNA, 201 bp, Homo sapiens
taaaaccaggggagactcgacccaaggcattgtgtttgagctaggctttgaacaatgtatagaccctcaccaagtatggaagtggaagagtaagacattcmaggtagaaggaacagtatgaggaaagtcagagagctaacaaagattatagtgtaatgccagaatcatgagaaatttgctgagaattcatttgaggccata

SEQ ID NO: 18827 - DNA, 201 bp, Homo sapiens
gccatctctgcctctgtcttctcaccaccatcttccttgtccatgtctctctatgtcttcaatgttcttcttataaggacaccagtccttggatttagagyccaccctaattcactgtaatcacatcttacctaagtccatctgcaaagaccctatttccaaataaggtcacattctgaggccctgggtggacatgcattt

SEQ ID NO: 18828 - DNA, 201 bp, Homo sapiens
tttaaggacctttgtgatagttttgcacccactggatgacccagaatcatcttcctcttttaagatcagctgattagcaacgtcagttccacccacaatcytcatttccctttgttgcgtaacctaacatattcacaggttctggtgagtgggatgggggtatctctaggggaccattatccagccttccacaggcacttt

SEQ ID NO: 18829 - DNA, 201 bp, Homo sapiens
gatagttttgcacccactggatgacccagaatcatcttcctcttttaagatcagctgattagcaacgtcagttccacccacaatcttcatttccctttgtygcgtaacctaacatattcacaggttctggtgagtgggatgggggtatctctaggggaccattatccagccttccacaggcactttgtcacaggccaggcg

SEQ ID NO: 18830 - DNA, 201 bp, Homo sapiens
ttgctgtgtaagaaattaccacaaatttagtatatttgttatctcatagctccataggttaaaagtcctggttcaggctgggacttctgctcagggtctcwtgaggctgaaatcaaagcgtcagccagggatggggtcttatcagaggcccttggttactaacagaattcattttcttgtaactgtaggactgaggtgctt

SEQ ID NO: 18831 - DNA, 201 bp, Homo sapiens
ggagcttgcagtgaaccgtgatcgcttcactgcactccagcctgggcaacagagcgagaatccatctcaaaaaaaaaaaaaaaaaaaaaaaaaaaaaaaargaaagaaagaaattacaggtaggctagagcacggatgagcaaactgtttttataaaggaccagagagtatatatttcaggctttgcaggccctatgacgt

SEQ ID NO: 18832 - DNA, 201 bp, Homo sapiens
taaagtttagacctattttaataaggctgacttgggttgaagataactagagccatgactttcatcttgatggacaatgagtactcactctacttttttaktttatatttttattttagttcatttcatttaagacagcgtctgttacccaggctggagtgcagtgacatgatctcggctcactgcaacctacaccttctg

SEQ ID NO: 18833 - DNA, 201 bp, Homo sapiens
tgcagggagatttggggatgttggatgctaaggcccaagccgtctattgtatgccttttgctttggcataaaacaacagatgaccttctgttaggtgtatstctgctcatgcttgagagtggtggtgtttggaaagactcaatagcatatgcacatgaggaagttgaccaaatgattccacagcgcatactcattttttgc

SEQ ID NO: 18834 - DNA, 201 bp, Homo sapiens
tctacctggtgggagaaacagctgccagaaaatccagattcccattctcatgctagcttcataacagcaggagagctcctcactctgtttcccagggtgtrtatatatatgtatacatatgtatatgtatatcaatatatatatcaggtaagattctagtccagtgtgagccatatgctttattcctgagcaatcgctgtg

SEQ ID NO: 18835 - DNA, 201 bp, Homo sapiens
cctatctgtgatgacctgtaaatggaatttaagggaggaatcacacgtgttagcacggggttggcattgcgtggctgttttcaattaacttgaccactatsataacatcaaaggtgtgtgtaccattctatgaccattgaatctccatggacatgttttgggaaatggatttgtcccattacactgctttctttagtgcat

SEQ ID NO: 18836 - DNA, 201 bp, Homo sapiens
gggcacggtggcctacacctgtaatcccagcactttgagaggctgaggcgggaagatcacttgttgaggtcaggagttcgagaccagcctggccaacatgstgaaatcccatctctactaaaaatacaaaaattaggtggcaggcacttgtaatcccagctactcagaaggctgaggcgggagaatctgttgagtccggga

SEQ ID NO: 18837 - DNA, 201 bp, Homo sapiens
gaagagcataagaaaaaggaagggtactgggtggaccaaatctattgttacaatatcccttatattccttagggttcctttttttcaagttaaagcattgrgtcatgtctctgataaatcgcccccccaccccgatccccaccctctgccgccccggccttctttttgtgctgttgggttccaaactttacctgaggattt

SEQ ID NO: 18838 - DNA, 201 bp, Homo sapiens
atcccttatattccttagggttcctttttttcaagttaaagcattgagtcatgtctctgataaatcgcccccccaccccgatccccaccctctgccgcccyggccttctttttgtgctgttgggttccaaactttacctgaggattttcacatgcacatctgttaaatgccatttaaagagaacactaacaagagaaagct

SEQ ID NO: 18839 - DNA, 201 bp, Homo sapiens
cctacttttaaaaaattgaggtgaaattcacataatataagattaaccatttcaaagtagacagttcaatagcagtacattcacaatggtgtgtaaatacygcatctatctatttccaaaatatttgtatctccccacaataaaagtctgtaccaattaagcagctactacccattcctcttccctaccattctaccttct

SEQ ID NO: 18840 - DNA, 201 bp, Homo sapiens
aaggcagactttagtctggtttataatgctttaatatttttttgaaggaagaaaaatgttcattacttaacgtaataattatttttaaaaagcagcctggsgggggggtattcatttttctgtggctgccataacaaagttcttcaaacttagtgtcttgagacaagacatttattttcttaaagttctggaggtcagagg

SEQ ID NO: 18841 - DNA, 201 bp, Homo sapiens
tggctgcctgcaagggaggctgggaaatatagtttgctgtgtgctgggtgggtgggagggagcgtccacattagtgaacagccaggcagtcgctgcctcamatttctttagggttatcctttcattccagcaattgaatttgatttgcactgtttcacttctctacaagggtgtaaaaagtagaggttcctcttgaaagaa

SEQ ID NO: 18842 - DNA, 201 bp, Homo sapiens
tgttttaaacccatctgtttttgtttctggtaactgtatccaaaagtaatacagaattttccgtaagaacatttattgtgtttccttctacccacgaattktcttatgctacacacacaacccactgaaatttcacctctattgtatgtggcttttctagaaacgtgtgcttctgggctttgtctcacacctcctggccag

SEQ ID NO: 18843 - DNA, 201 bp, Homo sapiens
ttatgtcattggctacaactcagtcacatgaccatggctgcctgcaagggaggctgggaaatatagtttgctgtgtgctgggtgggtgggagggagcgtcmacattagtgaacagccaggcagtcgctgcctcaaatttctttagggttatcctttcattccagcaattgaatttgatttgcactgtttcacttctctaca

SEQ ID NO: 18844 - DNA, 201 bp, Homo sapiens
tcagcttgttttgctcctgcatctttgcatcagctgggctttctgccctaggctggacatgggtggggcactttagctggggtggttctcctccacatgtstctcatcttcctgggaccagcagggctagaccagacatgactttcttatggcaagggcagaaatgcaagacagcaactcaaaacacataaggactttcaa

SEQ ID NO: 18845 - DNA, 201 bp, Homo sapiens
agcatgtagaaagatcactgcagatgtccttgtcgtgttgaccttattggagaatttcctatctgtgatgacctgtaaatggaatttaagggaggaatcamacgtgttagcacggggttggcattgcgtggctgttttcaattaacttgaccactatcataacatcaaaggtgtgtgtaccattctatgaccattgaatct

SEQ ID NO: 18846 - DNA, 201 bp, Homo sapiens
aaacaaacagatctcaggagaactctttcacaagacagcactagggggatggtgattagaaagcacctcatgatcccgtctacttcctgcagagaacagaytagccccctatgcagcacacacctttgtgaggtccctcctccaacacagggattacaattcaacctgagacgtgggtggggacacagagccaaaccacac

SEQ ID NO: 18847 - DNA, 201 bp, Homo sapiens
ggaccaagttttattccctgtttaaccttggcctgacaacctaataggtgctcagtgaacagttcttgaatttaattctctccctttccccacactgatgkgtatttaagctccagtggtactcgatgtgttgttttctttgttcttttttttgagacagggttttgctgtcacccaggctggagtgcagtggcagagtct

SEQ ID NO: 18848 - DNA, 201 bp, Homo sapiens
ttttcaggtagaggctgaatgatttccgcacctttttatagattgcatgacttcaaagatgcacactaatactacggctccttgggaaatctttctgcactgatccctttgaatcttcagtgtttcaacatagacttgttacaaagagaaggaatataagcctctgttctttcttgtttccctttgttaattcctttttcc

SEQ ID NO: 18849 - DNA, 201 bp, Homo sapiens
agaatataaaattttgttctattttattttaaagctctggttacatatggtcaagttgcttcccaaaaagcgtctctgtcaggatgatcttatgaacgacsttagtacctcaattttactgtcccatccttttttcctccttccttgcctccttccctctctgcctccttccttttcttcccatttccttccttccagcat

SEQ ID NO: 18850 - DNA, 201 bp, Homo sapiens
ggattgcttaagcctgggagattgaggctgtagtgagctatgattgcaccactgcactccagcctgggcagcagagcaagaccctgcctcaaaaaaaaaaagtaaaaataaaaataaaataaatatatatatgcatgcacatcctaattcctgtaacacgtggatatgcccttacttggaaaaagtgcctttgtagaatgc

SEQ ID NO: 18851 - DNA, 201 bp, Homo sapiens
tggaggaagggagtcaactaaacaatttattagggctttatgtaaagccctagggttagttggttggttggttttgttttgttttgttcctttttttttttgccaggggatgctgtggttgaatttccctctgtggtgagagttgcatggggcaatgaggaggtagtccagaatagttctatggaaataggaggctttcag

SEQ ID NO: 18852 - DNA, 201 bp, Homo sapiens
ataaatatttattgagtagtaagcacatgcaaggcattgagggtggggagggaaaaagacacaaattgtccttaccctcatggattcaccatctatttaamggccacaaatacttgtgtgagaagcaagtcttaatagtctgaagtattttcttagattcccttgagccgcaatgctgaaaagcttatggtggttttgcta

SEQ ID NO: 18853 - DNA, 201 bp, Homo sapiens
agctcaccggggagtgtttctcccagttcctccccagtacacagaaaaacaaagctttctgtctcaccaggaggactccacggtgagcatagcttggctcmgcccagcaggagattttgaaccgactctggtagattcttcctgcagccattcagctcccacctctttctctcaaaaagaaatccagggctgggtgtgtgt

SEQ ID NO: 18854 - DNA, 201 bp, Homo sapiens
gttgcccctaggatcatttttttcaaagctaatgtctgccacaaatgggagttttaataggttataattcatatgacttagtgttaaacctctacgttggkattcttaaatttaacatggataaactgaacttgatttcctgcattaaaaaaaattaaagaaatgaaagttctgactgttttattgtagctggggaattct

SEQ ID NO: 18855 - DNA, 201 bp, Homo sapiens
gttgtaaaagaatacaagtaagtagtcaagtgacaccttagcattctgatgaaaagagctttgacctcacagagcttctggaagggtctcagagacatccstgagggtcccttgactgcactttgacaaccacaggtctacatgatctgtatagccttttccagttttcacatcctatgattccaagagggaaaacaatct

SEQ ID NO: 18856 - DNA, 201 bp, Homo sapiens
ccacacccggcctcttctcgatagatcttatttggctgacaacgaaagctgttgtgctggtagcatcatccctttgcatgcaaaagataaactgaaatctraagtagccatatccttccggccaggtttttcaagtggttactctgttctgatcattgtcatgacaggaatagtgaaaataacaataaatcatttttcttt

SEQ ID NO: 18857 - DNA, 201 bp, Homo sapiens
gctcctacaccatgagtgcttttgtatggtgactgtctggttacaaggtcatcttttcccctggatgagacgccccttggggaaaggaccaagttttattycctgtttaaccttggcctgacaacctaataggtgctcagtgaacagttcttgaatttaattctctccctttccccacactgatgtgtatttaagctccag

SEQ ID NO: 18858 - DNA, 201 bp, Homo sapiens
ttttggaggacttgaaaggttcctgctacctttggctggggatggagggaacatggaagatgggtctttgtttagaggaagctctttatcctggtacgctrgaagttggcatagtcttagcagttagtccagatgtgaatttcaggattattctgtgagtcttccaagtcctgtctcagcagtgaaataggctcagtgtag

SEQ ID NO: 18859 - DNA, 201 bp, Homo sapiens
tggttcagggtgttgaggcttcgtgctgttaatattggaaggtgggtcatttgtactgggcatctgtcctgtatcttggagatgtttagtaacatccctgrcctctagccattagataccatctctcccagtagggataataaaaacatgtctccagatgttggcaaatgtctggccttctggggagtaaaatggcccctg

SEQ ID NO: 18860 - DNA, 201 bp, Homo sapiens
gatagtaggtaaattaatggaggaagggagtcaactaaacaatttatttgagcaattaatggaggaagggagtcaactaaacaatttattagggctttatktaaagccctagggttagttggttggttggttttgttttgttttgttcctttttttttttgccaggggatgctgtggttgaatttccctctgtggtgagag

SEQ ID NO: 18861 - DNA, 201 bp, Homo sapiens
gtttatgccactgcaacattttagaatcacctgggaagcttttgaaaactcccagcatcatgaagcatggtctcttgccttggggtcagtgtctgtcaacrtggcttttgctaaagagccttcccctatgagaagtgaggcaggagaaggcggagtgaccacaagatgccctgatggtgccaagctattattataaatgaa

SEQ ID NO: 18862 - DNA, 201 bp, Homo sapiens
agtttatgccactgcaacattttagaatcacctgggaagcttttgaaaactcccagcatcatgaagcatggtctcttgccttggggtcagtgtctgtcaaygtggcttttgctaaagagccttcccctatgagaagtgaggcaggagaaggcggagtgaccacaagatgccctgatggtgccaagctattattataaatga

SEQ ID NO: 18863 - DNA, 201 bp, Homo sapiens
tcttctttatattataagtttatgccactgcaacattttagaatcacctgggaagcttttgaaaactcccagcatcatgaagcatggtctcttgccttggrgtcagtgtctgtcaacgtggcttttgctaaagagccttcccctatgagaagtgaggcaggagaaggcggagtgaccacaagatgccctgatggtgccaag

SEQ ID NO: 18864 - DNA, 201 bp, Homo sapiens
gtatagtgatgggtctctcatggctcacgtattaactgtatttgttgttactgcttctcaggcactctgttaagaatgcagggctcttcctcagactcagsgcggggcctgggctttacagcaatggttttcagtttgtaatctctctcaaggaagggagaggagcacaaagctgccttgactgccagcaccatcagaaaa

SEQ ID NO: 18865 - DNA, 201 bp, Homo sapiens
acaaaaggccaaccccattagacagtggccaagggaggtgaactaaagttggtgctgtgaacagggctaatggtttgtgatttacccataagtggaaggtrtactccggctgctcctttaatattttatgattagcagtagaggtgtgtctgggggaaagagtcagcttattttatttatttattaattttttgagatgga

SEQ ID NO: 18866 - DNA, 201 bp, Homo sapiens
tccagaatcattggccctggctctactcctggaaacccagtccatctctaatccctttgatttccaatgggaggcaaatccaggggagttctagactgtckagaatattgtaccaagaacaaaaggccaaccccattagacagtggccaagggaggtgaactaaagttggtgctgtgaacagggctaatggtttgtgattt

SEQ ID NO: 18867 - DNA, 201 bp, Homo sapiens
cctggcttggtgtgttttgtggcatttggcaggcaaacgttttgaaaagaaatctcctttcaaaaatcacagcactggttgaagcaggagcatctctcccyttaaatgcaaaaggagttaatatgccagtgactacagtgtgcctggaaaggtcactggaggcatttttgtctggggcagcccctggagtcttggcttttg

SEQ ID NO: 18868 - DNA, 201 bp, Homo sapiens
agcccctgggcattatttccccaattccgtatcccatctactaatacaaactaatgagatctattaaggatgagtccacaagtttgaagggagtctcttaytaatgttccgtctttgcatggtgttacaacagcgggaccattttacactgagggtttgcgagaggcatggctcccctgttatgtatttgggacttactgc

SEQ ID NO: 18869 - DNA, 201 bp, Homo sapiens
ttttttcccttttctttttttttctccccatcttgaacatgttgctgtagacaggtgctaggtttccctgaatgactaaagcagagatttggttattttcytcccagaaaaagtagatgcatcagcagagttgagcccctgggcattatttccccaattccgtatcccatctactaatacaaactaatgagatctattaag

SEQ ID NO: 18870 - DNA, 201 bp, Homo sapiens
actaggggaaacaaaccctgttttgtagtatttgctgattactgtggtgtaaatactcacaccttggctgatttcaagttgcagcttggaacttggagttrgaaagagatgtgtagtcccataccattttatgtatgtaaagtatttgcactatgccgactaatagacataaataacctcatgagcatagataatagtcac

SEQ ID NO: 18871 - DNA, 201 bp, Homo sapiens
aatgtctccagacatttgcttctgtcccctggggatcaaaatcacccctggttgagaacttggggtaatttaagtggtgctccggtaaaggccattcaacwtgactcactgtgttgatgttatgttttctaacattgactttcctttaaaccatagggttcgaaaccgccaagtcttttgccctccatggtgcacatgtga

SEQ ID NO: 18872 - DNA, 201 bp, Homo sapiens
gtcccacaattggcaagtgccataaatatattataggccattatactttctacagtatctttaattgatatgccccatgtctaagaaaaaaagtagtttttcatgatgaaggtgatgaactacttctttccattattctatttcccccttttcttcttcaggctttaaagatatcataataccatttacatttactgttta

SEQ ID NO: 18873 - DNA, 201 bp, Homo sapiens
tggactctgatggatctaatcgaggattaggatggaggtaggtgggaacatatttagaaggatgccctgtggtttttctccttcctgctatttatatttcyctctctgtctttcccacctgtttggtgatgaggaaggagctgtgtactggtttgaaacctattcacgacatagtggacccaacaccaagtgtcttattgt

SEQ ID NO: 18874 - DNA, 201 bp, Homo sapiens
cctgccgtgctcaaagcacttgcttacttggaatgccataaattacatgaaggaattattcattgtatcacgaaacataccttccagtctcccgagtagtstattaggctaagtatggtcttttaaattattactttaaaaataaaagataatggaattatagcattaaatacattttgcaaatgatcttctagtaggatt

SEQ ID NO: 18875 - DNA, 201 bp, Homo sapiens
ctgttaggacattgtaattattttgtattacttaggaaaacttttatgattctactcttttaatttttttaataattactttatgacttcttcattagggwttctctcctccagtgcgtacgcagatcttctgaaaaggaatctgacaaatttagttgctgcatttttctaaattgctttcaagactacccagcacttcag

SEQ ID NO: 18876 - DNA, 201 bp, Homo sapiens
tacctctggaggccccaggctgggactttgggtacagatgcacaggagacctttgccccaccccgtcacggctgggcctactcagttccacgtctttgagktttcacgcggaaactggatgtttcttacatcctcagctgcaggcatggggaagagacgcacatcagccattaagaaaaaggtatgcagtctacatgcctc

SEQ ID NO: 18877 - DNA, 201 bp, Homo sapiens
ttgaaggaaagttttggctacccagttgttagctgctgaagtttaactgtgcattctaagcacaccagtattttattacatcatacctgggcagcagatarttttagtaaaaccttgaaaagatatgactattgggaagaaatttgggattctatcctttttctctccattcttctctcctgcaccaagtttctaagctcg

SEQ ID NO: 18878 - DNA, 201 bp, Homo sapiens
tacctttgtctcagtcaatatttacctctgaggtcaatacgtgtggatattcacctcagctgcagtcaatatccatttcgtattacaatatatgatgtgcrtatgtgaaaataaagaacagcatggtacaaaaaaggtctgctaggcaaagaagctttttgcaaagcggatgtgtttttgttttattttttgtttgtttgt

SEQ ID NO: 18879 - DNA, 201 bp, Homo sapiens
ccactgaccactctctgtacagatgcgctcaagcgaccataaccaccagtgttcctaacaatgcgcctattgacttcttatttcaatagatatccagattkattatccctcaaggtaagcatcgattttacctttgtctcagtcaatatttacctctgaggtcaatacgtgtggatattcacctcagctgcagtcaatatc

SEQ ID NO: 18880 - DNA, 201 bp, Homo sapiens
cctgattgagtaactgctctctgaaggtggaggctggactgcttcactggacagggtggcctggggttattctagtgcagtggtagctggtgacaaaactsaaagaagatgtaactagagaaaaggtactcagtgcagcctctgtgagctaccaccactgcctctagttttccagaaaaccaccactgaccactctctgta

SEQ ID NO: 18881 - DNA, 201 bp, Homo sapiens
ggcttcatatattattgagagcaaacctactttccaccgccactcctggatgcacttattttgcgagccttattcagaatgtcagcatggatcacttggcracaaaggcctaaagggcaagccaggaagcttccatggatacgttatttatggtgtttaattattattgtacagatttattaaatgactctgttacctagg

SEQ ID NO: 18882 - DNA, 201 bp, Homo sapiens
tgaaactacatgttcattgaaaatgatcttttgggtggttgatgttcgattttggctctgtgttgggcctgcccagtgaggtccttttgactccctaaggraccctgttttgggtttcttttgaggttgaagatatttcagactctttccccctcaacttccataggaaccaaactctctttcttcctcccgtttggttgg

SEQ ID NO: 18883 - DNA, 201 bp, Homo sapiens
cccggactcgaatcccagctctgatccatctcagctctgccatattgccaagttccgctgagactccatttactcacctgttgtatcatctgaattatttycatatccataatgtgcaaggatatccttccatgttattagaaatacagatacaccatcattatcagtggccaaatcattcaaatcgctgtttgcttcttc

SEQ ID NO: 18884 - DNA, 201 bp, Homo sapiens
ataaagtttatttttacagtaattttaagttcacagcaaaactgagtgggaagtgtagagtttcatatactccctgtcctcacacatgcacagcctcctcyagctatgcacattttcaatgaaactacatgttcattgaaaatgatcttttgggtggttgatgttcgattttggctctgtgttgggcctgcccagtgaggt

SEQ ID NO: 18885 - DNA, 201 bp, Homo sapiens
tggaggttgcagtgagccgagatcaggccactgcactccaatctgggtgacagagcaagactctgtctcaaaaataatagtaataataataataataatartaataataataataataataagaatctgactaaggttattaaccattaaggtatgctgtgctaaggagcagggggccccttccatccgtagagggcagaa

SEQ ID NO: 18886 - DNA, 201 bp, Homo sapiens
ggaagaatgaggatttggggaaggaaaattttgagagccattttacagcatttcaagattcagtgatctcagaacctcttttggttaaacaagcatgggargatggatgattggatggatggatgaatggataggtaggtgggaagataaatggatagacatataggtaggaaggaatgagggatatatggaaggctagca

SEQ ID NO: 18887 - DNA, 201 bp, Homo sapiens
tctttaaggaaaaaggttggatggatgatgtcaaagacccactgttcagtctttctttcttatattttgagccttaattgggtccctgtgagtcaatttcmgatgatagaatttgctgttttatagttttactctaacatgtagtaccttgagatagaccagtgatcccagactaagaattattcagaatcattcaccgtc

SEQ ID NO: 18888 - DNA, 201 bp, Homo sapiens
acaaaaagcagctttcgtttgcttaaaatttttgttctctgcctttatttttcaaaaatattttcactaggtatagaattctaagatgaaagttttatttkttttcagctgtggcttccatcattttcctgagaggtataactatcagtcttgtagctactggtctctaactacttctaaaactatctgcagtttttagca

SEQ ID NO: 18889 - DNA, 201 bp, Homo sapiens
ctagtgtgggtctatacgtgacactaggtgtagtgtaggtgacaaacaaaaagcagctttcgtttgcttaaaatttttgttctctgcctttatttttcaaraatattttcactaggtatagaattctaagatgaaagttttattttttttcagctgtggcttccatcattttcctgagaggtataactatcagtcttgtag

SEQ ID NO: 18890 - DNA, 201 bp, Homo sapiens
ttccattactcacctcctaggttaagcattgttattattattgatatagtaatttttgctatatattttaaaactcacagatttcactcttaccatttggrtcttaacatgtcgttaccctttatgttgctctttgttactttctgcatctctgggtttatagctaaggtcattttcctcctgcctgaagagcatccttta

SEQ ID NO: 18891 - DNA, 201 bp, Homo sapiens
atgacacaggagacagggaaagagttttgttatcctgatacacacattcttaaatgcctctagctgtgtagacattggtttgtccatattaatagtatttyacgaagtgccagttgtgtgcctgctttgtggcatatgcattggcattcattgctttatttaattcttccaacaacgtgtcagatgtctgttcaaattatt

SEQ ID NO: 18892 - DNA, 201 bp, Homo sapiens
ctcccattttacaccctgtttattgatactaagaagagcctccaactgaataagaactaatgacttctgcctgccatcattttggaatgtccaattccccrttctggagagcctttgattataacatcagcctgtcatttggacctctgacctgaattatatgaatctgaaaaatctcttcctttcctatcgtgaattcgg

SEQ ID NO: 18893 - DNA, 201 bp, Homo sapiens
ttgctgaatactgagtaaataaagaaaagttaacacagtggagtccaggtacagtggctcatgcctgtaatcccagcactttgggaggtcaaggcaggagratcacgtgagcccagcagttcaagaccagccttggcaacatggtgagaccccatctctacaaaaaataaaataattagctgggcatggtggtacatgcct

SEQ ID NO: 18894 - DNA, 201 bp, Homo sapiens
ggctgggacaacatgcccactctcaactaatttttgtagccatggagatttggaagtctggcaagtcttgggtcacatgatctaccttacagctgttactrcagacctcccaaagctcacgaactgagagtcaggaggcgtggttcccctaactcaaatcagaatttcgttatcaaaagaagagagggatggttctgtggt

SEQ ID NO: 18895 - DNA, 201 bp, Homo sapiens
gatggagtctccctctgtcgcctaggctgcagtgcagtggcgcgatctcagctcactgcaacctccgcctcccgggttcacaccattttcctgcctcagcstcccaagtagctgggagtacaggcgactgccaccacgcccggctaatttttttttttttttttttggtatttttaatagagacggggtttcaccatgtta

SEQ ID NO: 18896 - DNA, 201 bp, Homo sapiens
gaaaaggaacaacaaaaaagtatatctgtgaacttattaaatgactttaatcatatgaaaatcagccatcagccttattagagtggttgattttttttttratctaagagctttcttggttattttctgttcttaatcattgttgtatatccttaatgcgcaggacatgacaccgtataacaagtgttttaaaaatattta

SEQ ID NO: 18897 - DNA, 201 bp, Homo sapiens
ccagaatgagtgtgttttctagctgtcactgcctgatgtttactgctcaaagcttaggacttggattagagcccaggacttggcagccaagataaaccagstgcaattacgctgaacatctcagcccagctcctgtccatccctgaacaggacacttagggtagaggatgttctcagcagtgccatttgcatcccccttca

SEQ ID NO: 18898 - DNA, 201 bp, Homo sapiens
ctaaagtcagttacataaccaagcccagcttcagaagggaaattgtatgccttacaaggaggtgagaggatggaaaatgaatatttgctgaacagactttytgtccagtttgttgtatttggtggtggtgcagggcaaatatatgtttaaaaccttgttcagatttttagctttcttcagaacagagcttttaaaactgag

SEQ ID NO: 18899 - DNA, 201 bp, Homo sapiens
atcatacccattcccaagatttcagtcatcaaatccattccaatatgactcctgtatccatatgtccagttccaagtatctgtccatggtgttggtcccakgttattcgcacctcatatgtctttggcacagcactcttgacagctcataaagtcacgctgttacccccacaatgtccccccacatatcattgctatccct

SEQ ID NO: 18900 - DNA, 201 bp, Homo sapiens
cgatgagattggaggcacctgggtgtcagcctcttgggctggctcattacaggccactctgtctgaggaacactcaggtttgcaaaccgtttcttaaaatwacaggatacctagggacctgttggggtgggagggaagaaccctatgggcagaaatgtgactttctgtagcaaagatgtactgtttcccactgagaagaat

SEQ ID NO: 18901 - DNA, 201 bp, Homo sapiens
tacaggattttacatggcttagagaaatactgtggtggtgaaaatatgcataaaaaagcgagagattttacttttgaaatgctgccaaagtgaaatctctyttggataggcagatgacagtttagtacttgcaggtctttcgattctgacaactgtcagaagtgaatttaagtgctggtgactaggctgccagagaaacac

SEQ ID NO: 18902 - DNA, 201 bp, Homo sapiens
gtctttggcacagcactcttgacagctcataaagtcacgctgttacccccacaatgtccccccacatatcattgctatccctcctcgacacccacacctcytgcatgttcctgagcttcttaggcgtgttgcatcttcctgaccttcccagtccgaagcccaaggagatacttgataaatattcgtctaataaataaatga

SEQ ID NO: 18903 - DNA, 201 bp, Homo sapiens
aaactggctgactgagttaaatgaatgccaaagtcacagagctgctgagtggcagagttgtaattcccatgcagaactgtgtggcatcaaagccatttttwaactcattgcaatgcacagtgggttaaaatgagatgattgaaaatgagatgtggctgggcatggtggctcacacctctaattccagcactttgagaggat

SEQ ID NO: 18904 - DNA, 201 bp, Homo sapiens
tgaactttctgtcaccggtataatttaaagaaattatacttaagctttgtctcacttagaagataatatagaacagtggtgtttttttaattaaaaaaaargttaaaataacggttttgtatccttgctttacttcttaaacatatgggaggaaaaaaaatctttaacaagtttatttattttcattttctgctaaattac

SEQ ID NO: 18905 - DNA, 201 bp, Homo sapiens
gttacatcaaggctgggaggaggtctttccactggttttccgggctgtttgtgtactacacagcctgtgtacctggcaaggcacgctctgctctgccctgmcttctgatgagctgactaacaccttatagatgaggttcccttagaaccaaagatgccccatgaaactccctaggatgaatgttggaagtccttccaactg

SEQ ID NO: 18906 - DNA, 201 bp, Homo sapiens
ctctctctctttctttctctttcctttctttcttccatttaaattgagacagggccttgctctgtcactctggctggagtgcagtggcataatcatagctsactgtgcccttgaactcttggactcaggcaatccctcgacatcagccttctgagtagctgggactaccggtacctgccaccacacctggctatttctttt

SEQ ID NO: 18907 - DNA, 201 bp, Homo sapiens
gcaatgggaacagagctgaggctcctaaggtctagagtcaacatgaaaatacctttgcttctgggccatagctgtgtttcttcttaacaaggcagaagccyagaagagacttcatgtactgtgactgtaataaagagggttgtaagtagagaagctggaatttgaaaggttacgtacaagtcaagctgcctctgtaatgtc

SEQ ID NO: 18908 - DNA, 201 bp, Homo sapiens
ttattttcagtttatcaattaagttgttcaagtcttctatatactttgtgtttgtctgcttattttatctgttactaagagggatatgttaaaatcttccrttataattgtgaatttgtctatttattgtcctaattctgtcaatttttgacatatatgagaggctctattattaagtacatataaatttagaattgtcat

SEQ ID NO: 18909 - DNA, 201 bp, Homo sapiens
tgatcatcctcctgagtagctgggaccacaggtgtgcaccaccacgcccaactaattttttgtagagatggaattttgccatgttgcccaggctggtctcraactcttgggctcaagcgatccacccgcctcggccaccccgattcctgggattacagccatgagccactgtgcctggtcttctttttaatatatgtagtt

SEQ ID NO: 18910 - DNA, 201 bp, Homo sapiens
cttagggttcataggatctgtagtccttttctttatttttcatttttaaaaacaactttattgaggtatgattgacgtacaaaaagcctcacgtatttgaygtatagaacttgataagtttggagataagtatatacctgtgaaaccattatattttataagtacatgatacaatatgagcacagtactatatggtagatc

SEQ ID NO: 18911 - DNA, 201 bp, Homo sapiens
cttaagatcttcttagggttcataggatctgtagtccttttctttatttttcatttttaaaaacaactttattgaggtatgattgacgtacaaaaagcctyacgtatttgacgtatagaacttgataagtttggagataagtatatacctgtgaaaccattatattttataagtacatgatacaatatgagcacagtacta

SEQ ID NO: 18912 - DNA, 201 bp, Homo sapiens
gttgttcaccatatcttaagatcttcttagggttcataggatctgtagtccttttctttatttttcatttttaaaaacaactttattgaggtatgattgaygtacaaaaagcctcacgtatttgacgtatagaacttgataagtttggagataagtatatacctgtgaaaccattatattttataagtacatgatacaata

SEQ ID NO: 18913 - DNA, 201 bp, Homo sapiens
gtgactcagataggtgtgtattctcaagaagctttcattctaatgacacatactttgtctccagtcagagttatggcaggttttttttttttttttttttttgactaaattcacccatatttgatggcaagtgtgatcacagcatgtttataaaaatcattcttaattaaggcatttccatcttatcaagccccctattta

SEQ ID NO: 18914 - DNA, 201 bp, Homo sapiens
aacctgcctggccttgtgttatatcgatgctttctcaatctgttaaaaacgtagctgctattgaatgactaagaattgtttactctcatttccactctctkacatcttttttttttcttttaataccctgtgatgaaactgtgaagaaagatattcctgatcattgctttgacctggaaatttcaaagggacccacagtcc

SEQ ID NO: 18915 - DNA, 201 bp, Homo sapiens
tgtcagatgtgccctttctggtaataaaaagtcctttgccgtgggttattttgtcaagtgagatagcaggacttaacaggtttgtttgggaaaataaaatytgatagaaaaacggcatgcttttcccccacagatttcttggtagcatcattcaaaactacagtgagcagtatctttgcaggattttaatatttattcatt

SEQ ID NO: 18916 - DNA, 201 bp, Homo sapiens
aagtatgggccacacaaaacaggtctgtgggcttgacttgtcctctgatcatcagtttgtgacctctgttctaaagagtgaaaactatgtaagatagtatmagataagtaggtatttaaattactttgcaccttttccatttcatagaacttgaatgtttgtgttcaaagcttaaaacccaagacagtgagctattaagcc

SEQ ID NO: 18917 - DNA, 201 bp, Homo sapiens
ctctactaaaaatacaaaaattagccaggcacagtggctcatgtctgtaatcccaaatgcttgctcgggaggctgaggcaggagaatcacttgaatctggkaggtggaggttgtagtgagctgagattgcaccactgtacttcagcctgggcaacagagcaagactctgtctcaaaaaaaagaacaaaaaaaaaaaaagaa

SEQ ID NO: 18918 - DNA, 201 bp, Homo sapiens
gtaatgccagcagcacgggtgatgatcatggtcaacatgaccaactagaaagcccaaaccccacctctagctgacagtggcttctcagctaacctgtcacyacgtgggattgggcccccagtggtgtaagctttttcagagaagctacacatctagcttttggacctgtgatctccccaatgttttaatgctggcaactaa

SEQ ID NO: 18919 - DNA, 201 bp, Homo sapiens
agccctatgcctttgggaaggagaggaaggactaatatttgtgtggtacaaaggatgtgcctggcataccccatatcttttacaaagacataaatgtcttstgaataaaagtatgatgatgatgatcatggtgatgaagatgagggtgatgatgttgatgatgatgatggtgatggtgatgatggtagtatgataatgctg

SEQ ID NO: 18920 - DNA, 201 bp, Homo sapiens
cttgaaggggagggaaattgttagctacacgaccaagagacagaagagaggaaggagtttgtacccacaactcagctttattttatgtaagctctttctgyaaagggaaagtagctctttgtaccaaagcaagggcctctgaatgagagctgggagaggccagaatgggcctgtaagaggttgatgtgtatgagacctgaa

SEQ ID NO: 18921 - DNA, 201 bp, Homo sapiens
gcaatagaaattcaaggtatgaaattcaaggtgtggtctcagagtcattttatcttacagcttctctgctgtgttttctcagtatgtgaaatgggaacatsacttaccatctactcacctcctgtttgagttcaagggaaggtttgcagattggcctgaaggaagacttctcttgaaaaactcaaaccaaagagcacaccg

SEQ ID NO: 18922 - DNA, 201 bp, Homo sapiens
tgtcaccggtataatttaaagaaattatacttaagctttgtctcacttagaagataatatagaacagtggtgtttttttaattaaaaaaaaagttaaaatracggttttgtatccttgctttacttcttaaacatatgggaggaaaaaaaatctttaacaagtttatttattttcattttctgctaaattactttcagaac

SEQ ID NO: 18923 - DNA, 201 bp, Homo sapiens
tatgactatttcatgagtgcttactatataccaggcgctgttacagcccgtgtaatgccacctgggagttggggggagtcaccatcgtccatccgtctgtscatccatccatccatcctgcctccctccatcctttctctttttcacaatgtctcttgctccgccccctctcttcccctccttccttcctatccagtgctt

SEQ ID NO: 18924 - DNA, 201 bp, Homo sapiens
aatttgtaggagctgctcttaatgattattactgcataggctggaatagaagcaaaatttgcagtaatacttttgtacctttctctttaggccttggcatrtattaaagtactatacatttgtcttaaaaattgaaattgtagattattttcatctaagacccttttgttcacagatttttttttccaagtatacctattc

SEQ ID NO: 18925 - DNA, 201 bp, Homo sapiens
aagaccaacgtgtaaattacatattaatctttctttttctccctagctcggttttaagaataatgttttagccaacatatctgcattactcttggctcaayatgagaaatccatttttggtttgcctaacagaagatcatgttgctttgcttctctacacagtatgaaaacccaaagaaaagaaaaacagaggcagttttt

SEQ ID NO: 18926 - DNA, 201 bp, Homo sapiens
ttgtggtcaacagtggggcttagggggcaggttttgtggctgtgacagaacacgtggcccctagtgtgtctgttgaaagatgggcccctttcaggaaaatkgcttaccttactttttagacataatttttgttttctgttaaagggtcagttatagataagtatgctcccttgcaatgaaatgaacccactttatcaattt

SEQ ID NO: 18927 - DNA, 201 bp, Homo sapiens
atgattttttaaggaaaattttgaaaagtctacaagttaaatttttttttctatcccatacattttccatcctaaggcattgaaaaagcacactgtgaaatacttagtgtatctagaaacatcagggaagaatgcttccctcctaagcaaaattttgccttctgaaactttttcagcattcagtctttttatataatactt

SEQ ID NO: 18928 - DNA, 201 bp, Homo sapiens
aggaaaattttgaaaagtctacaagttaaatttttttttctatcccatacattttccatcctaaggcattgaaaaagcacactgtgaaatacttagtgtatctagaaacatcagggaagaatgcttccctcctaagcaaaattttgccttctgaaactttttcagcattcagtctttttatataatacttagaaaaatatt

SEQ ID NO: 18929 - DNA, 201 bp, Homo sapiens
ctgtttgaagcactgtattgagcataccatatgctgaaagacttggaatgcaaaaacctaaggccaagggcacttctcaatattaaaccctcagttgtaakggaggcatcaagactataagatccaagaccttaacttttgtgctccttgtcttgtggagggaacatccatcctcaaaacagaaacctgtgagatcccttg

SEQ ID NO: 18930 - DNA, 201 bp, Homo sapiens
gaagagattctcgtccgctcagttaaggtactcagactattttccaaccaatcaagagggtgctgcttcatggagttcgtttaagctgaagcggcagctgktgactgtcatttgcatcatctttatacatttactgtgaatgtcactgtccatttccactttctttctacttgtcttcaaattgatgcttatcaagtagac

SEQ ID NO: 18931 - DNA, 201 bp, Homo sapiens
tggccaaattctgtttgaagcactgtattgagcataccatatgctgaaagacttggaatgcaaaaacctaaggccaagggcacttctcaatattaaacccycagttgtaatggaggcatcaagactataagatccaagaccttaacttttgtgctccttgtcttgtggagggaacatccatcctcaaaacagaaacctgtg

SEQ ID NO: 18932 - DNA, 201 bp, Homo sapiens
tcaagtgatcctcctgccttgagctcccgaagcgctgggaccaatagagatttctctgagaattaggtcccccactattaataaggtcattgtcagctgarttggggaggtggcgtgggtagatacaattaatttagattttttaaaaggcttttgagaatattcggagaacctaatatattttgagacctgacatttatt

SEQ ID NO: 18933 - DNA, 201 bp, Homo sapiens
ggagatgttctttgagattcggtgattgagttgtgaacatatggactgagggtgttttgtggtaaggcttgagtcatgtctgtagcaaggatgtttcctgrataatgtgcactgagcatcaagtgcctgcagtggcctggcgggtaatgccagcagcacgggtgatgatcatggtcaacatgaccaactagaaagcccaaa

SEQ ID NO: 18934 - DNA, 201 bp, Homo sapiens
agtctcacacttgacatagtagggtttgacatggtttaaataaaatctcaaccagatcagtgggagatgttctttgagattcggtgattgagttgtgaacrtatggactgagggtgttttgtggtaaggcttgagtcatgtctgtagcaaggatgtttcctggataatgtgcactgagcatcaagtgcctgcagtggcctg

SEQ ID NO: 18935 - DNA, 201 bp, Homo sapiens
tgagcctgctacccttgtgcttctctgtccacgcaaagccaagtgctactgcggggttttccaaggcatagctagcatcctaatagtctcacacttgacakagtagggtttgacatggtttaaataaaatctcaaccagatcagtgggagatgttctttgagattcggtgattgagttgtgaacatatggactgagggtgt

SEQ ID NO: 18936 - DNA, 201 bp, Homo sapiens
aaacttaaaccagaaggaaccttcctggcatcggggaaagaagctgcctttttcttagctcctacctctgtgggagctttgtcagtatttgaggggacagrgttcccaccttcatgttttttgtgcctgaggattctgtgggcgactgtccccacctgtccagcctaccagtgagtctcatggtgtgcggctgcctgctcc

SEQ ID NO: 18937 - DNA, 201 bp, Homo sapiens
ttaggcctatcttcttgctttatgcataatggcagatctccagggagggagaggatgtgtgctggaagattctacaacttgttgattggttcctaaagatsgttttagtgctatgtttgtggggcggggctggagggggctggaaatcaccatctctgtggccttttaattgtgcccagttacaagtaacatttgtcccca

SEQ ID NO: 18938 - DNA, 201 bp, Homo sapiens
tattgatctagactgcctgctactttcatttaccatgttactgctcgtgggattacaggcacaaaggtttcataaatttcaaatgaaatatgaacatttgktgtcaaagtactgttaaggtatgaaaaccctgctagtattagttcccttttgttattattctattattattattattattgtgtttacatccacaggcaa

SEQ ID NO: 18939 - DNA, 201 bp, Homo sapiens
ctactaaaaatacaaaaaattagccgggtgtggtggcgggcgcctgtagtcccagctactcgggaggctgaggcaggagagtggcgtgaacccgggaggcrgagcttgaagtgagccgagatcgcgccactgcactccagcctgggcgacagagcgagactccgtctcaagagaaaaaaaaaaaaaattataacatggaaa

SEQ ID NO: 18940 - DNA, 201 bp, Homo sapiens
tgcctaccaccatgtttctgaggcctccccagccatgtggaactgtaagtccagttaaacctctttttcttcccagtctcaggtatgtctttatcagcagygtgaaaacggactaatacagtgaggaaatccatgtgttaggaagggagtgtggttgtacttcaacctggaactgtctaactcctaaggttttattaatat

SEQ ID NO: 18941 - DNA, 201 bp, Homo sapiens
tttaggagctctgtgccaggaacctggatgaagacccagtatgtatttcttattatatcacaatatcacaaatccacagtcacatggtgattgtggtagtktggggggcctgatggtggggtacacctgcttgaagtcaggctaccatgcccattggggtcctcccccttttttgccctctgatcttgtgagttccttaac

SEQ ID NO: 18942 - DNA, 201 bp, Homo sapiens
accccatgcctggccaatttcaaggattttaggagctctgtgccaggaacctggatgaagacccagtatgtatttcttattatatcacaatatcacaaatscacagtcacatggtgattgtggtagtgtggggggcctgatggtggggtacacctgcttgaagtcaggctaccatgcccattggggtcctccccctttttt

SEQ ID NO: 18943 - DNA, 201 bp, Homo sapiens
tcagcttcccaatgtgctaggattacaggcatgagaccccatgcctggccaatttcaaggattttaggagctctgtgccaggaacctggatgaagacccartatgtatttcttattatatcacaatatcacaaatccacagtcacatggtgattgtggtagtgtggggggcctgatggtggggtacacctgcttgaagtca

SEQ ID NO: 18944 - DNA, 201 bp, Homo sapiens
gtattccaaataattggtggaaggatggaaaggttaaatggaaattatgtaagggctgcaaagagattcatatatgactatttcatgagtgcttactatayaccaggcgctgttacagcccgtgtaatgccacctgggagttggggggagtcaccatcgtccatccgtctgtccatccatccatccatcctgcctccctcc

SEQ ID NO: 18945 - DNA, 201 bp, Homo sapiens
cccatctcatgttgacttaatttctccagcattcagttaagacctagccgaagcataattgtcagcatagtagagctggctctcctctttctaattgcccwgcagagtttttggggagtctgtatgcaattgtgtacaccccaatgccccaaaaccctcttctatttcctttagcactcttgagctgaagaagccccactc

SEQ ID NO: 18946 - DNA, 201 bp, Homo sapiens
gggtccctcccacaacatgtgggaattatgggagctacaattcaatatgagatttggatggggacacagccaaaccatatcacaggatagttccccatatsaaggtccttaacttaatcacacttgcatttgattttatcatgcaaggtagcatactcacaggtgggattaggacttagacaccttcagcaagaaacatta

SEQ ID NO: 18947 - DNA, 201 bp, Homo sapiens
ctcactttcgccatttaatagctttgggtctacaagtaaccaccccagatttttctcctcctctatgcaccagtcatatcaagaattactgtaacttcatwggatttttgtcaggacgctatgatgagaagaacatatgccaaggagacagttttctggcaaatcagaggcctgtaagaaatgatggctttttgcttgtat

SEQ ID NO: 18948 - DNA, 201 bp, Homo sapiens
ctttgagggtcctcaaaatagaaggtcagagagtagacttttaaaagtcttgcactgtttacaagtcagatgctttttggcagagtgactctcagctcccyccaacaatcccttcttgtcgttcagtagtagatagactctatcagggaaaaataggagaaataaaataagacagcatatggaaggcattgctgaaagtct

SEQ ID NO: 18949 - DNA, 201 bp, Homo sapiens
cctctgcagttatttttcatgcacactcggattacactgctcggtgatattacatctgcatgcgtcttgccctctgacacggcaaacacagatgctgcccraatccttgtaaagccatatatcttaagtaggaaggagcatctttgcaggggaggtgaattgatttgcaaagcagcctgacacatggtctcttatttctcc

SEQ ID NO: 18950 - DNA, 201 bp, Homo sapiens
aaattttcatagacatccaccccctcactgccacaccccctcatagatttcttcttttcctcctccttctcctcctccctcttcctcctctttttcccccmccttcaaatagttccaagaccagagttgagggtgggtgggtagagggctagtttacagataaaatggttggtgtagatcatctagtttggaaaaagcaca

SEQ ID NO: 18951 - DNA, 201 bp, Homo sapiens
tacccctgattggttgctttccacgaccattcagccgtttgcataggagctgtaactttgtaacttcgcttcaccctctgattggttgcttttcacaaccwatcagacatttgcataggagtgtaacttctttccacaaccaatctgactgattgtgggccattacttcatttccatgaggtgtacaccaagtggccaatg

SEQ ID NO: 18952 - DNA, 201 bp, Homo sapiens
tagggtctggtcaaggaaagggccacttcctgggcctcccaaaaagaggaaggagaaggccctggcttgtggaagagtaagaggggcctcgttaatgtctmccaagcacagtaccccaactccccacatacagtcccaacccttactgcagccgggaggttaggtgtctgccgtgctcatgaacaggaagtgaacccgatc

SEQ ID NO: 18953 - DNA, 201 bp, Homo sapiens
atttgaaaaaaaaaaaaagtcaccaagttgtttccaattgtttttgtaaatttgcttagtcattttcagagacaaaaatttgggaaaaggattgtagaatsactggcttcccaaaaccacttggtgtttacaaagttatcaaaaacgggctgggaccactgatggtaataacaaaacctggggccctgaatcgtgtattct

SEQ ID NO: 18954 - DNA, 201 bp, Homo sapiens; identical to SEQ ID NO: 3293

SEQ ID NO: 18955 - DNA, 201 bp, Homo sapiens
catgtagattgtacatcgtttgtcgataaatcagtgtacaaatactaggggtgagtgtgctcaaaacttatttttactgataatagtccatgatcaaggcrgtttggagaccactcaggacagggaaaacgcagactcatgtgacccatcagggcttcagggtgtcctctggtgaagggcagcagcaggacagagccccac

SEQ ID NO: 18956 - DNA, 201 bp, Homo sapiens
agtgtgctgaatcatgttttaaacataattatatccggaatgcacttacccatttgaaaaaaaaaaaaagtcaccaagttgtttccaattgtttttgtaartttgcttagtcattttcagagacaaaaatttgggaaaaggattgtagaatgactggcttcccaaaaccacttggtgtttacaaagttatcaaaaacgggc

SEQ ID NO: 18957 - DNA, 201 bp, Homo sapiens
taccaccacgcctggctaattttttgtatttttagtagagacgggatttcaccatgttggccatattggtcttgaactcctgacctcaagtgatcctcccrcctcagctgcccagggtgctgggatcacaggcgtgagccaccgtgcgcgacctcagggtcccttctaacctgtgctgttgtcataaaccctggaggagaa

SEQ ID NO: 18958 - DNA, 201 bp, Homo sapiens
aggatcctaaagagaagatgtaattataagatctaaaacgtggaggggggtggtgaattcagcctgcaggcatgtgtttgctgcccccacccccacatccyctttttttaaagttcgcataaaaacctggattcttggtttctcttaaaaaactggaaggtctggcacctttgctcccacatttcccgggcgcagcccttg

SEQ ID NO: 18959 - DNA, 201 bp, Homo sapiens; identical to SEQ ID NO: 3294

SEQ ID NO: 18960 - DNA, 201 bp, Homo sapiens
aagtgtgctgaatcatgttttaaacataattatatccggaatgcacttacccatttgaaaaaaaaaaaaagtcaccaagttgtttccaattgtttttgtaratttgcttagtcattttcagagacaaaaatttgggaaaaggattgtagaatgactggcttcccaaaaccacttggtgtttacaaagttatcaaaaacggg

SEQ ID NO: 18961 - DNA, 201 bp, Homo sapiens
cctacccaaggtctggtcattgctatacttgagttcttttcaggctcaagatctctacctttttgtgttttttttttttttgtacagagtcttgctctgtygtccaggctgtagtgcagtggaacaatctctgtatgctccctgcaacctctggctccaggtttaagtgattctcctgcctcagcctcccaagtagctgga

SEQ ID NO: 18962 - DNA, 201 bp, Homo sapiens
ctgtcaaacaacacagtccccatctgtactttgggagggaaggacttcttaattccagctgcctgttgccatgggggaacatagacccagaactgccatcytttctaatttttttaaaaattaaaaggctaaaagttttggcttataaaaatggtatttcctgagtttttacaattatagtattaagatattcctaggttt

SEQ ID NO: 18963 - DNA, 201 bp, Homo sapiens; identical to SEQ ID NO: 3297

SEQ ID NO: 18964 - DNA, 201 bp, Homo sapiens
cccacctcagcctgagtagatgggactacaggcatgtgtcaccatgccaggctaatgtttaaaaatttttcttagaggtagagcctcactttgctgcctargctgatctagaactcctggcttcaagtgatcctcctgccttgagctcccgaagcgctgggaccaatagagatttctctgagaattaggtcccccactatt

SEQ ID NO: 18965 - DNA, 201 bp, Homo sapiens
tgctgggaatgcgttcattttctttatcttgccattactgtacctctattgggaaatttactctctcttcatagataggatccgattcagtacatatttakaaaaccacacttacatttaaatacaggcctttcccatttcacagtgtttctagctcccctttccaatacatctctctctctctttctctctctctctctc

SEQ ID NO: 18966 - DNA, 201 bp, Homo sapiens
gttttcgagacgaagtttcgctctcatttcccaggatggagtgcagtggtgcaatctcctccgcctcccagtttaagccattctcctgcctcagcctcctragtagctgggattacaggcgcccgccaccatgcccggctaattttttgtattttttagtacagacggggtttcagcatgttggccaggctggtctcaaac

SEQ ID NO: 18967 - DNA, 201 bp, Homo sapiens
accaactccattgttactagatatcctgacactgaagaagctaaaaccaaacaacaatgacaacaacaaacccaagtctgccttatggcacattcttcacrtcgtaacaccttccttgggaccctatttctcagtatggacctgactctcccagggatcctagaatgcaagcatagtgattgcaaaccagaccatttgagg

SEQ ID NO: 18968 - DNA, 201 bp, Homo sapiens
tggtggggaaggatgttgcggtggggttggggtggcaatgaaaggtgaaaaccactgtggtcccacctgcccatcgtcagatttcggttcctctcagagtyaacgtagaaggtttctgggggcatggacctgagtcttatcccctttgcaaaagtaagaattgtatcgtagcctgactcagggttttagccaacttctctg

SEQ ID NO: 18969 - DNA, 201 bp, Homo sapiens
caatggacggagaactaccatcccatttgggccaacctcttttttttttttctttttgtttcgagatggagtctcgctctgtcaccaggctggagtgcagyggtgcaatctcagctcactgcaacctctgcctcccgagttcaagctattcttctgtctcagcctcctgagtagctgtgattacaggtgcgtgacaccaca

SEQ ID NO: 18970 - DNA, 201 bp, Homo sapiens
cgcccagagtcgtatcacttgactgcatttgaccattcagttttcagaccaactccattgttactagatatcctgacactgaagaagctaaaaccaaacarcaatgacaacaacaaacccaagtctgccttatggcacattcttcacgtcgtaacaccttccttgggaccctatttctcagtatggacctgactctcccag

SEQ ID NO: 18971 - DNA, 201 bp, Homo sapiens
aggatcgcttgcatccaggaggttgaggctgcagtgagccatgactgtggcactgcacttcaacgtgggcaacagtgtgagaccccatctccaaaaaaaaragcagtatagtcagtaagaaagaaaacaaactaacagtcaatattgtggctgctctcaatgttctttaaacggatcacattgccacttttttctctttgt

SEQ ID NO: 18972 - DNA, 201 bp, Homo sapiens
aggaataataattcagtgaaaggaaatttggatgacatgaactcatttccattagacttgagccacacaaatcaatgggaaaagaaacagctgaatccagsataatatctggctatttggagtgggcatgataatggagggagattggggaggtaacaaaccagctactattaagttcaagtcatgtcagttattcaaatt

SEQ ID NO: 18973 - DNA, 201 bp, Homo sapiens
tagtcccagctactcacctgtagtcccagctacttgggaggctgaggcaggaggatcgcttgcatccaggaggttgaggctgcagtgagccatgactgtgscactgcacttcaacgtgggcaacagtgtgagaccccatctccaaaaaaaaaagcagtatagtcagtaagaaagaaaacaaactaacagtcaatattgtgg

SEQ ID NO: 18974 - DNA, 201 bp, Homo sapiens
cagggttattaggaataataattcagtgaaaggaaatttggatgacatgaactcatttccattagacttgagccacacaaatcaatgggaaaagaaacagytgaatccaggataatatctggctatttggagtgggcatgataatggagggagattggggaggtaacaaaccagctactattaagttcaagtcatgtcagt

SEQ ID NO: 18975 - DNA, 201 bp, Homo sapiens
ctcagcctcttgagtaactgggactgcaggtgcatggcactgtgctccacaattttttttttttttttagagatgggatctcactgtgttgtccaggctgrtctcaaacccttgggtttaagtgatcctcttgcctcagcttcccaatgtgctaggattacaggcatgagaccccatgcctggccaatttcaaggatttta

SEQ ID NO: 18976 - DNA, 201 bp, Homo sapiens
ggggttgtacttggaatgactggcctagaaaaccctacaggtaccatttaagctccatagttcttctgtgtgtgtttcggatcccaggttccaaacctgctctaaaacttgttgctgcatctcacctaatcgtgtagtgagccaggtgagctcatctgtgaaatgcagacctttctggacgtaccacctcgtggggtgaag

SEQ ID NO: 18977 - DNA, 201 bp, Homo sapiens
agagagtattttgtaacctgtgacgctcttttcaagtcttagagaggaagtatggaaagagcatgcgcttttgactgaggaggtcttgggtttaaaggtcraattttgccacttactttctccatggccttggtcaacatcctgaagtctcaggtccttgtctgcctttgctttgacacgagatgttgcctgcctcaggcg

SEQ ID NO: 18978 - DNA, 201 bp, Homo sapiens
ttctcctgcctcaaggagctgcttctagtgtgtgctcttaaccctaaaggaaggaaacactgtgtcttcctcttctctcatacagagcccttcccatgacmaatgtgtggagtgttccctccttttacgtaattctccaattttctggaccccagcttggtgtcctacaattcagttttgacactaacgacccagagtcag

SEQ ID NO: 18979 - DNA, 201 bp, Homo sapiens
tttttttgaggtggaatctcctctgtctcccaggctggaatgcagtggcattttctcggctcactgcagcctccgcctcccaagttcaagccattctccartctcagcctcctcagtggctgggattacaggcatgtgctactacccccggcaaacttttatatttttagtagagacagagttttgccatgttcaccaggc

SEQ ID NO: 18980 - DNA, 201 bp, Homo sapiens
agaatagatggcaaatcccatgatttgtatttgactgacagtcaagaccctgtggggtgtgagcctggtgggggcattccaggctggtttctcctgcctcmaggagctgcttctagtgtgtgctcttaaccctaaaggaaggaaacactgtgtcttcctcttctctcatacagagcccttcccatgacaaatgtgtggagt

SEQ ID NO: 18981 - DNA, 201 bp, Homo sapiens
ctcctctgtctcccaggctggaatgcagtggcattttctcggctcactgcagcctccgcctcccaagttcaagccattctccagtctcagcctcctcagtrgctgggattacaggcatgtgctactacccccggcaaacttttatatttttagtagagacagagttttgccatgttcaccaggctggacatgaacttctga

SEQ ID NO: 18982 - DNA, 201 bp, Homo sapiens
tatttggaccacttctccctctttccggacagctgcttagtaggtttagcttaaattatacacatgccaagcatgtacacatatgagaagcctatatctcrtaatatccacagagaatagatggcaaatcccatgatttgtatttgactgacagtcaagaccctgtggggtgtgagcctggtgggggcattccaggctggt

SEQ ID NO: 18983 - DNA, 201 bp, Homo sapiens
tggcattttctcggctcactgcagcctccgcctcccaagttcaagccattctccagtctcagcctcctcagtggctgggattacaggcatgtgctactacmcccggcaaacttttatatttttagtagagacagagttttgccatgttcaccaggctggacatgaacttctgacctcaagggatccacctaccttggcctc

SEQ ID NO: 18984 - DNA, 201 bp, Homo sapiens
gaagagacctcaattctgtgccttgatgggattacaccgaagggagcactggtaggctgttgatgaaacaggtggtatttggaccacttctccctctttcmggacagctgcttagtaggtttagcttaaattatacacatgccaagcatgtacacatatgagaagcctatatctcgtaatatccacagagaatagatggca

SEQ ID NO: 18985 - DNA, 201 bp, Homo sapiens
ttggttgtcttagtagataggagtgtgagtacagaattatacgaagtgagaccatgggtgtgtgtgtgcacgtgtgtgcgcatgcctgtgtgtgtcattgsttagttaacaaaaggattgccctctgaagaacatgaacttgggccagacagcacgtgtagggggtggaattatggagcaattgttactttcttgtattaa

SEQ ID NO: 18986 - DNA, 201 bp, Homo sapiens
cgtcctaattgtgactctgccttgccattctatgttttatcggaatacgcagacatatactttatgaggttgggtaatgaagagagagagaccccaataaacatattttctaagagtaatggttatctatagctcaggaacccttggttagcacagcctctattacacagtactaggcaagcagttcatagctcaattaga

SEQ ID NO: 18987 - DNA, 201 bp, Homo sapiens
ctaaatcataaagaaccctgtctcgagcagacgagaaagagtaacggaggcctcaatggtgaaaggaaatcctgtaccagctgtgaaaacaatgagacacrttcagtaatagaatatagtgtgcttacaaattcagagttgggttcccttcttctcttgaagtggctataaattaattcatcaaaataaaaaaggccaaac

SEQ ID NO: 18988 - DNA, 201 bp, Homo sapiens
agagccaaggtcaatctgaatttttctttttctttcttcctttttttttttttttttttttttaaaaaaaaaaaggtgcttgaattagaaaggtagcacaytgtccacatggacagtgcaggatggggctggctttttcatttctgagagctggcaatggaatgaaggtcttttttttttttcttaatttttcttttttaa

SEQ ID NO: 18989 - DNA, 201 bp, Homo sapiens
aaagtaatataccacttttcgcttttttaatggtgagagccaaggtcaatctgaatttttctttttctttcttcctttttttttttttttttttttttaawaaaaaaaaggtgcttgaattagaaaggtagcacattgtccacatggacagtgcaggatggggctggctttttcatttctgagagctggcaatggaatgaa

SEQ ID NO: 18990 - DNA, 201 bp, Homo sapiens
ttatctcaacccatttaaatgtcttttccttgcaatgttttgtaatattacatgtagattgtacatcgtttgtcgataaatcagtgtacaaatactagggrtgagtgtgctcaaaacttatttttactgataatagtccatgatcaaggcagtttggagaccactcaggacagggaaaacgcagactcatgtgacccatca

SEQ ID NO: 18991 - DNA, 201 bp, Homo sapiens
ttcaacctggcaaccctgtgacctcagcactaggatatggatagaaaacatagtagcccctatttacctttatcttttatctcaacccatttaaatgtctwttccttgcaatgttttgtaatattacatgtagattgtacatcgtttgtcgataaatcagtgtacaaatactaggggtgagtgtgctcaaaacttattttt

SEQ ID NO: 18992 - DNA, 201 bp, Homo sapiens
tgttaaagtaaattttaattttagataaacaatggataattttttagcaaaaggatgttccacatttaactggacattatctctgtctctctccctccttmcctgcctcctatcctctcttcccaccccctacgatgtctatgtatagtttcaacctggcaaccctgtgacctcagcactaggatatggatagaaaacata

SEQ ID NO: 18993 - DNA, 201 bp, Homo sapiens
aatcttagctaagatttatcagaaattaaaactgtatacttaactaaccacctagataggtgcaggcatatatgaattcaccgaaatttgactcaactccyttggttaatttaaataaaataaaagtaaataaggggaaattgcatactcctatctggactgttttcttatggttttggaatctctggcaggtagaagtaa

SEQ ID NO: 18994 - DNA, 201 bp, Homo sapiens
aaaagtgtagtggtttgtagggtcatccccctaaagatatcccgccccaccaaagatatccctaaagacatcctgctggtttcagtggctcatgcctgcawtcccagcactttgggaggctgaggcaggcggatcacttgagctcaggaattcgagaccagcctggccaacatggtgaaaccttatccgtaaaaaaaataa

SEQ ID NO: 18995 - DNA, 201 bp, Homo sapiens
ggtatgtcacttaaaccttgtgttggagtttcctccttgttacatggaggtcacaagaataacaaactatgcatagatcacctaatttagtcattccaackgtgtggagagatagaggattaggatggactttatttcctaagtgagaaacgttggctttagtaaaagtgtagtggtttgtagggtcatccccctaaagat

SEQ ID NO: 18996 - DNA, 201 bp, Homo sapiens
tgtggggaggactttggacttggggattggactccatgggagaggtcagctccttgtctccctggtggtgagacagggaatggtagagtgtgtcctacctrtgtgcctgccttgctctacatcagtgcttcttggatattttggtatcaggactctaaactcttagtagttatccaggacccaaaatagcatttgtttatc

SEQ ID NO: 18997 - DNA, 201 bp, Homo sapiens
ctgtagttcatgaaacattcccttcgattctttgaactctctcatacctttcccttaaattcttctttttcccttatgtcaagcttctttcagtaacaacwgaaaggctaatagtagtgctgtgtggggaggactttggacttggggattggactccatgggagaggtcagctccttgtctccctggtggtgagacaggga

SEQ ID NO: 18998 - DNA, 201 bp, Homo sapiens
tccagtccgtgggggccctggtgctactgctgtagttcatgaaacattcccttcgattctttgaactctctcatacctttcccttaaattcttctttttcscttatgtcaagcttctttcagtaacaactgaaaggctaatagtagtgctgtgtggggaggactttggacttggggattggactccatgggagaggtcagc

SEQ ID NO: 18999 - DNA, 201 bp, Homo sapiens
tagggaggctgaggcaggagaatcacttcaacccggaaggcggaggtttcagtgagctgagatccagcctgggtgacagagcaagactccatctcaaagcraaacaaaacaaatgagggtcctcatcagcgtgcctttgacactgtcctctggtcctggtgatctgaatacatcaccacagaactgccagggtacgtgttt

SEQ ID NO: 19000 - DNA, 201 bp, Homo sapiens
tgcaggcttaaggctggaagaaaccccaagcatttggccaggaagaggcaactagttccagctggcccacatactacactttaaaaattacccagatgatstgattctgtagagagagagtgggtggagaggactccagggccatggaggaagattcggcctttctctccctaatcatgagcaatgtgatttggagagaga

SEQ ID NO: 19001 - DNA, 201 bp, Homo sapiens
ttgaaggtgacagagactgagaaagggctgcacacctttggcctaaagggtaatgagcaacacacaaggattgggagatgttcatggcaagaaaaattcasaagggacattgttgtttcactaattctgtaaaggagagcagcggcatttacttaggccgattccccattctctctttctgtttttaaacagagacagatc

SEQ ID NO: 19002 - DNA, 201 bp, Homo sapiens
cttcaaagatacaaagctagaaactacaaaactaggcatggttaataaataactgaaataccaggtgtatagaaatgcatctgtggaaaaatgaaatcatrtattctctaggatatattaggaaatggctctttggcaagtctagagggtaaagtatccctgaagggggaaaaggtttaaaaacagtaaactaaagaagat

SEQ ID NO: 19003 - DNA, 201 bp, Homo sapiens
tctttccccctcaacttccataggaaccaaactctctttcttcctcccgtttggttggaaagttattttgcctcactgcgtgatttttctactgcaccaaytcccctttcaaacgttattccacaacatactaaattaatgtatactgtgttctttgggtaatggggaggggagcctgtctcacagcacgcatttgttcag

SEQ ID NO: 19004 - DNA, 201 bp, Homo sapiens
tagttcaaataatacatatgctgaaattcctatatcccccccatactccagatcttcagtgtggaatttaaatataattccttattgtaaaaaaaaaaaawttttttttgatcaaggtgattttgataaactaaatgcatctttaattttactcacagcaaagcgattctttattttctctctaaaagcataattgatgtg

SEQ ID NO: 19005 - DNA, 201 bp, Homo sapiens
actaggaattgaaatggcctgaagctgagtttccactcttgtgaaggctggactgtctcttgttattacagcgagggtataactctttaggatcccgaccmaaggtttggtgtgtttaccgtggccctttcctggtgggtcctgagctcaaatttatgtctttttccttgttataaaattgccaaaagctcagcccatctt

SEQ ID NO: 19006 - DNA, 201 bp, Homo sapiens
ccttttgactccctaaggaaccctgttttgggtttcttttgaggttgaagatatttcagactctttccccctcaacttccataggaaccaaactctctttmttcctcccgtttggttggaaagttattttgcctcactgcgtgatttttctactgcaccaactcccctttcaaacgttattccacaacatactaaattaat

SEQ ID NO: 19007 - DNA, 201 bp, Homo sapiens
atcatacaatgagtggcttaaatatttattcttacagttctagaggctggaagtccgagacgagggtgccaaccttgttgagttcttagtgaggtccctcyttctggtttttaagtagcctgtttcttgctgtgtcctcatatggtggagagctgagaggaattgagagagagagagagagaggtcgcactgtctcatgtg

SEQ ID NO: 19008 - DNA, 201 bp, Homo sapiens
gtgttattacagggtagaaattcacctatgtcaagtaggcattataccaggtaacaatctcaagactcagcagggaaggatccacttgcaagcccacgtgsttgctggtaggactcagttccttatggcccagtggattgaaggcttcctttcctgcctggtgtttggttccttgccacgtagggatctccatcatggctg

SEQ ID NO: 19009 - DNA, 201 bp, Homo sapiens
aacagtcagagtgtccaagtaatctgagctagaaagttccttctttcagagaaaagttataaaaagtatatttgccggatccaaaaaaaatactgtgtatsaactactgagacctgcataatgttttcttagtattctcactctttaaaagaaaaaagaaaacctgtaaaatttgggaacttaaactttttttgatatttt

SEQ ID NO: 19010 - DNA, 201 bp, Homo sapiens
gcgtccaggactaaagtcatgtgcaatttaacaagatcttggtgagataaaggaagttgcgcttgaggaaacattgaaacacaccagatggaattttccarttccctcctacatgatagagactaggtgaagggagatagaccacaaattgattttgtgtaactcttaaattaagtggagcagagttaaaaaaaaaaaatc

SEQ ID NO: 19011 - DNA, 201 bp, Homo sapiens
ttggtgggaggtgtgcaggacacagctgaaacctttggtgtatagtggatactaaagcaatgctagtcttcttcgtgtgctaccagttagaatgaattttrctgacatcttactggtttctgagggtatacagacacttattgtcaaagatattattgattatctgatccccaaacatatggagttacatcacagcaggtg

SEQ ID NO: 19012 - DNA, 201 bp, Homo sapiens
gaaaatccttggggagccgccatcattccttccacgaaggaatgaaattataacgtaatgtattgttggagcccttagttcaacactgtcttttttcaggycatattaatgcaatggttagcatatcaacttccttctgtttttagtgactctaatacattatattcaccttgttctctgcatgttctttctttaagtcat

SEQ ID NO: 19013 - DNA, 201 bp, Homo sapiens
gggagccgccatcattccttccacgaaggaatgaaattataacgtaatgtattgttggagcccttagttcaacactgtcttttttcaggtcatattaatgsaatggttagcatatcaacttccttctgtttttagtgactctaatacattatattcaccttgttctctgcatgttctttctttaagtcatgttagatccct

SEQ ID NO: 19014 - DNA, 201 bp, Homo sapiens
ttatgtttccccagttggcacatcatggccaacaagagagtagggatcattaaggagtttattttcatctttattttatcatttaaaacacatttttttttccaatgagagtactgatgacataaaaggttatacattgaataaccacccaaattagcagtgtttcatatttacactgttcaacacagttctcttgtctct

SEQ ID NO: 19015 - DNA, 201 bp, Homo sapiens
atgctgatgtaaccatttccattctgaactcagaaaatggagataaatctcttgcaaggcttttgattttagtttttagatacagaacctttaaaaaaaaagaaaaataaacgttttgccacagtgtagtatatacaacagatgtgagggaaggacattgttttaagtgggaaacgtcagctctctcaacttctacacatt

SEQ ID NO: 19016 - DNA, 201 bp, Homo sapiens
caaagtaatataccacttttcgcttttttaatggtgagagccaaggtcaatctgaatttttctttttctttcttcctttttttttttttttttttttttawaaaaaaaaaggtgcttgaattagaaaggtagcacattgtccacatggacagtgcaggatggggctggctttttcatttctgagagctggcaatggaatga

SEQ ID NO: 19017 - DNA, 201 bp, Homo sapiens
tgaagtacaggcatatcccacagaatctcttaataccaggccaaaagtaactttatcttgatctgtagttcggacatatttcttggattgtccgcactcawaaaaagagattgcgtaacaccctttgaacaaatggatatttgagaaccatcctgtcttcagatttagattttttcaatttttttttactgtcatatgatt

SEQ ID NO: 19018 - DNA, 201 bp, Homo sapiens
gcaaagtaatataccacttttcgcttttttaatggtgagagccaaggtcaatctgaatttttctttttctttcttcctttttttttttttttttttttttwaaaaaaaaaaggtgcttgaattagaaaggtagcacattgtccacatggacagtgcaggatggggctggctttttcatttctgagagctggcaatggaatg

SEQ ID NO: 19019 - DNA, 201 bp, Homo sapiens
acatttgggaaatttgtaaagccttactttgaatgtctttttcttcactctatctgtattgtttggtgctttctatataaatttataaattggatgtacckccacagatgtcggttttctggtaataatacttttttacattaaaaaaaactcctgaaatgaaaatgtaacttagtcttattattgtaatctccccttgcc

SEQ ID NO: 19020 - DNA, 201 bp, Homo sapiens
ttagtcttttcaagaggcaaagtaatataccacttttcgcttttttaatggtgagagccaaggtcaatctgaatttttctttttctttcttcctttttttgtttttttttttttttaaaaaaaaaaaggtgcttgaattagaaaggtagcacattgtccacatggacagtgcaggatggggctggctttttcatttctgag

SEQ ID NO: 19021 - DNA, 201 bp, Homo sapiens
cattatggtacataaaagagctttctatcgcttttttacattatagtagttattcgttattattattattattattattattattattattattattatttctgagacaccgttttactctctctttgcccaggctggagtgaaatggcacgatcgcagctcactgcgacctccacctcttgggttcaagtggttcttctg

SEQ ID NO: 19022 - DNA, 201 bp, Homo sapiens
aatgtccggtttggagttggaggagtcattgattttaggcaaggtgatggtgagcccacagagcacagagttaatggaactctggccgttgatgtagcttygaagcctgaatttaagtcatatttttgaaaagttgcgtcttaaaaagttactagcgatggagaatgaaaagtcaatttggacactttaaaagtgagcctc

SEQ ID NO: 19023 - DNA, 201 bp, Homo sapiens
acagtcgtgatttagggcatgaagagctcactcatcaagatgtatgtaattcagattttctgagtgtttaattcggcgtctttggtcacaaggaacagagktttacttgtgccacctcttctaagaaaaaggtttactgtaagagataatgttggcaagctgaggaaaggaggcagttttgggtaactgtctcttgcgatc

SEQ ID NO: 19024 - DNA, 201 bp, Homo sapiens
atctaagatagtgatctggttacatagattatcagagatacttttttttttgattatcagagatacttttaaaaaagcaactacaaggtaaggattatcckttaatttagtgtttttctattaaactcaatttgctttaaagttttttacattttgcctcttttttgtatgtttgagtaccacttcctaaccaatcacaat

SEQ ID NO: 19025 - DNA, 201 bp, Homo sapiens
tacaggcacgagctgccacgcctcacctcttgttttcaataccattgataagttgtggtcttcagggacttgtgggcattttcaagttaaatatccaacaktcgtgatttagggcatgaagagctcactcatcaagatgtatgtaattcagattttctgagtgtttaattcggcgtctttggtcacaaggaacagagtttt

SEQ ID NO: 19026 - DNA, 201 bp, Homo sapiens
aagtctcgctttgttgcctaggctggtcttgaactcctgggttcacgtgatcctcctgcctcggcttcccaaagtgctgggattacaggcacgagctgccrcgcctcacctcttgttttcaataccattgataagttgtggtcttcagggacttgtgggcattttcaagttaaatatccaacagtcgtgatttagggcatg

SEQ ID NO: 19027 - DNA, 201 bp, Homo sapiens
aagaaaactcacagaagcagaaacttagggcttgctttaaatgttatcagtgtgaattgagatggtgtcagcattatttttttaaagaccaaaacaacaakagtaacaaacacacacaagccactgttagattttacaaaactttaaaaagtaattatcttaaagatatctaagatagtgatctggttacatagattatca

SEQ ID NO: 19028 - DNA, 201 bp, Homo sapiens
tcgcaatgattcggtgtgttttgttccgtgcatcctggcatgtgaaagaagtgaggtaaagagtataatttacttccttgttttaaagctagcattgcccrtgccttccacgcgggactgttgtggatatttgaccactgcaagaaaactcacagaagcagaaacttagggcttgctttaaatgttatcagtgtgaattga

SEQ ID NO: 19029 - DNA, 201 bp, Homo sapiens
aatcactgaatatgttataaccaaaaaggtcaaactcgcaatgattcggtgtgttttgttccgtgcatcctggcatgtgaaagaagtgaggtaaagagtayaatttacttccttgttttaaagctagcattgcccgtgccttccacgcgggactgttgtggatatttgaccactgcaagaaaactcacagaagcagaaact

SEQ ID NO: 19030 - DNA, 201 bp, Homo sapiens
gtctctgtttttttttttttttttttttttcctctaaataaacaaaggaatagaagatcctgtgaagagctgggtgtggtggctcatggctgtaatctcascactttaggaggccaaggcaggaggattgcttgagcccagtagttcaagatcagtctgggcaacataatgaaaacctaatgtctacaaaaagtataaaaa

SEQ ID NO: 19031 - DNA, 201 bp, Homo sapiens
gtttaatttttaggtctgtatttaaaaatctgtgtagtgacaacaattattcttattgtatgaacatattgtcggctggagagtattcagctgtcagacamagtgttctctaaagtgttcagccatcagacagaaactctattgctggtggcggggttgtgggctgggggaaccagagtatttgctcttctttagaagtca

SEQ ID NO: 19032 - DNA, 201 bp, Homo sapiens
ttttaagctaccacacagatgcaggaaactaatataccctttaatgattttctccatggcctttctgataatcctttcatccttcatctcccctgtcgccsttttctttgctttgcttgcttgcttgttttttttttttttttgagacggagttttgctcttgtcgcctaggctggagtgcaacggcacaatcttggttca

SEQ ID NO: 19033 - DNA, 201 bp, Homo sapiens
acacgaaaactaaaaacttatacatcattttatattttgaaattcccaatttgcaatgttatttttttttcttctttttttttttatgacacttttcttcyggaaaaaatccttaggacccagttactctctttcaggattttatatcataatgtgtctgtgagagacagagccagatgttcaggatttcagaccaccata

SEQ ID NO: 19034 - DNA, 201 bp, Homo sapiens
attgttttaagctaccacacagatgcaggaaactaatataccctttaatgattttctccatggcctttctgataatcctttcatccttcatctcccctgtygccgttttctttgctttgcttgcttgcttgttttttttttttttttgagacggagttttgctcttgtcgcctaggctggagtgcaacggcacaatcttgg

SEQ ID NO: 19035 - DNA, 201 bp, Homo sapiens
accatggctgaagggttattctggggagccttccctgtggaagccccattaaccatccctgctcattcctcccgtgagaccaccatttgctaaatcttctrtcaggtgatgtgggatccaagaagaaacaataatcagaagcttgccttacaggcatgcacaatttcgggtggactgtcacatgtgcactgaaaaagtcga

SEQ ID NO: 19036 - DNA, 201 bp, Homo sapiens
ggggtttcaccatgttagccaggatggtcttcatctcctgacctcgcgatctgcccacctcggcctcccaaagtgctgggattacaggcatgagccaccaygcctggccctgatttttaaatttttcatggagacagggtctcaccttgttttccaagctgatctcaaaatcctggcctcaagcaatcctctcctctgcct

SEQ ID NO: 19037 - DNA, 201 bp, Homo sapiens
gaataaaggcatggatgtgactgaggaggtaaaggtgaagaattggggaggggtggatggggctgactcatgacctaaagaacatggcatctggggctctyttgaaataatctgcactaaccactcattcacatttttttgagtctgtaagatcccaggcactcttggtagcaggggggttaggtgggtgaagggacaagt

SEQ ID NO: 19038 - DNA, 201 bp, Homo sapiens
agacatgaataaaggcatggatgtgactgaggaggtaaaggtgaagaattggggaggggtggatggggctgactcatgacctaaagaacatggcatctggrgctctcttgaaataatctgcactaaccactcattcacatttttttgagtctgtaagatcccaggcactcttggtagcaggggggttaggtgggtgaaggg

SEQ ID NO: 19039 - DNA, 201 bp, Homo sapiens
gttccaatgtttctgaaggatgtttttttaaaagaagtattcatttaggtgacacatatttattgagacactaatatatgccaggaattattctattggtkcctttggaggagacatgaataaaggcatggatgtgactgaggaggtaaaggtgaagaattggggaggggtggatggggctgactcatgacctaaagaaca

SEQ ID NO: 19040 - DNA, 201 bp, Homo sapiens
tgatcacaccacagcactccagcctggccaacatagtgagacactacctagatagcttaggagagttccaatgtttctgaaggatgtttttttaaaagaartattcatttaggtgacacatatttattgagacactaatatatgccaggaattattctattggttcctttggaggagacatgaataaaggcatggatgtga

SEQ ID NO: 19041 - DNA, 201 bp, Homo sapiens
gtgcaggttagaggctatgtcagaagcaagtcaggatttgaaggcagatctgtctgcttttgcccctctgtaaatccagagctgctgcctcatttcttacrttgcccccacccgtgcagcaattcttcctgggaggcctcattgttcatattcataaagggccccattcagtctcctttttggagaaatggccactgcaac

SEQ ID NO: 19042 - DNA, 201 bp, Homo sapiens
tggccaggagactaggcattcatagtggggcgtcctttaaggtctgaagaggacagtgaccatccaccacaggcaaacatgtgtgtgttaaaaaggaatgrcgttttggtctgtgctacaactgggatgaacctcaaacattacgctggacgtggtggcttacacctgtaatcccagcactttgggaggctgaggcaggta

SEQ ID NO: 19043 - DNA, 201 bp, Homo sapiens
ccaagttgtgtaaatcaaagcttctcctgccacactagtgtgtattaggccaggacttcatagtgtgattcaaatcaccaactgaatttttttttcctttycttcccctttctgggggactacgtttttcatggagaccggggccctccagctgctgtgatgatcctcccttgccagggaggtgctgttaatagcaaatgc

SEQ ID NO: 19044 - DNA, 201 bp, Homo sapiens
agatacaagaaggccacatgtggtggttcacccctgtaatcccagcagtctgtgagactgaggcagaaggattgcttgagaagtttgagattggcctgggmaatatagcaagatcccaaccctattaaaaaattaaaaatgaaaataaaattttaaagaaaggtatttctccccttcacggtaatttggagccagtacttc

SEQ ID NO: 19045 - DNA, 201 bp, Homo sapiens
tggtatccccaaacaaaatgttatcaaatgaagaactccttcccagctctcccttctgagtgtctgattttattcaagctcagatggcttctcagatagcktaaaaagtgatggagaatttcttttaccaattgtatgccctgtgggaacctgggtgctgtaatcactgaatatgttataaccaaaaaggtcaaactcgca

SEQ ID NO: 19046 - DNA, 201 bp, Homo sapiens
tggttagattacacgtttcctgagaggtatagatttcaaaattggtgtatttcacccgtccctcatcatggtatccccaaacaaaatgttatcaaatgaaraactccttcccagctctcccttctgagtgtctgattttattcaagctcagatggcttctcagatagcgtaaaaagtgatggagaatttcttttaccaatt

SEQ ID NO: 19047 - DNA, 201 bp, Homo sapiens
tactctaggaaggagaatctctgttgggatcttttggggagtacttgcctcccaagtgcttaggctcccgctgctgacaagaccctctgcctggcaagccstgcaggttggaatcctctgttagggttccaaagccttcaccaactcagagctctttctctctctgtttctcttttttgaatttaaattgatcctagtcac

SEQ ID NO: 19048 - DNA, 201 bp, Homo sapiens
gctgtttactctaggaaggagaatctctgttgggatcttttggggagtacttgcctcccaagtgcttaggctcccgctgctgacaagaccctctgcctggsaagccgtgcaggttggaatcctctgttagggttccaaagccttcaccaactcagagctctttctctctctgtttctcttttttgaatttaaattgatcct

SEQ ID NO: 19049 - DNA, 201 bp, Homo sapiens
ttaattatgaccataaaggccccatctccaaatgcagtcatgttgggggttagggcttcagtgtatgagtttgggatggcaggggagcagttcagctcgtragaatcgtaagattcctgatctgtttctcttccaagaaattgtttggtttcatgttgattttatctccttttccctatctgtctcaaagcactgaagaaa

SEQ ID NO: 19050 - DNA, 201 bp, Homo sapiens
tgtaaattgtctaaaattaaattttctgtggttgtcatccacatgggttctgaacttgctgttataattattcacattttcttgcagtgaaaatctacagrtcaaggtcatcttcacgtctttagttcttgttttgcttcaggtcagtttagaaccgaatgttaaaaggatattgtctattcgaagggtcagattgtggca

SEQ ID NO: 19051 - DNA, 201 bp, Homo sapiens
ttcttcctaccttccatatgagagaatagggaaaattaaagaataaatgtctctgggtttaatgcaactttactaaggaatgaaagtccgataagaatccrtatcttttgaaagaagattttttaaattccttatttttccttcctgcatggtcataaaacacactggggacagcccaccctgagaagtcaccaggcatct

SEQ ID NO: 19052 - DNA, 201 bp, Homo sapiens
cttacctctttttagtttaattaaaattatttctcagattaagagccatgctatgatgcttgccaacggatatttaaaacatgtaactgatttgttttttrtaatgcttcaggagaactcagttgagcagtaaagatgtgctcgtgatgtggttagctcagaataaggatgtgaaaaccaaaagggaaaggaggacaggag

SEQ ID NO: 19053 - DNA, 201 bp, Homo sapiens
ttgcaataatgtaattgaaataatgtaatacaatcctgcttaatattacactgtatatattcattgacttatagactgagctccttatcttgttcattgcyatggctttagcaccttttgaacagtggtgcttggcttttggtaggtggtcaacaaatgtgtattaagtatatgaactgttggaagggtctgctgtgaagg

SEQ ID NO: 19054 - DNA, 201 bp, Homo sapiens
ttaagcattgctaaattggaaaaccatggaatatagagatccagtagttaagagcctactgggagagacagcataataattacaataagtgcagaacttgmaataatgtaattgaaataatgtaatacaatcctgcttaatattacactgtatatattcattgacttatagactgagctccttatcttgttcattgctatg

SEQ ID NO: 19055 - DNA, 201 bp, Homo sapiens
cccattaaagaacacagctcatggtcggtccattaactactaattatcaaaacagtgggtgaaaacgatgtttggaaatagctgcgactctcgcgtgatasgaaaatatctgtgatttcgattgcgacaaacacacagatgcttctcacacgatcgcagtgcattgcctaaatgacagtaatgctaaactccagtcagatg

SEQ ID NO: 19056 - DNA, 201 bp, Homo sapiens
gcaggctgccaagaatagcagttagaaatagctagtatcaggcctggtgtagtggctcatgcctgtaatcccagtgctttgacaggctgagggaggagaaytgcttgagcccaggagatcgagaccagccagggtaacatagggagaccctcatctctacaccgaatttaaaaacttagctgggcatggtggtgcctacct

SEQ ID NO: 19057 - DNA, 201 bp, Homo sapiens
ttagcgagatattgtctctactctcaagaaactcgctttctttgggaatcatcacctgtttttgtgtcacggaccccttgggcatttggtgccctttgcasaataatggttttgaatacataaaacgcacgggatcacagaggaaaccaatcatattaaaatacagttgtcaaaatattaactcatgggatctagtaacaa

SEQ ID NO: 19058 - DNA, 201 bp, Homo sapiens
attcaagattggaaaatgttcatgttaaattattgttggccgactgtgggttcatttaattaggttctctgttttggggtatgttgaaaatttttcataakaaaatattattcagaggtctcaagaggcaggctgccaagaatagcagttagaaatagctagtatcaggcctggtgtagtggctcatgcctgtaatcccag

SEQ ID NO: 19059 - DNA, 201 bp, Homo sapiens
ctctttctcgatccttgcagtttcccttttgacctgtgggtacacatggtactgacgcaattggcacctcagatggttcttcctgacagctacccttgcamctgactcaggatacaaactacctttttttttggagacagatctcactttatcacccagtctggagtgtaattgacgcaatcctggctggctgcagccttg

SEQ ID NO: 19060 - DNA, 201 bp, Homo sapiens
acattgaaaacttatccaggagaggaaaggctctttcagctgctctttctcgatccttgcagtttcccttttgacctgtgggtacacatggtactgacgcrattggcacctcagatggttcttcctgacagctacccttgcaactgactcaggatacaaactacctttttttttggagacagatctcactttatcacccag

SEQ ID NO: 19061 - DNA, 201 bp, Homo sapiens
gctcagcacacttggtgcagtctctctggcttggtaattggtcccaagaaaatagtttttttccaattatggcaacattgaaaacttatccaggagaggawaggctctttcagctgctctttctcgatccttgcagtttcccttttgacctgtgggtacacatggtactgacgcaattggcacctcagatggttcttcctg

SEQ ID NO: 19062 - DNA, 201 bp, Homo sapiens
gcagagtaaacagacaacccgcagagtgggagaaaatctatacaaatctatacgtctatacaaggactaatatccaggatctacatggaactcaaattagmaagaaaaaagctaacaatcccatcaaaaagtgggctaaggacatgaatagacagttctcaaaagaagatacacaaatgaccaccatacgtgaaaaaatgc

SEQ ID NO: 19063 - DNA, 201 bp, Homo sapiens
ttgagcctaggaggttgagagtgcagtgagccgtgttgctgccactgtactccagcctgggcaacaggacaagaccgtgtctccaaaaggaaaaaaataawaaagcactgtctctctctacccttgcagtatccctgtaggagagagttactattagctcccagtttataggtgagtgatatggtttggatgtgtccccac

SEQ ID NO: 19064 - DNA, 201 bp, Homo sapiens
ggtgctagggtaaggcacgcaggatgcaagattagcgagatattgtctctactctcaagaaactcgctttctttgggaatcatcacctgtttttgtgtcayggaccccttgggcatttggtgccctttgcagaataatggttttgaatacataaaacgcacgggatcacagaggaaaccaatcatattaaaatacagttgt

SEQ ID NO: 19065 - DNA, 201 bp, Homo sapiens
acatcttcccctttcttctcccccaggtttgtcccatttgtactgactctgacccaggttgtcatgacttgagactcactagaagtttcagaaagatgcasactgctttaaaaaaaaaaaaaaagggcaaggggaggtgtgagaagaaagtataattctttttcttctaactggagatataaaaatcatataagcatgatt

SEQ ID NO: 19066 - DNA, 201 bp, Homo sapiens
gcagtaaaatagtttttcagtcactttgccttcatttgtttgacattcttggaatatttgggctctacaaggtgctagggtaaggcacgcaggatgcaagrttagcgagatattgtctctactctcaagaaactcgctttctttgggaatcatcacctgtttttgtgtcacggaccccttgggcatttggtgccctttgca

SEQ ID NO: 19067 - DNA, 201 bp, Homo sapiens
agggccacatcttcccctttcttctcccccaggtttgtcccatttgtactgactctgacccaggttgtcatgacttgagactcactagaagtttcagaaaratgcagactgctttaaaaaaaaaaaaaaagggcaaggggaggtgtgagaagaaagtataattctttttcttctaactggagatataaaaatcatataagc

SEQ ID NO: 19068 - DNA, 201 bp, Homo sapiens
ccctctgataatcctgcaagagccagcccagttttgctgacagcacagtctgctgtttaattattgtgtgttcaatgacttacctctttttagtttaattraaattatttctcagattaagagccatgctatgatgcttgccaacggatatttaaaacatgtaactgatttgttttttataatgcttcaggagaactcagt

SEQ ID NO: 19069 - DNA, 201 bp, Homo sapiens
gacgtctatgctttccagcttgccaattctggggcctggcacagtatctttcaccccggagtctcagtttcctcatctgtaaaatgggaaccatgacgtcrgcatcacagagttgtgagaattcgacaaggtggaatgaaagcaactagtgtggtgtctgaccgcttgtgttagtccatgaggaatttccttacgtattgt

SEQ ID NO: 19070 - DNA, 201 bp, Homo sapiens
atgcctatgcttttaaaaaattattgtgatacagtgaaacaaggaagaacgtgtagctggaaaaatagtatttgcttgtaatatacattcagattcataayaggcttatttgattcccaggacagggtgagcaaaggatgctgtttcctgggtgtctgctttggtgttcattgagtcatgtctctctctttagaccttact

SEQ ID NO: 19071 - DNA, 201 bp, Homo sapiens
attactgaaaaaaaaacaaaacaacaacaacaaacaacaaaaaaaacaccttccactaaaactgactcaaaaagataatagcagggaaaatgacatgtcgrtctgtgattccttttttacttgtcagtccttttgggagttgaacatataagcacatgtacctctatgtgacttttgagacgtctagaatagagaattcac

SEQ ID NO: 19072 - DNA, 201 bp, Homo sapiens
gcctgaaataatttcaaattaacccctgaggaacaaatgctcatgactttcaatgaatagaaaaatcagactgctagaacctccagactgcatgtcatgcrtagaagtagaatcctggggaagctagctcacaaaagcaagggagatacctgcaaggctgagctgagcttgcaagggaagaaaaatattagagagttgtca

SEQ ID NO: 19073 - DNA, 201 bp, Homo sapiens
agtggaatcacagacatgagccaccatgcctggcctgaaataatttcaaattaacccctgaggaacaaatgctcatgactttcaatgaatagaaaaatcaractgctagaacctccagactgcatgtcatgcgtagaagtagaatcctggggaagctagctcacaaaagcaagggagatacctgcaaggctgagctgagct

SEQ ID NO: 19074 - DNA, 201 bp, Homo sapiens
ggtccacctcctgggtaaaggagattctcctgcttcagcttcccaactagctgggacaacaggtgtgtgccaccacgtccagctaatttttgtatttttawtagagacggggtttcaccatgttggccaggctggtcttgaactcctaacctcaagtgatctgcccgccttggcctcccaaagtgctgggattacaggctc

SEQ ID NO: 19075 - DNA, 201 bp, Homo sapiens
caaattccaagcaaactttttacttcttattatgtaaaatggaagggttagccaaattaagatctcaccatcaaccttgagggagtgacttctacatgccrtgtattactggttataaagctagtcttgtttggattgaagaatttaatcatatttaacttttcaaaggatgctttttaaaaaaccttatccgcgtgttat

SEQ ID NO: 19076 - DNA, 201 bp, Homo sapiens
cattttattttgtgggcagatttcttttacagttctggctgggtttcttttagttggcttctttgctttgctcctgttacgacttagccctgtagctctgrgctcttcgattctcacgtgctgatggtgtagctgagctctgctaatgctggttattaatctgacaatctataccagggaggttttataattgccataatt

SEQ ID NO: 19077 - DNA, 201 bp, Homo sapiens
agctagtctgagtggcagccttacccattttattttgtgggcagatttcttttacagttctggctgggtttcttttagttggcttctttgctttgctcctrttacgacttagccctgtagctctgggctcttcgattctcacgtgctgatggtgtagctgagctctgctaatgctggttattaatctgacaatctatacca

SEQ ID NO: 19078 - DNA, 201 bp, Homo sapiens
ggtggttcacacctgtaatctccacactttgggaggctgaagtaggctgaagtgggaggatggttagagcctaggagttcgagaccagtctgggcaacaamgtgagatcctgtctctacaaaaaataaaaaaaattatctgggtatagtggtgtgcacctgaagtcccagctaactgggagtctgaggcaaggaaattgtt

SEQ ID NO: 19079 - DNA, 201 bp, Homo sapiens
gacaaaggtgacagaaaggaaatctcctaagttggcctacagggtgctttagaaaacatctggctgggcatggtggttcacacctgtaatctccacacttygggaggctgaagtaggctgaagtgggaggatggttagagcctaggagttcgagaccagtctgggcaacaacgtgagatcctgtctctacaaaaaataaaa

SEQ ID NO: 19080 - DNA, 201 bp, Homo sapiens
ctaagcagacatactcgatacatcttcactaatgagttctgacttcataaaatgtattaatgacttctttttgaaagtaagagtgctttgaataccagtcrttattgctttagaagttcataaaagcaaaagcacagtatttcccccagtgtttgtgcgataagagaatagatgtaggtccagcgcctagaattttagcta

SEQ ID NO: 19081 - DNA, 201 bp, Homo sapiens
cagtgcagtgatgcaatcttggctcactgcaacctctgcctcgcaggctcaaatgattctcctacctcagcctcctgagtagctgggattacaggtgcccrcccccatgcccagccaatttttgtatttttagtagagatgcggtttcaccatgttgaccaggctggtctcgatctcctgacctcaggtgatccatccatt

SEQ ID NO: 19082 - DNA, 201 bp, Homo sapiens
tctgagagcagggccaagaaagggaaagagagagagaggaaaaaaaacaaaaaagaaaaagaaaaaagagaggtgggtagggagggaggagagacatggayccacggggaatgggaagagaaatagaaatagggaatttgaaatggaaataaaacaaaagggcaggaaaggaagaaataaagagaatgagataaaaggaaa

SEQ ID NO: 19083 - DNA, 201 bp, Homo sapiens
atcttcacctgggaatgttctcctaatagtcacttttgttataaatcttcacctagcatgggagttaagtgcattttaaaactagacctggggactatgtrtcctaaaatgcaaaaatagcccccaaaatgaaaattaatgttgagaatctagtcaatctgccagcagtacgtacataactgttctgtgtatatttcacat

SEQ ID NO: 19084 - DNA, 201 bp, Homo sapiens
gtgaatgggtttggagccaacagggataatagacaacgctatcaagaggggggccaaccacacatgtgcagccactgtatgacgtctggattttccttgasttatggtgatcactattgggaggtggtaagcaaacaggtgacataatttgaatcatggttttaaaagacgccatggttgccatgaggaggacaatgcgta

SEQ ID NO: 19085 - DNA, 201 bp, Homo sapiens
cctttctcagcattccacaagttacttcgtccttcctttgttctcctctgcctttgcctcttttttctttttttattttaattttttttttttaattatastttaagttttagggtacatgtgcacgttgtgcaggttagttacatatgtatacatgtgccatgctggtgcgctgcacccactaactcgtcatctagcatt

SEQ ID NO: 19086 - DNA, 201 bp, Homo sapiens
ggattacaggcgtgagccaccacgcccggccttgatttttcttaacctttatttccaattatgcatcttctgagtaactataaagaaaagcaaaatctacrgtaggtatggagtgagtgcagagtcaccatcagcttgaacaaatgtgtgtatctgtggtcaagtttaattgcttcttctgtaatttatattaatcacgct

SEQ ID NO: 19087 - DNA, 201 bp, Homo sapiens
tggctaatttcttttgtatttttaatagagatgaggtcttgctatgttgcccatgctggtcttgaactcgtgggctcaagcagtccacttgcctcagcctmccaaagtactgggattacaggtgtgagccaccacatctggcgaaactctgggtagtttctaattatttctgtatttctatttgtatttaaaagtacagga

SEQ ID NO: 19088 - DNA, 201 bp, Homo sapiens
gtgttgttatgcagtgtgtgactgtaccagcagcttgatctttgtgcttctagagaacatttaaattgattcgcttttgtgagacagggtcttgctctgtyacccaggcttcagtgcatcagcgtgatcatagctcactgtagcctctccctcctgggccaagtgatcctctcacctcagcctcctgagtagcttggacta

SEQ ID NO: 19089 - DNA, 201 bp, Homo sapiens
agtaggagatatatcttacttaaaaaaaaaaaaaacaaacaaacaaaaaaaaaaaactccttcttcatttgttatagttccaggatagagtgtgtacctgkatagagagagtcaggcagatataggtgtgccctccttccaagatgtgtgatggtgggcaactttctttgcatctctgagcctctattttctctatataaa

SEQ ID NO: 19090 - DNA, 201 bp, Homo sapiens
aggatgtacttacaaatcctacgtggtataacccattatacacagaggctgtatgggatagcctgttgcttccaggctgcaaacttgtatagcatggtacygaactgaatactataggcagtcataacacaatggtaagtatttgtgtatctaaacacagaagtggtacagtaaaaatacagtgttgtaatcttatgggac

SEQ ID NO: 19091 - DNA, 201 bp, Homo sapiens
ggaggtgattagatcatgagggtggagccctcataagtaagatttgtgccctgatgagaagaggatagaaaggtagctaactttccttaagctatgtgaakgtgagaacacagtgggaaggcagccatctgtaactagtaggagggccctccccaagaacgtgaccatgctgccaccttgaccttggactttaagcctcca

SEQ ID NO: 19092 - DNA, 201 bp, Homo sapiens
agaaggacgtgtttgcttcctctcctgccatgattgtaagtttcctgaggtctccccagccacgtggaactgtgagtcaattaaacctctttcctttatamatttcccagtcttcgatatgtccttatagcagcatgaaaacagactaatacaggggcctctgggaggtgattagatcatgagggtggagccctcataagt

SEQ ID NO: 19093 - DNA, 201 bp, Homo sapiens
ggacatggttgtgtccccactgaaatctcatcttgaactatagttcccatgatccccatgtcttgtgggagggacccggtgggagataattgaatcatgcygttctcacgataatgagtgagttctcatgagatctgatggttttataaggggctttcttcccttttgcttggcacttctcttactgctgtcatgtgaaga

SEQ ID NO: 19094 - DNA, 201 bp, Homo sapiens
tctttttttttttgtcagactacttgccagcatactaaaatcaggatattttacttaaatgtagatttatgacagttttgaaaaatcagaatgagtattgkagactaaatgtttatgtcttccccaaaaattcctatgttgaaaccctaatcttaaggtcatggtatttggacatggttgtgtccccactgaaatctcatc

SEQ ID NO: 19095 - DNA, 201 bp, Homo sapiens
agtgattgacttacccgagtgtacacatgtttgcatctcacttgtatgttccttacatgtttacttaattattgggaaggtgtattaatgtcctgttgctrctataatggaccaccacaaactcggtgcttctatgctgcaaacctaagattataggcagtcataacacagtgttaagtatttgtgtatctaaacatagaa

SEQ ID NO: 19096 - DNA, 201 bp, Homo sapiens
ttttgctgttacgagcatggatttagctcatttttaccatcttccctagttgtatcaccttcctcccattatgtttgtaacttcagattttgtatatttcrcatatgtcaatatgtaaacattttatatatatatatatgcatgcacacacatgcatacatatatgtaatggtatatatacatgtaagtttccatttttgc

SEQ ID NO: 19097 - DNA, 201 bp, Homo sapiens
tcagttttcgtgtctccctcccactggaccacaagcccctaactcttcatgtacacaccctgactcccagtgtgggctggccacccaggaggcacccagtytatgtgtgctgcgtgagtgatgtggaatgactgcccacgtaggaagtggcaggttggagaaaaagcagtcacagctcctggctgctgtggctgctttgag

SEQ ID NO: 19098 - DNA, 201 bp, Homo sapiens
tatgactttacctatttcgggtaattgatataaatggaatcatacaatacgtggccaactgacttctttcatttaatgttttcaaggtttgtgttatttcrtgtattaatattatgttggtgcaatcacttttgaaccaatctaactaatacttcatccccttgtatggccaaataatattctattctatcaatatattat

SEQ ID NO: 19099 - DNA, 201 bp, Homo sapiens
atggcctgggaggcaagtgtgatcattcaggtaatcaaagtaactacagaaacagaggtatggattagctagtcattgcagatgtggcattgagcatatargcgtggtgtacatcttagaacttcatctggaaatgcctgtgggggagttggatttcaagatcatcgtcaatgtcatgtcactgtaatttcatttacatta

SEQ ID NO: 19100 - DNA, 201 bp, Homo sapiens
taagttcttaagatttggcagctgtggatcgtgtttagtaagcacgatctctaactctttggaactcagaactatgtaattgaaatggcctgggaggcaartgtgatcattcaggtaatcaaagtaactacagaaacagaggtatggattagctagtcattgcagatgtggcattgagcatataagcgtggtgtacatctt

SEQ ID NO: 19101 - DNA, 201 bp, Homo sapiens
gctttatgtggagaaaacagtattggaaattattactcagttcaagaaaacctcactgagcacctaccatgtaggtgctcatcccgataccactatcaggmcctttggaccagttgcaaggatgcaggatgaggaaggcaatgtgagaaaacagaaggagcaccaggcagtcgtgggcttgatttttattttactattttt

SEQ ID NO: 19102 - DNA, 201 bp, Homo sapiens
agatttccccttttcataaggacaccagtcctattggattagggctcccccattatgacctcatttatccttaattatgaccataaaggccccatctccaratgcagtcatgttgggggttagggcttcagtgtatgagtttgggatggcaggggagcagttcagctcgtgagaatcgtaagattcctgatctgtttctct

SEQ ID NO: 19103 - DNA, 201 bp, Homo sapiens
acctgaggtctagggctaaactcttgcctttacctgttccatgcttagccgttcctgctttttgcctagaacctcagtgctattgctcacacagacccagytcatgtccccaggccatgaccactgcctccccttctcccacctgtgcaggtgttaagcatcagtacataactgaggagtaggagggcagcagcccaaatc

SEQ ID NO: 19104 - DNA, 201 bp, Homo sapiens
gcttcagggaagggcagtgcaaattgtttctggactgatgccatcttttaataatagtagttaatagactgggtacaatggctgacgcccgtaatcccagygctttgagaggccgaggccggtgtatcgcctgagtccaggagttagagaccagcctgggcaaacagcctgaggcaaaacctcatctctacaaaaaataca

SEQ ID NO: 19105 - DNA, 201 bp, Homo sapiens
atgttaacctcctttggaaacacccgcacagacacacccaggaacagcaccttgcatccttcaatccaatcacattgacactcaatattaaccatctcagyaggcttcttcgtgttcacatagtctcctcaccgtgtgctgtgtccagatttccccttttcataaggacaccagtcctattggattagggctcccccatta

SEQ ID NO: 19106 - DNA, 201 bp, Homo sapiens
cccaggctcaactatcagccgccttctcatcccaagggctgtcaccaccagaaatttaacatgctgttagtgcatgcaaaaaaaagcccagtaattgtagsgctcatcagtacattgttaattgatcctcatttcctattattttacctcaaagcaaacacatcattcaccatagtgacaccagagttgtttatcttctct

SEQ ID NO: 19107 - DNA, 201 bp, Homo sapiens
ccgctgacttaaatgttaacctcctttggaaacacccgcacagacacacccaggaacagcaccttgcatccttcaatccaatcacattgacactcaatatyaaccatctcagtaggcttcttcgtgttcacatagtctcctcaccgtgtgctgtgtccagatttccccttttcataaggacaccagtcctattggattagg

SEQ ID NO: 19108 - DNA, 201 bp, Homo sapiens
ctcttacttaaacacacagcatgactctccttacacatttatttcagaagagcaaagtccgggtccccaggctcaactatcagccgccttctcatcccaasggctgtcaccaccagaaatttaacatgctgttagtgcatgcaaaaaaaagcccagtaattgtagggctcatcagtacattgttaattgatcctcatttcc

SEQ ID NO: 19109 - DNA, 201 bp, Homo sapiens
ccaccatacccagccaaaatattcttttcaaagtgattagaagtaggagaagcttgctctctttttattggcacttctgtcttacatgcactttttgattkaaattattctgtcttctatgaaatgacagtgattggaggtggtttatttttttttaagtctgcttactcggaaaaataaaacaaagttgacaacctgatt

SEQ ID NO: 19110 - DNA, 201 bp, Homo sapiens
cttccaaatgcccttaacccacagatgggaagaaaatgaggtggggggaaggggactttcttgcttcctcatagttctcccccatcctgtaaaggagcctrtgcttcccgactcccagggccctgcagcatgtcaagaacaatattggacaagcttgtcagtgagggtccaggtggttccctgccactacgatgcatgctg

SEQ ID NO: 19111 - DNA, 201 bp, Homo sapiens
actcctgggctcaagcaatctgctcacctgggtctcccaaagtgttgggattataggtgtgaaccaccatacccagccaaaatattcttttcaaagtgatwagaagtaggagaagcttgctctctttttattggcacttctgtcttacatgcactttttgatttaaattattctgtcttctatgaaatgacagtgattgga

SEQ ID NO: 19112 - DNA, 201 bp, Homo sapiens
accttcaccaccacccaatgtgtcctgctcatcactgaggtttgtcatttttactctgagtctgtccattgtcatcatctccaccatcaccccttttgttytcattgccacccttgcctggggtgagtgaagacgctcttctctggcttccacccttccaaatgcccttaacccacagatgggaagaaaatgaggtggggg

SEQ ID NO: 19113 - DNA, 201 bp, Homo sapiens
ttcccttcggaaaactccctgggtgccccagcattatgtggtaaaggacatgtatttccaactggcaggggctctgcaaagtttctctgcctcctttgctmaccaaaccctaaataattgtctggatgttccttttattgtcacctctgaaacaagacgaagatttggacggtttgctttagagtgcattaacttctttat

SEQ ID NO: 19114 - DNA, 201 bp, Homo sapiens
cacaattcacacaccaggctgccactttggcccctgcgtcaccttcaccaccacccaatgtgtcctgctcatcactgaggtttgtcatttttactctgagwctgtccattgtcatcatctccaccatcaccccttttgttttcattgccacccttgcctggggtgagtgaagacgctcttctctggcttccacccttccaa

SEQ ID NO: 19115 - DNA, 201 bp, Homo sapiens
agaataaaatatcatcaggagcagctcatgtgaccagaatgtgacaaagtctttgctctacaggtcaagttgggacttactgaggagaaatgaggggactkcaaagtccaggttgcaccatccactttatagatgaggaaagtaagaacccacagcatcttgcacgtagaattcaatatatgtcctgcttcttgaatcaca

SEQ ID NO: 19116 - DNA, 201 bp, Homo sapiens
gggattcatacggacattatttagacacacttccacctacagagtcacatattgtatagaataaaatatcatcaggagcagctcatgtgaccagaatgtgrcaaagtctttgctctacaggtcaagttgggacttactgaggagaaatgaggggacttcaaagtccaggttgcaccatccactttatagatgaggaaagta

SEQ ID NO: 19117 - DNA, 201 bp, Homo sapiens
tctgtctcaaaaaaaaaaaaaagtgtactttttgaggaaagttctatttttcattattttccactatgaatgaagaagaaaataatatacatacattactkggattcatacggacattatttagacacacttccacctacagagtcacatattgtatagaataaaatatcatcaggagcagctcatgtgaccagaatgtga

SEQ ID NO: 19118 - DNA, 201 bp, Homo sapiens
aggccctggggtggaaacacactcgatgtgttcaagggagagtaagtggtgaatgggtttggagccaacagggataatagacaacgctatcaagagggggsccaaccacacatgtgcagccactgtatgacgtctggattttccttgacttatggtgatcactattgggaggtggtaagcaaacaggtgacataatttgaa

SEQ ID NO: 19119 - DNA, 201 bp, Homo sapiens
cctttgcttgttaccagaagagtcgcccagttgtggcagagatcatctagctcgcaaaactgtaaatatttactctttggcctttcccagaaaaaagtgcsgactgctatgttagatactccagttcattcaaagtgatatcaccctaacattctctaaattagccacagcttagatgaaatttaggcaaatggaacgccc

SEQ ID NO: 19120 - DNA, 201 bp, Homo sapiens
gtgccgactgctatgttagatactccagttcattcaaagtgatatcaccctaacattctctaaattagccacagcttagatgaaatttaggcaaatggaaygccccaggccccaggaagactgtggcagcacattgtatgtaactgttggggatgttgcctgaaaccccccccttttttttaggcagctgcaaggattaga

SEQ ID NO: 19121 - DNA, 201 bp, Homo sapiens
tgaaaacatcacttttcctccacactaatgtgtgagcttagccagagtaggagatatatcttacttaaaaaaaaaaaaaacaaacaaacaaaaaaaaaaaactccttcttcatttgttatagttccaggatagagtgtgtacctggatagagagagtcaggcagatataggtgtgccctccttccaagatgtgtgatggtg

SEQ ID NO: 19122 - DNA, 201 bp, Homo sapiens
agtgactcagataggtgtgtattctcaagaagctttcattctaatgacacatactttgtctccagtcagagttatggcaggttttttttttttttttttttttgactaaattcacccatatttgatggcaagtgtgatcacagcatgtttataaaaatcattcttaattaaggcatttccatcttatcaagccccctattt

SEQ ID NO: 19123 - DNA, 201 bp, Homo sapiens
agactcctaaagggaagattagggttggaagaagatggaggaagagagtaatttaattccttaatggaaagaataaaataagagctcttgacttttttttkttgttgttgttaggatatggggagaggtttctgcaaatatcttcttcagggtttacgaagtgaaccggatgtccggtaacagggttgcatgtcatgcaat

SEQ ID NO: 19124 - DNA, 201 bp, Homo sapiens
tgctttcaggtggagaaattgtaccattgctgaaaatagcttcgctgacagttagggcaagcttcattggtagcaagtttctatctggaaagatgtaggasaggaacactgactctggaagcagacgtgacctagttttgaaacctgggataaccacttcctatctgtatgacccgagcaagttactttccttctcagaac

SEQ ID NO: 19125 - DNA, 201 bp, Homo sapiens
aaatttgcctatctctgatgattagcaagattgataggcttttcttatgtcgggccatttgttttttaacgaattgccctttcatcttatatgcatgactrttggatatgtatcgattactaattgattgcttgcctcatgtgctataatttaattttcaaaatgtcccttagaagttaatttataaagtgtctattactt

SEQ ID NO: 19126 - DNA, 201 bp, Homo sapiens
ttgatgtgccttctcatttaatataagtaattattttaaaggttattgtgattaacatgtattccttatggaaaatttagaaagcgaagaaaaataaaaayaagaataaaagatttaaaaaaaccccaattcttaccagttagaagtatactattaatatttagcatgtatgattgtaagcatgttttcccttctttcgtg

SEQ ID NO: 19127 - DNA, 201 bp, Homo sapiens
agctcattcattttgttaatcctgagtttggaatcaaccaatttatttaaacccgtgaagcctcgctctgtgcccggtcaagtgctgggagtggcatctgyggggagggccaaggcagatgtcatttccagactgcattggatcctggattcagaagctgaagcttaggagtgggcatggtggttcacgcctgtaaaccca

SEQ ID NO: 19128 - DNA, 201 bp, Homo sapiens
gcacagaaactgaagttaaagctaatacaatgtttttcatttttacccttacctctacaatgtacttaattgttacagattcgtatttattgattatcatrttgtattacattgatagccgtttaaaatttatgaagattccgtacttgtcatatttaattctcagcaccgtgcttacagctgtcttgtgataatgtcgaa

SEQ ID NO: 19129 - DNA, 201 bp, Homo sapiens
tgctgggattacaggcatgagccatcacgcctggtgaatggtgtcattttgatgtactgagccatctcagtttttccagcaaccttccctcacctttgtgstcagctagaaggtcagttaacacatgggatgggaattcttgccaatgtccttcgtaaaagaagaacttctccttcactcacatgtcctgatacttcctca

SEQ ID NO: 19130 - DNA, 201 bp, Homo sapiens
gcggggaggaaacctatttcagtgtctctactatttctacctaggtggaggataactagccagatgaacggagctaagccttttgtatgaagtttatttcwtataaagaggaacaaaatcagaatcaaatttcttctgtagttgcacagaaactgaagttaaagctaatacaatgtttttcatttttacccttacctctac

SEQ ID NO: 19131 - DNA, 201 bp, Homo sapiens
ctgtgcttgatggttttactttttgtgatttttggagccttcatgttagaagccatagtcatatggtgctctctgaaagcaagacaaggtttcttcactasactctaagaggagatctgagacagagagatgggggcggggaggaaacctatttcagtgtctctactatttctacctaggtggaggataactagccagatg

SEQ ID NO: 19132 - DNA, 201 bp, Homo sapiens
ttattattattgttgatctcttactgtgcctaatttataaattaaaatttatcctaggtatgtatgtataggtgaaagcatagaatacatagggtttggtmctatccagttttcaggcatcactgtgggtcttggaacgcatctcccgaggataagggggggctactgtcagtgtgaacctgattagatctcaactgaaac

SEQ ID NO: 19133 - DNA, 201 bp, Homo sapiens
aacttgttgtaacatgtaagaaattacatctgggctaaaaggttcaataatgattactcttataatggaatcttctacaaagcaagggatttcatgatatscctatgcttttaaaaaattattgtgatacagtgaaacaaggaagaacgtgtagctggaaaaatagtatttgcttgtaatatacattcagattcataacag

SEQ ID NO: 19134 - DNA, 201 bp, Homo sapiens
atatgtggattactttttctattatgtacatagggtcaatgatcctgggcaattaacatattttctctgggacttagtttcctcatctgtgttctctttcygttcccagttactatgattctattatagtaattgtttctgtttgggcacattcaataatggtgacagcattgcagtcatttttatgcagggtgggtggag

SEQ ID NO: 19135 - DNA, 201 bp, Homo sapiens
catttgttttggtttgaaaaacttactgaagaaatattcaaagaagtgtttgcagtctgtttattttttgaagataatttttaaatattggatgaagaacrtaattttttaagcttagatgatctggtaggatatagtagcaggatatgttgtcttgccatcaaagttaaaagctattcttcattttatttaaaatttagt

SEQ ID NO: 19136 - DNA, 201 bp, Homo sapiens
gctatgaaatttatctttgaacctaagtttattggcctaacttgcaatttcaatatcgatattagttttaaagacagttgccgacactgcatcagagcccygtttgtccccaggcattgggagtcaaagtgaattctgctgccacatggagggtttctttcaggcttgaatctgtctcttttattgcggtacacagcttgc

SEQ ID NO: 19137 - DNA, 201 bp, Homo sapiens
tgcggtacacagcttgcttatcagttaagtgtttcgtttatggatgtggtttgataaatgtctactgaacagtgacaaatgaacagcagtagggcctgtaytgtgctcagctgataaaccactgttagatcctcaaatgcttctcgtgaggatggatttttaacacttagaatactctgactttgtcagcttttctccatc

SEQ ID NO: 19138 - DNA, 201 bp, Homo sapiens
caaggcaggtggatcacgaggtcaagagattgagaccatcttggccaacatggtgaaaccccgtctctactaaaaatacaaaaattagctgggcatggtgrcgcgcgcctgtagtcccagctactcgggcggctgaggcaggagaatcgcttgaacccgggaggcggagcttgcagtgaggtgagatcgtgccactgcact

SEQ ID NO: 19139 - DNA, 201 bp, Homo sapiens
gattagtgatgtctgccatagtcaccccagctgctgctatccatcagaagtcatcagccctgtgcttccatctccatttctttttttggttttttttttttcatttttttcattttttttcattctgagtgtcatcatttaggagactcacacaaaagtaagagaatctttctagggaaatgttctcttttctttgcttga

SEQ ID NO: 19140 - DNA, 201 bp, Homo sapiens
atctactaaaaatacaaaaattagctgggcatgctggtgcaggcctgtagtcccagctacttgggaggctgaggcaggagaattgcttgaacccaggaggsggaggttgcagtgagccgagatcacgccactgcactccagcctggcgacagagcaagactccgtctaaaaataaaaaaaagaacgaagcagcccggccct

SEQ ID NO: 19141 - DNA, 201 bp, Homo sapiens
ctactcgggaggctgaggcaggagaatggtgtgaacccgggatggggagcttgcagtgagccgagatcacgccactgcactccaacctgggcaatagagcragactctgtctcaaaaaaataaataaataaaataaaataaagtactagattatgtttttcttcccaattaaacagatcatgagttcttttggtgactagg

SEQ ID NO: 19142 - DNA, 201 bp, Homo sapiens
taggccaggcacggtggcacacacctgtaatcccaacactttgggaggccgaggcgggcggatcacgagatcaggagattgagaccatcctggctaacatrgtgaaaccccatctctactgaaaaaaaatacaaaaaattagccgggtgaggtggtgggcgcctgtagtcccagctactcgggaggctgaggcaggagaat

SEQ ID NO: 19143 - DNA, 201 bp, Homo sapiens
atggggagcttgcagtgagccgagatcacgccactgcactccaacctgggcaatagagcaagactctgtctcaaaaaaataaataaataaaataaaataawgtactagattatgtttttcttcccaattaaacagatcatgagttcttttggtgactagggtgttgtggcattttggaggcaggaaagatacaggaagttc

SEQ ID NO: 19144 - DNA, 201 bp, Homo sapiens
ttaggccaggcacggtggcacacacctgtaatcccaacactttgggaggccgaggcgggcggatcacgagatcaggagattgagaccatcctggctaacayggtgaaaccccatctctactgaaaaaaaatacaaaaaattagccgggtgaggtggtgggcgcctgtagtcccagctactcgggaggctgaggcaggagaa

SEQ ID NO: 19145 - DNA, 201 bp, Homo sapiens
agacactcacaacccccatcataggcatattcacttatttgtgtgttcatttttacgttgtaggtattactagactaacacatgtgttcatcataaatgawtgtataatatatatattttaaatgataaaatataaataatgagaaagaataaagatgaaaataatgttttattttgtttgttaatgattcaaaacaaatc

SEQ ID NO: 19146 - DNA, 201 bp, Homo sapiens
tttgggaaaatttacaaggctatacttttatgatttatgcactttgatgcgtatatttgcatttcatcaagaaatgcataaaatatgcgtagaaaaattayttgaggaaagtattaaaagaaaacaaaacatggtttggttttgttttgtttttgagacaaagtctcactctgccacccaggctggaacacagtggtacaa

SEQ ID NO: 19147 - DNA, 201 bp, Homo sapiens
cttcataagcaccctaggtgatatagtttggatgtttgtcctgggctccaatctcgggttgaattgtaatccccagtgctggagatggggcctggtggaargtgtttggctcatgggggcagatccctcatggcttggtgttgtctttgtggcacctccttccacccaaccttgctcccaccatgtgagatgctggcttcc

SEQ ID NO: 19148 - DNA, 201 bp, Homo sapiens
ttttatttttgtgaaaattaaagttgggcattggcaacccaataccttttagtgttccactagaacaaaattaaatattaggccagtaatttgatgcagtkgtatccaaacttttccatttcatgccctaaaaattagacactcacaacccccatcataggcatattcacttatttgtgtgttcatttttacgttgtaggt

SEQ ID NO: 19149 - DNA, 201 bp, Homo sapiens
tatcctgctcctgataaccactatttcattctctatctctgtacatttgactgtttccttctaggattccgcatataagtgaatcatgcaatctttttttwctgtgtctgtgccagacacagaaaattatgcttatttcacttagcataatggcttccaagtattgtgttcgagatttttgctaagtgaatagctatagct

SEQ ID NO: 19150 - DNA, 201 bp, Homo sapiens
aaaattatatttcagcagaattctgtcattaaattataagttaatgaggaactacctgtgcctcgttcactaatcagttttcaagtaatgcagttttaagwttgtcgaactgctttcataataagcagataagcagcatgcttaatgcccaagaattgcgattgctcccctttttctgtttcacatacatcttactaagga

SEQ ID NO: 19151 - DNA, 201 bp, Homo sapiens
cttctgcacttagacttgtagaaaaggtccagatctgcaatgtggatgctgttggagtgctggcattttttccttctgcttctcacacggatattatgaatgataaatttttatgatggatgagttcctgacaccagagccagcaattcctactccccatatagtaatacagaaagcatgaaaagtagataactgaatcta

SEQ ID NO: 19152 - DNA, 201 bp, Homo sapiens
acacacgcacacacacatgaaaaaagcattacacacccatatatataaatagaaatgtgtaagtaaaccccagaaatttaagaatagaaatgctgaaaatwgttgtcaagaaacagaactaggacgtagaagtgatcattgcctttccaacccctctgaacaacttttaagaaactctgtctctgtttcatcgataaataa

SEQ ID NO: 19153 - DNA, 201 bp, Homo sapiens
ttaaaagtataaagataccaggataaagtgaagaaagcttggaaactggggacagaaaggcaatgtaacaaaaggacagattgagtgcaagactttctgcrggggcttatagaccataaaggaaggaagaacatttgtgaagcagatatttatcaaaatacccaggcaccccacaaatatttatctctatattcatattat

SEQ ID NO: 19154 - DNA, 201 bp, Homo sapiens
gagataaaatttgactctatatccttaactaactattagaataaccacaaatatgactcttctggttaaaaaagaactgttttttttggtatttgagcccrtgaagctgcattcagctgagctgggcccagatcagcagaaccattgatatgtcccatacacacatgagcaaagatgaggctttgctgtatgctgttgagc

SEQ ID NO: 19155 - DNA, 201 bp, Homo sapiens
gaagggtggggataaatgtaccagaaatgtattatccaaatataaaccatgctaaaacatgtaagattttcaaaaactgaaaaaagaacttaaaaagatamatatatacttgttattaggaatgttcccttcggaaagccatgtgggttatggtgttggaactgaaacaaataatctgatatattctaatatatggcctag

SEQ ID NO: 19156 - DNA, 201 bp, Homo sapiens
aatacccaggcaccccacaaatatttatctctatattcatattatttttgttttttacagcatctcattacataaaaattcaagatctggttgaaaatgarctgttttttgtgcctgctgtgatttgaaataacatttacaggaaatggaaaagcttccatgtgttaccctgtttatgaatttaaatgtcaacccccaaca

SEQ ID NO: 19157 - DNA, 201 bp, Homo sapiens
aggagttctaagaaaatctggcttccttgtttaaatttctccctccacatataaaatattggtgttggcaggggaatactgacatactttgagaaaggcargttgatctgtttcacctactaccttgatattggttgtcatctttagtagttaagccaaatgatgcccaatgaaaagctggcactaaggattaaaaatact

SEQ ID NO: 19158 - DNA, 201 bp, Homo sapiens
aggaaacagcaaaagagactgagaatggtatatacgtaaaagaatagaaggcaggaacttgaacagacacttgtgtaccaacgtccatcgatggatgagtrgatatacaaaatgtcgcatacacttacaatggaatattgtttagccctaaaacagaatgaaattttgacacatgctacaacctgagggaaccttgaagac

SEQ ID NO: 19159 - DNA, 201 bp, Homo sapiens
atttgcatgttggcctatcttgctaggttggggaagttctcctggatgatatcctgaagtgtgttttccagcttcttttcattctccttgtccctgtcacktactccattcaatcgtaggttcagtctttctacatagtcccatatctcttggaggctttgtttgttccttttcattattttttctctaatcttgtctgca

SEQ ID NO: 19160 - DNA, 201 bp, Homo sapiens
tgtgcctagcctggaagcaagaacatgagcaccacaaaaaaaaaaaaaaaatcaccgtgactttttggaaggaagaggagttctaagaaaatctggcttcyttgtttaaatttctccctccacatataaaatattggtgttggcaggggaatactgacatactttgagaaaggcaggttgatctgtttcacctactacctt

SEQ ID NO: 19161 - DNA, 201 bp, Homo sapiens
gaagttctcctggatgatatcctgaagtgtgttttccagcttcttttcattctccttgtccctgtcacgtactccattcaatcgtaggttcagtctttctrcatagtcccatatctcttggaggctttgtttgttccttttcattattttttctctaatcttgtctgcatgccttatttcagcaaggtggtcttcaaactc

SEQ ID NO: 19162 - DNA, 201 bp, Homo sapiens
agtaagccctgattgcattaccggtgtgcctagcctggaagcaagaacatgagcaccacaaaaaaaaaaaaaaaatcaccgtgactttttggaaggaagargagttctaagaaaatctggcttccttgtttaaatttctccctccacatataaaatattggtgttggcaggggaatactgacatactttgagaaaggcagg

SEQ ID NO: 19163 - DNA, 201 bp, Homo sapiens
tatcaaggttcttagcttctttgcattggattagaacatgctcctttagctcagtggagttttttattatccatcttctgaagcctacttctgtcagttcrtccatctcatcctctgtccagttctgcacccttgctggagaggcattgaggtcctttggaggagaagaggcactctgcattttgggttttcagtgttttt

SEQ ID NO: 19164 - DNA, 201 bp, Homo sapiens
cctcaagagacatgaggttcttatatttatttttattctgggaacatgtgcattgaggtaagaattttgaaacacttgcgtatattctgtacaaaatgtgygctttatctcgtttctattttgaatttcaaacaaatttatgatgagtaagcagtagctgtaagtttgactttaaatgaaaaatgattaagaaaaaagaaa

SEQ ID NO: 19165 - DNA, 201 bp, Homo sapiens
attggttgcttaaggcttttcctagaataattctctctccagcttgccaggattctcagtaggaggacccaggtggcattcattacgatggcttccatttycctaatcttttttcccaaagctaaccttattcccactcagagttactgtgactgtcacttccctacccagcagttactccacgctttcttaagcaaatga

SEQ ID NO: 19166 - DNA, 201 bp, Homo sapiens
cacagatcaccataacagatatattaattattcaaatgttgtgaaaattaccaaaatgtgacacagatacatgaagcatacacatgctttgtaaaaatggmaccaacagacttgctggactcaggaatgccacaaaccttcaatttgtaaaaacaaacaacaaaaaacccccacaatatctgcaaagcacaatgaagcaaa

SEQ ID NO: 19167 - DNA, 201 bp, Homo sapiens
aaaacccccacaatatctgcaaagcacaatgaagcaaagtgcaataaaatgaggtgtgcttgtagctattgtagtcaaatccttagagatagaaagttgcrtggtggttgctgggcctgggggaggagaaaatggggagttattgtttagtgggtacagagttttagtttgagaagatgagaaagttctagagatggatgg

SEQ ID NO: 19168 - DNA, 201 bp, Homo sapiens
ggaaagggactgttatcatctttgttttaaaatcaaactatatactaatttcctcccatagttatcttggcctgtactcaggaatgagcaaggacagttartttgtgaggttagaagcaagatggagtcagctatgtcagatttctctcactgtcatgatttttgcaaaggcagtcaaatctacattctcacagtattacc

SEQ ID NO: 19169 - DNA, 201 bp, Homo sapiens
caggaaaaataactaatggatgccaggcttaatacccgggtgacaaaataatctgcacaacaaaccccagtgacataagtttatttatataaaaaaaaaaacctgcacgtgtagccctgaatttaaaataaatgttaaaaaaaattactaaccttagacaacacctatggacaccctgcaatggaagatgagctatagctc

SEQ ID NO: 19170 - DNA, 201 bp, Homo sapiens
caacctgggtgacagagagaaactctgtctcagaaaaaaaaaaaaaagcttgtgtggtggactctaacctaatcagggctgatttatatgttgtttttttytcacatattttcctcaatgttctgttcatatcacatagaatcactgagaattcttctctgacattcacagggcccctaagtactgcttcacagactgaac

SEQ ID NO: 19171 - DNA, 201 bp, Homo sapiens
gcttgaacccaagagatggaggttgcagtgagccaagatcgcgccactgcactccaacctgggtgacagagagaaactctgtctcagaaaaaaaaaaaaaagcttgtgtggtggactctaacctaatcagggctgatttatatgttgtttttttctcacatattttcctcaatgttctgttcatatcacatagaatcactg

SEQ ID NO: 19172 - DNA, 201 bp, Homo sapiens
aggtggatcacctcaggtcaggagtttgagaccaggctggccaacatggcaaaacccggtctctactaaaaatacaaaaattatctgggcgtggtggcacrtgcctgtagtcctagctatttgggaggctgaggcaggagaatcgcttgaacccaagagatggaggttgcagtgagccaagatcgcgccactgcactccaa

SEQ ID NO: 19173 - DNA, 201 bp, Homo sapiens
cttggccaggtgcggtggctcacgccagcactttgggaggccgaggtaggtggatcacctcaggtcaggagtttgagaccaggctggccaacatggcaaarcccggtctctactaaaaatacaaaaattatctgggcgtggtggcacgtgcctgtagtcctagctatttgggaggctgaggcaggagaatcgcttgaaccc

SEQ ID NO: 19174 - DNA, 201 bp, Homo sapiens
tatttgcagccactgagataaaatttgactctatatccttaactaactattagaataaccacaaatatgactcttctggttaaaaaagaactgttttttttggtatttgagcccgtgaagctgcattcagctgagctgggcccagatcagcagaaccattgatatgtcccatacacacatgagcaaagatgaggctttgct

SEQ ID NO: 19175 - DNA, 201 bp, Homo sapiens
gaagcttggaagtagatcttaacaccattgccatcacccacccacacacatccctacaagtgaagaaacggaaacctcaaagcaggtaagtgactggtcasaaaaatcacaggtaataaagccaggaatcaaacattatcgcagcatgctagaaagcctatctgcttttgatttctcagtcacattattttttagtaattc

SEQ ID NO: 19176 - DNA, 201 bp, Homo sapiens
tgcctggctgcacagttgattatcttatttgcagccactgagataaaatttgactctatatccttaactaactattagaataaccacaaatatgactcttytggttaaaaaagaactgttttttttggtatttgagcccgtgaagctgcattcagctgagctgggcccagatcagcagaaccattgatatgtcccatacac

SEQ ID NO: 19177 - DNA, 201 bp, Homo sapiens
gtattactagactaacacatgtgttcatcataaatgaatgtataatatatatattttaaatgataaaatataaataatgagaaagaataaagatgaaaatratgttttattttgtttgttaatgattcaaaacaaatctttgccctccatatagagagtccatgtgtttgaatagactttattattttcaaaactcctcac

SEQ ID NO: 19178 - DNA, 201 bp, Homo sapiens
tcaaactcctggctttgagtgatcctcctgcctctaccttgttttcaaattgttggtgatgtgcttgctgtgtagatcattacttagttcagatgttttgwaaattaatttcttgtagaagaaaaacaatgtatagtgaaaatccagagtaaatgctttgactaaaaggaaagaaagaggcatcttctttagacattagtg

SEQ ID NO: 19179 - DNA, 201 bp, Homo sapiens
ttttttatcccttttgagttagagtcaaggaattattctcctccatggaaaccattttcttgccctcagatgactaaaccaagtgaaatttagcagagttragaacaagcgtgaagttttattccccagggcctttctgttaactccttaaaaggtttggaacattgagctgggagagttatcatgaatggcaaacaaacc

SEQ ID NO: 19180 - DNA, 201 bp, Homo sapiens
ctcaaacaggatacaccttagcaaatctacaccaagatacatcatgtgtaaacttctgaaaacaaaggcaaaggaaaaaaatcttcaaagcagactaagaraaatgatgcattaactacagagaagtaccaattcaaatgatagcagtttcttatccggaaacatggagaccagaaggcagtgcatctttcaatggctgaa

SEQ ID NO: 19181 - DNA, 201 bp, Homo sapiens
aacaaacatttattgagggcctagtatgtgccaagcacctcgctgggcactgaggattcatcagtgacccaacatagtccctaccctcaggtactgatgayccaccactttgactgttgcaccattctgttctagcagctcctaactacttgtgattcttctacctttacaattgtaatattaatgcctttataatatggt

SEQ ID NO: 19182 - DNA, 201 bp, Homo sapiens
gcatttgggaaacatttctcaattttaattcttttaaacgcaataatgcgccatcttgtggacatatccgatattaaattcttaaattaattctacatagygaactgctctctaagccagggttttcaatcatgggttctaatatagagatatgagaagcacttggggagcttttaaaatcctgatgtgcaggccacaccc

SEQ ID NO: 19183 - DNA, 201 bp, Homo sapiens
ccctctgtttctattcctaatttcctcttctaataaggaacaagttgtattgcattagggcccaccctcatgaatgcatttaacttaattacctctttaargcactattgctaaatactattaccttctaaattactgggggttaatacttcaacatataaatgttgaggggacacaagtcagcccttaacagtgttccct

SEQ ID NO: 19184 - DNA, 201 bp, Homo sapiens
ttcctaatttcctcttctaataaggaacaagttgtattgcattagggcccaccctcatgaatgcatttaacttaattacctctttaaagcactattgctaratactattaccttctaaattactgggggttaatacttcaacatataaatgttgaggggacacaagtcagcccttaacagtgttccctcattacattacaa

SEQ ID NO: 19185 - DNA, 201 bp, Homo sapiens
caggcaccacactttgacaatctcttccttagagaagcttgggcacagtgttgccagatcttgaattttcttctaaaaggagctgcaaaatccatgaaagrtgttaaatattggcaacagttgtttaaaaacaccatgtgaaccaaaaaaacattaactatggtctgagtaagacttgggagcttccatttggcagctttt

SEQ ID NO: 19186 - DNA, 201 bp, Homo sapiens
tgcttttgcagagtggctttagtacagaatatgttgatttggcattatcagcactaatttctgcatgccccagggcacccagtatgtgtctttgtgtattrcaagtgcctataagagtatagttattaaggtcacaagctcttgggtcagaaagccaagccacaacaccaataacaagctgtataatcctgcaagttatat

SEQ ID NO: 19187 - DNA, 201 bp, Homo sapiens
tactttattttgctgtatatgaatggatagttggatggataaattaatacagaaaaaacagattctaagtgtttgcaaaatatttttaaaatatgtttccmcaaatgaactatattccttttataaaaagtgaccaatttatgggatgcactaaatctcaattaaaaacatgcaataaatggcagtggctttcagggaagc

SEQ ID NO: 19188 - DNA, 201 bp, Homo sapiens
actgggtgaaatgatccctcttctccaatgcttctgataccccatttcattgtctgcctacacagaggggagagggcaacagctgaggtttcttacagtcycaagagaaccatttttaaaactcagtctatataaaatatttcctggatgttttcaccaaagctcattaatgtaattttcacatcattattgcagctaatg

SEQ ID NO: 19189 - DNA, 201 bp, Homo sapiens
tataagagatttatacttttgtagctgtggcatttaaacctactgattaaaatctaacttctatgtattagctatagaaaaatgaacttgaggcatatttmtctttgcagccaaacacctacccccagagaactatcacagcaatattgttgtactaagacttacagttcttatttagaaaactgtctagatttgccaaca

SEQ ID NO: 19190 - DNA, 201 bp, Homo sapiens
aagagctttctttttccatttttatagtttataaaatactagtgatagtccttctccttcatataacttccttcaagagttgagaatatgaatctaagaawactttgagttctgcatataatatatgtgccttacagagcttctcatgtcatgcatcacaactacagggtcacttcatgtcagtgtgcattgtctaagtat

SEQ ID NO: 19191 - DNA, 201 bp, Homo sapiens
agaccttatgacagaaaaccatcagcattgcccacatattactcaaaacacaagaatttcatttattcccatagcacctggaatctatgctggcatttagwcaagcctaatgcctagtgtaccactagagtgagattctctgtccactcttaactatttctagagcctatttttctatggtttcacatcttatgacttata

SEQ ID NO: 19192 - DNA, 201 bp, Homo sapiens
aatcgcttgaacccaggaggtggaggttgcagtgagccaagatttgccactgcactccagcctgggtgacagagtgagactgtatctcaaaaaaaaaaaawaaataaataaagagaataaggcatttgatatagtttctttgcataacaaaatacaaataaaaccacattctatttcatctaaacactttctcccaagtca

SEQ ID NO: 19193 - DNA, 201 bp, Homo sapiens
acacacaaacccatacctagctacccagtcctctcatctcatttaataaaaagtccatctttccccagtgaattgagacaccagttttttcaaaatatatrtaaattgcctcagtctttcttacacaaaatgtaacattctatctatgtgcttttataggttgcctgttttacttaatataacgtcaatacctcttcatat

SEQ ID NO: 19194 - DNA, 201 bp, Homo sapiens
cactttggacttctataacaaattataaatatgtcttagtcactttgggcttctgtaacaaattaccatagactggtggctgaaataaaaacattacccamagttctggaggctgggtagtccaagggcaaggtgccagcaaatctcatgtctgctgagggcccacttcttggtttgcagttggctgcattctcattgagt

SEQ ID NO: 19195 - DNA, 201 bp, Homo sapiens
acatttgtatgttgcatataattttcccatgtatattgcagtataccatgtatgttgcatataattttacatatctcagcataacaccttattattttatktttcacattctcctactagtcttgggacttcctgaagccagggctgtgtctcactcatgtctctgcctagcacctgtcacagtgctaggtttgcagaagt

SEQ ID NO: 19196 - DNA, 201 bp, Homo sapiens
tttgaaattttaagtgctatttattaacaaatccagtttaggaaaaaatctatattcaaaatgtcagtataattttctataacgaataaaatttaaatccytgaaaaaaataattttaaacagcccaacttccaaggaaatctgtaattgattttaggtaaaatatgtgttacaaatgctgtaaagctaaatgttgaaatg

SEQ ID NO: 19197 - DNA, 201 bp, Homo sapiens
aaacaagtccacggagtcagttccattcagtcagataagaaaacagagtgatttcgtgacatctagaactttatgaatggttccattactgggttttggawgaggaacgtgagctgacattgcagcaggtaatattaaagacaattgtaaccttcttatgaagaagaaaccatgccaaactttgccacaggttactgagga

SEQ ID NO: 19198 - DNA, 201 bp, Homo sapiens
aaaaatgtcaacacaagatcactgagctatgtgctggccacgcattgcatggaagagtcgcggcttgggaaaggagggaaagatgaaggagggatagatagtatatctgttttcggggtcatagagaccctgagagagtgtttgtatatcaaaatagaatacatgtaccatagaaagcaaactgtattaaatgccagcaaa

SEQ ID NO: 19199 - DNA, 201 bp, Homo sapiens
gggcttgagggagcctgctttgctctttttgcccttctgccatgtgaggacacagcaaaaaggtatcatcttggatgcaggagatgagccctcaccagacrccaaatcttctggtgccatggtcttggaattcccagcctccagaactgtgagaaataaatttctattaattataaattacctggtctaagatattatgtt

SEQ ID NO: 19200 - DNA, 201 bp, Homo sapiens
gaaaaatgtcaacacaagatcactgagctatgtgctggccacgcattgcatggaagagtcgcggcttgggaaaggagggaaagatgaaggagggatagatagtatatctgttttcggggtcatagagaccctgagagagtgtttgtatatcaaaatagaatacatgtaccatagaaagcaaactgtattaaatgccagcaa

SEQ ID NO: 19201 - DNA, 201 bp, Homo sapiens
gctggactgctggaagggacggactgcagaagaggaacctgtcatcacccatggcttcaccatgacaactgaaatatctttcaaggtagagtatatgaatrttactaagagaggcagctggagacacctgattccttttggttaaagcctcctaaggtagaaagtcccagtggtcacaattaagtccaaaggctgttaatc

SEQ ID NO: 19202 - DNA, 201 bp, Homo sapiens
actgcgaattgttgggtcccatgaagtattttatagaaagctctgccaaacaattttttaattatttaattaaaagaatcccctctctgattttttttttttaaaaaaaaaaggtaataagaacttgggacaaaaatttcattataaaaatgcttaagtggcaataccctaaaagaatgtgtctctaatattgtagtaaga

SEQ ID NO: 19203 - DNA, 201 bp, Homo sapiens
gactgcgaattgttgggtcccatgaagtattttatagaaagctctgccaaacaattttttaattatttaattaaaagaatcccctctctgattttttttttttaaaaaaaaaaggtaataagaacttgggacaaaaatttcattataaaaatgcttaagtggcaataccctaaaagaatgtgtctctaatattgtagtaag

SEQ ID NO: 19204 - DNA, 201 bp, Homo sapiens
ggcaaattttatttttgtgaaaattaaagttgggcattggcaacccaataccttttagtgttccactagaacaaaattaaatattaggccagtaatttgaygcagtggtatccaaacttttccatttcatgccctaaaaattagacactcacaacccccatcataggcatattcacttatttgtgtgttcatttttacgtt

SEQ ID NO: 19205 - DNA, 201 bp, Homo sapiens
tccaccagcagttttgataattaaagtacacaaaatgtatcaaacatttgagataggccaagtattccgttgaatttgttacagatcttgaagtggactcratcactacttgctacttttcagagaacctttccaggtatactagctaggtatgaatatcagaaggctattaccactgtttgaccacaaaggtaaagaaca

SEQ ID NO: 19206 - DNA, 201 bp, Homo sapiens
tttaaaacgtgtgatttataattacaagtttcaggtgatttctgagaatgctttttctcttctgagtgtaccaaaaagaaccccacaaaattacaagtackaatatgttttctctttgaaccttgtctcaatggtgttcaaaaactttgatgcaattaatcaattcataaaacaccttgttatcaagtttaattagccttc

SEQ ID NO: 19207 - DNA, 201 bp, Homo sapiens
tactgttatttagaattgtcaagtattaatgtttccctttcgttgacaaagatggggtgtgctgccacaggaaacccttgttatatggaggctcttccagstttatttaaattgtgaacatttgtacttaataacacgaacaatgagcagtctggatttttctttttcaagttgtcagtgcaagtaaaggcattttaaaat

SEQ ID NO: 19208 - DNA, 201 bp, Homo sapiens
  misc_feature (1)...(201): n = A,T,C or G, or insertion/deletion polymorphism (see Tables 1-2)
aaagggtccaatgtatagatctgattcatctccaaatattttcccactaaagactgtggaagtaaatatattgatggactctgtaatcactgatttaaaangtgtgatttataattacaagtttcaggtgatttctgagaatgctttttctcttctgagtgtaccaaaaagaaccccacaaaattacaagtactaatatgt

SEQ ID NO: 19209 - DNA, 201 bp, Homo sapiens
aaataaatgaagaaaagatacagttttaaagataaaatgaccagtgctggaaaagaaagcaaagcatagtttaaatcaatgtgctccatcaccgaaaaagsacgttagtaagaaacttggcttgttacatactttaaattctctgtttacattcagaactatatggttttaaaatattgtggtttcttctgagtaagtgtt

SEQ ID NO: 19210 - DNA, 201 bp, Homo sapiens
ttcatgagtatgaaaaaatgagtaaggtatatcttctgcacgaaaaatgtttctggtatcaaaaataaaatctaaaggtcatgaagagatgttttattttstagatacttggcatgcaaataaaataacctttttaaaaagtggtattaaaaagtaaggattcaaaccagcatttaactctttttttaaatcatcctttag

SEQ ID NO: 19211 - DNA, 201 bp, Homo sapiens
ctggtacaccctggtgaacagaatgatagccttcatcacactcatatataaaagaaagaaaccttgaaaatgagaggtatgaggataagcattgattcaargggaatttgttagtctgtgttttattttctgagatgcaaatgttgaattcaagggtttgatgggaaaccagcctggacgtaaatttatacatttcctcca

SEQ ID NO: 19212 - DNA, 201 bp, Homo sapiens
aatcttctggtgccatggtcttggaattcccagcctccagaactgtgagaaataaatttctattaattataaattacctggtctaagatattatgttatarcagcaggaatgaaccgagacagcagcctatttcagaagcctgtctctgatgctcctattccaaccaaaatctttaagccagagatcgcaaccagtaacct

SEQ ID NO: 19213 - DNA, 201 bp, Homo sapiens
cttcttcatcaacagttttctatacttatacagtgactttataaattcatcattattccatcccaaaacaaatatgaatactcttgttatggtaatgccaytgcgggatatgaaagggcagtcctctaccagctcgtttttttcctagtatgtacccatagttgcttttctttgacatagtcagtctgttctccttctact

SEQ ID NO: 19214 - DNA, 201 bp, Homo sapiens
gttataatgtttttttcttagtgttctttcatcttcttgttgaacaggatgccaactttaaaaataaggagatatcctttaaaaatgtttccttgctttawttgaaatattcaaagacctggctcactggggccatgttccaatggacttggcagcaattagctggatctgaggagtggaatccccgattagatgaccttg

SEQ ID NO: 19215 - DNA, 201 bp, Homo sapiens
caagcctgacagcttcaaaccgctttatttcagatgaagatgcatggctaagctaattatattttctcttcttcatcaacagttttctatacttatacagwgactttataaattcatcattattccatcccaaaacaaatatgaatactcttgttatggtaatgccactgcgggatatgaaagggcagtcctctaccagct

SEQ ID NO: 19216 - DNA, 201 bp, Homo sapiens
gtagtcattgcttgaagatttatactgggctgcaaaataaccctgagtgtctactcaactttcagttcgaagtgccttatcctgtatggtagtgggttacyttttgcatgccaactccatcatatggtagcagatgcctgggactttttgttgataaggattccaaggctatctagatggcctggaagtaccactaagatt

SEQ ID NO: 19217 - DNA, 201 bp, Homo sapiens
aagatttatactgggctgcaaaataaccctgagtgtctactcaactttcagttcgaagtgccttatcctgtatggtagtgggttactttttgcatgccaaytccatcatatggtagcagatgcctgggactttttgttgataaggattccaaggctatctagatggcctggaagtaccactaagattgattagtgatgtct

SEQ ID NO: 19218 - DNA, 201 bp, Homo sapiens
aacttcattaagtcattctctatcagaataggagctattgagaatttctgcagaactaggattgtgtcttctctacctatgaaatgagtggtgtcatgacraagcactctagggagccctgccaacctatttgataatgttgatggacaagattgtatggggagtggggagaaaaaacaccttttatattcttccctgatg

SEQ ID NO: 19219 - DNA, 201 bp, Homo sapiens
ctggccaagacttccagtactatgatgaagaagggtggtgagagtgggcatccttgttttgttcccgttctcaggaagaatgctttcagcttttccccatycagtattaagttggctgtgggtttgtcataggtggcttttaattcattaaggtgtgtcccttgtatgccaattttgctgagctgtgctctttttagtaat

SEQ ID NO: 19220 - DNA, 201 bp, Homo sapiens
ccctgccaacctatttgataatgttgatggacaagattgtatggggagtggggagaaaaaacaccttttatattcttccctgatgtatgtataagtagttstttaggaagagatgaaatgcgtggctttgtcctgaatagattcccttaggggacacccagggaattcctaggcccagtggaattaatgttctagaaagag

SEQ ID NO: 19221 - DNA, 201 bp, Homo sapiens
agattttaaaataattaaaatataaactctaggacaatcagggttaaaaaaaagtagcctgagactctgatttatcttttcttctatttttctgtctcaawtgcctgtttttttattgtttcgattaaaatctttatcaacagacgttatataattctttgaaagggttttgtcctgtagcttttgaatgtgtactttcat

SEQ ID NO: 19222 - DNA, 201 bp, Homo sapiens
gagactactttctgttcccctcactcaaagttatagccataatactgctgcctaacaaccaaccataaaaatcagtcacaaaacaagcatttgctaagttratgagtctatgaactggttctggtctggaccaggctcacctgatctcagtaggcttgttcatgcctgtgtttagctggtggtcagctaggggtgagctgg

SEQ ID NO: 19223 - DNA, 201 bp, Homo sapiens
tttttaaaaccattagatcttgtgagacttattcactatcatgagaacagcagaggaaagacctgcccccatgattccattacctcccaccaggtccctcmtacaacacgggggaattcaagatgagatttgggtggggacacagccaaacctatcacttgtcaagctctttctatatttaatcagcaagacaagtctctt

SEQ ID NO: 19224 - DNA, 201 bp, Homo sapiens
ttcctggtaagacacctctgtcttccttctacacactattcaataccgtcttctctttgacatgaccttttccttccacctcttttcacttctctcttacytgcagggttaggagacacctgctatgtgagtgtatgtaaaccatacttcacagagcaagccttaaaaaaataccagctttcatcctttttccttcccttc

SEQ ID NO: 19225 - DNA, 201 bp, Homo sapiens
tgtgcactcaaatctcctgggaattttgttgaacatgtagattctgacttagttgatctggagtagggcccgagaacttacatttctaatgtgctccctgrtgatgctcttgccactggtatgtggactacactttgagtagcaagatctagaaagccaggtcgtcagctcagagtttctagaacagtgcctgctatttag

SEQ ID NO: 19226 - DNA, 201 bp, Homo sapiens
tctaactatagcacagtaccatggaaggaagtagatatcattacaaaataggaaaacttaaatctcaccaataaagaactcatcaactagggagatgctgyggactcattgtaaaagtgtctgtgcattctattaacaaacaggcgtcattatgatagctagaagcattgaccttggatgaaagttgaggggaatataatg

SEQ ID NO: 19227 - DNA, 201 bp, Homo sapiens
tctaaacatttattaagaatggaaggttgaaatggtgacatccctttgtgggagcaataataagatatttacatacaaaaggtatgtctgtaaatgatacyctgtaggaaaaaccaattagggggccaacacccagagttatctgggcagtcaaaggggagaattacctaaggctggcttagaaagggaaggggcagagag

SEQ ID NO: 19228 - DNA, 201 bp, Homo sapiens
tcgaagtggaattgtgaatcttccaatcgtctaaaccacatttcttctaaactacatttcacaaaaacatattgggtgggactcgtttgagaaaaaaaggytatatatatatctttttaatcccatatcatatactgctattttttaagtacctaagatagtgtttggtataaattaaccatatagaaaatatttgaataa

SEQ ID NO: 19229 - DNA, 201 bp, Homo sapiens
ttagttggtttcatagcatgaagagttgttaacatggatttttaatgttttatatcatatttttggacctgtaccatggcaagaaaaccacctaacctccrttctccatagcttttgtggcaccttagcccagatttgcttgtgaattgaatttttttatttaaccaaattctgagaataaatatgcaggaagtcctcctg

SEQ ID NO: 19230 - DNA, 201 bp, Homo sapiens
atgggatcaggcagagaccagactccatccttctgagaccacacccttgctcagctccttccccagccccgtctgctttcctggctcccctactctgagartccctcagtaaatcacgtgcacctgaatccccatcttgcattctgcttctagggaacccaaactaaaaatatatgtattcgaatgaagcaattgggtctc

SEQ ID NO: 19231 - DNA, 201 bp, Homo sapiens
caaatgaacgctacggttgacctcataggtgtgttatgaatgtttaccctgacctcctagaagaaaaggaaaaagaaaggaaagagagagggagaaggtgwgggaaggggggaagaaaagaaaggagagaaaagaagacagagaaaaaacagggagggaggaagctggggaaggaaaaagaccatttgctgactccgttgt

SEQ ID NO: 19232 - DNA, 201 bp, Homo sapiens
gacacagggaatgccatgtcagaacaaagtcacaacatggctatgaattctgttcatgtcctctcaacagtgatcattttgtttctgtattaccttgtaaygaaggccatattggaaggtgagtagaggaccgacatataatatcaatttctggcttctacaagaaggcatcagggagaccttgacaatttcttcttcgtt

SEQ ID NO: 19233 - DNA, 201 bp, Homo sapiens
ccaaatgaacgctacggttgacctcataggtgtgttatgaatgtttaccctgacctcctagaagaaaaggaaaaagaaaggaaagagagagggagaaggtragggaaggggggaagaaaagaaaggagagaaaagaagacagagaaaaaacagggagggaggaagctggggaaggaaaaagaccatttgctgactccgttg

SEQ ID NO: 19234 - DNA, 201 bp, Homo sapiens
cctggaagctttacatcattatttaagagtttttataactcaatctttagctctcccaccaggttagtgagggaggctgaaagttccaaccctccagtcasttgatctgtctggtgatcacccctatcctgaggctctccaggggccctattctaaatctacttattaacataaattcagatatgattgaaaggggtttac

SEQ ID NO: 19235 - DNA, 201 bp, Homo sapiens
atgcccttagagtatagtttgaaatcaggtagtgtgatgcttccagatttgttctttttgcttagtcttgctttggctatgcgggctattttttggttccrtatgaattttagaattgttttttctaactctgtgaagaatgatggtggtattttgatggagattgcattgaatttgtagattgcttttggcagtgtggcc

SEQ ID NO: 19236 - DNA, 201 bp, Homo sapiens
ataagaagaaaaagcaaaagctctaacttggaatgtaataaatacaattttgaaattagttcattaataattgtatggctgtttaaaaagagtgaaatatrtggcacttaatatgtcatgaagcagtgacttagtttagaatataataaaatctactactatcccatgatgaaagtctactacagttataacttagccaca

SEQ ID NO: 19237 - DNA, 201 bp, Homo sapiens
aatgaacaagtatttagtttataagaagaaaaagcaaaagctctaacttggaatgtaataaatacaattttgaaattagttcattaataattgtatggctktttaaaaagagtgaaatatatggcacttaatatgtcatgaagcagtgacttagtttagaatataataaaatctactactatcccatgatgaaagtctact

SEQ ID NO: 19238 - DNA, 201 bp, Homo sapiens
ttgctttgtcgaagatcagttggctgtaagtatttgggtttatttctgggttctctattctgtcccattgttctgagtgcctatttttatgccagtaccayactgttttggtgactatgcccttagagtatagtttgaaatcaggtagtgtgatgcttccagatttgttctttttgcttagtcttgctttggctatgcggg

SEQ ID NO: 19239 - DNA, 201 bp, Homo sapiens
tagcctgctacttatttacatgacttgcctggcccctgtaacatctgagtttgcaacccttgggctggaatagctctagaccactgatggatggggctttkttggaacggagccagaattaccctgtattcttttcatattttcttacaatgaacaagtatttagtttataagaagaaaaagcaaaagctctaacttggaa

SEQ ID NO: 19240 - DNA, 201 bp, Homo sapiens
tttttcccccactttatgtttttgtttgctttgtcgaagatcagttggctgtaagtatttgggtttatttctgggttctctattctgtcccattgttctgwgtgcctatttttatgccagtaccacactgttttggtgactatgcccttagagtatagtttgaaatcaggtagtgtgatgcttccagatttgttctttttg

SEQ ID NO: 19241 - DNA, 201 bp, Homo sapiens
ttgactgacttacatctctgggtatcagttggatgttgatgaatctaggataatttggggtatgggactgggatgactgaggtgactcaactcttttcctygtgttaaatcttctactagagtagtctaagcatgttcccgtgacatgccataggaataggagtgaaagctaagtaagggcttttttaagcctctgcatag

SEQ ID NO: 19242 - DNA, 201 bp, Homo sapiens
tcctacatgtggctagccaattaccccagcacactttgttgaaaagggtgtttttcccccactttatgtttttgtttgctttgtcgaagatcagttggctrtaagtatttgggtttatttctgggttctctattctgtcccattgttctgagtgcctatttttatgccagtaccacactgttttggtgactatgcccttag

SEQ ID NO: 19243 - DNA, 201 bp, Homo sapiens
gacaaacgtctttgggttattatcttgattatttttttttattatactttaagttttagggtacatgtgcacaacatgcaggttatttatcatttttgtamaatcaaaatttgtttcctaattcacaatcatttttatgcccagctgagtcttccaaaagaaaacacctaactaaaaatagaaaacttctaggccttaatc

SEQ ID NO: 19244 - DNA, 201 bp, Homo sapiens
gatccagtttcattttcctacatgtggctagccaattaccccagcacactttgttgaaaagggtgtttttcccccactttatgtttttgtttgctttgtcraagatcagttggctgtaagtatttgggtttatttctgggttctctattctgtcccattgttctgagtgcctatttttatgccagtaccacactgttttgg

SEQ ID NO: 19245 - DNA, 201 bp, Homo sapiens
agcacactttcatttacagctgctttcctctgtctccctcttcctttcccagcccatcctttccactttgaccctggaccctagcttctcaatgatttcayactaaaattgatcccttccctttcttatgttgtcaatatttcccctgtaaccagatctgtacatcaatattaaacatgacatgcttacccatcttaaaag

SEQ ID NO: 19246 - DNA, 201 bp, Homo sapiens
agcatgtgcaggggaactgtcctttataaaaccatcagatctcatgagacttattcactatcatgagaacagcacaggaaaaacccacctccatgattcarttacctcccactgggtccctcccattactcatggggattatgggatctacaattcaaaatgagatttgggtagagacacagccaaaccatatcgatgtat

SEQ ID NO: 19247 - DNA, 201 bp, Homo sapiens
accaacactccttctactgtagtgcattatcacttctaaaaggaaagtaatttctttccactagtgatttagttcagattgcattattagatagtgacgtrgttgaatgtataattaaatctgctttacaaaagaaaaagcagtattttatcatttctttttaaattatgagttgtctcttaagagggatttctcttttat

SEQ ID NO: 19248 - DNA, 201 bp, Homo sapiens
taacgctttttcatggcttcgtattactttattgcatgaatgtagcttaatttatttatctagttccctactcgaggtggtgtattagtccgttttcacayggctgataaagacatagccaagactgggcaatttatacccaaactgtgaggtttaattgaactcatagtttcacatggctggggaggcctcataatcatg

SEQ ID NO: 19249 - DNA, 201 bp, Homo sapiens
ttttcttcaggggtatttacagttttcggttttacgtttaagtctttaatccatttggagtttatttttgtatatggtttaaagaaatggtcctgtttcartcttctgcatagggctggccagttatcctagcaccatttattgaataggcaatccattccccattgcttgttttgtcgactgtgtcgaaggtcatatggt

SEQ ID NO: 19250 - DNA, 201 bp, Homo sapiens
aaagatccaaatccatatagttttcaatttgcttcttttacttagcattatgccatggtgatttttcatgtcatgctttttaacgctttttcatggcttcrtattactttattgcatgaatgtagcttaatttatttatctagttccctactcgaggtggtgtattagtccgttttcacacggctgataaagacatagcca

SEQ ID NO: 19251 - DNA, 201 bp, Homo sapiens
caatatgccaaaagaccctgcacttggcctttttagtccaagtgatctatattttagctgagtttcctagaagtatatacaaggattctcagtggtgactrgaatgaacagactagctgttcaggaatctaatgcctaccatagctattaatagctaccactggctgttcgtggtggctcacacctgtaatcccagtgctt

SEQ ID NO: 19252 - DNA, 201 bp, Homo sapiens
tactaaacaagaaatgacaaataagcaaaagatgttagtagtgaaataagaaataaaataattgttgacatttttgtcaattttcctgattattaccccartgggattcaaacacacacacacacacacacacacacacacaaagatccaaatccatatagttttcaatttgcttcttttacttagcattatgccatggtg

SEQ ID NO: 19253 - DNA, 201 bp, Homo sapiens
caaatatttttctgcctctccccctctttcaaggactctaatgacttttacattagaccacttttctgggaacaagttccagactggaaaagtggtctaaygtaaacgttgtctaatgttccactgggaacaagtactgtgtgtagtgctgaccattgttaccccgaaatcttgaaatcttgtgggtagtctttcctcaac

SEQ ID NO: 19254 - DNA, 201 bp, Homo sapiens
aatacaaatcctttctttagatatatgatttttcaaatattttctccaagtctgtggcatgtcttttcattcttataacaccgtctttcaaacagcataartattttacttttataaaatctagttatcaatttgttcttttatggattttggtgtttgtgtcatatatatatataaatatttgcctaactcaaatatttt

SEQ ID NO: 19255 - DNA, 201 bp, Homo sapiens
aggtggatcacctcaggtcaggagtttgagaccaggctggccaacatggcaaagcccggtctctactaaaaatacaaaaattatctgggcgtggtggcacrtgcctgtagtcctagctatttgggaggctgaggcaggagaatcgcttgaacccaagagatggaggttgcagtgagccaagatcgcgccactgcactccaa

SEQ ID NO: 19256 - DNA, 201 bp, Homo sapiens
tgtggcagtgttgcggtaatagatacatgatccatctggcttcatccttgtagagaaggagattggctatctttccttcagggttccagtcctggttcttyctttaactagctatgtggctttagcaaatattttaacatcattaagtggcatatgtaaaatggaaaaaaactaatttttgtctaactcacaaaattgcta

SEQ ID NO: 19257 - DNA, 201 bp, Homo sapiens
gcctaactctatcaatcgataagcacctagaggatatttttgatgtaattgttcatatcatgatacgagatgtaaaatgcacaccaagctctgtagactcyacttttgtgcaaaaaaaaaaaaaaaaaaaaaaaaggatctgtgtccctagagctctacatctaaataactctacagtctggctactcaaagtgtgaagtg

SEQ ID NO: 19258 - DNA, 201 bp, Homo sapiens
cgcttgaacccaggaggtggaggttgcagtgagccgagatcatgccattacacttcagcctgggtgacagagcaagactccatctcaaaaaaaaaaaaaaagaagtctggacaccccaatattagtccatttccatgcttctaataaagacatacctaagactgggcaatatgaaggaggtttaactggacttaaacttca

SEQ ID NO: 19259 - DNA, 201 bp, Homo sapiens
agcaacagaaatcgtttgtgaaacttcaaaagaaacactacaaagaaatgaaagacctggttaagagacaccacaagaaaaccactgaccttatcaaagarcacactaccaagtataatgaaattcagaatgactacttgagaaggagagccgctttggaaaagtccgccaaaaaggacagtaagaaaaagtaagttcaat

SEQ ID NO: 19260 - DNA, 201 bp, Homo sapiens
gcttaaatacatgcaagaacttcattaagtcattctctatcagaataggagctattgagaatttctgcagaactaggattgtgtcttctctacctatgaawtgagtggtgtcatgacaaagcactctagggagccctgccaacctatttgataatgttgatggacaagattgtatggggagtggggagaaaaaacaccttt

SEQ ID NO: 19261 - DNA, 201 bp, Homo sapiens
ttggaggaatcaaaattgaacaatcaagcctgaggacttgatagagtctcaactttgactttttagttttttttctctctctcaatctttttctttcttaraaaatagaaaaatgactgcttactactgattgtaatgtgtctcaacttttgaaattcagccttaaacttgttttactgtgcacatttgcttttgttgaat

SEQ ID NO: 19262 - DNA, 201 bp, Homo sapiens
gagttagcaaatatgctgaatataaaattaatttataaaaatccatttcatttccatatataagcaacaggcagctagaataacttaaaaaatatataacrtcataacaagtaaagttattattgggtataacatcaaacaaggtctattataacatgcttatgaattggaagagccaatagcataaaaataagttctggc

SEQ ID NO: 19263 - DNA, 201 bp, Homo sapiens
ccatgccaacttctactgttttttgattcttggattatggccattgttgcaagagtaaggtggtatcgcattgtggttttgatttgcatttccctgatcaytagtgatgttgagcattttttcatatgtgtgttggtcatttgtacatcttcttttgagagttgtctattcatgtccttagcccactttttgatggaattg

SEQ ID NO: 19264 - DNA, 201 bp, Homo sapiens
tacattcccaccagcagtgtagaagtgttccctgattgctgcatccatgccaacttctactgttttttgattcttggattatggccattgttgcaagagtraggtggtatcgcattgtggttttgatttgcatttccctgatcattagtgatgttgagcattttttcatatgtgtgttggtcatttgtacatcttcttttg

SEQ ID NO: 19265 - DNA, 201 bp, Homo sapiens
cgtctctaatctcatccaagtcattggaaatgctgttaattcattcctttttgtggatgagtagtgttctatcatgtatacataccacagtttctatatcyactcattgactgatgggcatttcagttggttccacgattttgctattgtgaattgtgctgctgtaaacatgcgtgtgcaagtatctttttcaaatagtga

SEQ ID NO: 19266 - DNA, 201 bp, Homo sapiens
tggatttgaatgaagacatgtctcagcccctttctcactatttcattaattcctcgcacaacacctacctcacaggtatgaattttctagttctttgttastttagccagtctcaccaaatttcaccaacctctactttctgttgttcggaagctgaagtgtgttttcttccatttcctgcgaagtgcctctgagaactct

SEQ ID NO: 19267 - DNA, 201 bp, Homo sapiens
tttccatctgctacctcattatatctaccaagatatcaatccacttaatttttttttcctgaaccatttcacggtaagttgcagacaggatagcccttcaycttaaataattcagtgcatatactccaagaacaagaacattttttacgtgaccacagtgcataattatcaaaatcataatggtgcatactactatccagt

SEQ ID NO: 19268 - DNA, 201 bp, Homo sapiens
gaggttctgcatttgtattagtcgattctcacactggtgtgaagaaatacctgagactgggtaatttataaagaaaagaggtttaattggctcacagttcygcttggctggggaggcctctggaaacttacaatcatggtgcaaggtacctcttcacagggtggcaggagcgagaatgagagcagagtgaagtggggaaaa

SEQ ID NO: 19269 - DNA, 201 bp, Homo sapiens
aaataccacagaagtgatgctgtgcctttcccagcacattctatcagacagaaaatgatattttgaaataccatttggcagttggctctttgaccaatttrcctctaattcaaactctgtatcattattgagcaagcatttagtagcttgaaattgtagctgcatattctccattttgctcacaagtgtatcacatttaga

SEQ ID NO: 19270 - DNA, 201 bp, Homo sapiens
agaattggaattattaagtcaagtatataaaaaattgagtcttattgcatatagttaaattgtctctcagaataaaactgctccaatttcaacttccaccrcgaatgtatgaatgtgcctattgccatgaatgtttgccgaaataaatctttggcaatatcaaaatatatccatgtagcctctattttatttctttatttt

SEQ ID NO: 19271 - DNA, 201 bp, Homo sapiens
gaattggaattattaagtcaagtatataaaaaattgagtcttattgcatatagttaaattgtctctcagaataaaactgctccaatttcaacttccaccaygaatgtatgaatgtgcctattgccatgaatgtttgccgaaataaatctttggcaatatcaaaatatatccatgtagcctctattttatttctttattttg

SEQ ID NO: 19272 - DNA, 201 bp, Homo sapiens
gggtttctttagttagttatttaagctttgttatgttcccagttcttctcagccatttactactagtttctgtcttgtgtgttttatttattaaaaaaggrcccccctccagcaatagtataaaaataatcacctctgtttttcttatattttgaaatattgtgggtttttttaacctttaaatcttaaatagataactta

SEQ ID NO: 19273 - DNA, 201 bp, Homo sapiens
agtgttacacagtggaagtatttagaggagaggaaatttccattcatatctgaaaaacaacatcattaatatttcttcttctaaaaaatctagagacatayacttttagtttagtctacatgatatgatataatcacagagaagtaaccatactttgtagctagaaccctactggcataaaaataatgtagtttcacaaga

SEQ ID NO: 19274 - DNA, 201 bp, Homo sapiens
tttgcaaaagagggaaactacaccgttagagatacattctgaattatttacaggtataattatatgatatctgggactggattaaagtagaataggggcaygggagaaggggttggggttggataggatgaccacgaatgaatggtttttgaggctggtttatggctttgagtgtgcattatactattaagtttacttttg

SEQ ID NO: 19275 - DNA, 201 bp, Homo sapiens
tttttttaagacacgagatcttggtctgtcacccaggctggtgtgaagtggcatgatcacaggtcactgcagcctcaaactcttgggttcaaggaattctyccacctcagactcctgagtagctgaaactagagtcatgcaccacaacgcccaactaattttttaatatttagtagagacaaggtctcactctgttgtcca

SEQ ID NO: 19276 - DNA, 201 bp, Homo sapiens
tattcagagtgtcttaacaggtaaatgccaccctttccccccatggaattaagcagctcagtgttacacagtggaagtatttagaggagaggaaatttccrttcatatctgaaaaacaacatcattaatatttcttcttctaaaaaatctagagacatatacttttagtttagtctacatgatatgatataatcacagaga

SEQ ID NO: 19277 - DNA, 201 bp, Homo sapiens
gggacaggcttaaatacatgcaagaacttcattaagtcattctctatcagaataggagctattgagaatttctgcagaactaggattgtgtcttctctacmtatgaaatgagtggtgtcatgacaaagcactctagggagccctgccaacctatttgataatgttgatggacaagattgtatggggagtggggagaaaaaa

SEQ ID NO: 19278 - DNA, 201 bp, Homo sapiens
ccagacacaagctgctctcattacaaccatctcttctcatctcttgaggatgagctcactaataagagtacattatctcttattgggacaggcttaaatamatgcaagaacttcattaagtcattctctatcagaataggagctattgagaatttctgcagaactaggattgtgtcttctctacctatgaaatgagtggtg

SEQ ID NO: 19279 - DNA, 201 bp, Homo sapiens
agatgacattttagaaactttaaatccttattctgtactagcctttataaattaaagaataatagaaatatgggtaaacgatatgaatgggaaagtaaagycccccaaagaaagaaagaaatgcaaacacaaatagatatgagaaagttattaatttcagcaataatcaaagaaatacatactataacaataattattttc

SEQ ID NO: 19280 - DNA, 201 bp, Homo sapiens
ggtcatttaaatcaatgagttgaatacaaacagaagtataattgccaaattatgggttttgggaaactatgatgaacacgagattctttacttgtctgttktaggttatttttccaggttatgtgatcctgtgatcacatatctgccaacattttcatgttttgggtatttcctaatgtaattgaatttctcctggtttag

SEQ ID NO: 19281 - DNA, 201 bp, Homo sapiens
atgttgggtcacaattgtctgatgatcctggctaagcatttggttaacctcattttgggtcctctttctctcttcacatggaggagcacagcacttgaackctctcgtgtttgaggacaactgggctgacatcgagtgaatttttggaaaactattatgtctttgtagtcacttaatgtcagcttgatgttgaagcaaagt

SEQ ID NO: 19282 - DNA, 201 bp, Homo sapiens
ggtggtcggcacaaacaaccatatattgtatggttacatttatatgaaataattagaataggcaaatctatgaatacataaagtgatgaatgattgcctgrgactaggtgtgtggggtggggtgcaggaatgaggagtgactgctagtgggtacatggtttctttttgaggcgataaaaatgttctaacttatattgggat

SEQ ID NO: 19283 - DNA, 201 bp, Homo sapiens
atacttgaagtcattttcttaagagtggaaatgactttaggctcttacatagacactttgtctcctaagccatctcatggcaactgctctgtgttcaagaragcaccatggtttcactggggcagcaggcagataccatgtaattgagaaatcagatcaaacagatgcatctagagagggtcaagacaaataatacattct

SEQ ID NO: 19284 - DNA, 201 bp, Homo sapiens
gctacggttgacctcataggtgtgttatgaatgtttaccctgacctcctagaagaaaaggaaaaagaaaggaaagagagagggagaaggtgagggaagggrggaagaaaagaaaggagagaaaagaagacagagaaaaaacagggagggaggaagctggggaaggaaaaagaccatttgctgactccgttgttttatttcc

SEQ ID NO: 19285 - DNA, 201 bp, Homo sapiens
ctcactctgttacccatgctagagtgcagtggagcgatcctagctctatataacattgaactgctgggcacaagtgatcctcccaccttagctttccaagyagctaaggccacaggcttgtgccactacacctggctgatttttaactattttgtagagatggggtattattatgttgtccgggcttgtcttgcactcctg

SEQ ID NO: 19286 - DNA, 201 bp, Homo sapiens
ctctaaccctaggtgatctctgcaataagtgcagtgaaaccatggggtcagagcctcaggaaatggtagagttgaaggccaagatctgctgattgataacytcacagagaagaaaactcaagaagaaaccaagggactgaatgaagaagaaagaaaagagatgagatggagtaccccatctctccctgaggatggaaggag

SEQ ID NO: 19287 - DNA, 201 bp, Homo sapiens
aatcactaatatattgagatgcatatgctgttagaataacttgctttccttttacatcttcatatttaaatgagagtattatattgtcttttaagaaatcrtatcagtggctagacagattgcatgatgaatacattttattttcttatacgtatttgttagtggcaatgttgggactgctgtgggtgagaacttctgcta

SEQ ID NO: 19288 - DNA, 201 bp, Homo sapiens
ataagaatttgaattgttatatgttaaaaacttatttcttcacattgatgcatttgatatattattatttataagtagtacatgtggcccatttaaacaaygtgagggtttcataagtgattttttctttgggttgcaaactattgacaggtggggagtcaaatttgaatatctttgtgctcttgttaactaaaacaatgc

SEQ ID NO: 19289 - DNA, 201 bp, Homo sapiens
acatcatgttgtatgccttgaatttacacaataaaatttatttttttcaacgtgcatacagatcacttgagaatcttgttacaatgcagattcagattcartaggtctggcacagatcacaaaacaccgcatattcaacaagcttccaggtgatgcttatggcccatggaccatatttggattagcagggctctcaaactt

SEQ ID NO: 19290 - DNA, 201 bp, Homo sapiens
ttttttatgttgccctattttacattatttttaataattttgttcaatatttgtcttcaatattgtaatcagatgcaaataaactggctttctcaaccttrattacatcagccttctctgtgaaataaattcaatcctttattacacagtttttttttacaacagctattcaacaaatgtgtatgtcatcctttctgtaaa

SEQ ID NO: 19291 - DNA, 201 bp, Homo sapiens
cttctgtccactaatcctacagcttcccttggtacttgtgcactccctgctgctttctctccactagctgtagtgtgttggaccctgtgaggtcacctttkcctggtcacctccctcacgtttgccatttgactgtgcccaggtcatactgagcacactgccaggaggaaggttgagcttggaggacatgaatgaggagaa

SEQ ID NO: 19292 - DNA, 201 bp, Homo sapiens
cttattaatttgaattagtttgagtccttagggaaccctgcgagggtttagttgtcttgattacaaaggcccacatccctcagaaagtaccctcatgtcgscagctggacaaccttaaggattgtcattgtggaatcacggcacaatccaatttcttatctcactgttatgagttgagtggtggtcaccaaaaagacatgt

SEQ ID NO: 19293 - DNA, 201 bp, Homo sapiens
aactttaccttaataagtaactgtttaaaactttacttattaatttgaattagtttgagtccttagggaaccctgcgagggtttagttgtcttgattacaraggcccacatccctcagaaagtaccctcatgtcggcagctggacaaccttaaggattgtcattgtggaatcacggcacaatccaatttcttatctcactg

SEQ ID NO: 19294 - DNA, 201 bp, Homo sapiens
tcgaaagcctggcccacaggtgactcccttgtctaaagaaaacgcttggtcttgctttcagcacatggcttcctgaaaacgaactttaccttaataagtarctgtttaaaactttacttattaatttgaattagtttgagtccttagggaaccctgcgagggtttagttgtcttgattacaaaggcccacatccctcagaa

SEQ ID NO: 19295 - DNA, 201 bp, Homo sapiens
tccatggattagagcacatgataactcttgagccagattataggaatccctatcataagattaggagaagtgagagaaaagaatcagaatcgaaagcctgrcccacaggtgactcccttgtctaaagaaaacgcttggtcttgctttcagcacatggcttcctgaaaacgaactttaccttaataagtaactgtttaaaac

SEQ ID NO: 19296 - DNA, 201 bp, Homo sapiens
agctgttagcagctgacaccttcagcatctgcaggatgggtgcaatggccccgtgaagggaacctgagtggggcacggaagtactaactacagttactgayccaccttcctctttcttgcctccaacagtcactctattactctgttatgtatagtcatagcatttatcactatctggaaatagcaggtatatttatatat

SEQ ID NO: 19297 - DNA, 201 bp, Homo sapiens
gtcatagcatttatcactatctggaaatagcaggtatatttatatatttactgcttattatctgtctcctttccactagataccataagctccagagcacrtcagtgttgtatcatcagtttctaaacaagtgccaggcacatagttaggtaccggggacacaatttgttgaatgagtaggggcgggatgaggtaggaact

SEQ ID NO: 19298 - DNA, 201 bp, Homo sapiens
cgggatgaggtaggaactttggaaatctgtgtcatgcccaactgtagtggatgctatcagtgtcccatccagatcacctcagatcctggctttttcaaccygggttcccattctccagcttctgcatgcttcactcctaacaagtgtcgtctgcttattagtgtgtgctttattagttgagatagtaatagctagaattga

SEQ ID NO: 19299 - DNA, 201 bp, Homo sapiens
aacccggaaggtgatgttgcagtgagccaaggttgcaccattgcactccagcctgggcaacaagagcaaaactccatctcaaaaaaaaaaaaaaaaaaaaaaaggaatagcacataaaggtataaagctgtcatgtgtttgccaaaggataatgttttctattatgatagaagattggccccaagagtagtcatcacataa

SEQ ID NO: 19300 - DNA, 201 bp, Homo sapiens
gaacccggaaggtgatgttgcagtgagccaaggttgcaccattgcactccagcctgggcaacaagagcaaaactccatctcaaaaaaaaaaaaaaaaaaaaaaaggaatagcacataaaggtataaagctgtcatgtgtttgccaaaggataatgttttctattatgatagaagattggccccaagagtagtcatcacata

SEQ ID NO: 19301 - DNA, 201 bp, Homo sapiens
aggctttaatgtgcacacaagtcccctgtggatcttgttaaaatgcagactctttcagtgggtctgatgagggacctgaggaactgcatttccactgagaytcccgggaaagctgatgctgctggtctccagaccacactaagagtggcaagggatttgttcattaatcttcataacagctcggtgaaataggttctatta

SEQ ID NO: 19302 - DNA, 201 bp, Homo sapiens
tgtgtgatgtaaatgcaaatgtctggagtcatcggggatgcttcataaagtgtggagcagacctagagaaaggttatgaaaatgtacaatgcttttccatygttgtagcttcatgcagacattatatatcatgaaatgaccatatgtttgagtaaccatttatatggaagatgagagagtttgaaagttcatttttttgat

SEQ ID NO: 19303 - DNA, 201 bp, Homo sapiens
agatgccaaatctttgccagctccttcctctgccccatcctacatctctcactcccttacaggtttcccctaaatgcattcccttaataaatcatgggacrattattttcatctcagcctctgcttctgggaaacccagctaacaatatcgaatatggaaacatcaaacccctgaatataaccagggctgcctcttactta

SEQ ID NO: 19304 - DNA, 201 bp, Homo sapiens
aataaaacatatgtttctctatagttcaatttattttgtgcttgaaggaattttttttttttttttttttttttttttttgagagggagtctcgctctgtygccaggctggagtgaagtggcgtgatctcggctcactgcaacctctgcctctcgggttcaagccattctcctacctcagcctcccaagtaactgagatta

SEQ ID NO: 19305 - DNA, 201 bp, Homo sapiens
ccaaatgtccaacaatgatagactggattaagaaaatgtggcacatatacaccatggaatactatgcagccataaaaaatgatgagttcatgtcctttgtrgggacatggatgcaattggaaatcatcattctcagtaaactatcacaagaacaaaaaaccaaacaccacatattctcgctcataggtgggaattgaacaa

SEQ ID NO: 19306 - DNA, 201 bp, Homo sapiens
tagcaaagacttggaaccaacccaaatgtccaacaatgatagactggattaagaaaatgtggcacatatacaccatggaatactatgcagccataaaaaakgatgagttcatgtcctttgtggggacatggatgcaattggaaatcatcattctcagtaaactatcacaagaacaaaaaaccaaacaccacatattctcgc

SEQ ID NO: 19307 - DNA, 201 bp, Homo sapiens
acccagccatcccattactgggtatatacccaaaggactataaatcatgctgctataaagacacatgcacacgtatgtttattgcggcattattcacaatwgcaaagacttggaaccaacccaaatgtccaacaatgatagactggattaagaaaatgtggcacatatacaccatggaatactatgcagccataaaaaatg

SEQ ID NO: 19308 - DNA, 201 bp, Homo sapiens
aataccatttgacccagccatcccattactgggtatatacccaaaggactataaatcatgctgctataaagacacatgcacacgtatgtttattgcggcaytattcacaatagcaaagacttggaaccaacccaaatgtccaacaatgatagactggattaagaaaatgtggcacatatacaccatggaatactatgcagc

SEQ ID NO: 19309 - DNA, 201 bp, Homo sapiens
cttttacactgttggtgggactgtaaactagttcaaccgttgtggaagtcagtgtggcgattcctcagggatctagaactagaaataccatttgacccagscatcccattactgggtatatacccaaaggactataaatcatgctgctataaagacacatgcacacgtatgtttattgcggcattattcacaatagcaaag

SEQ ID NO: 19310 - DNA, 201 bp, Homo sapiens
tggctgcatgaatcaatgtcagctggatacaaatatatctctggaaaggggacattgggaaaaagggtggatacactaagcatagaccccagaacctgttctcagaaaaatattttcatggtaaatcctgagatattaaaggacaggtttaaaatgctggctgcatgctttctctgtcttttattttcattggatgctaga

SEQ ID NO: 19311 - DNA, 201 bp, Homo sapiens
agacattgggggagtgatatgggtcctgggatgggaacagtaggattctgataacaagccaaagagatcagaaattcctttaagtattttaccggtacccyatagtcctcaaaatcacatacacaaaatatcatgggtacagatcaacaacaaacttagactggctttataacagtgcaaggtctaaaactttgttaccaa

SEQ ID NO: 19312 - DNA, 201 bp, Homo sapiens
agagtgtcattgcttagaacttcttaggaaaacaaatcaataaatctgtaggaaataggctgtgtgctgaaccttatttggtttctgctttttgaccgagragaagcatattatattgaaagggtatatacttggtacatagaaggaaggcgacctttaatctctgactttatataaacataaaaaccgtgaatagaaaag

SEQ ID NO: 19313 - DNA, 201 bp, Homo sapiens
ctcaagaagctgcattttatagccgtagaagagccatgctgcattgataaaatgtgctccttagcaggcgctcaaatgttacaccagctcactggcttgastaatcagtcctcctttcactggttcagttgcatcagacgagtgttcatttttcacacccagcaaccactctcagttcttaattctgatgaatgcatgtca

SEQ ID NO: 19314 - DNA, 201 bp, Homo sapiens
aggtgctggagaggatgtggagaaacaggaacacttttacactgttggtgggactgtaaactagttcaaccgttgtggaagtcagtgtggcgattcctcarggatctagaactagaaataccatttgacccagccatcccattactgggtatatacccaaaggactataaatcatgctgctataaagacacatgcacacgt

SEQ ID NO: 19315 - DNA, 201 bp, Homo sapiens
tatatgcctgatgggcctacttcttttttgaaaggtgctcttctcctaacttctgggacaccggatttgctgttttttcttcctggattcttttctctcakatcttcatggggatgtttcttctcatcatggatataacccctttgcagaggccctcccagtcccaagcgatcctaatcaaagcagcttccttcaaccttt

SEQ ID NO: 19316 - DNA, 201 bp, Homo sapiens
taaaaagtcaggaaacaacaggtgctggagaggatgtggagaaacaggaacacttttacactgttggtgggactgtaaactagttcaaccgttgtggaagwcagtgtggcgattcctcagggatctagaactagaaataccatttgacccagccatcccattactgggtatatacccaaaggactataaatcatgctgcta

SEQ ID NO: 19317 - DNA, 201 bp, Homo sapiens
tggcaatcattaaaaagtcaggaaacaacaggtgctggagaggatgtggagaaacaggaacacttttacactgttggtgggactgtaaactagttcaaccrttgtggaagtcagtgtggcgattcctcagggatctagaactagaaataccatttgacccagccatcccattactgggtatatacccaaaggactataaat

SEQ ID NO: 19318 - DNA, 201 bp, Homo sapiens
caatgagataccatctcacaccagttagaatggcaatcattaaaaagtcaggaaacaacaggtgctggagaggatgtggagaaacaggaacacttttacaytgttggtgggactgtaaactagttcaaccgttgtggaagtcagtgtggcgattcctcagggatctagaactagaaataccatttgacccagccatcccat

SEQ ID NO: 19319 - DNA, 201 bp, Homo sapiens
gaagacatttatgcagccaaaaaacacatgaaaaaatgctcaccatcactggccatcagagaaatgcaaatcaaaaccacaatgagataccatctcacacyagttagaatggcaatcattaaaaagtcaggaaacaacaggtgctggagaggatgtggagaaacaggaacacttttacactgttggtgggactgtaaacta

SEQ ID NO: 19320 - DNA, 201 bp, Homo sapiens
gtctcttcagagtctttagtttgttttcatccttttccagcagaagagccctacaaaagaagacatttatgcagccaaaaaacacatgaaaaaatgctcaycatcactggccatcagagaaatgcaaatcaaaaccacaatgagataccatctcacaccagttagaatggcaatcattaaaaagtcaggaaacaacaggtg

SEQ ID NO: 19321 - DNA, 201 bp, Homo sapiens
tttcaatacctgatatttaatttgaatggagtataacaactacattgatatagggaaagttttattgaatgaacaaagccatcacataaatttttctttcatttttttttttgtcagtctctgaaattagtgaataggtagagacatccatcagttggatcattcttaggtaacattttgtttataagaacagggcagtgc

SEQ ID NO: 19322 - DNA, 201 bp, Homo sapiens
atttcaatacctgatatttaatttgaatggagtataacaactacattgatatagggaaagttttattgaatgaacaaagccatcacataaatttttctttcatttttttttttgtcagtctctgaaattagtgaataggtagagacatccatcagttggatcattcttaggtaacattttgtttataagaacagggcagtg

SEQ ID NO: 19323 - DNA, 201 bp, Homo sapiens
ttagagaattacttctttctgtagttaataacacaaagcaatcctgttcaggttctttggataagcctccctactttccttcttctgttcttgttctcccktagcccaaagcagcaagccaagatggcggagtactgccgactgatctttggggatgcccttctcatggagcccctggaaaaatatccagtaagcagttct

SEQ ID NO: 19324 - DNA, 201 bp, Homo sapiens
tagcatcctgcttctctgtagcagacgctggtgattcatcacaccacatttctttggcactctggatttcagcacaagtgctgtagacagttaattgcctrtcgctagtgtcccgcttccttcaagtgcatgtgggaaagaaggagagggaagagaatctgaaagaccgttcagcaggcaggtgcaactcagaattaagag

SEQ ID NO: 19325 - DNA, 201 bp, Homo sapiens
attttttgtgccaagcagtttttgaaatattttacatgcctcagctcatgtaagccttaccacaaacccaggtgcttctaagagtaaatattatgattatygccattttacagatgatggaactgagtcctaaagaggatgaataacttgctcaaggccatgtaactaaaacatgacagagatgggattccaatccagtta

SEQ ID NO: 19326 - DNA, 201 bp, Homo sapiens
ctttgggaggccgaggcaggtggatcacgaggtcaggagatcgagaccatcctggctaacacggtgaaaccccgtctctactaaaaaatacaaaaaaaaaacaattagccgggcgtggtggcgggcgcctgtagtgccagctactcaagaggctgagacaggagaatggcgtgaacctgggaggtggagcttgcagagagc

SEQ ID NO: 19327 - DNA, 201 bp, Homo sapiens
aattttttaaaaaaaaggagaagaaaaagaggaggaggagaaagatgtgctctatgggttgatttggaaatatcccctagaaagaaggcaagaataatcayatttgcatatatttgcataaaggaactagaaggagatataaaaaacagaataaaagtgttttgtagtgggtggaaactggtagatggagacaagggtggg

SEQ ID NO: 19328 - DNA, 201 bp, Homo sapiens
tatatttgcataaaggaactagaaggagatataaaaaacagaataaaagtgttttgtagtgggtggaaactggtagatggagacaagggtgggtgtgaaaktcttcactctgtaaaactttttatacttcataatttctgagctgtttctgtactagttaatggaaaaaatgaaaagagaactattgtgttcttataagaa

SEQ ID NO: 19329 - DNA, 201 bp, Homo sapiens
aggagatacacctaatgctaaatgacgagttaatgggtgcagcacaccagcatggcacatgtatacatatgtaactaacctgcacattgtgcgcatgtacmctaaaacttaaagtataataataataataataataataataataataataataataaaagttttggtagggtcgggcgcagtgactcacgcctgtaatcc

SEQ ID NO: 19330 - DNA, 201 bp, Homo sapiens
tataaaaaacagaataaaagtgttttgtagtgggtggaaactggtagatggagacaagggtgggtgtgaaagtcttcactctgtaaaactttttatacttsataatttctgagctgtttctgtactagttaatggaaaaaatgaaaagagaactattgtgttcttataagaatggcaaggactgctaattttctaccctaa

SEQ ID NO: 19331 - DNA, 201 bp, Homo sapiens
taaaaaacagaataaaagtgttttgtagtgggtggaaactggtagatggagacaagggtgggtgtgaaagtcttcactctgtaaaactttttatacttcawaatttctgagctgtttctgtactagttaatggaaaaaatgaaaagagaactattgtgttcttataagaatggcaaggactgctaattttctaccctaaca

SEQ ID NO: 19332 - DNA, 201 bp, Homo sapiens
tggataataccctgcaagccagccctttggaggaatcaaaattgaacaatcaagcctgaggacttgatagagtctcaactttgactttttagttttttttytctctctcaatctttttctttcttagaaaatagaaaaatgactgcttactactgattgtaatgtgtctcaacttttgaaattcagccttaaacttgtttt

SEQ ID NO: 19333 - DNA, 201 bp, Homo sapiens
gtatcaatgagcataaccagccccctgaacttggtttctagtgccgttcttcaataaaaggaactagggctcttggagaaatggctgattctagagctggrgaagggaatttacaagattaggctggagcatctaacaatgccaggaagcaagaaagtttctcaaaggaacatatggaaccaactaaaagacttctcaatg

SEQ ID NO: 19334 - DNA, 201 bp, Homo sapiens
gttagattacagggtatttatgcatatgttttcccagtagtactcactatattttaaaacctgattaagatgacataagataaaatgtggcgtattgtgaytgagaacccctagtctcgaatgctcatatttagtgggtataatgatgaaaactattttcgaggacatttttgaaagattccaaaaacatacagaaatata

SEQ ID NO: 19335 - DNA, 201 bp, Homo sapiens
aaagcttggaagtagatcttaacaccattgccatcacccacccacacacatccctacaagtgaagaaacggaaacctcaaagcaggtaagtgactggtcasaaaaatcacaggtaataaagccaggaatcaaacattatcgcagcatgctagaaagcctatctgcttttgatttctcagtcacattattttttagtaattc

SEQ ID NO: 19336 - DNA, 201 bp, Homo sapiens
gcaaatcaataaacgtaatccagcatataaacagaaccaaagacaaaaaccacatgactatctcaatagatgcagaaaagccctttgacacaattcaacarccctttgttttaaaaactctcaataaattaggtattgatgggatgtatctcaaaataataagagctatttatgacaaacccacagccaatatcatactga

SEQ ID NO: 19337 - DNA, 201 bp, Homo sapiens
tctagacctaattagccttctctgtgggcagccattgtcttcatttaatatctagggcagagattctcaaacttcagattgcatctgaatcactgggaggkgaatcacccagcacagattgtcgggccaccccagagtttctaatttagtaggcctagagttgaaccagagaatttgcatttttcacttgttcccaaatga

SEQ ID NO: 19338 - DNA, 201 bp, Homo sapiens
gcagtatggccattttcatggtattgattcttcctatccatgagcatggaatgttcttccatttgtttgtgtcctcttttatttcgttgagcagtggtttstagttctccttgaagaggtccttcacatcccttgtaagttggattcctaggtattttattctctttgaagcaattgtgaatgggagttcactcatgattt

SEQ ID NO: 19339 - DNA, 201 bp, Homo sapiens
tatctctgttttggtaccagtaccatgctgttttggttactgtagccttgtagtatagtttgaagtcaggtagcatgatgcctccagctttgttcttttgrcttaggattgacttggcaatgcgggctcttttttggttccatatgaactttaaagtagttttttccaattctgtgaagaaagtcattggtagctttatgg

SEQ ID NO: 19340 - DNA, 201 bp, Homo sapiens
ttataatcattagttgaggttaatctttgatttgtcaaggaggtgtttgaatttcctcaaataatattttcagattttgaagagtcacacacacacacacatatacacaataacacatttatacagacacacgaacaactttatacaattggagagaagcttagcagattaaccattttggcatcaaaatggatttcgccc

SEQ ID NO: 19341 - DNA, 201 bp, Homo sapiens
attataatcattagttgaggttaatctttgatttgtcaaggaggtgtttgaatttcctcaaataatattttcagattttgaagagtcacacacacacacacatatacacaataacacatttatacagacacacgaacaactttatacaattggagagaagcttagcagattaaccattttggcatcaaaatggatttcgcc

SEQ ID NO: 19342 - DNA, 201 bp, Homo sapiens
cttggaaagacttagcaaagcccagatttcaggaaagtagaaaaattgcatttaatgctttgattataaaattatcttgtgagtttcttgtttttttttttgtttttttttttgagatggagtctcgtcctgttgcccaggctggagtgcagtggcacgatctcagctcactgcaatatctgcatcctgggttcaagcgat

SEQ ID NO: 19343 - DNA, 201 bp, Homo sapiens
actccctgaaacataaaaaaagtctattttatgaattttatatacttatagtttattttattatttgtagaacttttaaaatttatatcttcatatatgartttcatttttattttgtgtgttctatcttatatatttgtagataatttcataaatgtttatttttgctagttaagcatctgatataaatgacatttccaa

SEQ ID NO: 19344 - DNA, 201 bp, Homo sapiens
gtctgtgacatttggaaataattgtagtgaaacagaataatcctacactcttatttatccatactaaaatgtcttctaccttggacactacaagatatttytggaaaaaaaaaaaaaaagaggcgacttgacacccataaaagaatgcattcacatcctttctaacttcatttcctccaggacaaatatcagtggatgggt

SEQ ID NO: 19345 - DNA, 201 bp, Homo sapiens
agcatagaccccagaacctgttctcagaaaaatattttcatggtaaatcctgagatattaaaggacaggtttaaaatgctggctgcatgctttctctgtcttttattttcattggatgctagaatttgaatgggccctgtttctgctttattaatccatattttgtggcaggagaaattcaggagaactcaggaatggcag

SEQ ID NO: 19346 - DNA, 201 bp, Homo sapiens
aagcatagaccccagaacctgttctcagaaaaatattttcatggtaaatcctgagatattaaaggacaggtttaaaatgctggctgcatgctttctctgtcttttattttcattggatgctagaatttgaatgggccctgtttctgctttattaatccatattttgtggcaggagaaattcaggagaactcaggaatggca

SEQ ID NO: 19347 - DNA, 201 bp, Homo sapiens
taagcatagaccccagaacctgttctcagaaaaatattttcatggtaaatcctgagatattaaaggacaggtttaaaatgctggctgcatgctttctctgtcttttattttcattggatgctagaatttgaatgggccctgtttctgctttattaatccatattttgtggcaggagaaattcaggagaactcaggaatggc

SEQ ID NO: 19348 - DNA, 201 bp, Homo sapiens
ctaagcatagaccccagaacctgttctcagaaaaatattttcatggtaaatcctgagatattaaaggacaggtttaaaatgctggctgcatgctttctctgtcttttattttcattggatgctagaatttgaatgggccctgtttctgctttattaatccatattttgtggcaggagaaattcaggagaactcaggaatgg

SEQ ID NO: 19349 - DNA, 201 bp, Homo sapiens
aacatttttgaagatacggtctctgttctattttttatttttcattcctataaagttttattgaatgcctatatgtgtccaacataccagatcctaaggtatgtttcacataagtcagattggtctctgtccttaatggtgttatcatatagcagaggacaaaatcataaaataataataatatatgaaagatatgtaagc

SEQ ID NO: 19350 - DNA, 201 bp, Homo sapiens
atttttgaagatacggtctctgttctattttttatttttcattcctataaagttttattgaatgcctatatgtgtccaacataccagatcctaaggtatgtttcacataagtcagattggtctctgtccttaatggtgttatcatatagcagaggacaaaatcataaaataataataatatatgaaagatatgtaagcatg

SEQ ID NO: 19351 - DNA, 201 bp, Homo sapiens
catttttgaagatacggtctctgttctattttttatttttcattcctataaagttttattgaatgcctatatgtgtccaacataccagatcctaaggtatgtttcacataagtcagattggtctctgtccttaatggtgttatcatatagcagaggacaaaatcataaaataataataatatatgaaagatatgtaagcat

SEQ ID NO: 19352 - DNA, 201 bp, Homo sapiens
acatttttgaagatacggtctctgttctattttttatttttcattcctataaagttttattgaatgcctatatgtgtccaacataccagatcctaaggtatgtttcacataagtcagattggtctctgtccttaatggtgttatcatatagcagaggacaaaatcataaaataataataatatatgaaagatatgtaagca

SEQ ID NO: 19353 - DNA, 201 bp, Homo sapiens
ttttttttctgtgacagagtctcactctgttgcccaggctggaatccagtggtgcaatctcggctcactgcaacctctgtctcccgggttcaagcgattcycctgcctcagcctctcgagtagctgggactacaggtgtgtgccaccacactcagctaatttttgaatttttagtagagatgtggttttgccatgttggcc

SEQ ID NO: 19354 - DNA, 201 bp, Homo sapiens
gctgaagtgaagttacaaaggtcacactcccgtgcaaacatctgattggttgctttttgcaaccaatgacctgcattctgaggtgttttttttttttttttaacttaagatacatgaatcctctgggctgcgttctgtccttggctgctttttgcaaccaatcagaggctagggtgaagttacaaagttgccaaggaagac

SEQ ID NO: 19355 - DNA, 201 bp, Homo sapiens
gctaggaagtcagctagccactttctcacatctagcaaactgctcctacctactatccttgcaagaggcagaactcagatttgtcatttttaaatattcartgaaccactgggcttattcaggattatttgaaactataaatacatatattttttaaaattcttggattcaaggggtacgtgtacaggtttgttacatgga

SEQ ID NO: 19356 - DNA, 201 bp, Homo sapiens
agtttgaatttttttaagataactatactagacttaatgttgtggtaggtttgtgactgtccttgattttagtcctcaaatatctatagcagcagcagtttgtatctgaaattattacaaggggatttgcctattagaaatatgcctaagttccattattcattaaggtcacagcagcaattctgattaatggagctgatt

SEQ ID NO: 19357 - DNA, 201 bp, Homo sapiens
cttggccaggtgcggtggctcacgccagcactttgggaggccgaggcaggtggatcacctcaggtcaggagtttgagaccaggctggccaacatggcaaarcccggtctctactaaaaatacaaaaattatctgggcgtggtggcacatgcctgtagtcctagctatttgggaggctgaggcaggagaatcgcttgaaccc

SEQ ID NO: 19358 - DNA, 201 bp, Homo sapiens
gcaatggcaggaaatggaaccagctgttcaaaagcatactttgtttgtaacttaaatgtttatacatccaatcttcttataaagtttgaatttttttaagmtaactatactagacttaatgttgtggtaggtttgtgactgtccttgattttagtcctcaaatatctatagcagcagcagtttgtatctgaaattattaca

SEQ ID NO: 19359 - DNA, 201 bp, Homo sapiens
attatataattatgtataatatataattttttataattatgtgtaatatataattatttatcatataattacaatatatattattaacataatatctaaayatattaataatctaatatctataattaatataatatataaatattacttcttgaaatccaacgtgcacctgaatcacctgagccgttgttaaaatgcaga

SEQ ID NO: 19360 - DNA, 201 bp, Homo sapiens
ttatagtgattttacatggaggcaatggcaggaaatggaaccagctgttcaaaagcatactttgtttgtaacttaaatgtttatacatccaatcttcttayaaagtttgaatttttttaagataactatactagacttaatgttgtggtaggtttgtgactgtccttgattttagtcctcaaatatctatagcagcagcag

SEQ ID NO: 19361 - DNA, 201 bp, Homo sapiens
aatgctgtctctacctaaagccttatctagcacgtgggaaggacagaggctttggagtccaacggttagaatatggctaaagggccagccacctgctaccrtataacgtgcatcctcagtcaccccaggggactccagcacccgttcagaagttctggctggctgtatttgtagctccttcttctctagaatccatatgaa

SEQ ID NO: 19362 - DNA, 201 bp, Homo sapiens
gaaatgtgtctttagccactagccgaggacagaccaataaacagcatccaaaaatgttaatgattatatatggttccagaatttacaatggtttgtgttaygattttttttaattttacagtggctggaaagtgaaacacattcaataaaaactgtatttcaaatacccatacaatgattctacttttcactttcagcaca

SEQ ID NO: 19363 - DNA, 201 bp, Homo sapiens
ttgcctagtggtctctgtacagaaaaattttggctaatgctgtctctacctaaagccttatctagcacgtgggaaggacagaggctttggagtccaacggytagaatatggctaaagggccagccacctgctaccatataacgtgcatcctcagtcaccccaggggactccagcacccgttcagaagttctggctggctgt

SEQ ID NO: 19364 - DNA, 201 bp, Homo sapiens
gcctctgcactccagcctgggcaacagagcaagattccgtctcaaaaaaaaaaaaaaaaaaatatgtatatatatatatatatatatatatatatatatttaaatgacacttttaaaaatggagggaggagagtagttatgatatatcagtttactgtaagaataattttgacagatgggatattttcgcatgtcagcatc

SEQ ID NO: 19365 - DNA, 201 bp, Homo sapiens
agcaaggtcttttattgttgtttccacaggaacaaataggcaaggtaatgtaaggcaggcttaggattggcttgtttgaataatttcagcaggctctggggtgtaggagctctctctattgtctggtacctggccctgggtgatggagcagtagaatattggccctgagtatgacagcctaatgagaaggtggtgggtatg

SEQ ID NO: 19366 - DNA, 201 bp, Homo sapiens
cgcctctgcactccagcctgggcaacagagcaagattccgtctcaaaaaaaaaaaaaaaaaaatatgtatatatatatatatatatatatatatatatatwtaaatgacacttttaaaaatggagggaggagagtagttatgatatatcagtttactgtaagaataattttgacagatgggatattttcgcatgtcagcat

SEQ ID NO: 19367 - DNA, 201 bp, Homo sapiens
cacgcctctgcactccagcctgggcaacagagcaagattccgtctcaaaaaaaaaaaaaaaaaaatatgtatatatatatatatatatatatatatatatatttaaatgacacttttaaaaatggagggaggagagtagttatgatatatcagtttactgtaagaataattttgacagatgggatattttcgcatgtcagc

SEQ ID NO: 19368 - DNA, 201 bp, Homo sapiens
actacctccctggatccatgcccttagacatgtaactttataattgccttctactcagcaatgtgacacattgcaaatgagatgttggcaaatgtcacatmtacagagaaataaaaagcagttgtgcaattgggcttgctcttagggttgtcctctgacactgccatgagaaggataggcccaggctatccggccagagga

SEQ ID NO: 19369 - DNA, 201 bp, Homo sapiens
atcacgcctctgcactccagcctgggcaacagagcaagattccgtctcaaaaaaaaaaaaaaaaaaatatgtatatatatatatatatatatatatatatatatttaaatgacacttttaaaaatggagggaggagagtagttatgatatatcagtttactgtaagaataattttgacagatgggatattttcgcatgtca

SEQ ID NO: 19370 - DNA, 201 bp, Homo sapiens
ttaagttatacttgctgctatttacttcgccagaagactgattgcattattggccccaattcttcatcattactacctccctggatccatgcccttagacrtgtaactttataattgccttctactcagcaatgtgacacattgcaaatgagatgttggcaaatgtcacatctacagagaaataaaaagcagttgtgcaat

SEQ ID NO: 19371 - DNA, 201 bp, Homo sapiens
acctgggaggcggaggttgtggcaagctgagatcacgcctctgcactccagcctgggcaacagagcaagattccgtctcaaaaaaaaaaaaaaaaaaatatgtatatatatatatatatatatatatatatatatttaaatgacacttttaaaaatggagggaggagagtagttatgatatatcagtttactgtaagaata

SEQ ID NO: 19372 - DNA, 201 bp, Homo sapiens
ggcgaggtggctcatgcctgtaatcccagaactttgggaggccaaggcaggcagatcacttgaggctaggagttccagaccagcctggcccacatggtgaractctttctctactaaaaatacaaaaaattagccggacatagtggcacatgcttgtaatcccagctacttgggaagcagaagcaggaggattgcttgaat

SEQ ID NO: 19373 - DNA, 201 bp, Homo sapiens
aggtcaggctttttaccctaagttgggacagcaccgtggtaccattcatactccagaactctccaggatcaggctgagaccagtctccagctgtaactacrtccttgcctagctgcctctgcttccctatattgcttcccttattccctcatctgtttcccctgagagcttctctcaatgaatccctgccttatgttcata

SEQ ID NO: 19374 - DNA, 201 bp, Homo sapiens
actgctttattttgaatttttttttttctttacacagagtagggaagaattcaaatgttcagcaagtattcttaagcacctaagtcattgcactaaagtaratctcatttgatggctctcttaaggtggattctctagaaccaaagactgagagacacttttgggtacaaagagtttatctggaaggtgatgtcaacaagc

SEQ ID NO: 19375 - DNA, 201 bp, Homo sapiens
acgccctacacccaatagtggcccgtagcccatgattgactcatagagtggtgtcaaaggtcaggctttttaccctaagttgggacagcaccgtggtaccrttcatactccagaactctccaggatcaggctgagaccagtctccagctgtaactacgtccttgcctagctgcctctgcttccctatattgcttcccttat

SEQ ID NO: 19376 - DNA, 201 bp, Homo sapiens
caaataggtgtgggtgacagacaagtacttaacagggtaatagaatatcataaggcaagtggaggcagggcgagatcacaggaccacaggaccacaggacygaggcaaaattaaaattgctaatgaagttttgggcaccattgtcattgataacatcttatcagtagacagggttttgagatcaactggtctgaccaaaat

SEQ ID NO: 19377 - DNA, 201 bp, Homo sapiens
acgttgtgccttaaagctgtgattttattaataaaataataaatcatgactgttaacattgtaggacatggtggttaataaagggaaatgacaatgacaasaggagcagcaatagacagtagagtaaaagaacaaaatcaagtgtgagacatgtgaagaaagaccaaagcacaggacagcaaagtaggtattaataaatgg

SEQ ID NO: 19378 - DNA, 201 bp, Homo sapiens
aaatgtcaacacaagatcactgagctatgtgctggccacgcattgcatggaagagtcgcggcttgggaaaggagggaaagatgaaggagggatagatagtatatctgttttcggggtcatagagaccctgagagagtgtttgtatatcaaaatagaatacatgtaccatagaaagcaaactgtattaaatgccagcaaact

SEQ ID NO: 19379 - DNA, 201 bp, Homo sapiens
tttagtagttctattgtctgcgttttttattgtaaataggtaccatgatgaattcctctgtgcttttcttccatgaggttgctccatgaccatctttttgygtctggatttgaaggttgcccatgaagattgttggttccatgtcaaactaaagcatttcttgagggtttttcttcatggcttaaaaacgttgtgccttaa

SEQ ID NO: 19380 - DNA, 201 bp, Homo sapiens
cctgaagattcatatgaagggcaactcatcaagattataagattataaagatatagctgttgtctgtatctgtctatctagttgtccatctagttatttgrtttggccttgatttttaaaaactagctgcagctatattgatatgtgctttggaaataaaacaacatggaggaaacacagcatgttaacgatgcctatatt

SEQ ID NO: 19381 - DNA, 201 bp, Homo sapiens
ttctctgtcttttattttcattggatgctagaatttgaatgggccctgtttctgctttattaatccatattttgtggcaggagaaattcaggagaactcasgaatggcaggaagtggatgagaaagagtgtgtgatagaaactgcaagtagccttaagggcaaaacaagaataatgctactgagatgatgaggcttgcata

SEQ ID NO: 19382 - DNA, 201 bp, Homo sapiens
taagggcaaaacaagaataatgctactgagatgatgaggcttgcatatccagctggctactgtattctggccaccagaattggatttcagcttggattttygaggcttagcagtacaatgaggactgggattcataaattataattataagtgttatttattaaaaggtagttttggtctcagaaggaaccaaataataat

SEQ ID NO: 19383 - DNA, 201 bp, Homo sapiens
gattcataaattataattataagtgttatttattaaaaggtagttttggtctcagaaggaaccaaataataataatgcatgcatcactgaaagataaaaayccataaaaaataattggggaatatgagataaggggaaaattgagaataagaataaaaaggtaacttggagtaagggaggaaaaattagtaagccaatcat

SEQ ID NO: 19384 - DNA, 201 bp, Homo sapiens
tcaagaacctcactctcctctaatattttcaaagcctggttctattaaacattacctgtgtggctttcctgagactccagcttcttccttgttggctaaakggtgaagataatgataataataagtacttgaaatggttgctataaggattaaatgaaataattcattaggaaacctttagcacaggagttctcaaattta

SEQ ID NO: 19385 - DNA, 201 bp, Homo sapiens
agaatgcattcacatcctttctaacttcatttcctccaggacaaatatcagtggatgggttcatgcgctatctgagtggagaagaaaacggagtcgtttcrcctgagaaactggatttgaatgaagacatgtctcagcccctttctcactatttcattaattcctcgcacaacacctacctcacaggtatgaattttctag

SEQ ID NO: 19386 - DNA, 201 bp, Homo sapiens
tttcctgaggcctccccagccatgcaaaactgtgagtcagttaaacctctttgttttataaactaccatcttgggaagttctttatagcagtgtgagaacrgactaataccgggtccttttccatcttcaggttccccttggatgctaccctctgcacaccacccttggcagctcctggcctccccacctaacagtgtcat

SEQ ID NO: 19387 - DNA, 201 bp, Homo sapiens
tcatgtggaaaattaaagatgttaaattaaaatattgacactgatgttagtaagtaatgattgtttataagatgtctggatttaaaagctttgtttacttaatttgttaaaaatggaagtttacttgtctttggtgtagaaaattaaacatgtgactctgaactttgtagagtgcttaacagcttttataatacttttata

SEQ ID NO: 19388 - DNA, 201 bp, Homo sapiens
gaggcctccccagccatgcaaaactgtgagtcagttaaacctctttgttttataaactaccatcttgggaagttctttatagcagtgtgagaacagactawtaccgggtccttttccatcttcaggttccccttggatgctaccctctgcacaccacccttggcagctcctggcctccccacctaacagtgtcatatgggg

SEQ ID NO: 19389 - DNA, 201 bp, Homo sapiens
atcatgtggaaaattaaagatgttaaattaaaatattgacactgatgttagtaagtaatgattgtttataagatgtctggatttaaaagctttgtttacttaatttgttaaaaatggaagtttacttgtctttggtgtagaaaattaaacatgtgactctgaactttgtagagtgcttaacagcttttataatacttttat

SEQ ID NO: 19390 - DNA, 201 bp, Homo sapiens
gatcatgtggaaaattaaagatgttaaattaaaatattgacactgatgttagtaagtaatgattgtttataagatgtctggatttaaaagctttgtttacttaatttgttaaaaatggaagtttacttgtctttggtgtagaaaattaaacatgtgactctgaactttgtagagtgcttaacagcttttataatactttta

SEQ ID NO: 19391 - DNA, 201 bp, Homo sapiens
agtagagacatgaacttagtgagggagagcattcctctttgccggggatacagcaagagcaaagcatatttcaggaatagaggaaggccaatgtggctacygtagagttcagaccttttaggccatgaaaatgacttgggcttttcttctgatggaagagggaaggcttctgaaagttctgagcacagaagtgatgggatc

SEQ ID NO: 19392 - DNA, 201 bp, Homo sapiens
gcatagtttaaatcaatgtgctccatcaccgaaaaaggacgttagtaagaaacttggcttgttacatactttaaattctctgtttacattcagaactatayggttttaaaatattgtggtttcttctgagtaagtgtttctcaaatctaagtgttcctttagttcatacacagaaacctttttaaatttttttttcccaaa

SEQ ID NO: 19393 - DNA, 201 bp, Homo sapiens
tgatcatgtggaaaattaaagatgttaaattaaaatattgacactgatgttagtaagtaatgattgtttataagatgtctggatttaaaagctttgtttacttaatttgttaaaaatggaagtttacttgtctttggtgtagaaaattaaacatgtgactctgaactttgtagagtgcttaacagcttttataatactttt

SEQ ID NO: 19394 - DNA, 201 bp, Homo sapiens
atcctgagacttggctaaagttgcttatcagcttaaggaatattggggttgagatgatgtggttttctaaatatagaatcatgttgctgcagacagagacragttgacttctctcttcctatttgaataccctttatttctttctcttgcctgattgccctggtcagaacttccaatactaggttgaataggagtggtgag

SEQ ID NO: 19395 - DNA, 201 bp, Homo sapiens
cctgatcatgtggaaaattaaagatgttaaattaaaatattgacactgatgttagtaagtaatgattgtttataagatgtctggatttaaaagctttgtttacttaatttgttaaaaatggaagtttacttgtctttggtgtagaaaattaaacatgtgactctgaactttgtagagtgcttaacagcttttataatactt

SEQ ID NO: 19396 - DNA, 201 bp, Homo sapiens
tccagatgttctatttggtttattttcaaatatataatctgtatgtcttagcttgttgcagggaagctttcctgtgagatttctcactctgggaaagcctmagctcttgactgtaggctcctcacctttcaaggctatcaaagggtgaacacacaatttccatcatgagcaaaagcctatcagggcaaaagcagcttcctt

SEQ ID NO: 19397 - DNA, 201 bp, Homo sapiens
gtcgcttcagctgtaaacacatatatatgtagttttaaatacatatatgtgtatacacacacacacacacacacacacacatatatatatatatatatatwttttttttttttttttttttttttttttgagatggagtctcactctgtcgcccaggctggagtgcagtggcgcaatctcggctcaccacaagctccgcct

SEQ ID NO: 19398 - DNA, 201 bp, Homo sapiens
acacacacacacacacagagtcgcttcagctgtaaacacatatatatgtagttttaaatacatatatgtgtatacacacacacacacacacacacacacayatatatatatatatatattttttttttttttttttttttttttttttgagatggagtctcactctgtcgcccaggctggagtgcagtggcgcaatctcgg

SEQ ID NO: 19399 - DNA, 201 bp, Homo sapiens
cacacacacacacacacagagtcgcttcagctgtaaacacatatatatgtagttttaaatacatatatgtgtatacacacacacacacacacacacacacmtatatatatatatatatattttttttttttttttttttttttttttttgagatggagtctcactctgtcgcccaggctggagtgcagtggcgcaatctcg

SEQ ID NO: 19400 - DNA, 201 bp, Homo sapiens
acacacacacacacacacagagtcgcttcagctgtaaacacatatatatgtagttttaaatacatatatgtgtatacacacacacacacacacacacacayatatatatatatatatatattttttttttttttttttttttttttttttgagatggagtctcactctgtcgcccaggctggagtgcagtggcgcaatctc

SEQ ID NO: 19401 - DNA, 201 bp, Homo sapiens
acgtagaggttacttggctaagatcaaggtgccagcaggtgcatttcttcctggaggccctgggggaaaatctgtttcctcaccttttccagcttcatagrccccttcctccaacttcaaaggcagcaagattaggctgagtccttctcatgctgacatgtctctggttctttcttcaaattccctcttccactctaaagg

SEQ ID NO: 19402 - DNA, 201 bp, Homo sapiens
aaagtgttttaagagttttaaaagaccagtgtacactgtatcaaatattcctgcttatttccaaagaaaagtgaactgctttattttgaatttttttttttctttacacagagtagggaagaattcaaatgttcagcaagtattcttaagcacctaagtcattgcactaaagtaaatctcatttgatggctctcttaaggt

SEQ ID NO: 19403 - DNA, 201 bp, Homo sapiens
aaagaactgctatggtttaattctatcagtgaaaataacagggtttgtgatgtttttaatttatttttccctccccacattaactttcctcatttgtgttyggtaaatttgcttcaactgctcaatttgcatgaggattaaatttcattaacagatgcaattagaaagtggaatttatagaataagtcttctttataccct

SEQ ID NO: 19404 - DNA, 201 bp, Homo sapiens
gggaaaaatgtcaacacaagatcactgagctatgtgctggccacgcattgcatggaagagtcgcggcttgggaaaggagggaaagatgaaggagggatagatagtatatctgttttcggggtcatagagaccctgagagagtgtttgtatatcaaaatagaatacatgtaccatagaaagcaaactgtattaaatgccagc

SEQ ID NO: 19405 - DNA, 201 bp, Homo sapiens
ttgactttctcccagaaagtcctccctgcttgtttctggctttaaatctattgagtaaaatttatctgaaggaaatttaatcaataattcaaaacaggaayagattattcatagggagagctgtgctcacagttttgttaatttgcagtggtagcattctttatcactggctgaaactcaagtaaaggagtgaaagatcaa

SEQ ID NO: 19406 - DNA, 201 bp, Homo sapiens
ttaccctgacctcctagaagaaaaggaaaaagaaaggaaagagagagggagaaggtgagggaaggggggaagaaaagaaaggagagaaaagaagacagagraaaaacagggagggaggaagctggggaaggaaaaagaccatttgctgactccgttgttttatttcccagaatgattcaatacctcaagaagatttcactc

SEQ ID NO: 19407 - DNA, 201 bp, Homo sapiens; identical to SEQ ID NO: 3326

SEQ ID NO: 19408 - DNA, 201 bp, Homo sapiens
gcgtggtggtgcgtacctgtagtcccacgtactggggaggctggggccagagaataagttgaatcggggaggcaaaggttgcagtgagccaagagcgcacsactgcactccagcttggagtagacagagcaagacttaatccccctaccccccaccctcccaaaaaagaaaaagaaacatgtaaaatacattttcatttaa

SEQ ID NO: 19409 - DNA, 201 bp, Homo sapiens
gctttgtcataaatagctcttattattttgagatatgctctatcaatgcctagtttattgagagtttttagcatgaagtgatgttgaattttatcaaaggscttttctgcatctattgagataatcacatggtttttatcttggttctgtttatgtgatggattacatatattgatttgcatatgttgaaccagccttgca

SEQ ID NO: 19410 - DNA, 201 bp, Homo sapiens
gagccaccgtgcccagccagaaattatttttaaaactgtggttttgtattcccaggataaaatgtgtatcttttgtacagcttcacaaattagtatgtccmtttacctatagcagtgcataaaaggatatttctttaaagatctatttgtataacattctacagtcccctctttattgaaagtactaatagcaatatttct

SEQ ID NO: 19411 - DNA, 201 bp, Homo sapiens
ccagttctgcacccttgctggagaggcattgaggtcctttggaggagaagaggcactctgcattttgggttttcagtgtttttttgttgattctttctcgwctttatgagtttgtctagttttgatctttgaggctgctgacccttggatggagtatttgtggggattttttgttgttgatactgttgttgttgctttctg

SEQ ID NO: 19412 - DNA, 201 bp, Homo sapiens
tcttggggccatctgagaggctgggcatgtaagggaggaagacatcagcatgtgtgggaactgtgcacctaagctgcaggagtcaccttagatggtggacrtggtgtaggacaccaacagggtcttgtacaccataataggaattgcttatgtaatgggatcctacccttcatgtggggcagaaaaatatcaatgtctgct

SEQ ID NO: 19413 - DNA, 201 bp, Homo sapiens
ggcaggagaatcgcttgagcccaggaggcagaggttgcagtgagctgagattgcaccattgcactccaacctgggcaacaacagcaaagactccgtctcaraaaaaagaaaaaaaaagaagacaatttcctcagtaaagaaattgacgcttataaataataaaattatggatcagcttaccctagttattgcatgtggagg

SEQ ID NO: 19414 - DNA, 201 bp, Homo sapiens
ctgcagatattttcttgaatgaaatttgacatctctgaggaccgacaaggatactgctcatatggaatgtatattatttttattattattattattattgktattattaattttgagatggagtttcgctcttgtggctcaggctgaagtgcaatggcatggtcttggctcactgcaacctctgcctcccaggttcaagta

SEQ ID NO: 19415 - DNA, 201 bp, Homo sapiens
gtctgcagatattttcttgaatgaaatttgacatctctgaggaccgacaaggatactgctcatatggaatgtatattatttttattattattattattatwgttattattaattttgagatggagtttcgctcttgtggctcaggctgaagtgcaatggcatggtcttggctcactgcaacctctgcctcccaggttcaag

SEQ ID NO: 19416 - DNA, 201 bp, Homo sapiens
caacattagcaatcaggggtctgcagatattttcttgaatgaaatttgacatctctgaggaccgacaaggatactgctcatatggaatgtatattatttttattattattattattattgttattattaattttgagatggagtttcgctcttgtggctcaggctgaagtgcaatggcatggtcttggctcactgcaacct

SEQ ID NO: 19417 - DNA, 201 bp, Homo sapiens
ttgttgaagacagaattagtaccatgagttaatgaaacccaggtcttttcagaagattgtgactcatttttatcattgcccctgtctggtgtaatttcaaygtaaatccaatttgttctacatgcaatggtacatagttgcatttgggaaacatttctcaattttaattcttttaaacgcaataatgcgccatcttgtgga

SEQ ID NO: 19418 - DNA, 201 bp, Homo sapiens
aacaacattagcaatcaggggtctgcagatattttcttgaatgaaatttgacatctctgaggaccgacaaggatactgctcatatggaatgtatattattwttattattattattattattgttattattaattttgagatggagtttcgctcttgtggctcaggctgaagtgcaatggcatggtcttggctcactgcaac

SEQ ID NO: 19419 - DNA, 201 bp, Homo sapiens
atttacatttctaaccaccttttattaaataaaaggaaactaatttttgacataatattatgtatccatgtacttcaccgaatcttttaaaaaatagtttycaggccgggcgtggtggctcatgtctgtaatcccagcactttgggaggccgaggcaggcggatcacaaggtcgggagatggagaccagcctggctaacat

SEQ ID NO: 19420 - DNA, 201 bp, Homo sapiens
atggtgaattcaggtcaaatgatgaatttccttctagcttttctttttttatggagacttcactttggcacacttgtaactttactgacaatacccttttrtatatgcttttttttcccttatatcatgaccgtttcctgctaatattcaaattaggccgtttatttaagggttgtcaaatctcaaatagctcatcataga

SEQ ID NO: 19421 - DNA, 201 bp, Homo sapiens
ggtggtgatggttgcacaacagtgtgaatctacttaatgccactgaactgtacacttaaaaatggtaaattatatattatgtatgttttaccactttttttaaaaaaaaaaaaaaaaaaaagaagaaactgagaaggagcaaccagtgaggagggagaagaaccagaacagtgtatttcctggatgcctaaaaaatatttc

SEQ ID NO: 19422 - DNA, 201 bp, Homo sapiens
agcgtctctttctattctgtcttgatacattgcattgaaagaactgctatggtttaattctatcagtgaaaataacagggtttgtgatgtttttaatttakttttccctccccacattaactttcctcatttgtgtttggtaaatttgcttcaactgctcaatttgcatgaggattaaatttcattaacagatgcaattag

SEQ ID NO: 19423 - DNA, 201 bp, Homo sapiens
ttccacaaaatgtaagcatatcattttgagacaaattttaaaatcgttttagacttgacaaattacatgaaagagacacttagtcagaaatgattttttttaatgaagtgaaatttaataagtgactctgaatgtctgttgatgtgttgggaagcccatctttgcttgaccaaagatttatccagtaataatcaaaacatc

SEQ ID NO: 19424 - DNA, 201 bp, Homo sapiens
catttacttttctcattcttctcttacagtcatactacataccaggcagctctaaagatatattgtttaattttacatgttttggacttctttaaaaaaakaatcatactgaacaaaaatggaatcatattgcatgtattcttatgaaacttcatttttcatccaataatgctacttgaaatgtatttatgttgatgtagt

SEQ ID NO: 19425 - DNA, 201 bp, Homo sapiens
tccatctcaaaaacaacagcaaaactgctgtttaactccacaaaagtcattacaccactatacattcactaaaattgctaaaattaaggaaaaaaaaaaaacagtagtaaggccaggtgttggcaagattgtagaatagctgaaactctcatacaggggtgatataaaatggtacaactactttggaaaactctctggcag

SEQ ID NO: 19426 - DNA, 201 bp, Homo sapiens
aaatgctatgggcaccaactgtttgaatgattggtgtgcttgctatgtgaattattaaatattttaaatattatttatgtttaatgtggtgcccaccagamccagatgtaacgtacagcttttccttggacagtatagagaagaccttgaagttatgttcttttaactcagtctttagtatttctctgcatgaaatccttc

SEQ ID NO: 19427 - DNA, 201 bp, Homo sapiens
atataatactttctcagtttcctgttctccttgtaagtaagtatcatggttttggcctggacagggtgaaaattctcatactgtagaaattatcagtggayttttgtctatacttcttccatttgctttgtatatagtaagaccagccaaggatataaattctcatatccaaatttttcatctaatattttaatatttaac

SEQ ID NO: 19428 - DNA, 201 bp, Homo sapiens
atgtgtatcttttgtacagcttcacaaattagtatgtccctttacctatagcagtgcataaaaggatatttctttaaagatctatttgtataacattctayagtcccctctttattgaaagtactaatagcaatatttctaaaattatttaattttccagtgaatgccaaagagtcccaattatgggaaaatgtgttccat

SEQ ID NO: 19429 - DNA, 201 bp, Homo sapiens
aatttaattttctttctttctttctctttctttctccctctctttctttctttctttctttctttctttctttctttctttctttctttctttctttctttctttctttccttctttctttctgtgcttctttctttctttcgtattgctccttgtgtagcagggctatcccataggcagggtgcccagggtagtgaaagt

SEQ ID NO: 19430 - DNA, 201 bp, Homo sapiens
aaatttaattttctttctttctttctctttctttctccctctctttctttctttctttctttctttctttctttctttctttctttctttctttctttctttctttctttccttctttctttctgtgcttctttctttctttcgtattgctccttgtgtagcagggctatcccataggcagggtgcccagggtagtgaaag

SEQ ID NO: 19431 - DNA, 201 bp, Homo sapiens
ggagtagcaattttaatttccttcaaggacttttcctttgcattcacaactgggcggctgactgcttggcacaagtggtctagcttttggcctatcttggsttttgacacgccttcctcactcagcttaatcttttctagcttttgacttaaagtgaaaggtgcatgattcttcctttcacttgtacacttagaggccatt

SEQ ID NO: 19432 - DNA, 201 bp, Homo sapiens
gaaatttaattttctttctttctttctctttctttctccctctctttctttctttctttctttctttctttctttctttctttctttctttctttctttctttctttctttccttctttctttctgtgcttctttctttctttcgtattgctccttgtgtagcagggctatcccataggcagggtgcccagggtagtgaaa

SEQ ID NO: 19433 - DNA, 201 bp, Homo sapiens
gggtgagggctcccctctcccatgtggctctcaggtggaccaccacaccacactgctcttccttcctctccatggatcatgccagctgcctcgtcagttcygatgagagaacctggatatcttgattgctggtggaggattcacacactattatgattctttttgatggagcctctctgatggctgctgctcctagttggc

SEQ ID NO: 19434 - DNA, 201 bp, Homo sapiens
taacattcttgcttttagctcctatattacagccaaagccacactcttgtctcatttctcaaaatgaataaatgaataaataaataaataaataaataaaataaaaatcctttgatttctacgcagctaactttgacatttaatcttatgcagctttgtgtaactattccttgtgtgtatgtcctgtttaccccagtagat

SEQ ID NO: 19435 - DNA, 201 bp, Homo sapiens
cagggcatgtgcaagttttcctgatgtgcatgtgaaactgtgtctattacatatgctgaagttttcccccaaatgggaccagcacccacatgtctgatatrttccttaggtagagccattcttctcaataaaacacaaaatagtgaaatacagaaatgtctgatttgtaaagagagggtatctgtaacaaaattgaaagtc

SEQ ID NO: 19436 - DNA, 201 bp, Homo sapiens
atgagtcagggtcaggcctgaagaggcactctggctgcagtctgccacagctggtgtgttgggctgtgggggaacctcttgggaccaagctgcccagcctycctggccccaggagaggaaaagcatggcctggagctgtagagatggatgctgtccttccccacccagggagcttagcgtgacaggcagttacaagtccca

SEQ ID NO: 19437 - DNA, 201 bp, Homo sapiens
cacaccccaaacctcagcatcacgcagtatacctctgtaacaaacctgcagatgtacctcgggttctaaagtaaaagttgaaaatttaaaaaaaaggcagwtgagagaacagctgttgcaaagagtatcagttgaaaccaaatttctctctaagccagaagaatagtgggtatgtgagcatgtgcaagattttgcactgca

SEQ ID NO: 19438 - DNA, 201 bp, Homo sapiens
tgctctgagtggggtggcaaaactggagaggattttgagacaaggcatggtgtaatgtgactaagtataaattctatgtagcacagccttaaatgttagasaggtagaaaacagatcagtggcggcctggcaacaggggataggccacaaaagggcacaagaaacttttaagggtaatagaaatattctgtaccttgatgg

SEQ ID NO: 19439 - DNA, 201 bp, Homo sapiens
cttccaatactaggttgaataggagtggtgagagaggccatccttgtcttgtattggttttcacagagaatgcttccagttttttcccattcaatataatrttggctatggctttgtcataaatagctcttattattttgagatatgctctatcaatgcctagtttattgagagtttttagcatgaagtgatgttgaattt

SEQ ID NO: 19440 - DNA, 201 bp, Homo sapiens
aaatgcagaatctcaggccccaccccagatctattggatcagaatatcctttaaacaacatcctcctggagtttcatatgcattttcaagttgagaagaartagataaaaaaataagtaaaataaggaaaataggaagagtttggggagcttaatgggagattatgtaagagagatatgtggaggtcaaatgcccagggct

SEQ ID NO: 19441 - DNA, 201 bp, Homo sapiens
acagattgtaaaactgatgttgaataagtttacataacctgaaacttcttacctccttcatcatgcaaaccaagtgaaccaaaaaaaaaaaaaaaaaaaaaggtcacactctagccaaggtaaggtactatgccaacaaaaaggattaaagacttgtgtcaagcttctttatgtgtggcttctcaaaagcattctaggatt

SEQ ID NO: 19442 - DNA, 201 bp, Homo sapiens
tccgtgaaccgatttccacgaccggttctttcctacgtgtgaaccgtgctctgctgcaatctactagtgcctcgggcattcctgcggcctttgtctaagcmgaaagggtagaacttcctgaacactaataaaggaaacataaaagcagaggtcagctggaagattggcaataggctaatgaaactgacagtcatttttgac

SEQ ID NO: 19443 - DNA, 201 bp, Homo sapiens
agaagatgcctgcctccccgtcgtcttccagcatgattgtaagtttcctgaggcctccccagccatgcaaaactgtgagtcagttaaacctctttgttttrtaaactaccatcttgggaagttctttatagcagtgtgagaacagactaataccgggtccttttccatcttcaggttccccttggatgctaccctctgcac

SEQ ID NO: 19444 - DNA, 201 bp, Homo sapiens
tacccagctgttagtaattttcctcccagtcggaggcagaattttgaatagactgaaaacatgtttgtgcagggttctaagatgctacatgaattcagatrttcattcatttaattcatataatagcctcagatgatatctttctttctcaccacaaggctatgctttgtctaaatggccaggtaaacatcccagaagtga

SEQ ID NO: 19445 - DNA, 201 bp, Homo sapiens
ttcagaaaagtcatccaaggactgttttcttttgtggttttctttctggcagcattctatggcttctctgttcttggagtgttcttctgccttgacaaggwaaagttcatgcctaagcatgtgcagaaactcaaggtcaagtgcaccactgagcaccttcagagtgaatttttaggggataatgttgtcacaactgtcttc

SEQ ID NO: 19446 - DNA, 201 bp, Homo sapiens
ccacagtgtgtccatgtgtactcatcattcagcttccactcataagacagaacatgtggtgtttggttttctgttcctgggttagtttacggaggataaargctccatctccatccatgtccctgtaaaggacatgatcttgttcctttttatggctgcatagtattccattgtgtatatgtgccacattttcttcatcta

SEQ ID NO: 19447 - DNA, 201 bp, Homo sapiens
actgaagccctacggcagactttgggactactgtttttttaaataaacaattatggcattttcagatatggatattatcaaaggaatgatctaattgtccrccacagatttggatcagatagttattcctcataatacctcaagctgagactcaggaaactagtcctgcgtggggacatatgtcaaatgcattacaaaagc

SEQ ID NO: 19448 - DNA, 201 bp, Homo sapiens
tgtcaaggagatgacagtctagaagaatggataagatgtgtctaaaagtaacttgaatgcaaagccatatgtggaaactataagacaaaaattaacgcaayggagttagatagggggaaaaataaacacttgtctctcggaaaccttcctgagaaaagtggtgtttgaagtgagcattaagaatagattaagtcatgtcat

SEQ ID NO: 19449 - DNA, 201 bp, Homo sapiens
ccagcacccacatgtctgatatattccttaggtagagccattcttctcaataaaacacaaaatagtgaaatacagaaatgtctgatttgtaaagagagggtatctgtaacaaaattgaaagtcacagatttgatatctacttttacattcttgtatccagtaacatttttttgagcatctgctactgagtgaagcatggaa

SEQ ID NO: 19450 - DNA, 201 bp, Homo sapiens
gaagtcctgtttctcagaagcctttggataaactcaaatttctatgatataaacattcaagctaccccaaatcaattaagaatgttataaaataaaaatayaaccaatgcctaatccaattgaatcctattaaatttttaaattaatatctagaaaataatttagtttttatactttacagccattttcagaacaagtaaa

SEQ ID NO: 19451 - DNA, 201 bp, Homo sapiens
aaggaagaaaagataatttttttttgtctttttaaggcacgagttcacataaatatttctacttctacctaccaatttaaattattattattattattatwcttgagacagggcctcactctgttgcccaggctggagcacagtggcatgatgatagctcactgtagtcccgatctcctgggctcaagcaatcctcccacc

SEQ ID NO: 19452 - DNA, 201 bp, Homo sapiens
tagtttctagttatatacagatatttcagataataagaaccaaatcttgcctcaaatgctaacatcgtggatgacaacatagagcctactgtaatccattrtgatatgagcaatgatggtaggtttgacagctgcatagggatcacaggagaaactgtacctgagctgtacctgtatcaaacaactacataattttttctg

SEQ ID NO: 19453 - DNA, 201 bp, Homo sapiens
ctggtcattcatttatctcttttggagaaatgtgtattcagattatttgcccattttttaatttttttttctttttaaaatttaattgtaaaatttgaatmacttttttgtgctcttctttgttttggtcttgttttgtttgatttggtcttgttttgttccttaaccttttggtgactagtgagtagctattggtagaaa

SEQ ID NO: 19454 - DNA, 201 bp, Homo sapiens
caagctccgcctcccgggttcacgccattctcctgcctcagcctcccgcgtagctgggactacaggcgcccgccaccacgcccggctaatttttttgtgtkttttagtagagacggggtttcactgtgttagccaggatggtctcgatctcctgacctcgtgatccgcccgcctcggcctcccaaagtgctgggattacag

SEQ ID NO: 19455 - DNA, 201 bp, Homo sapiens
aaggattttaatatattgttaaattctagtttttttttgtttttgtttttgtttttgagacggagtctcgctctgtcgcccaggctggagtgcagtggcgsgatctcggctcactgcaagctccgcctcccgggttcacgccattctcctgcctcagcctcccgcgtagctgggactacaggcgcccgccaccacgcccgg

SEQ ID NO: 19456 - DNA, 201 bp, Homo sapiens
ttttaataatatgtaatatattctcatacttccaaaaatataaagggcaggattttaacaatgagaggcatgttaattattcacggagttttgcacattcmtaaggaaagcttagaaagccctatttctctgtgggaatatattccgccagtggaacccagcattataattattttgttaacattaatgggaggaatgtct

SEQ ID NO: 19457 - DNA, 201 bp, Homo sapiens
ggaagcggaggcggacggatcacctgaggtcgggagtttgagaccagcatgaccaacataaagaaaccccatctctactaaaaatacaaaattggccgggygtggtggtgcatgcctgtaatcccagctacttgggaggctgaggcaggagaattgcttgaacccgggaggtggaggttgcgatgagccgcgatcgcgcca

SEQ ID NO: 19458 - DNA, 201 bp, Homo sapiens
gtagttcatttcactaactacaaatatatattatataatgtgtacatatgtatagttatatatatatatacacacacacaaattagtgttatatacatatrcagtaatacacatgcttatatacatatatgcacatatataaacacacacaaatcacacaaatgcaggttgagtattctttatctgaaatgcttggggcca

SEQ ID NO: 19459 - DNA, 201 bp, Homo sapiens
tttaagtaaatattttgctctctgttaagtgttcctacttggaagtgtaaatatctgcaaatgtgtttatgtgagtcctctaacttcagaaagagtcctawcctattttcttcaagctcttcatactaaatattaattctctgggaaattatatagtgatatattgacctctacagaatagattcttcatataaattaaac

SEQ ID NO: 19460 - DNA, 201 bp, Homo sapiens
ctccgggtttacttttccaaggaatcagtgatataactgccatgacaatgaaagagatcaaaatttgggagacagaaagacgaggggtgggaagttgaatwtttttcctcatttataacatgatctggttgggaggattcaaggcagaccagttagtacagatccccagtcccttttggggatcataggactcttgtttta

SEQ ID NO: 19461 - DNA, 201 bp, Homo sapiens
gtaggaggggcttatggactccttaagggcataggctgttggagtccctgctgagagatctctgccctaccttgtggaactggagtgaaacaacgggggcrttgcttccagccatctgggagagaggatccagagcttcccctcagagagctgggatgttgtcagcaggcatcagacagagcaaaaagccatttttcttta

SEQ ID NO: 19462 - DNA, 201 bp, Homo sapiens
ttagatatatttgatcttcagtgaacagttgttagtatgtcaagaaaagtaatgaaggttcttaaactaaacttaattttttatggaggaacacaaggcaatttgctaattcggggatctacttctctttcatgatagcatctgcagatgtcatgacagtttttcaagaccctggcaacttgataatgtggcccaaatagg

SEQ ID NO: 19463 - DNA, 201 bp, Homo sapiens
gagtattaattaggatatgggtctagctactctaacagacatccaagtgtcttatgattagagtttatttctactctgagataattaggcaagagctgacrtggttctccgtggtgttcaggactcctaacctggactccctccatattgttgctatgctgctgtcctccaacattgcttccacctcctgatctaagatgg

SEQ ID NO: 19464 - DNA, 201 bp, Homo sapiens
caatcacaccccaaacctcagcatcacgcagtatacctctgtaacaaacctgcagatgtacctcgggttctaaagtaaaagttgaaaatttaaaaaaaagrcagatgagagaacagctgttgcaaagagtatcagttgaaaccaaatttctctctaagccagaagaatagtgggtatgtgagcatgtgcaagattttgcac

SEQ ID NO: 19465 - DNA, 201 bp, Homo sapiens
gtcagttatatttttaaatgcctaaattggatgcagcattccctaacttcaagtctgtcttattttctaaagtaaatatttaagaccatttcttcttaagycttaactacatcttacaagctttgatacctaatatatttgctataatctacttgttaatacagtctgatttccattatttctcctttgatccatgaattg

SEQ ID NO: 19466 - DNA, 201 bp, Homo sapiens
ataattgaccaagaaacccagataatgaaaggaagaaagagaaagaaagaaagaaagaaagaaagaaagaaagaaagaaagaaataaagaaaggaaggaagatagtaatgaaatgtgggcatggttgactaatgtatgagagttcatcagatgtataacttacttttcttttgaataatttgtatttatttattgagcatt

SEQ ID NO: 19467 - DNA, 201 bp, Homo sapiens
attgaataattgaccaagaaacccagataatgaaaggaagaaagagaaagaaagaaagaaagaaagaaagaaagaaagaaagaaagaaataaagaaaggarggaagatagtaatgaaatgtgggcatggttgactaatgtatgagagttcatcagatgtataacttacttttcttttgaataatttgtatttatttattga

SEQ ID NO: 19468 - DNA, 201 bp, Homo sapiens
gtttgtatatttcatctctcatgatcaatcaatattttttgaatgagtacatgaatatttcatctcagtaagtgatcattccctcctcatccatcttaatsataaaattctaatgtcctaggttctttatctttcaacaaattatgtttccctttcttaatgggtagaaaaaggaagcttccccataggcctaaatgtgct

SEQ ID NO: 19469 - DNA, 201 bp, Homo sapiens
acttaaaggaacacagaaagataggaaacctttagagtgaaacaaagagcaggttccaggtacgctgtggcatgaggaagctggagttgagctaactagaygtgaacatctgatgtggttggtttgggaagcagatcttgcttcctccggttgattctgagttgaaaggagggagccaagaatagggaagctggcagtcat

SEQ ID NO: 19470 - DNA, 201 bp, Homo sapiens
gcagtgagccaagattgcaccacggcactccagcctgggcgacagagcaagactctgtctaaaaagaaaaaaaaaaagaaaaaaagaaaaagataagtatmagctaacatttatttcactgcattttttcatagcattcttaaaataagtaatcatgtcagactccacaaaaatgtattaattctttatgtacatgtgata

SEQ ID NO: 19471 - DNA, 201 bp, Homo sapiens
ttagtttgtttagtagcactggtttttgggaattttttttcttttttgtctttacacattgcagagtagcagtaaagaaataggttggtcttttaaagggwgtatttcctgcttttaataaacacaagttttatgagaaaaataaataaatttcaatataaaattaagatgtacagaatatagatttagcacatataaaaa

SEQ ID NO: 19472 - DNA, 201 bp, Homo sapiens
agggattgtgagtagagtgtgcaagatggaaagtacgttggcattataatgattcatcatcaacaacaccatgtttgcttgcctggttgaatgtccctgartacaccagctgacatggatgccagaattccagctatgagaatttctcctctatttattttaaacgtaggtacaaatcagttctctttgaaccctgcctga

SEQ ID NO: 19473 - DNA, 201 bp, Homo sapiens
aattctttcctatttttaaaatgaaaatagctgagagatttgtgaggaaaatttgaaacaatgttgattctgaatgtttttaaaaatttctaatatttatraaacaactgtatctcagatgagcttcaatttgcaaggcatcattccattttcatttttaattctctgttccaatgcctctgctaagaaataagcattttc

SEQ ID NO: 19474 - DNA, 201 bp, Homo sapiens
ctcaaactcttgacctcaagtgacccacccacctcggcctcccaaagtgctgggattacgggtgtgagccactgcacccggcccagattgccttcttcagrtaagtattttaaacctcttatgagctgtttccttccttcatcccttcgtttcctcctttttcctcccctcctaggactctctttctcttttcatttgcct

SEQ ID NO: 19475 - DNA, 201 bp, Homo sapiens
tttttagtaggtatggggtttcaccatgttggacaggctggtctcaaactcttgacctcaagtgacccacccacctcggcctcccaaagtgctgggattaygggtgtgagccactgcacccggcccagattgccttcttcaggtaagtattttaaacctcttatgagctgtttccttccttcatcccttcgtttcctcctt

SEQ ID NO: 19476 - DNA, 201 bp, Homo sapiens
caataatatatagattgtacatttgtttttcatggattataagacatttttcatttttcagccacacggtattgattcatcacttccatattcagctatgmctatatatgtccatgtcacaaagttattttcccattaaaaatttactctgtccttgcaataagaaacacaaaagagttagttcaaaggaaaaaataacaa

SEQ ID NO: 19477 - DNA, 201 bp, Homo sapiens
tggtagcacttatgggaacagaaatgatctagatttaactttaaaagtggaattcaattatagctgccaggattctgagttggtctggttaatttcagctrtggagatacatctaggatattctgcaggtatttacctacttgagtaggtaaatccttctctggaaacttcttaggaagttgagtctataagaaatactca

SEQ ID NO: 19478 - DNA, 201 bp, Homo sapiens
tccttttgggacagaaataacaatatctgttctttctgagaaaacttggagagaatgtcaatgtgatatctcagggataattcatttttgaaaaaggagartcctttctactgaatactttttataagggacatttttagctttggaactgcatttctcttccctgtctggatgttagctgtttgtatgagtggtgaggac

SEQ ID NO: 19479 - DNA, 201 bp, Homo sapiens
tagggaaaatataaaatagaatataattttttgtttagaagtatatagcagaagttcagttttggttacgttcagtttgagattattattaaatactcaaytgggtgattttgagtaggtagttggatatatgagcctggaggtgagtgccaaatataacacgtaaatttgggggtcattgggtatttgattgtattaaaa

SEQ ID NO: 19480 - DNA, 201 bp, Homo sapiens
gaatgctcttcttaacattattctcagtagcctcagaccagaaataacctaaattaaatatccaccagcagcaaaataaacacgactatacagtgttttttaaaaaaaaaaacaaaacagaaaatagcaagtgttggcaaggatgtagaaaaattagaacttttgtgcattgctggtgggaatgtaaaatggtccagctgc

SEQ ID NO: 19481 - DNA, 201 bp, Homo sapiens
tgtgtgaacaaagaaacaatcatatatataaatatattatataaatatatatttatataatatataaaaatatatatttatataatatataaaaatatatattatatttatataatgcatttatatattatatatttatattatgtatatatatatatttgaattagcctgtatggacatttttaaaacaactttgcagac

SEQ ID NO: 19482 - DNA, 201 bp, Homo sapiens
catcataattgtatttaattatgtatccatttatcattttccaaaagattaaaccatgcacaaaaatacccctctgtgttctttacggcagtattaatagytgcatatacctaggagaaaaaggcaatttaaattttctcccatgttattttagatgtattttactcctcctcctcaaagtgggtatgaacagcaacactt

SEQ ID NO: 19483 - DNA, 201 bp, Homo sapiens
ttttgtgtgaacaaagaaacaatcatatatataaatatattatataaatatatatttatataatatataaaaatatatatttatataatatataaaaatatatattatatttatataatgcatttatatattatatatttatattatgtatatatatatatttgaattagcctgtatggacatttttaaaacaactttgca

SEQ ID NO: 19484 - DNA, 201 bp, Homo sapiens
gccttatttgttcaatccattatagctggtaacattctgtaaaagaggacgcaaaaggcacccatgaccaatactagataatacgtattcaatcattagamccttttatgaaaacaaggggcgaaaagtgctgcgacaattcccagagaaattgaaatggatatttcctatataatgctaaaagagcatcagatatgaagt

SEQ ID NO: 19485 - DNA, 201 bp, Homo sapiens
gtttttttgtgtgaacaaagaaacaatcatatatataaatatattatataaatatatatttatataatatataaaaatatatatttatataatatataaaaatatatattatatttatataatgcatttatatattatatatttatattatgtatatatatatatttgaattagcctgtatggacatttttaaaacaactt

SEQ ID NO: 19486 - DNA, 201 bp, Homo sapiens
agccagagttgttttgtttgtatgaaaagtggcagtgctgtctaagatttactgatccctgtttagaagtcatctaaaaataatatctgagtaactcaaaycctctccattttccccagaaatagttttactgtaggggtgagatgtaggagagggagggagcgtctgtgtactgccacagctgggaacattactgcacct

SEQ ID NO: 19487 - DNA, 201 bp, Homo sapiens
tgtttttttgtgtgaacaaagaaacaatcatatatataaatatattatataaatatatatttatataatatataaaaatatatatttatataatatataaaaatatatattatatttatataatgcatttatatattatatatttatattatgtatatatatatatttgaattagcctgtatggacatttttaaaacaact

SEQ ID NO: 19488 - DNA, 201 bp, Homo sapiens
actttttcaagaaaaggtaaaattgtgaattgcatttcaaccacacagaaaccaaacaaagttcgggagtgcaaactatattctccttctttcttaacatmagatttttccattgtagcaaatgtgattaggcagggccttgactaaatcactagaacagtgagtgctgacactaaagctggaagctaaaaatgcctccag

SEQ ID NO: 19489 - DNA, 201 bp, Homo sapiens
ctgtttttttgtgtgaacaaagaaacaatcatatatataaatatattatataaatatatatttatataatatataaaaatatatatttatataatatataaaaatatatattatatttatataatgcatttatatattatatatttatattatgtatatatatatatttgaattagcctgtatggacatttttaaaacaac

SEQ ID NO: 19490 - DNA, 201 bp, Homo sapiens
actgtttttttgtgtgaacaaagaaacaatcatatatataaatatattatataaatatatatttatataatatataaaaatatatatttatataatatataaaaatatatattatatttatataatgcatttatatattatatatttatattatgtatatatatatatttgaattagcctgtatggacatttttaaaacaa

SEQ ID NO: 19491 - DNA, 201 bp, Homo sapiens
acaaggtcattctaaggttatgcttaagttattgctgtcaggtatgtttatcctacaccaggttgataagacaatgatgtcatcagtcagagccacataarcttgacagccattaaaagtttatcttcctggctaggcgtggtggctcacacctgtaatcctagcactttgggaggctgaggcaggtggatcatgagatca

SEQ ID NO: 19492 - DNA, 201 bp, Homo sapiens
tgatactgtttttttgtgtgaacaaagaaacaatcatatatataaatatattatataaatatatatttatataatatataaaaatatatatttatataatatataaaaatatatattatatttatataatgcatttatatattatatatttatattatgtatatatatatatttgaattagcctgtatggacatttttaaa

SEQ ID NO: 19493 - DNA, 201 bp, Homo sapiens
tatgatactgtttttttgtgtgaacaaagaaacaatcatatatataaatatattatataaatatatatttatataatatataaaaatatatatttatataatatataaaaatatatattatatttatataatgcatttatatattatatatttatattatgtatatatatatatttgaattagcctgtatggacattttta

SEQ ID NO: 19494 - DNA, 201 bp, Homo sapiens
ggacaacacagtccctgtctcaaaaaaatcaaaaaagaagaagaagaaaaagtattttaaacctgtcattaagaagaaaaaagatgtaattacacacttarggaggccagagtgggcagattgcttgatcccaggagtttgaaaccagcctgggtgggccgggcatggtggctcacgcctgtaattctagcacttttggta

SEQ ID NO: 19495 - DNA, 201 bp, Homo sapiens
gtatgatactgtttttttgtgtgaacaaagaaacaatcatatatataaatatattatataaatatatatttatataatatataaaaatatatatttatataatatataaaaatatatattatatttatataatgcatttatatattatatatttatattatgtatatatatatatttgaattagcctgtatggacattttt

SEQ ID NO: 19496 - DNA, 201 bp, Homo sapiens
ggattaagctattcattcttttcgcattaaaacaatgatgtagttttattcgtaaatctataaagttaagtgcacagtcatcacttttagtacgttctgaktcattgaaatcctgtaaaattttatggaaaaatctgtgtaaacaagctttaaataaggcaatattccaataccaaaactcgggatttaggcataggtgct

SEQ ID NO: 19497 - DNA, 201 bp, Homo sapiens
gttccttatatattttggatattcactccttatcagatgtgtggtttgcaaatattttctctcgctctgggttgtctcttcagcacagaaatggacagtcrcacgttaccacctgtatgatcattattttaaacacaagcaggaaaagcttttgggttccaaagtttcagtcattatgattgaaaaactgccaaactggta

SEQ ID NO: 19498 - DNA, 201 bp, Homo sapiens
ggtgaattgccaaaaaagatagagttaaataatcagtccatctaactgaccttaactaatgtaaaattactttctgtaagcccaggttagttataaaaagwttgaccctttaccgcagtttatctgatataatctcagattaattaatcttgattagtttgttatttgcctcagatttttaattttaaaaggatattattg

SEQ ID NO: 19499 - DNA, 201 bp, Homo sapiens
aaaatgtgttgagcaggaaaagaaacttcacagtatttgtgtttttcttttggccctttctgctaggtatcctcactctaattgagcaggctctggaaacytgaaacgcacatcagtcttgtgcctttttctgtttcttccactagcagttgataattatagcttttcgtagatactcagcacattccatgtttttgatgg

SEQ ID NO: 19500 - DNA, 201 bp, Homo sapiens
aaaaaccacatgactatctcaatagatgcagaaaagccctttgacacaattcaacaaccctttgttttaaaaactctcaataaattaggtattgatgggaygtatctcaaaataataagagctatttatgacaaacccacagccaatatcatactgaatgggcaaaaactgaaagcattccctttgaaaactggcacaaga

SEQ ID NO: 19501 - DNA, 201 bp, Homo sapiens
caagtgggcttcatccctgggatgcaaggctggttcaacatatgcaaatcaataaacgtaatccagcatataaacagaaccaaagacaaaaaccacatgaytatctcaatagatgcagaaaagccctttgacacaattcaacaaccctttgttttaaaaactctcaataaattaggtattgatgggatgtatctcaaaata

SEQ ID NO: 19502 - DNA, 201 bp, Homo sapiens
tccagggatgcatttctggaaaaagcgtaagtcactctaattttattgctaagggcgttgcttcttctgagtcagtttcctttctcctttgtgagtcttcygtttatgccatactgacttctcacattgataaacacaaattttcctttgggatttattagagaactgatacctcccctgttcagaattggaagacttcca

SEQ ID NO: 19503 - DNA, 201 bp, Homo sapiens
  misc_feature (1)...(201): n = A,T,C or G, or insertion/deletion polymorphism (see Tables 1-2)
cttaatattagagattatttaatgcaatattttttaattgggtcagcaccataatcctaaaatattgattttatactagacaccttaattttaaaagcacncagttgatctttcagaagacagatgcaaatgcatggaggaatggttatcttttagttctttaaatatgaataataaatagatttgactgaatggaatatt

SEQ ID NO: 19504 - DNA, 201 bp, Homo sapiens
aatactatcacaatggccattaagtttcagcatctgaattttagaggggacatactgaggcaataacaaacattatgtttttgagaaggtcccattttttyttaatttaaagctcagtccaatgaatatctgtaacaaagggttagtgaaatcccagtccaaaattatcatcttttgaaggtaattcagatggacatttct

SEQ ID NO: 19505 - DNA, 201 bp, Homo sapiens
cttataactgttacatagttaattcaaagaagcattgtatcaagataaataaatatagaaaacaaggaatccattttcaagaaacatactttgttctagtyctgacttcagatttaaaacacacacacatacgcagaagacacactgaatatgattgaatctagaatatagaaataaaataattgaatatattccatttgt

SEQ ID NO: 19506 - DNA, 201 bp, Homo sapiens
tcatatggtatatagtatcagatagctagaaggaggatatttaatgttccccacacaaagaaatgataaatgtttttgattttatatatatatatatatgrtaattaccgtgatctgatcactatatgttatatggatcgaaacatcactatgtactccatgaatatatacaattattatgtgtcaatttaagaaattaaa

SEQ ID NO: 19507 - DNA, 201 bp, Homo sapiens
ttctaaacaagcatttatcgctctttgaagttgtgtcgtatttagaaatttagattcatagtaattagatatttagatagattatactggaatatttgggyggcatatggacagcaggtctgtaaataaaatttaaatcttcattactatattttctacattctgccttatgcttgatttaagcttttttcccttcttttc

SEQ ID NO: 19508 - DNA, 201 bp, Homo sapiens
tcagagggaaggagagtcagcgacgtgctctcgtaaggtcatcttagaagaccactctctccaattattttaagcagctctttagagctttctacattgtraagttctttatcctacctgtgtatccctagggctttacagagtggagattcagtaaatattttgacaagagtgagcaaatgatttaacagtcgatggagt

SEQ ID NO: 19509 - DNA, 201 bp, Homo sapiens
ggcaaaatcaaatgccagtccacaggatagataagtgagcttggtagcctcatcaaccccatagtctgctgagtcttgttaaaacttctttccttcatcayacctttcagaggtgccttgccatttcatgggagagctattgggacagagcagagaatggcttctttccccctagatgtgacctcccagcagaacacagca

SEQ ID NO: 19510 - DNA, 201 bp, Homo sapiens
tgtatgatactgtttttttgtgtgaacaaagaaacaatcatatatataaatatattatataaatatatatttatataatatataaaaatatatatttatawaatatataaaaatatatattatatttatataatgcatttatatattatatatttatattatgtatatatatatatttgaattagcctgtatggacatttt

SEQ ID NO: 19511 - DNA, 201 bp, Homo sapiens
tgtgtatgatactgtttttttgtgtgaacaaagaaacaatcatatatataaatatattatataaatatatatttatataatatataaaaatatatatttatataatatataaaaatatatattatatttatataatgcatttatatattatatatttatattatgtatatatatatatttgaattagcctgtatggacatt

SEQ ID NO: 19512 - DNA, 201 bp, Homo sapiens
aaatgtgtatgatactgtttttttgtgtgaacaaagaaacaatcatatatataaatatattatataaatatatatttatataatatataaaaatatatatttatataatatataaaaatatatattatatttatataatgcatttatatattatatatttatattatgtatatatatatatttgaattagcctgtatggac

SEQ ID NO: 19513 - DNA, 201 bp, Homo sapiens
gttttataagcacctcagtttttttctcagtgtgaaatcatctatatcaatctttttggtgctgtaccctatactgaacatggaaattccaccatttaacrtgctaaacagctagcaaagaactattccatagatattgaacttgaaaactatacattttaataagccaaagtacatcaggaaaaatcagagctttaatga

SEQ ID NO: 19514 - DNA, 201 bp, Homo sapiens
aaaatgtgtatgatactgtttttttgtgtgaacaaagaaacaatcatatatataaatatattatataaatatatatttatataatatataaaaatatatawttatataatatataaaaatatatattatatttatataatgcatttatatattatatatttatattatgtatatatatatatttgaattagcctgtatgga

SEQ ID NO: 19515 - DNA, 201 bp, Homo sapiens
caagagggggctgtgctctgtgtcacctccactctaaggcccagtgacggagcctgcaccgtttctaatgtttccggttactgtggcagaaggaaaaagcrtatgacgaatcacacactggctcttcaaatgtctgcccagaagtgacacagtccccttgagctataagttcctggtcaaaacaaacaacatggccacacc

SEQ ID NO: 19516 - DNA, 201 bp, Homo sapiens
aaaaatgtgtatgatactgtttttttgtgtgaacaaagaaacaatcatatatataaatatattatataaatatatatttatataatatataaaaatatatatttatataatatataaaaatatatattatatttatataatgcatttatatattatatatttatattatgtatatatatatatttgaattagcctgtatgg

SEQ ID NO: 19517 - DNA, 201 bp, Homo sapiens
tcctatatttaggaccacaaaactcaaaaatacttaaatatatgtccggttgaattttgggtattgtgtgtgattttgtttaagtggaagtcacaatataragtagattttttacgaataatcttttgagtccaaaataccttccaactgatatatttatattcattacattctattttatttgtcatataataaatgagt

SEQ ID NO: 19518 - DNA, 201 bp, Homo sapiens
agttgtcaaagggccctgtccccttggggatcacaatctcaaggcggcggggaacatccggaaataagatagttatagttggtgatgcattaccagagacrtgtgatgccataatagtgactaacccaaggacagtgagttagcttttgttgcataaattacccccaaaatttagtggcttaagacaactctttgtttagg

SEQ ID NO: 19519 - DNA, 201 bp, Homo sapiens
agaaaaatgtgtatgatactgtttttttgtgtgaacaaagaaacaatcatatatataaatatattatataaatatatatttatataatatataaaaatatatatttatataatatataaaaatatatattatatttatataatgcatttatatattatatatttatattatgtatatatatatatttgaattagcctgtat

SEQ ID NO: 19520 - DNA, 201 bp, Homo sapiens
tcttatcttgggtatatatgctgcctatatatatgcatatagtaagatgtttaagtttttaaaattaactgcattgttgaatatttgaaatacacatctgwtatttgttattgaactttaaaatgatatatgaggatttaggtaaatactgtctgtctaaaattaattttggaaagtaactcataagatgatattttcaat

SEQ ID NO: 19521 - DNA, 201 bp, Homo sapiens
gcagaaaaatgtgtatgatactgtttttttgtgtgaacaaagaaacaatcatatatataaatatattatataaatatatatttatataatatataaaaatatatatttatataatatataaaaatatatattatatttatataatgcatttatatattatatatttatattatgtatatatatatatttgaattagcctgt

SEQ ID NO: 19522 - DNA, 201 bp, Homo sapiens
tatgtggctttccttaataaacaatccaatacataaaaacccttgctggtcccagaaatcttttttcccctggagatttttaagcaatacttttttcactrctgtcattcagtaattgaactgtgtcagccaaatgaaaacttttataagcttctcagaggacagtgcagtggtactgtctccatttatataaatcgagta

SEQ ID NO: 19523 - DNA, 201 bp, Homo sapiens
tgcagaaaaatgtgtatgatactgtttttttgtgtgaacaaagaaacaatcatatatataaatatattatataaatatatatttatataatatataaaaatatatatttatataatatataaaaatatatattatatttatataatgcatttatatattatatatttatattatgtatatatatatatttgaattagcctg

SEQ ID NO: 19524 - DNA, 201 bp, Homo sapiens
cgatgccccttttcaaacattctctcttgtcttttaaagtattggtgacttcttgtctttctttatctgagaacagaatgcttctttttcacaggctttttggtttgagagctgaatatttcacgttctttctgattttcttgagaagggaggctgaagggaatactgatgtcatatatgttctttctagaatttcaggtc

SEQ ID NO: 19525 - DNA, 201 bp, Homo sapiens
tcgatgccccttttcaaacattctctcttgtcttttaaagtattggtgacttcttgtctttctttatctgagaacagaatgcttctttttcacaggctttttggtttgagagctgaatatttcacgttctttctgattttcttgagaagggaggctgaagggaatactgatgtcatatatgttctttctagaatttcaggt

SEQ ID NO: 19526 - DNA, 201 bp, Homo sapiens
tgttcagcatgataccaatacttcaaaatttgataagattagctttattactaaaatgtggttaggttttacgaatgcccacatgtacttcgacatgtatrttctccactcaatcaaaatagtacattgcacttttcaactattatatgtctttactgttggcctacaatcacaagagtctgatttgtccattattaatga

SEQ ID NO: 19527 - DNA, 201 bp, Homo sapiens
accagaggttccactgggttagacctttgatttattttaatgaagagcccttcttctttgttgatgtctgacagcacattcacagtgatccagtcattttkggggtaagatagaaggaatccaggtagaatacaatataaaaatgtctcaaactaggcaagagaagagtctagtcctgtggtaggtcatatttgtcaaaat

SEQ ID NO: 19528 - DNA, 201 bp, Homo sapiens
acaaaattcagaaggaggaaataagctagtctccctcacaccctccttctccagccatcctgtgcccttccccagatgtaatattttcaaatagtttaacgtacgtttctgtgctgattactttttttgctatttccaacaatgttgctatgaatattcttgtcattgcccccaagtgcacatgatttcaagagttctgta

SEQ ID NO: 19529 - DNA, 201 bp, Homo sapiens
tgaaaggggggttaggggcaagcacagacttgtaaataatctatgagtaaacgtctatacaccagatttgcctagaggatggtgtatttgcgtggcaggayattgggtacagctttagcagtgaaaagagcaaagtgcaaagagaacctagaagaatgcaccactgggagctgactattattattttcattaaaggtgagt

SEQ ID NO: 19530 - DNA, 201 bp, Homo sapiens
agtgaggccctccttctcatttgtacaaattagtaagatgtcaacctacatgtggagttctggagattcatcttaagacttataaaagggaaaaaaaaaaagaataagtaaaggtattgagggcctactacgtgctgatggccaaggtactttcacctacattaacaaatcaaatcatttcaataggccctgtagggtggc

SEQ ID NO: 19531 - DNA, 201 bp, Homo sapiens
ttgacctagccaccgtagccatggaattttatttatttatttatttattattttctgaaacagagtctcactctgttgcccaggctggagtgcaggggtaygatctttgctcactgcaacctccacctcccggtttcaagtgattctcctgcttcagcctcccaagtagctgagatcacaggcgtgtgccaccacacccag

SEQ ID NO: 19532 - DNA, 201 bp, Homo sapiens
taacctggaaggcagaggttgcactgagatcgcgccaccgaactccagtctgggtgacagagtgagaccctgtcaaaaaaaaaaaaaaaaagaatattgarcatatgtttacataaattaattattttgagcaatgactatttctgcttcagaaaatctggacttcttaagttgtgttcaagaaaaaaaaaacaagacaac

SEQ ID NO: 19533 - DNA, 201 bp, Homo sapiens
ccaggcatggttaattagccctgctacttgagaggctgaggcacaagaatcaagaatcactttaacctggaaggcagaggttgcactgagatcgcgccacygaactccagtctgggtgacagagtgagaccctgtcaaaaaaaaaaaaaaaaagaatattgaacatatgtttacataaattaattattttgagcaatgact

SEQ ID NO: 19534 - DNA, 201 bp, Homo sapiens
gagatctatgctgtataaaaagtaattcatccaattctattatgacttatatatagcaatctactcatttatgaaacaaagaattccaggcatatcttgtkttactagcctgtcctgagtattgtggttcgaattcatttgtggactcttgagtagggctgtctgtctataatgacaatgcatatacatgtagaaccagct

SEQ ID NO: 19535 - DNA, 201 bp, Homo sapiens
aaaaggaactgggcccttctggaggcaatagactgttcttgaagacttgctgaagttagtggctcttttggagaagcctacatatcaaggaaatatgacarcctccggaactgcaagcagcctctggtatccaaggccccaacaaaaagccagagccctcagtcacagagctcaagaaattgaattctaccgtcaacctga

SEQ ID NO: 19536 - DNA, 201 bp, Homo sapiens
gggcacatgcaagctgacactctcaggactccaaagtgtacacacttttcactataccacacagcctctcatgcacgtagacaatcacacacatacaaacwttctaacaaaagtttgtaggaattgtgctgggaccatgctgtatagctgtagtccatggtgtataacatgcctgcagtagaatatctattgaaatgaata

SEQ ID NO: 19537 - DNA, 201 bp, Homo sapiens
atgaaataggagttaacactgaagtctagagaggttatgcaatttgcttatggtcacacagctaataagagctagatagaggtctcctctagagctcatgmgcttaaccagtacctccatccatgacactgtcttaccctaatactggaggagttgaggaataggcttccccacatcgtggataataaagctaaaattttc

SEQ ID NO: 19538 - DNA, 201 bp, Homo sapiens
tacacatattagaaatatgagaactaatgtttattgagcaattcatatctgtataccaaacattctactggtatttcaacaccgtgaactagaaacaattmctaaggttatgaaataggagttaacactgaagtctagagaggttatgcaatttgcttatggtcacacagctaataagagctagatagaggtctcctctag

SEQ ID NO: 19539 - DNA, 201 bp, Homo sapiens
tgtagtaaactaaacacagcccaggccttggttaggggcccagtaggagcagagaagggaacagcagatgagcttggatgctccactgcaaacatgagtcytaagccaagcacacaagatcagaagtacacaatgtcagaggcaggacaaatggaaaagcaggggaaacaacacaggaagatctaggaaccccagtggccc

SEQ ID NO: 19540 - DNA, 201 bp, Homo sapiens
tggactccctacaagtctaagaggcccagagaaacactcacattttatcaaccaaaggaagatacgagagagatttgacctggagctaaatacccacttcytaaattagaggaggggaggaggggtcttacccaccttcagatttgactctccttggccgaaataccaatgaggtgagcctacaatccactttcattatta

SEQ ID NO: 19541 - DNA, 201 bp, Homo sapiens
atccacattagggagggcaggctgcttaactcggtctaccaattcaaatgttaatctcatccagaaacccctcacagagacacccagaagaatgtttaacsaaatatctgggcaccccatgacccagtcaagttgacacataaaattaatcatcacgagctacaaaggcagagttgaacagttgccatagaaatagaaact

SEQ ID NO: 19542 - DNA, 201 bp, Homo sapiens
agacagaggctgcaattaactatgaatgcactactataccctagcctgggccacagagaccatgtctcttaaaaataaaataaataaaataaaataaaattaaaataaaataaaataaaataaaataaaataaaataaaataaaaaaataaaattgtttgtaaatatttcctgattcagtgtatggccccgattcgatata

SEQ ID NO: 19543 - DNA, 201 bp, Homo sapiens
acctatatgacaaaccctcatgtgtacccctgaacctaaaataaaagctaaaaaaaaaagaaaacagaaatgtcctttttcaactggatgaattttattcygtaagaaatagaggttaaacaaaagcattttcaagtgaaattacatgtattttcagtatttagaggaaatactttttagattatcaactttaacccatta

SEQ ID NO: 19544 - DNA, 201 bp, Homo sapiens
gataaaaaggcaaactctagtcaattgaatttctcatatatctttcattctaacccgttcagatgtactaatttgtcacatgccatggttacttttccctytttagactttcaagttggaaaaagcttttttcagattcagaaagataaaatatcagccatgtattaaatgcattaaatgtttttctctcagctgctttta

SEQ ID NO: 19545 - DNA, 201 bp, Homo sapiens
aagaatgagtggggggaaaagccccttataaaaccatcagacctcaatgaacttactatcatgagaacagcagcatggtggtaaccgcccccatgatccarttacctccacggggtccctcccatgacacatggggattatgggaactacaatctagatgagatttgggtggggacatagccaaaccatatcagagggata

SEQ ID NO: 19546 - DNA, 201 bp, Homo sapiens
ctaaaggcagaaaagataatgtatttaaatatgtcttcttattcttaggacagaagaaggtccctatacatggcagatgttcattaaggatcagggtttastgatgttaatgctattatataggttcattagtcatataaaagttcattatgtgccaggcactttcaaggcaagttctgagaaacaacattaatgactggg

SEQ ID NO: 19547 - DNA, 201 bp, Homo sapiens
cctcaagtgatctgcccaccttggcctcccaaagtgctgggattataggcatgagccactgcacccggccaccttctcagatcttttgctagctgctgctkcttcttcttctttttttttttttttaaatggagtctccctctgtcgtccaggctggaatgcagtggtgtgatcttggcttacagcaacctccacctcctg

SEQ ID NO: 19548 - DNA, 201 bp, Homo sapiens
gggtttctccatgttggtcaggctggtctcgaactcccaacctcaagtgatctgcccaccttggcctcccaaagtgctgggattataggcatgagccactrcacccggccaccttctcagatcttttgctagctgctgctgcttcttcttctttttttttttttttaaatggagtctccctctgtcgtccaggctggaatg

SEQ ID NO: 19549 - DNA, 201 bp, Homo sapiens
cccaggctagaccataatggcacgatcttggctcaccacaacctcagcctcacgggttcaaacaattcttctgcctcagcctcccgagtagctgggatcayaggcatgcgccaccatgcccagctaattttgtatttttagtagagacagggtttctccatgttggtcaggctggtctcgaactcccaacctcaagtgatc

SEQ ID NO: 19550 - DNA, 201 bp, Homo sapiens
tcagggcctttggacctgttgttccctattcttggacccgttgcttccttagatctttggttttgttttactttttgagaaggaattttgctcttgttgcycaggctagaccataatggcacgatcttggctcaccacaacctcagcctcacgggttcaaacaattcttctgcctcagcctcccgagtagctgggatcata

SEQ ID NO: 19551 - DNA, 201 bp, Homo sapiens
tgttaaaaccatttgatctttaaactggcttgcttcatttcataatggatcgaagacaatggacacaaagtatataggcagtaaaataatgataaaataartgttggtactctaaaatagaaataaattagaaaattaagaacaaggaaaacaaaacacaaatgcacacacatagcagctaagctggctcatacctcaggg

SEQ ID NO: 19552 - DNA, 201 bp, Homo sapiens
ccttctctgcctgaagccataagtacttgaacagacagttttttggggagatcttcctagttaaaaatattgagctaatatctaaacttatagataacttygggacatttgatttgagttaaggttagaacaatgctgcgtaattctggccacatatataattaatttaaattcttctagattaaaaaaaatgttgcagaa

SEQ ID NO: 19553 - DNA, 201 bp, Homo sapiens
agtgctacattagaggaaaataaacaattggctaggtacaaaggctcatgcctgtaatcctaacactttgggaggcagaggtggttggattgcttgagctsaagagttcaagaccagcttgggaagcatggtgagacccaatatcatttttcctattttaaatataatttttttccctttcctaaaatagaaaaaattagc

SEQ ID NO: 19554 - DNA, 201 bp, Homo sapiens
gtgcccttgaggtgaggctggtagcaggcttgatagaccatggacatggctttttgtctgcttttggttattttgttagacctatttcagggtctccaccrttgtcacattctttcctttttaagagtattttttttttctggttatacccatgaaaccttattttaagtccctaaccacaggctttagagatctatgctg

SEQ ID NO: 19555 - DNA, 201 bp, Homo sapiens
tccatggactgatattttctagccaaagggagctaaaaatcagccattttgacatttggatttttcattgatgtgtcttgtttatttaattcaatttaatrtgaaagagtagagagggtagaacaaactgttcagcaacgtatagatcattaggttttaaaaccaaataaaaagtactcagtgtaaaaatttgcctgactg

SEQ ID NO: 19556 - DNA, 201 bp, Homo sapiens
tgcactaagaatgattttgacattttgaacggattgaaaaataatcaaatgaagaagaatattttagagcacatgaaaatcatttgagattcaaattctartgtcctcaaaatttctattgagcacagccatgtgcattctgttatgcattgtctatgtgttcacactacaacagctgcattgagtagttgtgacagagac

SEQ ID NO: 19557 - DNA, 201 bp, Homo sapiens
aaacaagaacagggttcaaatccaggccagtgcctctgtttgcacagccagtgcactaagaatgattttgacattttgaacggattgaaaaataatcaaaygaagaagaatattttagagcacatgaaaatcatttgagattcaaattctagtgtcctcaaaatttctattgagcacagccatgtgcattctgttatgcat

SEQ ID NO: 19558 - DNA, 201 bp, Homo sapiens
tcgggaggccgaggtgggtggatgacttgagcccagaagttcgagaccagcctcggcaacatggcaagaccccatctctgcaaaaaaaaaaaaaaaaaaaatacaaaaattagccaggcaggggatgcgcctgtagtcccagctactcaggagactgaggtgggaggatcacttgagcctgggagatggaggctgcattaa

SEQ ID NO: 19559 - DNA, 201 bp, Homo sapiens
agtttctcagtcacactagcacatttcatgtgctcagtgttcccatgtagctagtggctgtggtattggacagtgccaatatgcaacttttccacaattayggacagttctattgaatagtgccaaacaagaacagggttcaaatccaggccagtgcctctgtttgcacagccagtgcactaagaatgattttgacatttt

SEQ ID NO: 19560 - DNA, 201 bp, Homo sapiens
catgtgcagtataggtatttgcatttgctatgtgtgtttccctgtgttcgcgatgtaatatataaaatcaagacatcaactgttgtctccccagagttatrgctatataacttaagcagcaaaggaaaggatttaggggtccattttaatgtaggcaagagataagaccattttttcaagttaataggaaagaaaattatg

SEQ ID NO: 19561 - DNA, 201 bp, Homo sapiens
  misc_feature (1)...(201): n = A,T,C or G, or insertion/deletion polymorphism (see Tables 1-2)
ttgaatgaggcaggaagatagttgacagttggttaattcatgtattcattctagttagttttgtgtctgcacttccttctggaatttaaacatttttgaanatacggtctctgttctattttttatttttcattcctataaagttttattgaatgcctatatgtgtccaacataccagatcctaaggtatgtttcacataa

SEQ ID NO: 19562 - DNA, 201 bp, Homo sapiens
atctcttaggtcagttttgcaagttcattatttcaagctgtctaaaggaggtataggattttgtaacaagtaattaaggaaaccaccataaaagtttaagwttatactatatgatagttttcattatccaatgctgcattttttgtaatagacattgaataggagggaactatccttactaagtggtaggcatttttcccc

SEQ ID NO: 19563 - DNA, 201 bp, Homo sapiens
tcagtggttggcttctctggccttgacctgtgagctcagcatgaagtgctgagatttgatttaagatgacctagagtttatgtactgtcatttacttggarattatcactttgcgtatttcagatgacatctcttaggtcagttttgcaagttcattatttcaagctgtctaaaggaggtataggattttgtaacaagtaa

SEQ ID NO: 19564 - DNA, 201 bp, Homo sapiens
attcccaataaggtttgccaccaaaggagtttgctctaaatttgtgactggatgtttggttttcagaggtttcaggatttcagaatcatggtaagggattrtagacatgtatttggtatgtgcaatattgggggacttgaatattaagtctgattgggaacatctctgggtttctgtatgtgtacacattctacacaatag

SEQ ID NO: 19565 - DNA, 201 bp, Homo sapiens
ttataaaaccatcagctctcatgagactaatgcattatcatgagaacaacacaggggaaccacgcccataattcaattacccccacttggtaacccccccktgacactgtgggtattacaattcaaggagattttgtgtggggacacacccaagccatatcatgtatctaatatgaaaatgaagccatgagactggaaaat

SEQ ID NO: 19566 - DNA, 201 bp, Homo sapiens
cgcatcattttataatgaataagacttcacaggtatgctaaatggttgttaccaaagtcatttaaataatagtgattttatgcgtctgtgtttcagtggtyggcttctctggccttgacctgtgagctcagcatgaagtgctgagatttgatttaagatgacctagagtttatgtactgtcatttacttggaaattatcac

SEQ ID NO: 19567 - DNA, 201 bp, Homo sapiens
tgtgttagtcagaattcagtgtgggtaacagaagggcaggccagattggagagagctggaaacatattccaggtagagacaatggtgcctgatgaagcctragggtctgaatgctggagtaaagccaggggttatttacactgtgactgggtgtgaatctacagatagatctgaaactagaagataagcccatgaaggaaa

SEQ ID NO: 19568 - DNA, 201 bp, Homo sapiens
ataaattaacttgaacctgcctagttgtctgtttcagagccagaattcgaacatggattcattttagccgcagtaagcacctgtgttagtcagaattcagkgtgggtaacagaagggcaggccagattggagagagctggaaacatattccaggtagagacaatggtgcctgatgaagcctaagggtctgaatgctggagt

SEQ ID NO: 19569 - DNA, 201 bp, Homo sapiens
cactagaaaaaaaaattaaatattgaaattacattgaggattatttgccctcaacttcactgaatatttacccatttcttttataatgttataatttatarcaatgaattgtatttctcaccttccccttttttgttttgttgttgcttaactcagaaagaaataaaagttttgaaatgtcttccttcgtggaaaccaaag

SEQ ID NO: 19570 - DNA, 201 bp, Homo sapiens
gtatgagtgttctgagtgataatataaaatgcattttttactgaggagcatgatcagaacaatatcaaaccattgaccaacatcaacatatttctattagraagatatttaaatgaagtttgtatagtaaaaggaagaaagaacactaaaatatttgcaaatctaccctgcacagtcactttaatcttttcagcttctaat

SEQ ID NO: 19571 - DNA, 201 bp, Homo sapiens
gtgtgattcaggtgccattggaggtttctggaagagaagggccttttaaaagcctctgagaggccagtattatccccagaaagaatgagaggaggtttatkgtatgcacgcaagcaatatctatgaatccctttacttgcttgtatcttaccctcttctgccctaggaacaggctcgtgggagaagtgacccaactacacc

SEQ ID NO: 19572 - DNA, 201 bp, Homo sapiens
ccatcccaagagaacgaccatttcactgcaaaggcattttaagagccatgtagaggaattgtggccgattgaataggaagttctacctggttcaaatgagytcacatctctcggggaagctggtgactgtggacccaggtagtccaggtcatctttgagaaatgatggagaacgtagtgtcagaggtgaggggattctgtg

SEQ ID NO: 19573 - DNA, 201 bp, Homo sapiens
ttatctgtgtttcctgcatttctacaatgactctcttccaagggaatacagtcacaaaagtggactgggatcaactttactttacaatcttactttcttaycccaagtatagataaactcacaataaggcttgtgtttttgatactcagacctggctatgcaaataaatatggggatgtatgaatacaacgggaagagtgg

SEQ ID NO: 19574 - DNA, 201 bp, Homo sapiens
attacattgaggattatttgccctcaacttcactgaatatttacccatttcttttataatgttataatttataacaatgaattgtatttctcaccttcccyttttttgttttgttgttgcttaactcagaaagaaataaaagttttgaaatgtcttccttcgtggaaaccaaaggacttgaacaactcaccaagtctccag

SEQ ID NO: 19575 - DNA, 201 bp, Homo sapiens
tgcaatatgtgtgaacgttcatctgatgcactgagtctgaggaaaattttgaccagtaacctttgtccactggaaaagagtctatgtagaattagatgttmattgtaagtaatcacagaagtgcaaattataaaaaagaaattttttgtacaaattaaaaagcaggaaaaggaataatagaatcctcttttaatgaggcat

SEQ ID NO: 19576 - DNA, 201 bp, Homo sapiens
gaaatttcttgagtgagaaggagccaataattggaaaacccctgattacctaatgcttgtagcatgtcccaggatctgaagaattttttatatatcaataktttgaataaaattcgtatttgtcctcagagagacaaaaacttctgcttttaagaatactcagaagctaaactaagacattcattataccatctaattgtg

SEQ ID NO: 19577 - DNA, 201 bp, Homo sapiens
ctatttataaatggcaatgataaaaatatttccttcacaggaacgtttggaagaccaaatgatttaatatttgtgaagaacttagtatagttctggcacasagcaaacactatatacatatttatcagataaacaaagtgactccaataagctagctgcaaccaccgcaactgtcatctacaacttaaccagttttatttt

SEQ ID NO: 19578 - DNA, 201 bp, Homo sapiens
ctgaaaaagaactaaaaaagcccagctgtccaacaaagtcatgtctctaggaagagacacactgagggaaggatgtaactgagagaaataagacataggcytcagatttcctagttgggccaatgagaagagtgaacagcatcattatgtggagaaagtgaattatagaacctgatcgttatttgtgagctcattgatgta

SEQ ID NO: 19579 - DNA, 201 bp, Homo sapiens
ttgattttagtcctcaaatatctatagcagcagcagtttgtatctgaaattattacaaggggatttgcctattagaaatatgcctaagttccattattcawtaaggtcacagcagcaattctgattaatggagctgattcttgatagctgtgaggatacttccaatacatattataacttttacaacagagaaagccctta

SEQ ID NO: 19580 - DNA, 201 bp, Homo sapiens
tcatggcagaaggcgaatagggagcaggtgtgtcacatagcaagagaggaagcaaaggagtggggaggatgtgccaggctcatttaaagaaccagctctcrcatgaactaattgtgcaagaactcactcatcaccagggcgatggcgccaagacagtcatgaaagatttgcacccataatccaagcagctcccactaggcc

SEQ ID NO: 19581 - DNA, 201 bp, Homo sapiens
acatggtgggtaggtggctcagcctctaccacttacaggataatttctgacaagtcacttaatccctctaagcatcaatttcctcatctcaaaatagcaaycatgattatggtaatgtaatacctatctcacagagttgctgtgttatgcacataaaattcctggcaaattatttttttcaagtgatacttgctctgcaaa

SEQ ID NO: 19582 - DNA, 201 bp, Homo sapiens
aataaacagcatccaaaaatgttaatgattatatatggttccagaatttacaatggtttgtgttatgattttttttaattttacagtggctggaaagtgawacacattcaataaaaactgtatttcaaatacccatacaatgattctacttttcactttcagcacagtattcaataagttgcgagagatattcacatttca

SEQ ID NO: 19583 - DNA, 201 bp, Homo sapiens
caaatattattaaagagtgataattaaatgtgcctgatgtataaaaagcatgtgaggtcatttaaactaacacttttattgtgattgttgtgaaggttatsaaaaacttgatcatgtatattatctaaagggattgttacaaacctcaagtgacttcaggtcattgaaaccattgcatgtggtgaccagctacagaggcca

SEQ ID NO: 19584 - DNA, 201 bp, Homo sapiens
ttgtttgcgtaatggagaccctctcttcctttctctcttccttcctttctccctgtcttccttgaccaaagttaagcaaggcaaaacagtcaaaagttttytgacataagttgcagtgacaagaactgacagagcacttgatgtaaattttcttataaaacagattttaaaagtgtttacaatattgataggataagaaat

SEQ ID NO: 19585 - DNA, 201 bp, Homo sapiens
tagccgaggacagaccaataaacagcatccaaaaatgttaatgattatatatggttccagaatttacaatggtttgtgttatgattttttttaattttacmgtggctggaaagtgaaacacattcaataaaaactgtatttcaaatacccatacaatgattctacttttcactttcagcacagtattcaataagttgcgag

SEQ ID NO: 19586 - DNA, 201 bp, Homo sapiens
gactctgcttatattttcagaaatgtgtctttagccactagccgaggacagaccaataaacagcatccaaaaatgttaatgattatatatggttccagaayttacaatggtttgtgttatgattttttttaattttacagtggctggaaagtgaaacacattcaataaaaactgtatttcaaatacccatacaatgattct

SEQ ID NO: 19587 - DNA, 201 bp, Homo sapiens; identical to SEQ ID NO: 3318

SEQ ID NO: 19588 - DNA, 201 bp, Homo sapiens; identical to SEQ ID NO: 3319

SEQ ID NO: 19589 - DNA, 201 bp, Homo sapiens
ggcagtctcctgggtcatctccagaatctggagtgcagagccacagtgacccataatggacattgtgtaagcaagaaataagtatttgttattcataaatyaccagtgttttgggcttgttactgcaacattgacccattggtagaaacaactcagcttctggttaatagggtattattttaaaatccgctatgaacattc

SEQ ID NO: 19590 - DNA, 201 bp, Homo sapiens
gtcccagctactcgagaggctgaggcaggagaatggcatgaacccgggaggcagagcttgcagtgagcaggagatcgcgccactgccctccagcctgggcracagagcgagactccgtctcaaaaaaaaaaaaaaaagaaaagaaaagaaggcctcagatggagccatggagagttttcaaggagcaactaggcctaggat

SEQ ID NO: 19591 - DNA, 201 bp, Homo sapiens
gtcaggagatcgagaccatcctggctaacatggtgaaaccccgtctctactaaaaatataaaaaattaggtgggcgtggtggcaggcgcctgtagtcccarctactcgagaggctgaggcaggagaatggcatgaacccgggaggcagagcttgcagtgagcaggagatcgcgccactgccctccagcctgggcgacagag

SEQ ID NO: 19592 - DNA, 201 bp, Homo sapiens
caggcagaacatcttggagcaagtgatatttgaactaagagccaaaggctgagtaggaattaactaggtaaatggtataaggtctggtagagtgagaaagwgtgtgtggatgaagagaaaccctttcagatacggagaataatacacgcaaagtccctgtgataggagggaccatggtgtgtgcaaggaactgaagagtca

SEQ ID NO: 19593 - DNA, 201 bp, Homo sapiens
tggggaaacagtaaagttcagacccattcactttaaatattcatccaaaagatatttattaagcatttagtatgtgtcaggcactgcgctgcatactaagratacagagtgaacaggaaggtagccaggaaccctgtgctgggaatggacaggcctccaggtgcctaagaagatcagagtaaaatcaggaaccaaatgatc

SEQ ID NO: 19594 - DNA, 201 bp, Homo sapiens
ccttttttttttcttttaatgtgtggcaccatcattctgaaaatatcttattcttgtgattacttgtttataacttgtttcgtccccacacaggggccgcrtctctgttatttctccaagcacctggcatagaggagatattcaacaactttatagaatgagttaatattttgcagactaaatagttgggcaatagaaggt

SEQ ID NO: 19595 - DNA, 201 bp, Homo sapiens
ccgctctgtgggtttgtcagaaggtgtcaagtcctaccttctcagtaggcgtctacacagcctggcgctgtatccctctccacccgccccctcgcagtgtrcactatacttccactgttccagctctttgtctgtccccagatggaaccatgcttctcctgtttctgctgctaggccacaattcctccagatatctccaca

SEQ ID NO: 19596 - DNA, 201 bp, Homo sapiens
gtttcccattggccacttcgtgctcacctcatgtaactgaagcagtagcctgcaatcggtctgattggttgcagaaaacagccaaccagaggctgaagtgragttacaaaggtcacactcccgtgcaaacatctgattggttgctttttgcaaccaatgacctgcattctgaggtgttttttttttttttttaacttaaga

SEQ ID NO: 19597 - DNA, 201 bp, Homo sapiens
ggacagaacataaagattcatcacatatcaaaaatcattctgaatatgtagtaattaagatattagtgggatactggcagctttaacattggcacaaatawgtgatctatgaataagcgcacactgatgtgagaacttgatttatgagagagatggcactggagacatgtggagaaactcaggcttttcaataaacattga

SEQ ID NO: 19598 - DNA, 201 bp, Homo sapiens
agtcataggacgggaatccagatgtttatttttaggggtctcagataacatatctttacatttgaaaggcaacagggtatttgtttggttacactataagyatgtattattttgttgagactaaattacttttttttatttctatgatgcagcactcttttagtatggagaggctcatttggcaattccctcaccttttta

SEQ ID NO: 19599 - DNA, 201 bp, Homo sapiens
cttgtttttatccaccacatctacagctgtttggttttttctgtttgtttgtttgtttttttgttctcatccctgcattcagacaatcaaaatgttttctyctttcaatttccagaaaattacaatgatccaggttcttcgctgaagctaccatatctttgtttcttgtgcaatgataatgtcactgatggcataatgtct

SEQ ID NO: 19600 - DNA, 201 bp, Homo sapiens
aacagcttaggtgactgggatttaagcatatggctttctatgtcttagcaaccctcatgtggttggaggttgtcagtcttattccccatttgacctccagyattagcccagaggctggacaaaagaagtaatcaattaataattgatatcaaaataaatgattcagtgtcttttcaacataggacaacacagtcagtgagg

SEQ ID NO: 19601 - DNA, 201 bp, Homo sapiens
tagtctttttactgactctgcttatattttcagaaatgtgtctttagccactagccgaggacagaccaataaacagcatccaaaaatgttaatgattatakatggttccagaatttacaatggtttgtgttatgattttttttaattttacagtggctggaaagtgaaacacattcaataaaaactgtatttcaaataccc

SEQ ID NO: 19602 - DNA, 201 bp, Homo sapiens
actagctgcggggggtgcaaaggtatgctcactaacattaagtaatttactgtccctttggaaggtaatatatattcccctaaacaggaaaagtaagtttrcaagggagcatggtttatgtacagtcacaggagtagggcttgtaaaagattctgtagatattgaggaggaggtatgtgtgagacagagcatgggatttaa

SEQ ID NO: 19603 - DNA, 201 bp, Homo sapiens
tctctttgcattttgtatcatgtgcactactaatctcttacatttgttaatccattgctatggttttgacataagttggactgacaccttcatttagcagrtgtagaaagaggcccagagaggtccacttacaggcaggagtagggccaggccagaaatctagtctcccgtctttttgcttttcttagcaaacagattccc

SEQ ID NO: 19604 - DNA, 201 bp, Homo sapiens
attgatctgttgattttcccattcatgaaacaaacagagtccttacatggcaggtggaagggcattaaggtttactcagcatctctagttgcagctggatrtgtaccttatttctctgtagtaaaagaagtcttgacacctgaattaaaaaattatcattaaaaagtttaaaggaaggaaacattataagtgttcgaacta

SEQ ID NO: 19605 - DNA, 201 bp, Homo sapiens
gtaataccatctggcagaactcacattcgaccttttattaaaactacaattatgtcacacctgtgaggtttaaaattcaaggctccggaagttaaagcgaygtgtccaaggttacatggaaaattcttgagagctcacagtttcctgccctggcctttcacttcggatgtacaccatagtacgtgtgttttctgattagag

SEQ ID NO: 19606 - DNA, 201 bp, Homo sapiens
aaaaatacaggttttaagtccatgtcttaaaaattgcctccaagctaataaggaggtgtgggggaagcatttaaccttgcatggtgtttcaaggattattytccctgctcaccaattgataagcagagataattttctttaaaattcaaggttttctcttggactcagcacagcacagctccctaccagacaactctccct

SEQ ID NO: 19607 - DNA, 201 bp, Homo sapiens
ctgtgtgctggctgagtttggatccagatagccaggatccagttagccaaaaccagtcacatggtctaaccccaaatcagtgggcagagatgtacacaacyccctacttgaccccactgtggggttccagagggtgggactgaggatttgagaacaattatcacatccactacacaagaaaacatcattttcctcttctat

SEQ ID NO: 19608 - DNA, 201 bp, Homo sapiens
cgatcatggctcactgcagcctcaatttcccgaggtcagttcaatggatcctcccacatcagcttcccacgtagctgagaatacaggcttaccaccacacytggctgatttttttttatttttagttttgtagaggtggagttttgccatgttgcccaggctgatcttaaactcctgagctcaaagcgatcgtcccgcctc

SEQ ID NO: 19609 - DNA, 201 bp, Homo sapiens
gggatcagaacaagccccagaggctgccctgaaagctgcagatggaggatgcacagccaggatcaagacaaaaagtagaactgggggctgagagtagaacycagacagggagctatcagagtggccaaagcagattaaccaccttggcatcccccaagagctattgagaaacgcaggagctcaggccccactcaggcctcc

SEQ ID NO: 19610 - DNA, 201 bp, Homo sapiens
aggagttagagtacacgttgggctttgcaacgggtctgctttcatttgttaagcaattgttttttatttggatttcatttattcatttaaatatttatgargccctactacttaccctcaggatgctaggcattctaaaggaatatcttgctagagaaacgtctccgtttagattgtaccttaagtttcagtcacagcaca

SEQ ID NO: 19611 - DNA, 201 bp, Homo sapiens
aggttagagcaatgccaaggaatgcctggaaccaccagaggctgaaagaggcagggacctgaatctcccgtagcagcgtgacactgatgacactttaattktggacttttgatctccaaaactttgagagtcaatgtctgttcttttaaaccaccaagtatgtggcaatttgttatggcagcctcaggaatctaatacatt

SEQ ID NO: 19612 - DNA, 201 bp, Homo sapiens
acaaaacgttcttttataatagtgtatggaaaaaagatttttgtactaattttaatatttccccaaatgttttttgcattcttgttctttccttaaacatyttcattcatacactacagctgaaaacaaaatgatgaataaaaagtaatagtacataaggccgggcatggtggctcatgcctgtaatctcagcactttggg

SEQ ID NO: 19613 - DNA, 201 bp, Homo sapiens
tttctttatccagtccaccattaatgggcacctaggttgattgaatgtctttgctattgtgaatagtgctatgataaacatacaagtgcatgtcacacacyttttgatgtgaaaaaaaaaaaaaaacaagtcatttaaactagatccataatctgttatctgagattcttggggcctgttgtttttcagaattttaacttt

SEQ ID NO: 19614 - DNA, 201 bp, Homo sapiens
gaatagcagtccccaaaaagatatgtccatgtcctaattctcagaacctatgaatgacaccttatttggaaaaaggctccttgcagatataattaagtatyttgagaggaaaagatcatcctgaattacccaggtgtgtcctaaatccagtgacaagtgtccttgtaagagacatactaggaagatttgacacagacagag

SEQ ID NO: 19615 - DNA, 201 bp, Homo sapiens
tcaaggcttgcccccgactccctcccccactttattagtccccagtgtcaatcattgccatatttatgtccatgaatacccaatgtttagctcccacttayaagtgagactgtgtggtatttggttttctgttcctacattaatttgcttaggataatggcctccagctgcatccatgttgctgcaaaggacatgatttca

SEQ ID NO: 19616 - DNA, 201 bp, Homo sapiens
gaggaaagtttccctcaacactgcagtgaggagccttatagaatgtccgtcctcatttggcattgcacataaaaatgcaaaaagaaacttgagaaaattcygcatcccttatttgacaaaatctgattctaacaccagcttcaaccaactcccttccccatgtgatgccactgatgctggcccaattcaaagaaaaagcaa

SEQ ID NO: 19617 - DNA, 201 bp, Homo sapiens
accaccgtccttccggccaggtaggactggatgggaggggtcgcttttgagagaagggtggtgtgtagccatccagttttcaggcatcacggacttgctcstttgtccttcatcctccctttctctacattcccatcttttttttctgctaaagttcccagccacacccatgatcatttcctcatcctttctgccttcctc

SEQ ID NO: 19618 - DNA, 201 bp, Homo sapiens
tttagtagagacggggtttcaccacgttgggcaggatggtctagatctcttgatcttgtgatccactcacctcggcctcccaaagtggtgggattataggygtgagccaccgtgcccagccagaaattatttttaaaactgtggttttgtattcccaggataaaatgtgtatcttttgtacagcttcacaaattagtatgt

SEQ ID NO: 19619 - DNA, 201 bp, Homo sapiens
gatcctgtcacaaaaataataaacatagtacccagcaattagtttttcaaggcttgcccccgactccctcccccactttattagtccccagtgtcaatcaytgccatatttatgtccatgaatacccaatgtttagctcccacttataagtgagactgtgtggtatttggttttctgttcctacattaatttgcttaggat

SEQ ID NO: 19620 - DNA, 201 bp, Homo sapiens
gttttttttaaagccctattttgatataaccaggatagtgaaaattatcaaacacacacatccaaaacactttaaagcaactaatgtaaaattttaattgwtttctagaaaccaatagctgatttaactatgaccttcaatattttaaagggaaaagatggccaacctcaaaccaagagaaatactctcatcccttggtat

SEQ ID NO: 19621 - DNA, 201 bp, Homo sapiens
tacaaaatcacatttgtcttgaaaatctatctgtcctgtggtgattttttttccaagaatatgctttgaggccacagcaatgaaaggatggggccagctgwgttagcttatgagtattttatgggtccaggccacataatgagactactttctgttcccctcactcaaagttatagccataatactgctgcctaacaacca

SEQ ID NO: 19622 - DNA, 201 bp, Homo sapiens
ctcattagatttttttaatcctcaatgtatctctgttttttttaaagccctattttgatataaccaggatagtgaaaattatcaaacacacacatccaaamcactttaaagcaactaatgtaaaattttaattgatttctagaaaccaatagctgatttaactatgaccttcaatattttaaagggaaaagatggccaacc

SEQ ID NO: 19623 - DNA, 201 bp, Homo sapiens
gtttactattgaatatagacaaattttggccaggcgctgtggctcatgcccagcactttgggaggctgaggcgggctgatcacctgagctcaggagttggagacaagcctggccaatatggcgaaacctggtctttaccaaaaatacaaaaattagctgggcgtggtggtgcgtacctgtagtcccacgtactggggaggc

SEQ ID NO: 19624 - DNA, 201 bp, Homo sapiens
ttaccataataaaaaaacaaattatagtatgttcatataaaatagtattatacagtgatggaaatgaatacactataaacgcactccacaggttgaatctytcaaatataatgttgagtgaagaaagtcatatacaaaataatacataaaattaattgtatgtaagttcacttacataaagggcacacaggcacaactaaa

SEQ ID NO: 19625 - DNA, 201 bp, Homo sapiens
gagccaggggtccctgtccaatccccaagctgaacagagaataaaatccggattatgattaagctcatatccaccaccacaaaatggagagaaaaacaacmgatttggttaacacccagtgttcaaggaatgagaaaagggataggaagcaaacttgaagcattgaaaaaatatgtcaggtcctgaaactggggggaggag

SEQ ID NO: 19626 - DNA, 201 bp, Homo sapiens
ttgtttgtttgttttctgattgtaagctaaccttcaagagtaactttgcttgctccttggccttcacttattttttttatctaaaagctttccttaactakatcaaatctctgccttttttaaagacagaagaaaagaatgtcagagtcagaaaagcatcccaagtacaaaaatctttgacaacacaggaagaattgaata

SEQ ID NO: 19627 - DNA, 201 bp, Homo sapiens
tccctaggctgtttcaaagattgctattgtctattggccccataaggtaactgagtttgagatttaaacaaaaattaaaacttagattcgcatggatgccrttgattcctcccccttttctttaccatatcaactttctttccccctcctttgtccatatttttctttcttgaggatgagaaaatgtggacatatggtgat

SEQ ID NO: 19628 - DNA, 201 bp, Homo sapiens
agattctaagattataatagaaacatgcaaagaatttctaaagctaagaagaagctgtcccttagggctgcatggtactccctaggctgtttcaaagattkctattgtctattggccccataaggtaactgagtttgagatttaaacaaaaattaaaacttagattcgcatggatgccgttgattcctcccccttttcttt

SEQ ID NO: 19629 - DNA, 201 bp, Homo sapiens
ctactgagaaaacaaactgaaacaagtgatcctatgtctatatttaaggtaacataaccatacaaagaatataattactttcagtgaattttggcagagtratataattgtgcatccttagtaggatatatttgatgaataaaaagaacttcaaaaaagtctcaagcttcatttgcttattttattgacaggtcataatat

SEQ ID NO: 19630 - DNA, 201 bp, Homo sapiens
ggagagaaagtgtgtattatctaggctttacctgggtaaggaaagggcttttctgtgatggcatgcaactgcctatgacattctttctacaagtagggtcktgatggaattaaagaccataactcgaacttgctatgctacaagccttttctatgggggactatattcccattccacataaacaacattagcaatcagggg

SEQ ID NO: 19631 - DNA, 201 bp, Homo sapiens
gccctccaattctcagaagaatctccatggaacccacaatagctggaaacatacagaaagggaactctgggaaatatagtttggctgagacagttggcacrataagaagcatcacactgttaagtaaaaatcagaaaatgttttatttcaaaaatactctgtgtctcttgaaaaattagattctaagattataatagaaac

SEQ ID NO: 19632 - DNA, 201 bp, Homo sapiens
gattgactgtgacaaatatatcatactaatgtaagatattaacaacagcagaaacagtttcccctgttgtagaaggtatagataggagtattctgtctatwctctttgcaacttttctgtaaatctatttatagacatctaaaatagttgctgtagtagggcatggtggtgtgaacctatagtcccagctaatcatgaagc

SEQ ID NO: 19633 - DNA, 201 bp, Homo sapiens
aatgacattatctgctggtcttcttccccagaaccgaaaattccagtctaatcatgagaaaatcatcagacaaatccagattaagggatattttgcaaaayacctgagcaggattccttaaaacagtcaaggttttcaaaaacaaggaaagtctgagaaaactcgtggtataggggaacgtaagaaggcatgatgagtaaa

SEQ ID NO: 19634 - DNA, 201 bp, Homo sapiens
taagcgattaaatttcaaatgttctcaccacaaaaaatggtaagtatttgaggtgataaatatgttaattggctttatttaattactccatgttgtatttrtaaatcatggcatcattctgtactacataaatacatacaattttaaattgtcaattttatttatatatatgtgtatgtacacacacacacacacacacac

SEQ ID NO: 19635 - DNA, 201 bp, Homo sapiens
gcattcaggcaaaaattgtcttgtgttaagtgttttcaacacataataatttcaagatgaaattattgtgaattgaaaagcaacaaaaggaaagtgaggtycactatcttctatctccttgctaatggaggccagaacttatttagttttgtgagtcagatgagttgaaatttgccttccagtattccaaggcagcaaaag

SEQ ID NO: 19636 - DNA, 201 bp, Homo sapiens
ttatattatttgactacctcatagttctttaagtgagagccttatgatttttttacagaaacacttacgttttattcatgtttttgctgtttcttggcttktttgttagttttactattttccctgatctttagcagtaaattccaaaatattctgagcaagataattagagtaccatattattattgctgcctctcaaag

SEQ ID NO: 19637 - DNA, 201 bp, Homo sapiens
tggctatctgccccgttctcaatgctgtctctctaatgatggaccctagcaggcaggcaggaaaggaaaattacaagtaggcttggtgactagagtaaccwgcagaagctgagcctctttgtcacagagttgaacatacacacatacacacacacacacacacccctggcccaggagtcagacaattaaaggaagacccaa

SEQ ID NO: 19638 - DNA, 201 bp, Homo sapiens
aatgcctctgcactcttcctcttcccacactcttctctctcgctggctgcctgatgaaactcaatcaagagtgcagatttcccaacaattacaatcagccsatagagacagtccaagaggacaggcctctgctcactcccagggaacctcgtcacacctctttgagatgaatggattggcaaaacaggacactgcaggtgg

SEQ ID NO: 19639 - DNA, 201 bp, Homo sapiens
gtattttatagaaattatattagattttgttttcattttagaatgctatttttatgctaaaaatgaaataatcacattaccataaaagtgagaaatagaawaaataaagatactcataattctaacacagtttatattttagtgtttcttttcaaagtcgttttgtattctttaaaaaaatggtcatagttattatcacag

SEQ ID NO: 19640 - DNA, 201 bp, Homo sapiens
acctcccatagtcatggctcaacactatgctgttttaaccctgctttccagggagtatcaaatttgatatttccaactccaaaagaattgtgaagatgctrtaaaatgtagccttgttggtttaggaaggcaagaaaagaataaaaagaaatgtggaaaatgaaaggatatttataattttaggctgatcctggagaaaca

SEQ ID NO: 19641 - DNA, 201 bp, Homo sapiens
gcagtgagccgagatcgcgccactgcattcaagcctgggcgactgagtgagaccaccctgtctcaaaaaaaaaaaaaaaaaggaaaagaaaacacggttartcacaagttgccttgagtctgttgtgaatatgccaatgtttattgatcactttgctgctcctgactctctttataagaagaatcatcttttgaggggaat

SEQ ID NO: 19642 - DNA, 201 bp, Homo sapiens
tccagcctgggcaacaagagcaaaactccatctcaaaaaaaaaaaaaaaaaaaaaaaggaatagcacataaaggtataaagctgtcatgtgtttgccaaargataatgttttctattatgatagaagattggccccaagagtagtcatcacataaatagttggaattttacattttttaatttgtgagtgcaaatcttcat

SEQ ID NO: 19643 - DNA, 201 bp, Homo sapiens
caatagagcgacactgtatctcaaaaaaaaaaaaaggctgagatgagcagaggtggggctgtgtagtaaggcactgtgggggagatgaaggcaaactgagyacagtaggacatttacatattttacatattaaacagatatcctctgaaaacatatactccttgggattctagggaaacaccattttcatttaattgcatg

SEQ ID NO: 19644 - DNA, 201 bp, Homo sapiens
catggcttcagccggtccctccatatggggtccctgacttcccgcaacaagatgggatgaagttttttaactagaaagtgatcatagctaagtttttgcasacaccaaaagtatgtataggctacatgacatcatatttcttcctgttcttccatttctttcaccatgttgttgtatataataatttactttctcttcatc

SEQ ID NO: 19645 - DNA, 201 bp, Homo sapiens
gaagaaggaggtaaattcattggccaccgtatcttgccagtgcaagccattcggccaggtatgggtagtgtgctgagaaaccttttatcaaagttgcaaaraaaatcattactgcttaaaatattactagaaaatgacttaagaaactattttctgctttgtaattttgttatgtaacaagggcgatgagatttagttaca

SEQ ID NO: 19646 - DNA, 201 bp, Homo sapiens
attatatattaaaaaaatcaacagttcaaaagtttcatctcattatgtatttgctatcaattatataattaaagtatgatgtaggaatttttaaatcatcrcttttaaattttaaaaattagttctaagaccccaaactatgtgcaattttacaaagtatatttgactgccttacaacaggctactatctacttaggtatt

SEQ ID NO: 19647 - DNA, 201 bp, Homo sapiens
cccaagtcaagtcattcctgcattttatagcatgagttacagatttactttattgacttttatgtgttctatggctttgatggaagaaggaaaatatgtgsatagagtaattgaagaaacgaaattgcttaaagctacattttaaaatcagtaatgaccatagtgataaaagctgtttctctctttctttagtaaacttta

SEQ ID NO: 19648 - DNA, 201 bp, Homo sapiens
ctggggatatcctcacagtgaaagcagaacagtaagagacagagtggaaacacacaaggcctcttgaggcctagacttggaacaggcactccatcaattaygccacatgctttcgcccaaagcaagtctcaaggtcaagccagttttcccccgatttagcagtagggaaatagaaggagctacagtcatgttgcaaaagga

SEQ ID NO: 19649 - DNA, 201 bp, Homo sapiens
taagtaaaattgtgactgattttatagcaattaagatgaatttttctttgcagacaaattttattgaaggaatattgacaatcaactttcattgaaagcartgggttttgtgatttcatggaataaatgctctgttctaagagttaactgacctatgtttttgtttcagggttttggctaaatagctgcacatctgtagca

SEQ ID NO: 19650 - DNA, 201 bp, Homo sapiens
gcaagactgtgtctcaaaaaccaaccaaacaaaaaacaacagggagtgtccaaaggctgtaatacaaggtcaaatgtagtaaatgatgtaattgggaatcrtaagaagtgtttggaaatattagattttaatttgcccagtggtgccgtaggttggaatggagggaatgcaggaagatgggcaaggcttcacagagaagga

SEQ ID NO: 19651 - DNA, 201 bp, Homo sapiens
gggcgctggtagtcccggctacttgggaggctgaggcaggagaatcactggaacccgggaggcggaggttgcagtgagccgagatcgcgccactgcattcmagcctgggcgactgagtgagaccaccctgtctcaaaaaaaaaaaaaaaaaggaaaagaaaacacggttagtcacaagttgccttgagtctgttgtgaata

SEQ ID NO: 19652 - DNA, 201 bp, Homo sapiens
cttcattactatattttctacattctgccttatgcttgatttaagcttttttcccttcttttcactggttagatttttttttcatttattttttcttctargtcgttgacctttttataggcatagaaaatgccttgtaccgtgcaccaaagttcttaaaattttaaaagctttctttgactaagtcatcccttgccctct

SEQ ID NO: 19653 - DNA, 201 bp, Homo sapiens
cagtgttgtatatgatatcattttattagattctaaactctttgtgagttagaactatttaattaaataaaaatagttgacatctcttataggaaaatcamtgtgtgaagtcccaaatgatataaaaaaagaaataaaacatagttcttatgctcatgattcttacctttgaaaccctccctcctcagccccacaaagcca

SEQ ID NO: 19654 - DNA, 201 bp, Homo sapiens
tggggatttccatacctgggtttgccaaagccagtaggaaacatggggaaaccccatctctaccaaaatacaaaaattagccaggtgtggtggtgggcgcyggtagtcccggctacttgggaggctgaggcaggagaatcactggaacccgggaggcggaggttgcagtgagccgagatcgcgccactgcattcaagcctg

SEQ ID NO: 19655 - DNA, 201 bp, Homo sapiens
tcctgcccttggttgccgaggaacccgaacattctgaatttgctatgcctctgctgggactcagtgggctttatcagtttctgaacagtttttgctttaawttattgggactgggtactcaattcacaggggtaatatgaatttggaaactgcactcattcatgggtttctaattccctttgtggatgtttttcctcaatg

SEQ ID NO: 19656 - DNA, 201 bp, Homo sapiens
tagaattttcaagatggacgcagtaaacactggccagtcttctgactcagtgaaataattggtttcctggggatttccatacctgggtttgccaaagccartaggaaacatggggaaaccccatctctaccaaaatacaaaaattagccaggtgtggtggtgggcgctggtagtcccggctacttgggaggctgaggcagg

SEQ ID NO: 19657 - DNA, 201 bp, Homo sapiens
attaaataagctgagcaaggtcatatttcataaaatgcaagcattctaaaccctatgtggagaaagaatcttatctatcccaaagtgaattgtctactttrtgtagatctatggcatcagtttaacttatgttgccttcttagccctgtgtaacaggttctattgctagttggtatttgttcacaagataaaaattaattt

SEQ ID NO: 19658 - DNA, 201 bp, Homo sapiens
tttccggttttttgctgcctcaaacaatgctttgatgtgtatatatatgtatatataaaatatcatctttgggcacaatacaggtatattcgaatttcctrttggtgaaattgctaagtccaaatatatgtgcatttttaattatgaaatgcattgccaaatggctcagcgaagagattatataaattaatcaattacact

SEQ ID NO: 19659 - DNA, 201 bp, Homo sapiens
ttgtacattgctgcacataagtcccatggaaacttattatgttataaacaacaagagacactcttagaagggaatacttggctcctttccagtagagttcygaattctggagaaacattcgactgcatgttttctagcaatgagatattcgattcagtccttgagtgtatgtgggtttcagttttgtttgagttgtggctt

SEQ ID NO: 19660 - DNA, 201 bp, Homo sapiens
ctcaaattaactggaaagaacaaggactggttcataggcaggactttagattttttttgctgtaagtgattttttctctctttttaaaaatgaggttacayaatattaattaataagcaaatcagagtatgctaagcatttaatatgtatgatcttgtttaaaccttttaacagcccaggaaaattggttttattattcct

SEQ ID NO: 19661 - DNA, 201 bp, Homo sapiens
tgtttgttctataatttctgagctcattttatgtaaaaataactcctgtgcattattcatgttgacaggccctttaaatagccataaagcctgtgggaacrgattaatgctgcatctgccctgtgctttttaagtctatcatttttatggaatggaaatcttgcataatgtcagaagttttctgacattgtcaactgcttg

SEQ ID NO: 19662 - DNA, 201 bp, Homo sapiens
aatgtggccagtcacactggaaaagtttattttagattgtcccactttgtgacatgcactaggatcttttcatgtggagagttcattttttccctatgaaraaagagattcaattagtttattcattttgtaggtaattttgagggcattggggaaaacagaagtaggtggtccctcgaagcaacttgtacaataaaatat

SEQ ID NO: 19663 - DNA, 201 bp, Homo sapiens
cggattctaatttctccagtcaccacaacaccaaacagggccttgcatgggtcagagtgttcaaaataccatttattgacaaatgcatcaaaatcaacaamaaaccagaatatagtcccaaaagagaaatccaccaagtaccataactgaccaaataatgactcaaattaactggaaagaacaaggactggttcataggca

SEQ ID NO: 19664 - DNA, 201 bp, Homo sapiens
atgtcatctagagttcccaacatttttaccatcctgcaatagcagtcataggagaatatgcctcaatcaaaatcaggctaaaaatttgtttcaattctgcrtgtgagctgggaccttaagtctttctggtcgctatttggtaggggaccaaatgtggccagtcacactggaaaagtttattttagattgtcccactttgtg

SEQ ID NO: 19665 - DNA, 201 bp, Homo sapiens
gctgtgtctccccagtgaatgtcatctattgtatgtccaatggaggaagtgttgagagcttctgcccaaaataaggataatactaaaggtattggcagatkctacaaggctcaatttttaagtctcatgtccttcataaagtatttcccatattaccttaaggctacaatacagtcttcattttcagcatccacagtccat

SEQ ID NO: 19666 - DNA, 201 bp, Homo sapiens
aaactacacatgaaacctcattcaaagtgtgactttgctagcagtttactcaacaatgggcatgtcatctagagttcccaacatttttaccatcctgcaayagcagtcataggagaatatgcctcaatcaaaatcaggctaaaaatttgtttcaattctgcatgtgagctgggaccttaagtctttctggtcgctatttgg

SEQ ID NO: 19667 - DNA, 201 bp, Homo sapiens
ccatctgtgaaattagccgtagattatgaaaacagagtatgtgagaattgtaatccctctattgtaatctatggctaattcatgaaagtaaatgtgtgatmatttaatttttatatattagagcagattcaaagttgagattcatgttttctatcacatctacatacttacatatatacctgtagattgtgtagggaagag

SEQ ID NO: 19668 - DNA, 201 bp, Homo sapiens
ttctggctcaatttagagcaaactacacatgaaacctcattcaaagtgtgactttgctagcagtttactcaacaatgggcatgtcatctagagttcccaasatttttaccatcctgcaatagcagtcataggagaatatgcctcaatcaaaatcaggctaaaaatttgtttcaattctgcatgtgagctgggaccttaagt

SEQ ID NO: 19669 - DNA, 201 bp, Homo sapiens
gatcttctgaatcagaatttgcatcttaacaaaatccccagagattttgtatgtacattaccttgtcacttttaatgtgcatccatctgtgaaattagccrtagattatgaaaacagagtatgtgagaattgtaatccctctattgtaatctatggctaattcatgaaagtaaatgtgtgataatttaatttttatatatt

SEQ ID NO: 19670 - DNA, 201 bp, Homo sapiens
cacattatctttctcagggatgttccatgctgagaaaaagaattcagcgatatttctcccatttgcttttgaaagaagagaaatatggctctgttctgccyggctcaccagcggtcagagtttaaggttatctctcttgtttcctaaacattgctgttgtcttggtcttttttcaaggtgccccagatttcatattgttta

SEQ ID NO: 19671 - DNA, 201 bp, Homo sapiens
ttaaaaaggaaatgcatgttaggaactgtgcttggtaaatcacatggtctctagtttctgtctttcctcttttattgattcagtatttggatctacttagyattttgcctacctcgtccttgactcctccaaccttcctttctggcaacttagcaaccctcattctgcccttcacccaacagccttatcaacactttgaat

SEQ ID NO: 19672 - DNA, 201 bp, Homo sapiens
cagggcattggaacaattttaattccactggtccctcatcagtttatttttgaaatttaatctaatagacttttaaacacataagacattattctatgttwtgatcatggttcatttagatatgtctacatattcacatattctttgtgaaacgttttttcttgtatcttctgcccatttgggatcatcatcttgtacttc

SEQ ID NO: 19673 - DNA, 201 bp, Homo sapiens
tgggagcactatgggagactggagtctattgcatctctgcagcctcaacagtaagagacagctatgcccggggggccagtttagagacccacccgcaggcrcacattatctttctcagggatgttccatgctgagaaaaagaattcagcgatatttctcccatttgcttttgaaagaagagaaatatggctctgttctgcc

SEQ ID NO: 19674 - DNA, 201 bp, Homo sapiens
tatgtctttgttatttgcatatcaaaattccttatggattgattgatttattgattttctagattatttcaggtcagtttctttctgataagaaagttggracttacgtggaagtagatatgtttggtttgcctgtggatacaaggaggaaggcatttaagaccaaaacatcccaaggaaatgctgtgaatcctgtctggg

SEQ ID NO: 19675 - DNA, 201 bp, Homo sapiens
aacagaactttgtacaggagatactcttattgtggtccaaatctggagggttctattagatgaagttcatccaaacatagaacttagattaagggagtagmtgtatactccacagccaatccttcacaaaactcatttgtctccattgggttttttataagctctggaaaacaaacaaacaaaagagatatttaataagtt

SEQ ID NO: 19676 - DNA, 201 bp, Homo sapiens
gaaaagggtggccccaggagagggagaaagataagggaacagctggccaatggagcagtcagtacccacacaacatttattcattaaattcaacatcttayataggtgcagttcctgatgctccaaaacaattacaatggtaatatcaaagatcactgatcacagatcaccataacagatatattaattattcaaatgttg

SEQ ID NO: 19677 - DNA, 201 bp, Homo sapiens
ttcgcttatgaagcttagtttggctggatatgaaattctgggttgaaaagtgttttctttaagaatgttgaatattggcccccaatctcttctggcttatrgggtttctactgagaggtctgctgttggtctgatgcgcttccctttgtaggtgacctggcctttctctctggctgctcttaacattttttcctacatttt

SEQ ID NO: 19678 - DNA, 201 bp, Homo sapiens
ttcttcatagtgtcattcgtctttatattttggtgtgtttttgcaatggctggttttcctttccatatttagtgcttccttcaggagctcttgcaagtcargcctggactaaatccctcagcatttgcttgtctggaaaggcttttatttctccttcgcttatgaagcttagtttggctggatatgaaattctgggttgaa

SEQ ID NO: 19679 - DNA, 201 bp, Homo sapiens
ttatcatcaaagaaatagaggggaaatagcaactgggtagacaggttacatacagtgtacgttacagccatgtttataacaattttttgtttcttcctttytggccccttggaaagagatctgaagtgtttctatgaatttttagtagttctattgtctgcgttttttattgtaaataggtaccatgatgaattcctctgt

SEQ ID NO: 19680 - DNA, 201 bp, Homo sapiens
tcattttgagacagcatctcactctgtcacccaggctggagtgcagtggcaccatcttggctcacttcaacctccgcctcccaggttcaagtgattcttgygcctcagcctcccaggcagctggggctacaggcaccagccaccacacgcagccagtttttttttatttttagtagagatgggatttcaccatgttggcca

SEQ ID NO: 19681 - DNA, 201 bp, Homo sapiens
tcatgggtagcaccaagggataagctctttctctggaagaatagtacatttctttctattaaaaaaacatgaattagtcaacccattatgtgtttgtttttgcccttattaccagaaaactacaagatgattttcaatcacagtgaggattagtttctgtgactaacatgtttctttctttctcattcttatgagtttgat

SEQ ID NO: 19682 - DNA, 201 bp, Homo sapiens
gcatttgctgaggagtgttttacttccaattatgtagttgattttagagtaaatgccatgtgatactgagaagaatgtatattctgttgatttgggttggwgagttctgtagatatctgttaggtcccgttgatccagagctgagttcaagtcctgaatatacttgtaaattttctgtctcattgatctgtctaatattga

SEQ ID NO: 19683 - DNA, 201 bp, Homo sapiens
aatgttaactattttacttacagataaaatgtgaatgtaaaatcattaatgtgtttaaattatataactctcagtatcagtaacccatacaaagattttcwtgttactgctctaggtcatcatgattaaaatcaacctcagtaaatgtggaagcacccttaaacttcttccctggatataactggacatgaaaagaactaa

SEQ ID NO: 19684 - DNA, 201 bp, Homo sapiens
tacttatgtattcattttgagacagcatctcactctgtcacccaggctggagtgcagtggcaccatcttggctcacttcaacctccgcctcccaggttcawgtgattcttgcgcctcagcctcccaggcagctggggctacaggcaccagccaccacacgcagccagtttttttttatttttagtagagatgggatttcac

SEQ ID NO: 19685 - DNA, 201 bp, Homo sapiens
agacatttatttaatatttttaatttctaagtttttagggttggcaatatagattctcaagcaagaattaataattacttagatatggtgctaattcttaygtttctcctataaacatataatgtagatcttctcagccaccctctcaggttgattatgcactaataaagtggaataaattttaacataatttcagaaatt

SEQ ID NO: 19686 - DNA, 201 bp, Homo sapiens
tcttccaagtatgacagacacaaagaaaagcctgtgatgatttagaaatgtgctgggctaattgcagctggttgagggtcctcgttgttttccataaaacygtattgtattatgaagaggacagcaggtcaataaccctgggccatgggacccctcttcagcatcacttttcagtaaaagacaattcccgattattttgtg

SEQ ID NO: 19687 - DNA, 201 bp, Homo sapiens
aataattattttatggttctatatttccttgtttattagcaatttactaggttggttataacccaagagatttttttctttttcttttaagctatgatttytccttattccagttttccatttgcttgttcttttttatggtatccgattctttacagaagtattctgattaaattagactgtacttaatggaaaacagaa

SEQ ID NO: 19688 - DNA, 201 bp, Homo sapiens
gcaacaacagcccccatgacttgagtctctctaataaaaaaagaaaagaaaaaatctgaggacaactgtaagggtagtcagggttttcattttttttttttctgtgacagagtctcactctgttgcccaggctggaatccagtggtgcaatctcggctcactgcaacctctgtctcccgggttcaagcgattcacctgcct

SEQ ID NO: 19689 - DNA, 201 bp, Homo sapiens
agtaacagttgattggggctctgctttaaaattatcttatgttcattgtttggttaaaattaattgtcttatgaatattaactttgaatgaactgagtatytgtagatcaaatactttgaggttaccaaatggcatctcagttttagaacattccttccattttgattcatcactgaatagttttctgtttgtggaaattg

SEQ ID NO: 19690 - DNA, 201 bp, Homo sapiens
cacttaattaattttaatgttactattattatagtaaataattattttatggttctatatttccttgtttattagcaatttactaggttggttataacccragagatttttttctttttcttttaagctatgatttctccttattccagttttccatttgcttgttcttttttatggtatccgattctttacagaagtatt

SEQ ID NO: 19691 - DNA, 201 bp, Homo sapiens
cattttctttttccagcttattcaaaagttgacggatgtcgcagaagagtgtcagaacaatcagttaaagaagctcaaagaaatctgtgagaagtaagccytcattcccattacaattgacatgtgcatctgaatttattcaacacaaattcccatctgatttgcctcttttttctcttttacttccattgtgacttcaga

SEQ ID NO: 19692 - DNA, 201 bp, Homo sapiens
ttccactacttctcaattgccttataccagatctcattcacagatttgtgttgcttcttgagccccatagatatttgagttcagagattctgaaattaatrtacatgtattaagttaatacatgtaaggtcctaggaacagtgcctgccacacaataagcacttaattaattttaatgttactattattatagtaaataat

SEQ ID NO: 19693 - DNA, 201 bp, Homo sapiens
gactagtcaactcagcttgccttatatgtttttgggaaagagaatctccatctgtgggaaaagcagtgggggctttcagaggatgtccacactgtctattkggtgctccagtaagaagggttgagtccagttgctacagccacctgaaaaccttgcagaaggttctccaggttcctcatgaggaaaaaaggaaaagattac

SEQ ID NO: 19694 - DNA, 201 bp, Homo sapiens
tgatgagaggaaggggaggtgagtgaccctgggcctaacagagagctaggctattcctatgataccaggaacaactttgagcaatgattttgccagctacyggcactttatttcagtcatatttaattagagacacagagccactaatcaagattggttaccggatttgaccttatgcaattgtggaagctattaaacagt

SEQ ID NO: 19695 - DNA, 201 bp, Homo sapiens
aggacggctaaccactcttgaaatatacatttataaaaagaaaaagaaaaaccaaaactaattttaggtgatcgggagaaggatgttctccagggacatarctgagttcattctaggacatttgattcagcctgtcccttgttttgtaaatgccatgcacaggctttgagtcgagaaagtggttgtagctagggctcaagt

SEQ ID NO: 19696 - DNA, 201 bp, Homo sapiens
tggtattatgatttgtcttgtcactattacagctgccacttatagaagactagtcaactcagcttgccttatatgtttttgggaaagagaatctccatctrtgggaaaagcagtgggggctttcagaggatgtccacactgtctatttggtgctccagtaagaagggttgagtccagttgctacagccacctgaaaacctt

SEQ ID NO: 19697 - DNA, 201 bp, Homo sapiens
ctaggacggctaaccactcttgaaatatacatttataaaaagaaaaagaaaaaccaaaactaattttaggtgatcgggagaaggatgttctccagggacayaactgagttcattctaggacatttgattcagcctgtcccttgttttgtaaatgccatgcacaggctttgagtcgagaaagtggttgtagctagggctcaa

SEQ ID NO: 19698 - DNA, 201 bp, Homo sapiens
aggatggtccaaataacctaatcagccattaccagaaatagaaagtccccacattgcatttctgaaatatttgaattagttaacatctgtatcagtcaggkttcaactagaaaaacagagccagtaaaagattgtgtgtgtgtgtgacagtaattggcttatgcaattttggtggatggctatctgccccgttctcaatgc

SEQ ID NO: 19699 - DNA, 201 bp, Homo sapiens
tcctgacctcaagcgatccacctgcctcggcctcccaaagtgctggaattaaagtgtgagccactgtgcccagccacatgtgaatcttttaaaactaggcytgacatatagaaattatcagttaaagtgttgtaggaccctatccttagttcagctaaagacgggttccttgtcacatggccacaaaaagttaggcttgaa

SEQ ID NO: 19700 - DNA, 201 bp, Homo sapiens
tgtaaccacccagctcctgtcactcgtttgccttttgatctggccctgcctcagtttgctctccctgagaaatcccatcattgttttcagcttcaccttgrggggagaattcaagcacaacaagcaggcttctcaaaatgcctgtgaggccaagaaacaaatgtctagtttcctttcagataaaattgtaaatactcaccc

SEQ ID NO: 19701 - DNA, 201 bp, Homo sapiens
actaaaaatacaaaaaattagccgggcgtggtggcaggtgtctgtaatcccagctactcaggaggctgaggctgagatgagataggagaatcccttgaacmcggaaggtgatgttgcagtgagccaaggttgcaccattgcactccagcctgggcaacaagagcaaaactccatctcaaaaaaaaaaaaaaaaaaaaaaag

SEQ ID NO: 19702 - DNA, 201 bp, Homo sapiens
tagtgagaggacactttcagctaaatagagacgttgcaggagaccccaaggaaatggccagagtctttgcacactggaattttacatctagacagcttgayaaatggcatgactacaaagtaatgcctcatgatttctttaattgtgataatcatgattaggcaatcccttttgaatgatcaaataggctttctgctggcc

SEQ ID NO: 19703 - DNA, 201 bp, Homo sapiens
tttctggattcttttgaaaaatcaaaagaataatctagttagtagaactagttagtagaactagttagtagtaatctagttagaagaacgggtgtctgctstctgtaaccacccagctcctgtcactcgtttgccttttgatctggccctgcctcagtttgctctccctgagaaatcccatcattgttttcagcttcacct

SEQ ID NO: 19704 - DNA, 201 bp, Homo sapiens
aggataatgttttctattatgatagaagattggccccaagagtagtcatcacataaatagttggaattttacattttttaatttgtgagtgcaaatcttcwttggtgaaaaaatatattccttgttatcagctagaccttaataggtgaagctaagtaggtgagttatacttttaactgtggtaacccattttttaaatag

SEQ ID NO: 19705 - DNA, 201 bp, Homo sapiens
ttactacaaattaaattatataaactttcaatgaaataaatttattcaaaacaaatgtaacaaatactcataactcatcatttaccaattttttcctagarctttgttgaagcactttttaaattttttttaagacagggtctcactgtgtttcctggctggaatgcagtgaagcgatcatggctcactgcagcctcaatt

SEQ ID NO: 19706 - DNA, 201 bp, Homo sapiens
actgtgtttcctggctggaatgcagtgaagcgatcatggctcactgcagcctcaatttcccgaggtcagttcaatggatcctcccacatcagcttcccacrtagctgagaatacaggcttaccaccacacttggctgatttttttttatttttagttttgtagaggtggagttttgccatgttgcccaggctgatcttaaa

SEQ ID NO: 19707 - DNA, 201 bp, Homo sapiens
ctcacttacaaataatttaatacctctcactattgccggtgctctcactattgctggtgctctctaggtactttgcatctttacatctactacgcaccatsggtagtggtggctctgacagtctgctactgtacacctcctcccaacgccttattcaaggtcacgactttgttactttgagactggctctgggcaagtatt

SEQ ID NO: 19708 - DNA, 201 bp, Homo sapiens
cagcaatgtccacgctcattaaggctgtatttctggattttcctttgcaatgggcttccatgttagatcttcactacatccaatttcagaaaaaaaaaaaagttttgagaaaagttctccatgtgagagcacttctgtgctgtttttgaaacttccttctcatttttctggtatcttccagcaggcaatggggaaacctgc

SEQ ID NO: 19709 - DNA, 201 bp, Homo sapiens
caaaagcatactttgtttgtaacttaaatgtttatacatccaatcttcttataaagtttgaatttttttaagataactatactagacttaatgttgtggtrggtttgtgactgtccttgattttagtcctcaaatatctatagcagcagcagtttgtatctgaaattattacaaggggatttgcctattagaaatatgcct

SEQ ID NO: 19710 - DNA, 201 bp, Homo sapiens
tagtggcatactatttaatattaacaaaatcataatattaattattctgtctcctggaggttcagtagacaaaatttaaataaaaatagtaaatgccgtgygggcagaacttcagtaggagtgagggtcttctgaaaactagctgaggtcgggctcggtggctcacacctgtaatcccagcactttgggagactgagaagg

SEQ ID NO: 19711 - DNA, 201 bp, Homo sapiens
tgtaaatttctaatttaaggcaacactgacaaattagaaggtttaacacaaaatccagatttctggattcttttgaaaaatcaaaagaataatctagttartagaactagttagtagaactagttagtagtaatctagttagaagaacgggtgtctgctgtctgtaaccacccagctcctgtcactcgtttgccttttgat

SEQ ID NO: 19712 - DNA, 201 bp, Homo sapiens
gtagtggcatactatttaatattaacaaaatcataatattaattattctgtctcctggaggttcagtagacaaaatttaaataaaaatagtaaatgccgtrtgggcagaacttcagtaggagtgagggtcttctgaaaactagctgaggtcgggctcggtggctcacacctgtaatcccagcactttgggagactgagaag

SEQ ID NO: 19713 - DNA, 201 bp, Homo sapiens
ttattcaagaataggatcaaaaatttacctgggggtaaggaaagtgtcttcctcttcccagtgatagttgccttgttaaagactttagacaccagcgcaaygtggttaagtctccactagtgcaacaaagaaaaggatagaggccagtccctgaatagggaggccccagcagactttcagatggttaactatcaagtccaa

SEQ ID NO: 19714 - DNA, 201 bp, Homo sapiens
gtatatcacataagaaagggggctgtccaaactctgcccctgcttttctctgcatattagtgttattcttttccaaagtagcaagacaggcttccccttgrtagaaaatacaggcactgatcccttctgagttttatttctccattgacatgtaggaaaaatcttggggaaaaccttgtttgggtcccatgatgaccaagt

SEQ ID NO: 19715 - DNA, 201 bp, Homo sapiens
acgtgacgaagaaggaaatgggaaaagagggagatgtccaatattctctagcagatgccttttattcaagaataggatcaaaaatttacctgggggtaagraaagtgtcttcctcttcccagtgatagttgccttgttaaagactttagacaccagcgcaatgtggttaagtctccactagtgcaacaaagaaaaggatag

SEQ ID NO: 19716 - DNA, 201 bp, Homo sapiens
acttttcattggcaagaatttttcaaatggctatgcctggattaaaaagtggtagggaggacttgtaaacattgtccttggatttggcagctgcacccagrcacagcagacaccgtggacaggtgcctgcaaattttgaggataccgacttattttctgcaatgtagaccaaaatactggaatccaaacctgctaaatgta

SEQ ID NO: 19717 - DNA, 201 bp, Homo sapiens
ccaagtctagctttgttgcccaggctggagggcagtggtacaaacttggtgcactgcagcctccatctcctgggctttagtggtcctcctacctcagcctyccaagtagctgggactacaggcacgcaccaccatgcccagctaattttctctattttttaagagacaggtctcactatgttgcccaggttggtctcaaac

SEQ ID NO: 19718 - DNA, 201 bp, Homo sapiens
tggctccatcatcccctaggatcttgctggaaaggggaaagaaatagtagagattccccatatgtccccaaaaagccctgccctaacttttcattggcaaraatttttcaaatggctatgcctggattaaaaagtggtagggaggacttgtaaacattgtccttggatttggcagctgcacccaggcacagcagacaccgt

SEQ ID NO: 19719 - DNA, 201 bp, Homo sapiens
ttgtttttgtttttttagagaccaagtctagctttgttgcccaggctggagggcagtggtacaaacttggtgcactgcagcctccatctcctgggctttaktggtcctcctacctcagcctcccaagtagctgggactacaggcacgcaccaccatgcccagctaattttctctattttttaagagacaggtctcactatg

SEQ ID NO: 19720 - DNA, 201 bp, Homo sapiens
gtgtttccagttgatgaacagtttatctcatcatggcaattcagagaaccaggttcctttcataatgtggctccatcatcccctaggatcttgctggaaargggaaagaaatagtagagattccccatatgtccccaaaaagccctgccctaacttttcattggcaagaatttttcaaatggctatgcctggattaaaaag

SEQ ID NO: 19721 - DNA, 201 bp, Homo sapiens
ttgaactcatagtttcacatggctggggaggcctcataatcatggcagaaagcaaggaggagcaagtcacgtctgacgtggatggcggcaggcaaagagarcttgtgcagggaaactccccaatataatactattagatcttgtgagacttattcgctatcacaagaacagcacaggaaagacccacccccataattcaat

SEQ ID NO: 19722 - DNA, 201 bp, Homo sapiens
gaaagtaaaagttcccctgggctttataacactagctctttctttctcatagttataaggtagttataaagtactcaagatttatagttaggattattctstaattctactttaacttcagaataaccaaaaaggcccccagaaatttaagaggccatccttatggcataaacattggctaataaagattaatcataaata

SEQ ID NO: 19723 - DNA, 201 bp, Homo sapiens
aacattgatggaaagtaaaagttcccctgggctttataacactagctctttctttctcatagttataaggtagttataaagtactcaagatttatagttargattattctctaattctactttaacttcagaataaccaaaaaggcccccagaaatttaagaggccatccttatggcataaacattggctaataaagatta

SEQ ID NO: 19724 - DNA, 201 bp, Homo sapiens
gataaacattgatggaaagtaaaagttcccctgggctttataacactagctctttctttctcatagttataaggtagttataaagtactcaagatttatarttaggattattctctaattctactttaacttcagaataaccaaaaaggcccccagaaatttaagaggccatccttatggcataaacattggctaataaag

SEQ ID NO: 19725 - DNA, 201 bp, Homo sapiens
cttctcaaagctctttctgctaaaatgctatagttatatgtggtcgtagaaataaaagagaagccaaacactcaagtgggcactgcttcccattttttgamtaatgagagattattcaaaatcttgatattgagttcttactacctacccaagcactgagctgtcttctgtaatcatccacaatatctatgatgtcagctc

SEQ ID NO: 19726 - DNA, 201 bp, Homo sapiens
tgttatgtaacaagggcgatgagatttagttacatgtttttgtgacatgttgtagtattaatgttagtcaactctttcaacaataattatgtgtaacaaayaatctgaaaacttatatgcaaatatttatcttcgtgctcataggtctgtgggttggccgggtttggctaatctagcctgggctccgcagcatagctgtgc

SEQ ID NO: 19727 - DNA, 201 bp, Homo sapiens
actcaagtgggcactgcttcccattttttgactaatgagagattattcaaaatcttgatattgagttcttactacctacccaagcactgagctgtcttctrtaatcatccacaatatctatgatgtcagctccatcattatcattttatgtaaggaaactgagatgcagactggccactggctcaagctcatacaactatt

SEQ ID NO: 19728 - DNA, 201 bp, Homo sapiens
ttcagaccgcaagctctgggcagatacagatcagctatgaatggacgagcccaccaggacaagcaatcaggtgctgagtggggggtctagggtcatatgtsctcatttcaggccactgctcctccaccaagtcactgcatgaccacctgaatgtcaattttctcacctgttcaatggagataaaaatatctcttacctcat

SEQ ID NO: 19729 - DNA, 201 bp, Homo sapiens
cagccccagaaagctaaaaagttgtgtttcagaccgcaagctctgggcagatacagatcagctatgaatggacgagcccaccaggacaagcaatcaggtgytgagtggggggtctagggtcatatgtcctcatttcaggccactgctcctccaccaagtcactgcatgaccacctgaatgtcaattttctcacctgttcaa

SEQ ID NO: 19730 - DNA, 201 bp, Homo sapiens
ctcgcgttcttcttacaatcctcatgtctgtcccaccagcaatcatttcaggaccccaaaccaacgttagtaccatcaaactgagttcagccccagaaagytaaaaagttgtgtttcagaccgcaagctctgggcagatacagatcagctatgaatggacgagcccaccaggacaagcaatcaggtgctgagtggggggtc

SEQ ID NO: 19731 - DNA, 201 bp, Homo sapiens
agcgtgtgcagcttcctgaagtagaattcccaatgtatgcatccatcaacagtgacctagagttctcattctgagaatgaatatataagcaaacaataagyaaaatatggttagttctcagaaacatgctattgagtgaaagaagccaaacacaagagtatgattccttcatgtaaggtgcaaaaacaggcaaaagtaatc

SEQ ID NO: 19732 - DNA, 201 bp, Homo sapiens
cgtctataccattagggtgaggttttaattttaaaagtgactttggtgaggcgtggaaattcttagggatttacctgagggtccccaatcactctgggtaytcagctctaccatcacattctactaaacacccacagcccagtgagcagggatttcgttgtaatgttaaggagtttttgcttctcagccacagatgtgctc

SEQ ID NO: 19733 - DNA, 201 bp, Homo sapiens
tttcaccttatatgactagctcgtgttattatttaactttgccttggctcactaattttattttcagtttctaacctttaagaggtaacagttttatactrttcaagactccccaaaccaaataccacagagccatttgtttacattagtaggtccccaataaatattcattagttatttcactgattaattaaagtaatc

SEQ ID NO: 19734 - DNA, 201 bp, Homo sapiens
attaactcagagacaagtcctaccacagtgattcacagttcctgaattcaaaacactgtgcatatcactgatttggcatttcaccttatatgactagctcrtgttattatttaactttgccttggctcactaattttattttcagtttctaacctttaagaggtaacagttttatactgttcaagactccccaaaccaaat

SEQ ID NO: 19735 - DNA, 201 bp, Homo sapiens
agaatagctcccaagggcctactgaagaaaagctttgtgcttaagacactggcaataagttcatttccatatggtgtaacttgaagctttggttttatagrttaactcagagacaagtcctaccacagtgattcacagttcctgaattcaaaacactgtgcatatcactgatttggcatttcaccttatatgactagctcg

SEQ ID NO: 19736 - DNA, 201 bp, Homo sapiens
tggggattaaataccaacgtgctttggttaaggattatgcatttcaaatgccacatccacagttcgagagttaagaaagaaagcatggcatccgtaaactycctgtcagatgtttactgaaaacttagtatttgcacaacattctgatagacactggagacgaaaatgaataaaacacgatcaccacacacactcagggga

SEQ ID NO: 19737 - DNA, 201 bp, Homo sapiens
ttatctatcccaaagtgaattgtctactttgtgtagatctatggcatcagtttaacttatgttgccttcttagccctgtgtaacaggttctattgctagtkggtatttgttcacaagataaaaattaattttaatattattttgaagcaaatataattatttaggaaaatctacccaaaatataggcatgcaccaaactcc

SEQ ID NO: 19738 - DNA, 201 bp, Homo sapiens
tagtagtcattgttatttgataactattacagaatagctcccaagggcctactgaagaaaagctttgtgcttaagacactggcaataagttcatttccatrtggtgtaacttgaagctttggttttatagattaactcagagacaagtcctaccacagtgattcacagttcctgaattcaaaacactgtgcatatcactga

SEQ ID NO: 19739 - DNA, 201 bp, Homo sapiens
acaggcctcccaggctaaattagacaaaccgaagtgtaattaaaaagtaagccccaggttaaaagaagtatttgggtgatgaggaaaattaagccgacagyatttcatctcccaaaattgctttggggattaaataccaacgtgctttggttaaggattatgcatttcaaatgccacatccacagttcgagagttaagaaa

SEQ ID NO: 19740 - DNA, 201 bp, Homo sapiens
ttgctagttggtatttgttcacaagataaaaattaattttaatattattttgaagcaaatataattatttaggaaaatctacccaaaatataggcatgcaycaaactccagcacccaataaaaagcagcagtaattgatttccattgtgaatggcctgtattcttctacattggcatggactatccagtttacttctgttt

SEQ ID NO: 19741 - DNA, 201 bp, Homo sapiens
agattattataagtaattggagactgtggagtcagaataactgagtttgaattctgacttcatcatttaccagctgtgttgcttaaccataaaatgctcayaatatttactccagcgaataatgggagaattcacagaggtaatccttgcagataatccctgctaatcatttaacctagtgccaggatatagtaaatgctc

SEQ ID NO: 19742 - DNA, 201 bp, Homo sapiens
tgaacaggcctcccaggctaaattagacaaaccgaagtgtaattaaaaagtaagccccaggttaaaagaagtatttgggtgatgaggaaaattaagccgayagtatttcatctcccaaaattgctttggggattaaataccaacgtgctttggttaaggattatgcatttcaaatgccacatccacagttcgagagttaag

SEQ ID NO: 19743 - DNA, 201 bp, Homo sapiens
ataatattgaaactatttctggatatattaatataaagcaaataaataaatatgctaatgctatctgaaagcaacctttttaggaaacgtatgcttcagtstttatgggtgaaatgtcatgatgcctgaaacattttcaaatgactcagcaaaaaatatagagatagacaatacataatgcatatgtggcaaaacattgaa

SEQ ID NO: 19744 - DNA, 201 bp, Homo sapiens
ggagtcattgagagaatataaatatgtgggctttttgttaaagcctgataggagaagagattattataagtaattggagactgtggagtcagaataactgmgtttgaattctgacttcatcatttaccagctgtgttgcttaaccataaaatgctcacaatatttactccagcgaataatgggagaattcacagaggtaat

SEQ ID NO: 19745 - DNA, 201 bp, Homo sapiens
ttaaccagatgaatacattggaggaaagatattctggtaggaacactgtgagtaaacaactgtaggactttgggagggattgtgagtagagtgtgcaagayggaaagtacgttggcattataatgattcatcatcaacaacaccatgtttgcttgcctggttgaatgtccctgagtacaccagctgacatggatgccagaa

SEQ ID NO: 19746 - DNA, 201 bp, Homo sapiens
ttaaaatgttaaaaagcattggtttaggtatttgacattttcttgtattttacttcttttgttaataattaaagaaatagtacttatcaagcactatgggrtcttgtccaccaatgagcattaacctgagagaaattatctgctaggtcaggtacaatatatccatagctgaaggtcccccagttcaacctataagagaac

SEQ ID NO: 19747 - DNA, 201 bp, Homo sapiens
gagaagataacagaagctaaatccaaagacaaaagtcagatggaagagtaagtcaaaagtgtcccctctcccaaacagttcatctgggaattattttattytgtacgtcagagtcacaggttcataaccagtcaaagactccttcgtgaagtttctcctctagtcagcctttcaaaagattcttttggtaaggtttttaac

SEQ ID NO: 19748 - DNA, 201 bp, Homo sapiens
ggaaggcaagaaaagaataaaaagaaatgtggaaaatgaaaggatatttataattttaggctgatcctggagaaacaccatcagaggctccaagtgaagcragaacgactccagcagaaaatggggtgaatcacactacaaccctgacacccaagccaccctcccaggctctccacagccagccagctccaggtaagccat

SEQ ID NO: 19749 - DNA, 201 bp, Homo sapiens
taatgtcctttatgatgcagaatttatctgatactttgagttaaatcaggcttgctttttggctcataagtatttatgtatagacagaaattgtggcttttatctatttttattaagtaaaattgtgactgattttatagcaattaagatgaatttttctttgcagacaaattttattgaaggaatattgacaatcaactt

SEQ ID NO: 19750 - DNA, 201 bp, Homo sapiens
atataaaagcttccactaactttccattctagggagtcattgagagaatataaatatgtgggctttttgttaaagcctgataggagaagagattattatawgtaattggagactgtggagtcagaataactgagtttgaattctgacttcatcatttaccagctgtgttgcttaaccataaaatgctcacaatatttactc

SEQ ID NO: 19751 - DNA, 201 bp, Homo sapiens
tttttttgatctttgaaatgttatagatgaaaaattgggagctctttattacttaaatttgaatttcttctactgtgagtggagaggaaacttttcatattgtgttgtttgtatttctaaccatatcctttgcccattttccaatatatagttcttctcactgtttcgtaagatattttgatatattaagagctatcatat

SEQ ID NO: 19752 - DNA, 201 bp, Homo sapiens
cctgggaaacatagtgaaaccctgtctctactaaaaatacaaaaattagccaggcatggtggtgggtgcctgtaatcccagctactctggaggctgaggtrtgagaatcgcttgaacccaggaggtggaggttgcagtgagccgagatcatgccattacacttcagcctgggtgacagagcaagactccatctcaaaaaaa

SEQ ID NO: 19753 - DNA, 201 bp, Homo sapiens
ttgcaagggtcttttgtatcaagtttgctattctctgattaaccaaagcaaatcacatggtctggtccagagtcagtgtggaagggcaccaccaacgggcwtagacataggttggtgtaaaaattggagactttaatacaattaacctcccatagtcatggctcaacactatgctgttttaaccctgctttccagggagta

SEQ ID NO: 19754 - DNA, 201 bp, Homo sapiens
tcttgttaatatgcaaattctcattcagtagatctggagtgggcctgaagtgatactactggtcctaggaccacactttgagtagcaaggctttctaaagktctgctctcccgcacagctgaattgaataacttttccttctagagatggcatcatggttagcttttgaaaaccttttggttttttttttaacttcagtct

SEQ ID NO: 19755 - DNA, 201 bp, Homo sapiens
agaccataaacaaaataagttggtaaaacatgtagtatgttaggtagtaataagggcttaggagaaaaacaataacagaaatgggagaataaggaggggcrgtttggggaaggatgatgaggatgcttggcgattttaaatagagtaggcacggaaaggtttacgcagaaggcaacatctgagttaagaggtgaagaactg

SEQ ID NO: 19756 - DNA, 201 bp, Homo sapiens
tttttcccaactcttgttcttagggtagtgttctcaaactctggcaatttgagtgtgcaaaaaaaaaaaaaaaaaaaattagagtagtggaagtgggacaratagttcctctttagcctcctgacatacctcttgtttggagggataagataatctctcagattgccacctgggcaaggaaactgggcaacacacttccaa

SEQ ID NO: 19757 - DNA, 201 bp, Homo sapiens
cctggaaggagtccatggactgatattttctagccaaagggagctaaaaatcagccattttgacatttggatttttcattgatgtgtcttgtttatttaaytcaatttaatatgaaagagtagagagggtagaacaaactgttcagcaacgtatagatcattaggttttaaaaccaaataaaaagtactcagtgtaaaaat

SEQ ID NO: 19758 - DNA, 201 bp, Homo sapiens
taatgcttactgaaatactttaaattcaagttctataagggaaaagtggattcttattctagaataacaaaacaattagaaattggcattttttaccaacycattatatcaaatattactctcaatactattctctgctttccaacaaccacctcccaagaaaaaactatttttccctaagacaatttttgtttgtttcat

SEQ ID NO: 19759 - DNA, 201 bp, Homo sapiens
aattccccaaatacagactgatgcaataataagtttaagagacagcaataatgaacaacaaagattgttgaatacatgagaaaatttgtttcaaattctaycctttggagataatcatcattaaagctggatgaactaaattttaacaaggaagttggcgagtaaccaaatctatatttaaaggctttcagcctaccaaat

SEQ ID NO: 19760 - DNA, 201 bp, Homo sapiens
ataataaaaattaaaatagtggccgcatattaagcattcaccatggggctatattctgtgctgagtcatttacaggaaacagcctatttaattctcacaayaaccattagagtttggtactattgtcagccccattttgcagataaaaaatgtatatagcaaaatttagtgactttcccaaggatccacaactggaaggtg

SEQ ID NO: 19761 - DNA, 201 bp, Homo sapiens
ctgaacataccctaatgctaggctcttaaaataggatcttgttttaaaaaggggttcagtagacaaagaaggccattccctttttcccaactcttgttctyagggtagtgttctcaaactctggcaatttgagtgtgcaaaaaaaaaaaaaaaaaaaattagagtagtggaagtgggacagatagttcctctttagcctcc

SEQ ID NO: 19762 - DNA, 201 bp, Homo sapiens
tgtttcctgatctgtaacattcagacaacaatagttcatagaactaatgactcagaagatgcaaatgtatctccatatgttaatactattgaaagtaatargaagatataggagaaaaaatcatcatactgaaattagtagaagtgatgaatggaggcagaagaaactagctggatattttcagtggaaaaactcatttta

SEQ ID NO: 19763 - DNA, 201 bp, Homo sapiens
aatggctgggcaggggttggatcaggcatagggagggattgccttgacagacctgagcaagtcaaagtaaattttaacgggcaataatggctttgagatcyggctataaccactgccttctgactttctccagcaactcatccccagtagtccagaacataataaaaattaaaatagtggccgcatattaagcattcacca

SEQ ID NO: 19764 - DNA, 201 bp, Homo sapiens
ctcacacacacacaccacggcctgctcttgttacaagcagttttggtaatgtggctcctgtgttcattatgaaatatttaggtatggacttgtcctcagtmatagcatctaaatatcacaaactcaggaaatctaaattgttctgacaagttacaagaataatttcaaagaacattttcttttggcagtagaccctgatgt

SEQ ID NO: 19765 - DNA, 201 bp, Homo sapiens
caatagttcatagaactaatgactcagaagatgcaaatgtatctccatatgttaatactattgaaagtaataggaagatataggagaaaaaatcatcataytgaaattagtagaagtgatgaatggaggcagaagaaactagctggatattttcagtggaaaaactcattttaaatcatgaataaccactgttagcaactt

SEQ ID NO: 19766 - DNA, 201 bp, Homo sapiens
accctgttcccaatactctgtctttctttccactgtttcctacaggtgataatacagagtacaaaattggaaggactcacaccataagttaatgataattrctttaatttattttgacattcaccctaaccttctaaatatttgtataattctctaagaacaatgcagagaaagtcatactgctaagaggaagcattcgaa

SEQ ID NO: 19767 - DNA, 201 bp, Homo sapiens
attaaaggtttagcagtcaaaacataaactaaatactgtttcatttgcactcacacacacacaccacggcctgctcttgttacaagcagttttggtaatgyggctcctgtgttcattatgaaatatttaggtatggacttgtcctcagtcatagcatctaaatatcacaaactcaggaaatctaaattgttctgacaagtt

SEQ ID NO: 19768 - DNA, 201 bp, Homo sapiens
ctcaaaaaaagaaagaaaagaaaagaaaaaagataattcaatgttaactatgtcatgccaagaggaaagtttccctcaacactgcagtgaggagccttatrgaatgtccgtcctcatttggcattgcacataaaaatgcaaaaagaaacttgagaaaattccgcatcccttatttgacaaaatctgattctaacaccagct

SEQ ID NO: 19769 - DNA, 201 bp, Homo sapiens
tttgaataagtttcataattttaagtatttgaattaaatttttatttaatttttattgttagctttacttgaggcctatttagccaatccttaactacccyaggatctgaaatagattaaaggtttagcagtcaaaacataaactaaatactgtttcatttgcactcacacacacacaccacggcctgctcttgttacaag

SEQ ID NO: 19770 - DNA, 201 bp, Homo sapiens
aagtatctgtgatacatgtaactgatgaagagcttgccaagacataaatgtaacttctaaaactatataggaaaatgacagataatgcactgggaaaaaaktagacaaagatttttgaccagtctattcataaaagaggatatcaaacagccaataaatgtataaaagtgttcaacatcatgaataataatgcaaattaat

SEQ ID NO: 19771 - DNA, 201 bp, Homo sapiens
atctcaaaaaaagaaagaaaagaaaagaaaaaagataattcaatgttaactatgtcatgccaagaggaaagtttccctcaacactgcagtgaggagccttwtagaatgtccgtcctcatttggcattgcacataaaaatgcaaaaagaaacttgagaaaattccgcatcccttatttgacaaaatctgattctaacaccag

SEQ ID NO: 19772 - DNA, 201 bp, Homo sapiens
atgctaaattgtcttctgaagtaactataccactttacactttcttcagcaatatatgaaagactgtattaccctgacacttgccaatagttgatattaaygtcagacttcctaatatttcctactaagatgagtatgaaatgatatctcaatgtggtctagatctgcctttttctgatcagtgaagaaactgaccatccc

SEQ ID NO: 19773 - DNA, 201 bp, Homo sapiens; identical to SEQ ID NO: 3317

SEQ ID NO: 19774 - DNA, 201 bp, Homo sapiens
ccagctgctgtggaaaaaagtttatccattcctcaaaaagttaaacatagaatcatcatatgatccagtgttccatacctagatatatttgcaaaagaatygaaagcagggactctaacaaatacttgtatgccagtgttcctagcaaaactattcacaatcaacaaaaactggaaactcaaatgtccatcccagataaat

SEQ ID NO: 19775 - DNA, 201 bp, Homo sapiens
atagggaatatgaatcttccattttacatgatgatgctaaattgtcttctgaagtaactataccactttacactttcttcagcaatatatgaaagactgtrttaccctgacacttgccaatagttgatattaacgtcagacttcctaatatttcctactaagatgagtatgaaatgatatctcaatgtggtctagatctgc

SEQ ID NO: 19776 - DNA, 201 bp, Homo sapiens
ctagcaaaactattcacaatcaacaaaaactggaaactcaaatgtccatcccagataaatggataagcaaaactatttagccttaaaaaagccatgaaagwctgatatttcctagaagacagatgaagcttggaaacattacactgagtgaagtaagccagtcacaacggacaaatattgtaggattaaaataggcatatt

SEQ ID NO: 19777 - DNA, 201 bp, Homo sapiens
tagacctgctgcccaatacaggagccactagctacctaccagtggctcttgagtccttgaaatattgctcgtgagatgtgttataactacaaaatacacaycagatatctaagacttcacttttttaaaaaagaatgtaaaatagctacaacatatctgttgattttaattacatgttgaaatgatattttggatatatta

SEQ ID NO: 19778 - DNA, 201 bp, Homo sapiens
atgtccagttgattgctgttttaagcagatctgctgtgaacatgccatctcatatctcctagtatgcaaactctgtaccagaagttttcttggttgtataycaaactgtggaattactgggccatagggaatatgaatcttccattttacatgatgatgctaaattgtcttctgaagtaactataccactttacactttct

SEQ ID NO: 19779 - DNA, 201 bp, Homo sapiens
aagcagtagtgctcaagaagattaaacttccatgttgagaatctcactggttatctttggccttctggatagctagttcttttctggcctgtgtacctttytatggctacataaaaaaattaataacctttctaaaagtaaaaatcctatttggagtaagatggcattgcaaattaaataagtattggaataaacaacatt

SEQ ID NO: 19780 - DNA, 201 bp, Homo sapiens
tcataattcagcagcaaagatcagatttttttttaagttcatagaaattgaagctgtttgtttactagatccccttaaactttgagactcatttttaccartaaatctttacacactaaagaacaacgatctatataaatagttcaattaggtagcctttctctctgctccttaatctgtttccaaagagactttgtaact

SEQ ID NO: 19781 - DNA, 201 bp, Homo sapiens
attagggtaaatggggtatccatcacctcaagcatttatcctttccttgtgttagaaacaatccaattatactcttctaattatttttaaatgcacaataagttaattgactgtactcaccctgttgtgctatcaaacactagatcttattcattctgtctaactacatttttgctcgtattaatcatcctcactccctct

SEQ ID NO: 19782 - DNA, 201 bp, Homo sapiens
atctaaaaccatataactacagaagtggggagctgaaagttcagaagtatcatctgactgtgttgatggcatctttacctcaattaataaggtgtggcaaygttcactcaaggacagaaattcaatctgtggtggatccaaggggattcaaaatatttcttttaatccaaccaaaacatattgctttaatggcattagttg

SEQ ID NO: 19783 - DNA, 201 bp, Homo sapiens
tcaatagcaagagtagaggcacatgtggccctttgagaacaactcagcactgcaacagtatcacttttgtcatatcctattgacaaaacaagtcacaaaakaggagtgaagaatggtgggtttttgaaaactcaatctaccacacttctcttatgtgaacttctctctgtgtactaatgaaaaaaatttaaataaagtata

SEQ ID NO: 19784 - DNA, 201 bp, Homo sapiens
tttttatttggatttcatttattcatttaaatatttatgaggccctactacttaccctcaggatgctaggcattctaaaggaatatcttgctagagaaacrtctccgtttagattgtaccttaagtttcagtcacagcacagaaaagggcttctttggaacctgtgacaggtgaccgtcttctccttttcctctgcagtta

SEQ ID NO: 19785 - DNA, 201 bp, Homo sapiens
aaaagtgtatcgtttagaagacataactttcaaaagcaaaagtatcccttagttctatttctatatatatatatagcattttaatgaattgtagcatcaaragaagtgaaaaaaagccttttaagtttaaattattgctccacttaattttctatactatagtatataaattactcttatcagatagcctatttttcatat

SEQ ID NO: 19786 - DNA, 201 bp, Homo sapiens
atttaaaatttctctctgttgcagatggtagcaaaaacatatgattaatagggggatgtgatcaaaatgtagaactgacttggaaatctttctctttttgwtattcttgagcatatgattggaaggaagaaagattcagacatttcagaaatggggtaaggggtgcaggggagagcagattcttccccccccactcactcc

SEQ ID NO: 19787 - DNA, 201 bp, Homo sapiens
gaggttgccgtgtggatttcagagtgtcacccgctctcagaaccccacatgtggactgcgcatcatagcttatcatgggactttgtggacacagggtctgrcggaccacagggggcttcctctcttgaaccctgtcgagggctgttcccagttctggaatagcatttcattgagtgtcaacaaagtactgggcatatgtgt

SEQ ID NO: 19788 - DNA, 201 bp, Homo sapiens
ttctctgggctcagggcccttcttcaattgcaagactcttgtgtgaacaatgcagacgctgcctctaaactccaacaaagacctgcttccaaatgtgaggwtgccgtgtggatttcagagtgtcacccgctctcagaaccccacatgtggactgcgcatcatagcttatcatgggactttgtggacacagggtctggcgga

SEQ ID NO: 19789 - DNA, 201 bp, Homo sapiens
tctgcagtcaaaatgattaatcatgaggcaaaaacaagaagccagagggaaaaaaggaagagctcacaaaggcaaaataaacatccataaacttaaacttycctgggtagggaagatctgaaaaatgtcacccatgagccactttctaacactcgttccatctttctttttccagtgtgcaaaactcaattgcacagtcct

SEQ ID NO: 19790 - DNA, 201 bp, Homo sapiens
tagaaattgaagggtggctgaaaggctttctttggtctaatccctgcctcccttcccagctgccatctcccagcacttcatatgaaaacctgtactttctsccgagttcccaccatgatgagatagggcagttaggattctctgggctcagggcccttcttcaattgcaagactcttgtgtgaacaatgcagacgctgcct

SEQ ID NO: 19791 - DNA, 201 bp, Homo sapiens
agctggcaaagtgggtgaaacattgtaaaccatgagaggagtgaaacaggatgagatcagagaaacaggagggaatcccactgctaggttctttagagctrgagcaagcaacagttcaaaatgtatcgaacgtgcaataagattctactgaagaaagaaattgatatggcgaaatttgagagtctcagagcaatgactcta

SEQ ID NO: 19792 - DNA, 201 bp, Homo sapiens
attaaggtatcttccctcaagacactttactgctatatgcttttatgataaatgtaccagcttatgatgtttatactgtaaatgataccttttagaaatgrtgttgtagaacctgcacagttattttctaagcctccacaggcacagtgccagaaactgagttaaatactttccatgagttcttttatttcatcatcttaa

SEQ ID NO: 19793 - DNA, 201 bp, Homo sapiens
tcaccctgtcgcccaggctgcagagcaatgatgtgatcgcggctcattgaaacctccgtctcccgggttcaagtgattctcctgcctcagcctcccgagtrgctgggattacaggtgcctgccaccacacctggctaatttttgcatttttatttatttatttatttatttagagacaagagtctaactctgccacccagg

SEQ ID NO: 19794 - DNA, 201 bp, Homo sapiens
ttatacttaagagcatagtctaaggaacagcctctctcatctacagactttttaaaaataatagtttatgtggatttatttctaatcgtaggttagaacawctagagccttatttccaaactgcctatagctgatatgctgtaaaccacttttaaagaaatagaattgcatctgcctccaagaatgcagcaattccttggg

SEQ ID NO: 19795 - DNA, 201 bp, Homo sapiens
acattccacagtggcctcctcactgttctctccatccttcattcatgctcctctccagtgttttctccacctacattgagagcaatgtttccagattaacyagtatatcaagtgagtcctaggtttaaaaacctgcaatcactttcattgcttttagtataaatatcaaaatccttatgcaggaccttgaaggctctacat

SEQ ID NO: 19796 - DNA, 201 bp, Homo sapiens
taaatatgataacctcatagcccagtggcagtgggctgggcgggaaaacagcaactgctagcaatcagcatgcactttatatagcatttccacttaacacmctcccccagtgacctccacctggcaaccttcatattgtaacctaaaactctgggcctcaatcccctgtacggcctgtgttccacaggactgaataggatg

SEQ ID NO: 19797 - DNA, 201 bp, Homo sapiens
tacagggctatttaaatataaattattgaaaaattgaataaaatttaaaattcagtttctcagtcacactagcacatttcatgtgctcagtgttcccatgyagctagtggctgtggtattggacagtgccaatatgcaacttttccacaattatggacagttctattgaatagtgccaaacaagaacagggttcaaatcca

SEQ ID NO: 19798 - DNA, 201 bp, Homo sapiens
actctgtctctacaaaaaaattttaagattagctgggtgtggtggtgcacacctatatttccagctactcagaaggctgaggctggaggatggcttcagcrtgggaggtcaaggcttcagtgagccatgatggtgccactgcactctaccatgggcaacagagcgaaaccttgtctccaataaataaatagataaaaataa

SEQ ID NO: 19799 - DNA, 201 bp, Homo sapiens
cattcctcctcttaagtctgtctcttgccccagccttagaacagaatccttgttaactaacccttcttctgtactatacaagagaggagttagagtacacrttgggctttgcaacgggtctgctttcatttgttaagcaattgttttttatttggatttcatttattcatttaaatatttatgaggccctactacttaccc

SEQ ID NO: 19800 - DNA, 201 bp, Homo sapiens
cacataacttgaagttgactttcagctacagacaaatgatgtgtccaactaaactttgttacatctcctctataggtgaccagtgaatgatattttaagtdaatgtattcatcagccccttttgtatatctctttcagagagtttctatgggagtgggtatagaaacataaacaacttcaagtcatctcccctcttgatgt

SEQ ID NO: 19801 - DNA, 201 bp, Homo sapiens
cttggagaaatggctgattctagagctggggaagggaatttacaagattaggctggagcatctaacaatgccaggaagcaagaaagtttctcaaaggaacrtatggaaccaactaaaagacttctcaatggtcaaagctggaacaatttaagcaacaaaataaagatgtgatattagattgcaactcaaagtataaaataa

SEQ ID NO: 19802 - DNA, 201 bp, Homo sapiens
ctcccaaagtgctgggattacacgtgtgagccaccacgcccagactctgacacctttttcaaaagacccgtgtgtgtgtgtgtgtgtgtgtgtgtgtgtgsatttgtagataccgctattcatcttattctgagtctttagccttattgtgccacacataacttgaagttgactttcagctacagacaaatgatgtgtcca

SEQ ID NO: 19803 - DNA, 201 bp, Homo sapiens
agcattcttgtgattataaataaagcaaactttattctaatgtaatgaaaataaaattctacagtgagacttgtactgtttttgtcttcaagtatttgttsatctgtgaaataatgcagtttaaaaacatgtcaaagaattactgaaaataactctttactgagaaagaggtatgagttattcctcttcctcgacatcagt

SEQ ID NO: 19804 - DNA, 201 bp, Homo sapiens
tttgtatttttagtagagacagggtttcaccatattgccaggctggtcttgaactcctgacctcaagtgatccgcctgcctcggcctcccaaagtgccggkattacaggaatgagccactgcacctggcctaatgttacatttaattaggtttgtctcaaagctgcaaatgaagactttttaagaataatttttataaaga

SEQ ID NO: 19805 - DNA, 201 bp, Homo sapiens
aacctcttcttcccctaaagttaacatctcacgggatcatggggcaatcatcaaaaccaggaaagtaacattggcatgatactctgacctaaactgcacamtttatttggactaacctgctttctacagtaatgtccttttactgttcaagattccaacgcaggatcccaaattgtattttattgtcatgattctttagtc

SEQ ID NO: 19806 - DNA, 201 bp, Homo sapiens
gtaaattagttcaaccattgtggaagacagtgtggtaattcctcaaggatctagaaccagaaataccatttgacccagcaatcccattactgggtatatasgcaaaggattataaatcattctactataaagacacatgcacatgtatgtttattacggcagtgttcacaatagcaaagacttggaaccaacccaaatgcc

SEQ ID NO: 19807 - DNA, 201 bp, Homo sapiens
ctttttcagtgatgagttatgacccatctgctggcacagtttgagaagaattctccaagcagcttataaacaaccatgccttagaagtgcattcttagtcytgcttcattaattctgtgccaagggctcctttccctctttctccaactttcttttcaacatctttgagtgtctgccctgtgctggacacattgctaagct

SEQ ID NO: 19808 - DNA, 201 bp, Homo sapiens
aattctgataaagagttacagagaatttagcatattgaaaagcaacattaaaagagtatgtaggcaattattttataaggatcagcatttattcaacaaayatttttaaactgtttactgtgtataaggtatgtggaattagctgctggagggtgtcgaatgaagattttacgtttcaatgcatttattattattattcat

SEQ ID NO: 19809 - DNA, 201 bp, Homo sapiens
tcctacctgctttctaaagcagctgagtttggtaaccatgggcaccctcttcagctgggaggccaggaaagcgttacccctgctgtatttaagccaaagarccacccactgtgggtgtataggtcccatgtagtcaaatctagtttttcaagggaagtaagaaacccattgtttcagtataagatcaccttaattaaaaga

SEQ ID NO: 19810 - DNA, 201 bp, Homo sapiens
caattgacatgtgcatctgaatttattcaacacaaattcccatctgatttgcctcttttttctcttttacttccattgtgacttcagagaaaagaaagaaytaaagaagaaaatggataaaaagaggcaggagaagataacagaagctaaatccaaagacaaaagtcagatggaagagtaagtcaaaagtgtcccctctcc

SEQ ID NO: 19811 - DNA, 201 bp, Homo sapiens
ggtcagatccccacggaatagggacatcttcctacctgctttctaaagcagctgagtttggtaaccatgggcaccctcttcagctgggaggccaggaaagygttacccctgctgtatttaagccaaagaaccacccactgtgggtgtataggtcccatgtagtcaaatctagtttttcaagggaagtaagaaacccattgt

SEQ ID NO: 19812 - DNA, 201 bp, Homo sapiens
ggcgtgaacctgggaggcggagcttgcagtgagccgagatcgcgccactgcactccagcctgggcgacagagcaagactctgtctcaaaaaaaaaaaaaaagttattgtccctcaaaaataagatggacgtgaattttatcaaggtgattagcaggtgttctatggctcttttattctactagtggaaaaattcagacctt

SEQ ID NO: 19813 - DNA, 201 bp, Homo sapiens
gggcacctaggttgattgaatgtctttgctattgtgaatagtgctatgataaacatacaagtgcatgtcacacactttttgatgtgaaaaaaaaaaaaaaacaagtcatttaaactagatccataatctgttatctgagattcttggggcctgttgtttttcagaattttaacttttctgattttagaaaggcaatgtgat

SEQ ID NO: 19814 - DNA, 201 bp, Homo sapiens
aatcacttagcttctctgtatttttgctgcttcttgtgtaaaagcgtggtaatgttacaggacattcaaaaatgatgaatttggggctgtttaggatgtgwagaaattatctcttgttcctgaagtgattaaagcagtataatcactggtcttgttgtcttgaccaccatatggaatggaagatgtcacccagaggttgca

SEQ ID NO: 19815 - DNA, 201 bp, Homo sapiens
gggatgagctgcaaagtcacaccacaaaggttatgattacaaggaggggtgaagaattactgccatttgcacgaccaatctaccattcccacctaacaccytgtttcacttgcacagaatagaaattcaacacatattagagtacaaaacccagaatatggcaattagatagtatgatgctgaacctcagaacagaggcaa

SEQ ID NO: 19816 - DNA, 201 bp, Homo sapiens
tccctgcactatgctttcctgcttgtctaagacacatcaggagccaagaagggagggagggaagaatgttgatgaaggaaagcagttgtttacccaccccygcccatttccacaaagcaatctttttattattattatcaattttcccttcatttggtggtcacctacctaacaattttcttattgtacagtgaattctta

SEQ ID NO: 19817 - DNA, 201 bp, Homo sapiens
gattcaagaagatgagaaatacactccgttctttgctgggatgggatgagctgcaaagtcacaccacaaaggttatgattacaaggaggggtgaagaattwctgccatttgcacgaccaatctaccattcccacctaacaccttgtttcacttgcacagaatagaaattcaacacatattagagtacaaaacccagaatat

SEQ ID NO: 19818 - DNA, 201 bp, Homo sapiens
cacaggtttccatatgtttttgaaatatagaaaaaacttcactaatttaagcttatcagcattcaaagttatcttatttgcagccactgagataaaagttractctgtatcctaactagcttactatttgaataaccacaaatattggttaaaaaagaaccaaaaatagttatcttggtttgactgtaaactgcattcttc

SEQ ID NO: 19819 - DNA, 201 bp, Homo sapiens
tattaatttggggaactaataaatgtccataaaatcttcacaatccacgttcttctgccatggcttcagccggtccctccatatggggtccctgacttccygcaacaagatgggatgaagttttttaactagaaagtgatcatagctaagtttttgcacacaccaaaagtatgtataggctacatgacatcatatttcttc

SEQ ID NO: 19820 - DNA, 201 bp, Homo sapiens
atttaagcttatcagcattcaaagttatcttatttgcagccactgagataaaagttaactctgtatcctaactagcttactatttgaataaccacaaataytggttaaaaaagaaccaaaaatagttatcttggtttgactgtaaactgcattcttccatcttgaaaattttgaatttttctagattttcaatatgttttt

SEQ ID NO: 19821 - DNA, 201 bp, Homo sapiens
taaagacaggcataggaaatcacaagggtattgattggggaagtgataagtgttcatgaaatctttacaatttatgtttagagattgcagtaaagacaggygtaagaaattataaaagtattaatttggggaactaataaatgtccataaaatcttcacaatccacgttcttctgccatggcttcagccggtccctccata

SEQ ID NO: 19822 - DNA, 201 bp, Homo sapiens
cttatttgcagccactgagataaaagttaactctgtatcctaactagcttactatttgaataaccacaaatattggttaaaaaagaaccaaaaatagttaycttggtttgactgtaaactgcattcttccatcttgaaaattttgaatttttctagattttcaatatgtttttggggtaataatgatatgtaatattataa

SEQ ID NO: 19823 - DNA, 201 bp, Homo sapiens
gggaaggtcagatccccacggaatagggacatcttcctacctgctttctaaagcagctgagtttggtaaccatgggcaccctcttcagctgggaggccagsaaagcgttacccctgctgtatttaagccaaagaaccacccactgtgggtgtataggtcccatgtagtcaaatctagtttttcaagggaagtaagaaaccc

SEQ ID NO: 19824 - DNA, 201 bp, Homo sapiens
tattgtttaaacacatgtgctctacaatttgtgcagttaatgcaattatcacatggtcctgaggtgacatacatcctcctcggctgacaggattaagagawtaaaataaagacaggcataggaaatcacaagggtattgattggggaagtgataagtgttcatgaaatctttacaatttatgtttagagattgcagtaaag

SEQ ID NO: 19825 - DNA, 201 bp, Homo sapiens
aattttagtgagctgtcacattgggaagaatctggttcattccccacatggttttagaaaccaacttggatataatggggaaggtcagatccccacggaayagggacatcttcctacctgctttctaaagcagctgagtttggtaaccatgggcaccctcttcagctgggaggccaggaaagcgttacccctgctgtattt

SEQ ID NO: 19826 - DNA, 201 bp, Homo sapiens
gggcaggaacttacttctgtggttcattctgcactttttttttcactacccacctaagaaaaatctagtcaatgcgactgaagtactaccaccttctgaaycttctttccttgataattgcttaattggaatttaaatctttgaatcaaattaagaaactagacattcctagtttctgtttctatcacaatttccagtacc

SEQ ID NO: 19827 - DNA, 201 bp, Homo sapiens
cagcttaatcacagaaacctgggaagggctccaggagacacttttcctgggaattatccagaatttgtcccgcaagtgattgaccatagtccgtaccaaaygatttgacttaattaatctcaaagatatatttccacaaaattaacattaagagttgttggtctactttcctttaaaaagagaaatccatgatttctacct

SEQ ID NO: 19828 - DNA, 201 bp, Homo sapiens
caggtgcaggaaatggggaggtgcgggtcaaatgatacaaagcaggaaatgtgtaggatgaacaagtaaaaaaatctaatgtacagcatgaggactataaktaacaatcatgtatcatagtcagaattttttctaaatgagtagattatagctgttcttgccacagggggacaaagcgggtaactatgtgagatgatggat

SEQ ID NO: 19829 - DNA, 201 bp, Homo sapiens
tttaatgtgcatacaggtgcaggaaatggggaggtgcgggtcaaatgatacaaagcaggaaatgtgtaggatgaacaagtaaaaaaatctaatgtacagcrtgaggactataagtaacaatcatgtatcatagtcagaattttttctaaatgagtagattatagctgttcttgccacagggggacaaagcgggtaactatg

SEQ ID NO: 19830 - DNA, 201 bp, Homo sapiens
aaaatcatggctcccaattaatgatgaagtttttcactttgctttagagcagggcttctcaagttttaatgtgcatacaggtgcaggaaatggggaggtgygggtcaaatgatacaaagcaggaaatgtgtaggatgaacaagtaaaaaaatctaatgtacagcatgaggactataagtaacaatcatgtatcatagtcag

SEQ ID NO: 19831 - DNA, 201 bp, Homo sapiens
taaatatttcctaattcagtgtatggccccaatttgattattttaataatgatatgaattccaccaataaaataatgtgacatcaaaaaaatccaaggtastgcttttataaggttacaatgttttgcccaaggccttggataccatttaattattcaaaacagaaacttgatatttcattcacaatataagaacttgaca

SEQ ID NO: 19832 - DNA, 201 bp, Homo sapiens
ccccgcaaaagcctacaggactatcccattcccacagttaggaatgactccatggtacttttcatggtccagagctctctgtgggatcaggccaaaaactrcactttatttatcttcttcatgaagatggtgaagaatctcaacagaccttcaaagagatcaaggcttgcatctaagacaggatcaatgattgcctctaag

SEQ ID NO: 19833 - DNA, 201 bp, Homo sapiens
aacacatagcatactgctgacctcacagcaggtactccagccaaccaatccctgaattaaaaactgattacaggcagctgctcgatgccttgccacttccmctctcagtgagtccattttatttgtctgacagcaaagctccaattctgtcttcacccctaccaacccacacttttacaaattgctttttagcttaatgtt

SEQ ID NO: 19834 - DNA, 201 bp, Homo sapiens
tgatcacacaggctgtctttcatcactagtggagtgtttggcacaagctagtactcagcaagatttgttgagtgagtaatttacacccccccatccccccracacacacacacaacaccatgcaaatctatgcaatcagggcacttgcaaatccttagtattatcaaaagaaaaatgcaaattctaaggcattcttatgcc

SEQ ID NO: 19835 - DNA, 201 bp, Homo sapiens
ctatctcatacacccactcagtcaccaacctttatagagcacatctttttaattcccctcaaagctgcactttcctctctgttccttgccatccacctatycgtctggattgctggaatggcctcctgacaagtctccttgccttctctgtgcatccccacccccgcatttgtcctccaggtcagtgtttcaaactctggt

SEQ ID NO: 19836 - DNA, 201 bp, Homo sapiens
ctgtgcatccccacccccgcatttgtcctccaggtcagtgtttcaaactctggtttctgttttgtttcgtttctgagactgggtccttcacccaggctggmgtgcagtggcatgatcatgatcacagctcactgcagccttgacctccctggcttaagtgattctctcacctcagcctcccacagaatactggaattacag

SEQ ID NO: 19837 - DNA, 201 bp, Homo sapiens
tattttttcttcttagctttaaaaatagacctgcagaatagatatggtataaagtgagactccatagtgtccagaattcttttctttgtatttgtactgawattctctctctcttttccagtgtatcaacttttagttatatattttgttcaaaaataacatctgatcatcataaacatcaattatttaaataggataaca

SEQ ID NO: 19838 - DNA, 201 bp, Homo sapiens
gataacttcgggacatttgatttgagttaaggttagaacaatgctgcgtaattctggccacatatataattaatttaaattcttctagattaaaaaaaatsttgcagaatgctacagagctgcaaatgaagactagtatcctgttaaaaccatttgatctttaaactggcttgcttcatttcataatggatcgaagacaat

SEQ ID NO: 19839 - DNA, 201 bp, Homo sapiens
tctcacacaatttgtcatttctctgaaaagagatttagattcaaggcccaaatatgtttgtttgtttacaggaagaataaaatttaaaaagttgaagaggytatttattttatcttttatattacaggttctgtaaaggcacctgccaaaacagaagatcttattcagagtgtcttaacaggtaaatgccaccctttcccc

SEQ ID NO: 19840 - DNA, 201 bp, Homo sapiens
agagtcagacaaatcttcctggggtttaatcttggattctcttctctatgacttaaggtaagtcagttaatatctctgcaccttagttgaatcaagaatakataaccatcatgagctgagtcctttgccttctcttgctgcatcttcacaacagatctgtgaagtgaggtttattgcactttatagattagcaaaccaata

SEQ ID NO: 19841 - DNA, 201 bp, Homo sapiens
tataataattgtacatatttatgaggtacatagtgagttttgatacatgtctagtgatcaaatcagggtaattagcatatctatcacctcagaagctcacmatttgttttgttgggaacattcaaaatcctgtcttatatatatttgaaaatatatacaatttttgactgcagtcatcctacattgctgtcgaacactaga

SEQ ID NO: 19842 - DNA, 201 bp, Homo sapiens
catgtctagtgatcaaatcagggtaattagcatatctatcacctcagaagctcacaatttgttttgttgggaacattcaaaatcctgtcttatatatattkgaaaatatatacaatttttgactgcagtcatcctacattgctgtcgaacactagaactcattcctttcatctagctgtaattttgtgtcctttaacaaat

SEQ ID NO: 19843 - DNA, 201 bp, Homo sapiens
tcagaagctcacaatttgttttgttgggaacattcaaaatcctgtcttatatatatttgaaaatatatacaatttttgactgcagtcatcctacattgctrtcgaacactagaactcattcctttcatctagctgtaattttgtgtcctttaacaaatccccccatgcaccctccccgctactcttctcaccctctagtag

SEQ ID NO: 19844 - DNA, 201 bp, Homo sapiens
cgaacactagaactcattcctttcatctagctgtaattttgtgtcctttaacaaatccccccatgcaccctccccgctactcttctcaccctctagtagcyactgttctattctacttctaagagatcaatgtttgtagcttccgtatgtgaatgagcacaagcagtatttatctttctattcctggagaagagcaggctt

SEQ ID NO: 19845 - DNA, 201 bp, Homo sapiens
cgtggaaagaggcccaagaggtccacttacaggcagtggtagggccaggtcagaagtctaatcttcagcctccttgctttgtactcccgacctcaaacccraccactctcttctcccaaccataatgcatcttagtgagttacagtacaacacaagatctagaaatatctgactattaaaaaattatctgctgatcataaa

SEQ ID NO: 19846 - DNA, 201 bp, Homo sapiens
taacaaatccccccatgcaccctccccgctactcttctcaccctctagtagccactgttctattctacttctaagagatcaatgtttgtagcttccgtatrtgaatgagcacaagcagtatttatctttctattcctggagaagagcaggctttttcctgaatacattgctgtccaatattactataaaacataatacaca

SEQ ID NO: 19847 - DNA, 201 bp, Homo sapiens
acatttggagtccataggtcctggaatctgtatttttaagaagttcccccacatgattctgatgttgcagccaaggaaggtgatccctggataactctctrtaactccttcaagtggttggaagaggagaaaagccctctagggaagggaaggtgctagtgagaggacactttcagctaaatagagacgttgcaggagacc

SEQ ID NO: 19848 - DNA, 201 bp, Homo sapiens
tcattagcatcttaagataaagatagaattttgaagttccatcatttataaccaatcaaatgcaaaattataagacagtgatattcttgatttgaaagctstaaactctgatgtctgctgctctgctcttcactagtaagttccctggcactagagcaatgttataggatggtgacctagtttagctctaccgtatttctc

SEQ ID NO: 19849 - DNA, 201 bp, Homo sapiens
gcagagaagtcttcagtcaagtctcaagataatttttttaagtgatgtcaatgacataaaacaaagaggaaaggtctgtgtcgttgcttaacgatttcacrtttttgccttccaggagacagagctactggatctcagccttgtcaaagatgccagatgtgggagacacgccaaagctcccaaggtaggaggttgagtgtt

SEQ ID NO: 19850 - DNA, 201 bp, Homo sapiens
ttttgttttctaaaatcagaaagcagaaatgaaataattataactatatcttaattcagagtttaaaggagaaatctccatttactggtttccccattacyacttaattggctaatctagtttttcatttaccctgatgtagacacaaatagaatctgcaatataatcaggcaccaaccatgggattaattagctaactaa

SEQ ID NO: 19851 - DNA, 201 bp, Homo sapiens
gtgtttggcctgtggtttcaaatgttatagacagacctgaggcaatgataactgagacaagccactgggcctaaaagtatatagaaatgggtaatcttagrgatggtggagtccattgagtaaatgggtggctggggggaagacatcagaccccgagaagcagaagctaaggcctggggaggaatggaagactatggactt

SEQ ID NO: 19852 - DNA, 201 bp, Homo sapiens
agacctgaggcaatgataactgagacaagccactgggcctaaaagtatatagaaatgggtaatcttagggatggtggagtccattgagtaaatgggtggckggggggaagacatcagaccccgagaagcagaagctaaggcctggggaggaatggaagactatggacttaagagtgtagcatcattggtcgaaagactttt

SEQ ID NO: 19853 - DNA, 201 bp, Homo sapiens
aaggaggtataggattttgtaacaagtaattaaggaaaccaccataaaagtttaagtttatactatatgatagttttcattatccaatgctgcattttttrtaatagacattgaataggagggaactatccttactaagtggtaggcatttttccccatgattatttgttcactgaatttggaagtgatggaattccaatg

SEQ ID NO: 19854 - DNA, 201 bp, Homo sapiens
ctctaggattatgtatggagggagcatgccgtgccacaggggcccacatagggaagcaccaggatcatcaggagacagagggagcaaggggaaaaatgtgrgcaaggtcttttattgttgtttccacaggaacaaataggcaaggtaatgtaaggcaggcttaggattggcttgtttgaataatttcagcaggctctgggg

SEQ ID NO: 19855 - DNA, 201 bp, Homo sapiens
tatttttgttaaatatgcttcaggttttccccatcaatatcaaaaattaagattggacttggaataaaagttctattttatattttaaatcttacaaatgraaataaataaacagcatggattcaataactatactgcgagtcaagactactcttattacactgaatgttttaccatattggaagacagtaagaatgttgg

SEQ ID NO: 19856 - DNA, 201 bp, Homo sapiens
tggtggagtccattgagtaaatgggtggctggggggaagacatcagaccccgagaagcagaagctaaggcctggggaggaatggaagactatggacttaasagtgtagcatcattggtcgaaagacttttatttatatttagggagactagagcatgtctttaggtagagcaaaaggaagcaggagagaggggaacactga

SEQ ID NO: 19857 - DNA, 201 bp, Homo sapiens
taaccttcctatatagtaaggacagaaatgatgatttaagccatcttaggcaaggcagtgctaacaatatgcttttgtaaagtcaccatccggtgtaaggmataggcaccagcttagtgatgtttgcaaataagccagtggtgggtgtggataaattagagagagtaccaaatgcagtttgaaaagtgttaagttttgtct

SEQ ID NO: 19858 - DNA, 201 bp, Homo sapiens
aaaaaaaagtaaagtcagttcatgtagctgtgagataaatcttgagaaaaagagtattgaatagggtactgagtttattggttaacacttaggaaagataygatgcttgataggagatcctttttattaaacacaaagaatagcattttattctatgccttagaattttgtgatagaattggcaacaattcagttcacaaa

SEQ ID NO: 19859 - DNA, 201 bp, Homo sapiens
agcatttttttgcattttgctttttatacttagtgatgtatcttagagatttttgcatatcagtatgcctagagctacttcactatttttatttgatgcamaatatttcatcacatggatgcgccatcatttttttcactttctccttaaatggatatttggcttgttttaattttttttctgttaccaatgatgctggaa

SEQ ID NO: 19860 - DNA, 201 bp, Homo sapiens
cattgccaacttatccttcaagatgatagtatagcagccttttaattttagaaattaagaaggttaagaaggtaaggcacagagattttatagcttgccaratagcataacaatttaggaactagaaatcaaatatcctatttcctttatagatttctagtgtctacatcaaattttttccaaatttataaaagaagaaaa

SEQ ID NO: 19861 - DNA, 201 bp, Homo sapiens
ggtaatttatgaagaaaagaggtttaattggctcacagttccacaggctgtacaggaagcatggtggcatctgctcctggggagtcctcagagagctttttactcacgggaagacagagtgggagcaggtgtcttacatggcaggaggagaactaagagagagtggggaggtgtcacacacttttaaacaaccagatctca

SEQ ID NO: 19862 - DNA, 201 bp, Homo sapiens
gcaatgattagtatttgaaccacaaggaacaggagaagtgaggggtcaatgtggtcagacttactaaggagtacttaaaggccactgcaaaaccaggcacytgatcctctaattgagaggggaagtttgcaagggaaaggtgtttgatatatggcaagttgaaagggtggagaggctgagcgccagaggtgagctgaaagg

SEQ ID NO: 19863 - DNA, 201 bp, Homo sapiens
acatgcatcagatagctatttttgtgcaaaagccatcccaaaatgtagtgatttgaaattacaactacatatttaggctctgattatgtgatcatctggtmagggcttagcagcagggttcttctgttgcatctgggctcattcaagcatctatgataagctgctgagtcagctaggttgctttgctctgaagattgactt

SEQ ID NO: 19864 - DNA, 201 bp, Homo sapiens
ctttcacttcctctctttcttggggctgaccagctgataaactagtcctctgtcctagattgtgttccccagaaacagaccttgaaatgaggattatgtgyaggggatttattagggaagcatctcaggagagactggcagaggagcaggccaaggaagggaaagaagacacatctgggttccatttcaggtgaagttcca

SEQ ID NO: 19865 - DNA, 201 bp, Homo sapiens
ctgtcccttactcacccctgctgtatatagagcactgagtgtagaatttcgctagccagaccacttactatttgacagagatgtgtatgtagggaacagcmttaagctatgccatgacttcctgtcatggctataattagcatcagttcaataggcttgagttaaaatggtttctgtggtgccattatagctttgttttgc

SEQ ID NO: 19866 - DNA, 201 bp, Homo sapiens
gttaactatagtcacctccttgtctatcaaacaccaggtcttaacgtcttctatctaagtgaagagtgggcatctttctcttcatcctgatcctaatatargtttcactgttgtgatatcatcaagtcagatattggctgtgactttgagtcagatattctttaacatactaaaggacacgggtcctatttgactaatgtt

SEQ ID NO: 19867 - DNA, 201 bp, Homo sapiens
tcactttgtatcttttccattaataaatttgtctgccttcctggatgcaataactcactgtttttactgtattttataatatggattaatacctggaagtkgtgattctcctttactactattaattttcaattccttttttgccattgccagtggaattcttatttcaaataaacttaatttaactgtattatgttttcc

SEQ ID NO: 19868 - DNA, 201 bp, Homo sapiens
aaaagtaagttttccctggagaaaaacccctcttgcagcatataatgattatattttaaatacggagtaatgggaccaaagaatgttacccttaatagagmgatttatgcttttgaagtcttaaatatatgtacattttgactgccttgttactttacacatataataaatatgcatgtattgtaatatataaaaataacc

SEQ ID NO: 19869 - DNA, 201 bp, Homo sapiens
gggaggagggagaggatcaggaaaaataactaatggatgccaggcttaatacccgggtgacaaaataatctgcacaacaaaccccagtgacataagtttayttatataaaaaaaaaaacctgcacgtgtagccctgaatttaaaataaatgttaaaaaaaattactaaccttagacaacacctatggacaccctgcaatgg

SEQ ID NO: 19870 - DNA, 201 bp, Homo sapiens
tgcgaattgttgggtcccatgaagtattttatagaaagctctgccaaacaattttttaattatttaattaaaagaatcccctctctgattttttttttttwaaaaaaaaaggtaataagaacttgggacaaaaatttcattataaaaatgcttaagtggcaataccctaaaagaatgtgtctctaatattgtagtaagata

SEQ ID NO: 19871 - DNA, 201 bp, Homo sapiens
ctgcgaattgttgggtcccatgaagtattttatagaaagctctgccaaacaattttttaattatttaattaaaagaatcccctctctgatttttttttttwaaaaaaaaaaggtaataagaacttgggacaaaaatttcattataaaaatgcttaagtggcaataccctaaaagaatgtgtctctaatattgtagtaagat

SEQ ID NO: 19872 - DNA, 201 bp, Homo sapiens
aactttttcaagaactttaactaggaaatggaacagagaaatggtgctgtgtttgccgaaggatggggtatcaagggaatgatgtcaatatgtttggcagyaattattttcaatgctgcatactattccattctctgaacctattgtaaactatatattcatgagtgtttagtatatacacatacctctgttttgcaaagc

SEQ ID NO: 19873 - DNA, 201 bp, Homo sapiens
cagagatgtgtatgtagggaacagcattaagctatgccatgacttcctgtcatggctataattagcatcagttcaataggcttgagttaaaatggtttctrtggtgccattatagctttgttttgccttacttatatctaggtgaccacatgttcaggtttttctgggacagtccctttttatgcctgttttctcagtaga

SEQ ID NO: 19874 - DNA, 201 bp, Homo sapiens
gcagtatcagatccttcagcaagaaagctgttttatcatttactaagtacctaggcacagcatcaccttgcccattaaaagccctgtcaggtacacatttkggttgctaggcagctgctggggaagcaatctcttccacacatatggtttatgccacctggcctgcatttcacaccaacctccccaaacttcccagggagt

SEQ ID NO: 19875 - DNA, 201 bp, Homo sapiens
taggcaagtactttatcatcaaaacattttccgatgaccatgattcacagcagatgtaaactaactccagtgtttttcaaactagtggtcttgacccacgrgtaggttatgacatcagtttattggttggacatcagcattttacaaaaatgaacagtgcaatagaacataacagaatatactagaaaatagtaatatcag

SEQ ID NO: 19876 - DNA, 201 bp, Homo sapiens
acagtttaatttcttctatggggtgtaaatatttaataaattgtcgatattcaaaagaccaatacatattttaaaatattctgggggttatttttacatayatcatcatgatccccataatgacgtttcaatcagcgacgaaccacatatatgatggtggtcttataagattataatatcaaatttttcctgtacctttta

SEQ ID NO: 19877 - DNA, 201 bp, Homo sapiens
taacatgctgtatagtttgtagccaaggagcaatgggctataccatatagcctgggtgtgtagtaggctacaccatctaggtttgtgtaaatacactctgygatgtttgcacaatgaagtcaactaaggacacatttctcagaaattatccccctcattaagtgatgcatgactgtatttcctgtaatagagactgtatct

SEQ ID NO: 19878 - DNA, 201 bp, Homo sapiens
atctgttaactattgctatataacaaccatcccaaacatagtaacttcaacaacaaccatttacttagtgccaattctatgagttagcagtttaagctggyctatcctgagtggttcttcctggcttccttgtgtgtatggtcagccattctgctaagccactctggttctgagagtcttttggctgtttgcctggggcac

SEQ ID NO: 19879 - DNA, 201 bp, Homo sapiens
ctattgctatataacaaccatcccaaacatagtaacttcaacaacaaccatttacttagtgccaattctatgagttagcagtttaagctggtctatcctgrgtggttcttcctggcttccttgtgtgtatggtcagccattctgctaagccactctggttctgagagtcttttggctgtttgcctggggcacttcagttct

SEQ ID NO: 19880 - DNA, 201 bp, Homo sapiens
cttccttgtgtgtatggtcagccattctgctaagccactctggttctgagagtcttttggctgtttgcctggggcacttcagttctcctctaccctggtcstctctaatcctcaacagactaactagcccaggcctgttcaaagggcaaagacagggctccaagacaatggaagaattgaaggcatgttgaggcctaaact

SEQ ID NO: 19881 - DNA, 201 bp, Homo sapiens
atgtgttacctgtgtgttctacattatttaatctttttacgcctcccagtagaacagggataataatggttcctacgtcacagggtgattgtgagaattcmgaaagtcagtatgtgtggaatacacaggccagtgatcaatgcctggtaggcaataaatgttaactctcactgtcaacactacagttggtttctattccaa

SEQ ID NO: 19882 - DNA, 201 bp, Homo sapiens
gtttctagtttttggtaattacaacaaaagccatttaattatgttcttacttgttttggaaaaaatccaataaaatggtaaaataatcactttgtgtgtayaggagtagggtgtggcagggaagtctgaatccaaaggtgttactctaagtctctgctggctgggcatggtgggtagtgcctctaattagagcactttggg

SEQ ID NO: 19883 - DNA, 201 bp, Homo sapiens
cttacttgttttggaaaaaatccaataaaatggtaaaataatcactttgtgtgtataggagtagggtgtggcagggaagtctgaatccaaaggtgttactstaagtctctgctggctgggcatggtgggtagtgcctctaattagagcactttgggaggctgaggtaggcggatcacttgatgtcaagacttagagaccag

SEQ ID NO: 19884 - DNA, 201 bp, Homo sapiens
caaataagtgatctatgaataagcgcacactgatgtgagaacttgatttatgagagagatggcactggagacatgtggagaaactcaggcttttcaataarcattgaaagaactattattattgatatggaaaaaaactaaattggattcctacctcacctcacacacaaaaatcctatctatgtggtttcaagaattaaa

SEQ ID NO: 19885 - DNA, 201 bp, Homo sapiens
gacactaaagaatgacctgattggctatttgaaatgactgcgaattgttgggtcccatgaagtattttatagaaagctctgccaaacaattttttaattayttaattaaaagaatcccctctctgattttttttttttaaaaaaaaaaggtaataagaacttgggacaaaaatttcattataaaaatgcttaagtggcaat

SEQ ID NO: 19886 - DNA, 201 bp, Homo sapiens
ccatccatttatccatccatccatccattctttcatccacctatccacctatggtatgtacttgcatgtgtgtgtgtgtgtgtgtgtgtgtgtgtgtgtgtaaacatatttaaaaggcaggtttactcattgcttttggtacagttctctaaactaaagaagcttatgttggtacttttattgtccatgaaattatattat

SEQ ID NO: 19887 - DNA, 201 bp, Homo sapiens
caacatccctccaaagatttacaggagaaaaatcaggtttctgctttttacagtaaagaaagacaaattctttctttcccacagacactaaagaatgaccygattggctatttgaaatgactgcgaattgttgggtcccatgaagtattttatagaaagctctgccaaacaattttttaattatttaattaaaagaatccc

SEQ ID NO: 19888 - DNA, 201 bp, Homo sapiens
ataatttctgtactcagtaaaaatgttctctttgaagtttggaagtgagtatcattaacaggcctttcattcacacctatttcctaacacaactctatccsttgaatgatagcaagcaaaccttgtcttcctttgcatgtgggtgcttgtgttttttaccatctgcctttcccactaccagttctctgcctcttattaaca

SEQ ID NO: 19889 - DNA, 201 bp, Homo sapiens
tcagagtgaccatatgactttaagcttcataatgggaaatattaactatagaactgagcactggatgcattgtcattgatgatatgctgaagagttctggrcatttcaattttttcatgttttaaagaactttttaaaatctgtgacatggcaaaattacttaaattatcttttgaagctcctagaggatgcctaatatca

SEQ ID NO: 19890 - DNA, 201 bp, Homo sapiens
agtaaaaaaaaaaacagcccatgatccaggcttaaacattcatggaaaagggaatgaaaataagaataagaatcacattttatgatcaatttgaattttcrtcaagaaggattttcatcgctgttacttattcttagtacagtcacagtcctgctaaaatgtattatcattgcagcatgtagagataactattggaaatca

SEQ ID NO: 19891 - DNA, 201 bp, Homo sapiens
gaggactttgcaaatcctttgaatctctccttagcctctccctgcagttccaagaaagcagtgactttggggtttcatattcaaatgccagagaactcacyttccacccaaagcacacacttggttttttaaaaagaaaaaaatgaatacaaaatagtgacttttcctgtggaccatttcaatatgatttgaaccgtcaat

SEQ ID NO: 19892 - DNA, 201 bp, Homo sapiens
cactccaggtgtttgatcaaagataattcggggctcccaatttccaacagtcaggaaaaatgtcatctactttggcacatgctgacttaccttaatcaatygcagtggttttcaagcttgaacacacaccagaatcaagagggcttgttatgatgcagactcctggactccactgtcccggagtctctgattcagaatctg

SEQ ID NO: 19893 - DNA, 201 bp, Homo sapiens
taactaaaacatgacagagatgggattccaatccagttagtgtggcttcaaaatgcacacttttaaccaacacatctcctacgcctaaacagaagcatcasgagccttcaaaacatcaaattcagacaacgagagcatccaccaggcaatggccagcaaatgtttgcctctgtggcttgtaacccttaaacacaagatgtg

SEQ ID NO: 19894 - DNA, 201 bp, Homo sapiens
ttgggggtggtgattagattatgggggcagttcccccatgctgttctcgtgatagtgagtgacttctcacaagatctgatggttttaataagggggctcaytctcattctcgctcctgctgcactgtgaagagggaccttccaccatgattgtaagtttcctgaggcctccccagccatacagaaatgtgagtcaattaaa

SEQ ID NO: 19895 - DNA, 201 bp, Homo sapiens
tgtgcatttaagacttcaccttttccaattctcctttcgtttgagaaccatgtggattcgtaagtattcaacacattcaggaatgagtctttttcccgaayagggcatactgagtaattgtttatcagatttaagattatttgacatgattaatggtgttcttcaatcatgttgtatattaactggcatgttttcatttgt

SEQ ID NO: 19896 - DNA, 201 bp, Homo sapiens
cacctggaagaagcttgaagcaactgtcatggcattttaatgtattttaactttttgacccaatcacaagcctgggcctttgattttttttttttttttttctactgcctgtaacactagaaagagggacacagggaatgccatgtcagaacaaagtcacaacatggctatgaattctgttcatgtcctctcaacagtgat

SEQ ID NO: 19897 - DNA, 201 bp, Homo sapiens
gaatacataaagtgatgaatgattgcctgggactaggtgtgtggggtggggtgcaggaatgaggagtgactgctagtgggtacatggtttctttttgaggygataaaaatgttctaacttatattgggatggtgctcgcatgactctctgaatatactaaaaaccattgaactgtacactttcaatgggcagattatatct

SEQ ID NO: 19898 - DNA, 201 bp, Homo sapiens
gaactttgaaaccatgctaagtgaaaggtggtcggcacaaacaaccatatattgtatggttacatttatatgaaataattagaataggcaaatctatgaakacataaagtgatgaatgattgcctgggactaggtgtgtggggtggggtgcaggaatgaggagtgactgctagtgggtacatggtttctttttgaggcgat

SEQ ID NO: 19899 - DNA, 201 bp, Homo sapiens
tagatgaaacagagacttgggggcatatatttcccaatttttcaaaatccatttttatcgcatattcaatttggcctgcttaccttatttacattacctgyctgggatgaaagacatttgaggttgtcattctggactcttaagtaagttcttcctttaaagtaaagaagctgaccttccaagctaatttatcccacttaa

SEQ ID NO: 19900 - DNA, 201 bp, Homo sapiens
aatagctggaaacatacagaaagggaactctgggaaatatagtttggctgagacagttggcacaataagaagcatcacactgttaagtaaaaatcagaaaatgttttatttcaaaaatactctgtgtctcttgaaaaattagattctaagattataatagaaacatgcaaagaatttctaaagctaagaagaagctgtccc

SEQ ID NO: 19901 - DNA, 201 bp, Homo sapiens
gactctactcagcagcagcacatgtcattttcatacacaggcccttggccaaaataaaaccacggccaagcctatggtcaacagggtgtgtagacagaatyctcccaaaggaagggggaagcaaatacgtgggaatggtgataaaatctaccacagcagtcactgcagtggtttttgtatcaggatgatagcagtggaggt

SEQ ID NO: 19902 - DNA, 201 bp, Homo sapiens
aaaggaaaattacaagtaggcttggtgactagagtaacctgcagaagctgagcctctttgtcacagagttgaacatacacacatacacacacacacacacmcccctggcccaggagtcagacaattaaaggaagacccaatgggcaggggaagtgattgcaggctcagctgctgcttcccatcaaccagacacataaatca

SEQ ID NO: 19903 - DNA, 201 bp, Homo sapiens
acattgtttagaaggttcattaatattgtttcagataactctagatttgttggctttctttatcatgatgatagtattaattattactgttaattattatrtaagattccattctgtgatgctatcttttggaatgttgacgtctatcagtcaaagacccctaggaacatacctatggtcaagttgggtttgtttgctcat

SEQ ID NO: 19904 - DNA, 201 bp, Homo sapiens
aaaaactctaaactatcatgaaagcaaatatggcttctgtcattttttttctttccttctaagattccatatatatatttgcatataaaataaaatgaacmtttttactccatctcctctgtcaatgaattgtttttagtattttccatccttcgtctttctttactgctctgtgggcaattttttttcctacactttttg

SEQ ID NO: 19905 - DNA, 201 bp, Homo sapiens
tataaagtatgcatccatgtaactaccatctaaatcgagaaatagaaacttggggagtacctgaaacacttccatgtatccattcccatcagaatgtcccrtttaccctcagaggtgactaccatcctgactattacagtggtccctactttgcgcttctttagagcacaaagtacaaatttatatgcagccctaaatgat

SEQ ID NO: 19906 - DNA, 201 bp, Homo sapiens
attgctatttttgatcttctggttttttctatccctggatgccttgggtaatctgagacaaagctcaagggaatgtaaccagccacccaaaatgaatgcastcaagtgagaagttgcagagctgtgacttggggcagtattatgaattactctgagaaggagcttcagctcccaagttcaatcatggacttggaatgtatt

SEQ ID NO: 19907 - DNA, 201 bp, Homo sapiens
agtaaaaactgtatttatagaaacattatttcatataaagagtggtggaaaaaagaaagttttcctatttaaatgagtttaagaaatgctaggtgcaaagraaggttagcacctaccgtaatgtgttttgaatataaaataaaaggatcagagtctcacagtcatcaactcttcatcctccttgtcaccacccaacttatt

SEQ ID NO: 19908 - DNA, 201 bp, Homo sapiens
ataccaaggtttgcattagataaatctgtaaccactcaactgggttcttcttgcctgctgcctagaaaaagccaatacactgagaacagcaggtgttacarcagagaaagtttacttattgcaaggcagtggagcagaaggatgggacatatttctcaaatcagtctctctgataatccagaagctaggatttttcaagga

SEQ ID NO: 19909 - DNA, 201 bp, Homo sapiens
tttcaaatattcaattacattcaaaattttgctaaaacatttgttcatgcacatcttgccatagtgaagtccagcccaggaatttctgcctttgcatatgwaatgggatataaccagagactgacaaagaacattcaggataaagagaactattaacttgacacgtattttgtaggagatgctgtgggaaaataggcacat

SEQ ID NO: 19910 - DNA, 201 bp, Homo sapiens
gcctattacatgtggtgcttctatgaacacttgtactgggggaaaaaaaatgccagggttaagggtaactgcctctaaattgcaacttcagttcaagcaargaaaagagaacatttccctagaaagattctcttacttttgtgtgagtctcctaaatgatgacactcagaataagacgctttcttctccttccacagtccc

SEQ ID NO: 19911 - DNA, 201 bp, Homo sapiens
gataactaaaaggagacaagggtgggtgtgactggcaccaacttgagagattgtttaggtgacacagtgtccatcacactattgtttttataagccccacwgtcttaacatctttaccaagcttctctgtcttctgccaataaggctgtattttatcatttttattttcactaacttatgttgagtttataattgcttttg

SEQ ID NO: 19912 - DNA, 201 bp, Homo sapiens
tttttaggctatcatctgtgtcctcttgacatgacctattaatctttgaaagtgttctggcacatagagatcttccagactcaccttattcctttctgctycagagatggaaacagactattctccagtgagccctggttctttttgatgggaaagaaaaagtatgagtaacagcaatttggaccctgaacattgcctgga

SEQ ID NO: 19913 - DNA, 201 bp, Homo sapiens
ttgtaaactacatacttaactgaagagaatgttaaattttgtgtagaggttaaaattaaaactgtaaccattctttctcatccaagttcaaggaggttcayggaatatcactttaacagtctagatctttgacatgataaaattcaaagaagtataatttttaaaatctgagcacattatagaatcttacatttatcctat

SEQ ID NO: 19914 - DNA, 201 bp, Homo sapiens
aatgtttaaatcagtaaaaattagaattgttaaatgttgtcattttactgataggtttggcagtaggggagaagagaaggaaaacagatacttttatatamcattggtgaaagtcaattgctaggactttaacagaaagaaaattggttatgtgtattaaaatcctcaaaagtatgcgaagtctttgaatcagaaattcta

SEQ ID NO: 19915 - DNA, 201 bp, Homo sapiens
gtttttattttttaaagctaacctgcatattttttgcaaagcccacaaaacaatgtcacttcttgtgttcagcatttctcttgtcctcatgttggcatgayaagttttctgttatatttcatttttcttcctaaaattcagattcatgggttgagggataaaaatgctagaggacatctttaaattacttgcagagattag

SEQ ID NO: 19916 - DNA, 201 bp, Homo sapiens
tctaggattttattgatcgaaatctcatttaaattcctcctattgactctctaacctctgcggaaggttacagaaaaatggcattgtcgtccccgagtgcrttccaagttcttcttaacttcatgtttggtatgttcatagacttctctgaaatatttcagattgcctaagaatgaaaaaaaaatttttcaagatcgtcat

SEQ ID NO: 19917 - DNA, 201 bp, Homo sapiens
gtttttaaaaattgctataaagtatgtgaatacaccacacttcatttacccattccactgttgatggacatttaggttgtttccagcttttgcctattacrtgtggtgcttctatgaacacttgtactgggggaaaaaaaatgccagggttaagggtaactgcctctaaattgcaacttcagttcaagcaaagaaaagaga

SEQ ID NO: 19918 - DNA, 201 bp, Homo sapiens
gtcgggtttttaaaaattgctataaagtatgtgaatacaccacacttcatttacccattccactgttgatggacatttaggttgtttccagcttttgcctrttacatgtggtgcttctatgaacacttgtactgggggaaaaaaaatgccagggttaagggtaactgcctctaaattgcaacttcagttcaagcaaagaaa

SEQ ID NO: 19919 - DNA, 201 bp, Homo sapiens
ctttgcatctggcttctttttttgttgttgtagatagctgtagtcgggtttttaaaaattgctataaagtatgtgaatacaccacacttcatttacccatkccactgttgatggacatttaggttgtttccagcttttgcctattacatgtggtgcttctatgaacacttgtactgggggaaaaaaaatgccagggttaag

SEQ ID NO: 19920 - DNA, 201 bp, Homo sapiens
aaggaaataaatccaatagtatgctcatgacaattagttatataaataaaataaagtaggttattagtccatataagatagcctcaggaaaaaattaaatrcccagataaaaagtatgcagcttgacaaatttttacagaatttatgaaattaccacttgtgtcaagatacagaacattatcaacaccccagaaacttccc

SEQ ID NO: 19921 - DNA, 201 bp, Homo sapiens
cctggaaagtggaagcatctctaaaaacaacttccacagaatgcatgaatttacagatgatatgaaaacatgtgcatattgaattttctgaaaaatggcttatcacaaaatttaaaaaaagtatttatcaaaggaactttgggcacataaggaaataaatccaatagtatgctcatgacaattagttatataaataaaata

SEQ ID NO: 19922 - DNA, 201 bp, Homo sapiens
aacctgggaggcggaggttgtggcaagctgagatcacgcctctgcactccagcctgggcaacagagcaagattccgtctcaaaaaaaaaaaaaaaaaaatatgtatatatatatatatatatatatatatatatatttaaatgacacttttaaaaatggagggaggagagtagttatgatatatcagtttactgtaagaat

SEQ ID NO: 19923 - DNA, 201 bp, Homo sapiens
tgaacctgggaggcggaggttgtggcaagctgagatcacgcctctgcactccagcctgggcaacagagcaagattccgtctcaaaaaaaaaaaaaaaaaaatatgtatatatatatatatatatatatatatatatatttaaatgacacttttaaaaatggagggaggagagtagttatgatatatcagtttactgtaaga

SEQ ID NO: 19924 - DNA, 201 bp, Homo sapiens
atcacttgagcatgggaagtggagactgcagtaagctgggatcatgccactgcactccagcctgggcaacaatgtgagaccctgtctctaaaaaaaaaaaagaaagaaagaaagaaaagaaaagaaattaatttaaaagtaaacaaattaaaaattaaatttattaatgcaatgtacaccttggggcaatgggtagtagca

SEQ ID NO: 19925 - DNA, 201 bp, Homo sapiens
cccggccgccatcccatctaggaagtgaggagcgtctctgcccggccacccatcgtctgagatgtggggagcgcctctgccccgccgccccatctgggatktgaggagcgcctctgcccagccgcgaccccgtctgggaggtgaggagcgtctctgcccggccgccccgtctgagaagtgaggagaccctccgcccggcag

SEQ ID NO: 19926 - DNA, 201 bp, Homo sapiens
tcacacactgccacccccttatgagtagaggtaatcagaatgacaccattatcaatgacagcaataggagtttgccaataaataaaaaacaaatataaaayattaaaaaataggacctttacatgtctcaccaatattaaaatatcttgtttaaaattattatatgtcccagtaacttttaaatattaattcaatagagga

SEQ ID NO: 19927 - DNA, 201 bp, Homo sapiens
aagttagtgatcgatgtctatagcagtggtttccaagctggtcctagacatagcaccctttgtttgtttcttctaacaaagtctcgtgagaaaggccaatrtgtagggaaaagctttaaaggtgctgtcttggtggaatagaggggagcctggagtacaggtgatggtggctgttgccctatcactctttctcctcctgac

SEQ ID NO: 19928 - DNA, 201 bp, Homo sapiens
ctttgtcccgctactccagacatccacctaggcactccaacaggacttgcttagaaaaaagttgcaacacagaccatttagaagttagtgatcgatgtctrtagcagtggtttccaagctggtcctagacatagcaccctttgtttgtttcttctaacaaagtctcgtgagaaaggccaatatgtagggaaaagctttaaa

SEQ ID NO: 19929 - DNA, 201 bp, Homo sapiens
tatttaggtgagttgctaatgacttagaccaacgtggaatgtggaggaaataaaaaggaatccaaatttgcatgtatgtacacacacacacacacacacamacacacacacacacacacatattataaagaaggaagtgatggcatgtgtttatggattttatgttgcatgtgaaagaaagatgcatggaatcaaagacga

SEQ ID NO: 19930 - DNA, 201 bp, Homo sapiens
agccaggctacaattcccagggactgcatgcctcaggagtagttgaagaataaataccttatcttccatgccccttgggttgcaaagttctgatgtgtgtyctctgctttctcccagagttcctcggtgagactgagccctaactgcccacagctgtaacctgcctgatacccttctccttcttagctgcctttccttctt

SEQ ID NO: 19931 - DNA, 201 bp, Homo sapiens
ttacaacactcaacccattaattcaacaaatgaaaaccaagcaaatgagaaattactcctggaggagacaaatatgggttttttttgttttttgttttttkttttttttttttttgcctgctgaaaaaggtaagactttgttgcaaataaaatatgttcccctgaaaggccataattttgactctttttgagaaggaacta

SEQ ID NO: 19932 - DNA, 201 bp, Homo sapiens
aatgtccttacaacactcaacccattaattcaacaaatgaaaaccaagcaaatgagaaattactcctggaggagacaaatatgggttttttttgttttttkttttttgttttttttttttttgcctgctgaaaaaggtaagactttgttgcaaataaaatatgttcccctgaaaggccataattttgactctttttgagaa

SEQ ID NO: 19933 - DNA, 201 bp, Homo sapiens
taaaatggaaggaaagtggagagaatatagcatgacaaagaaaagaaggcctcaccaggcgcagcagctcacatctgtaatcccagcactttgggaggccraggcgggtggatcacgaggtcaggagatcgagaccatcctggctaacatggtgaaaccccgtctctactaaaaatataaaaaattaggtgggcgtggtgg

SEQ ID NO: 19934 - DNA, 201 bp, Homo sapiens
atttattgattttctagattatttcaggtcagtttctttctgataagaaagttgggacttacgtggaagtagatatgtttggtttgcctgtggatacaagraggaaggcatttaagaccaaaacatcccaaggaaatgctgtgaatcctgtctgggaagaagaacctattgtgttcaaaaaggttggtcacatgttcttga

SEQ ID NO: 19935 - DNA, 201 bp, Homo sapiens
tatggcctgtctgttttgtgagtcaaactctgtgtctttgcagatcggaacccagcagccctgatcatggttcatcaacgattgagcaagacctcgctgcyctggatgctgaaatgacccaaaagttaatagacttgaaggacaaacaacagcagcagctgcttaatcttcggcaagaacagtattatagtgaaaaatacc

SEQ ID NO: 19936 - DNA, 201 bp, Homo sapiens
taaaattaattgtcttatgaatattaactttgaatgaactgagtatctgtagatcaaatactttgaggttaccaaatggcatctcagttttagaacattcsttccattttgattcatcactgaatagttttctgtttgtggaaattgtgtttttcaattttcctgcgcttctattttcaatttaaaatatctactctaaaa

SEQ ID NO: 19937 - DNA, 201 bp, Homo sapiens
aaataaatagataaaaataaggaaaaaagaaaaagaatgttgagagttctgtaaccttttatctagaagtctgagattaccatttgtcaattctggatgarttggtataatgatgtattcatcatttgcttttagggagaagacagagatgatccggtcatatatccaggaagtggtgcagtatatcaagagggtatgtgg

SEQ ID NO: 19938 - DNA, 201 bp, Homo sapiens
agagcgaaaccttgtctccaataaataaatagataaaaataaggaaaaaagaaaaagaatgttgagagttctgtaaccttttatctagaagtctgagattmccatttgtcaattctggatgaattggtataatgatgtattcatcatttgcttttagggagaagacagagatgatccggtcatatatccaggaagtggtgc

SEQ ID NO: 19939 - DNA, 201 bp, Homo sapiens
aaagaatgagagtaatgtatacatgtgctacaggagtagagataagaaagagcaatattctcatctttcatggtggtaagtcaaaaatagcaatacatgcrtattattttgagatacagaagtaaataccaaaagcttctgctaaaagatttgaaggtgtttgcttctaagtaaggagacatgaggaagcgtgtttctatt

SEQ ID NO: 19940 - DNA, 201 bp, Homo sapiens
  misc_feature (1)...(201): n = A,T,C or G, or insertion/deletion polymorphism (see Tables 1-2)
tctattaaccatcctagtaaaagtggtgctggatggcagccatagaataattctaaatttagcagataacccttggcttctcgaccatgttgtttttcctnttcttgtctcctgaagtggtatctgcacatcaagagcaaatcacacaggtggcttcttagctccccttggtgactccacacactggagacattcagcccc

SEQ ID NO: 19941 - DNA, 201 bp, Homo sapiens
tttcgctttactaggtagacgttataaaaactaatgatggtgatgattataatctctattctccatccttgaaagttcaaacatgccctaattaaagaaayaggctggcatagtgtcatgatgaagccagtaaacctcaggcaagagacttgacttgtgtgagcttcaggttcttcatctgtaaaatgggatgagaccagc

SEQ ID NO: 19942 - DNA, 201 bp, Homo sapiens
ccacttggctcacttcaacctctgcctcctgggttcaagccattctcctgcctcagcctgccgaatagctgggactacaggcgcatgccaccatgcccagytaatttttgtgtttttagtagagacggggtttcaccatattgaccaggatggtcttgattgtcctggtttctgtgtcattagtgattattggcagggatt

SEQ ID NO: 19943 - DNA, 201 bp, Homo sapiens
ccatatcagattgcattagaatgttgactgcatgttaactggtgatccttcttcctctcaatacttattttaaaatcactctaaacgccctgctcttattrctaattagattatttggccttggtgtatagtgtcttggggtcatcagtatgaaggtcaagtcacgcaaaaagagtggagtctccaatgtggatacaccca

SEQ ID NO: 19944 - DNA, 201 bp, Homo sapiens
ttggcagcttacacttctttggcttcaacaaagctggtgttttgtttggaccccgggagttccttcttgatttctcacctttctgaatgtggtagatacartagctctccccaagggtctgtgctgctatgttctgagatcattcatggagagccaacctaaagcctgctcctccaacccttccagtttttctgtcaagtg

SEQ ID NO: 19945 - DNA, 201 bp, Homo sapiens
tttgaatcatatttttccagcaccatttcgctttactaggtagacgttataaaaactaatgatggtgatgattataatctctattctccatccttgaaagwtcaaacatgccctaattaaagaaacaggctggcatagtgtcatgatgaagccagtaaacctcaggcaagagacttgacttgtgtgagcttcaggttcttc

SEQ ID NO: 19946 - DNA, 201 bp, Homo sapiens
gaatcgcttgaacccaggaggtggaggttgcagtgagccaagatttgccactgcactccagcctgggtgacagagtgagactgtatctcaaaaaaaaaaaataaataaataaagagaataaggcatttgatatagtttctttgcataacaaaatacaaataaaaccacattctatttcatctaaacactttctcccaagtc

SEQ ID NO: 19947 - DNA, 201 bp, Homo sapiens
tttcattggcccccgcatctctctgccacatgatggacagccatatcagattgcattagaatgttgactgcatgttaactggtgatccttcttcctctcawtacttattttaaaatcactctaaacgccctgctcttattactaattagattatttggccttggtgtatagtgtcttggggtcatcagtatgaaggtcaag

SEQ ID NO: 19948 - DNA, 201 bp, Homo sapiens
gggagccgagataaatgatcacttaacagaggaactgtggccggaagagtggggtcaagaaaacattgaacaaagaagggttaattttgaaggaggggaargaataagctagaaatggaagtatctgaaacaaactaggcagcatagaacagtgttcctaaatataaattttgaaaagttttttttttttttttttgagac

SEQ ID NO: 19949 - DNA, 201 bp, Homo sapiens
tgtacacttgactcttactatttacttcattatcacttcaatttcctagtaaattttttgaatcatatttttccagcaccatttcgctttactaggtagamgttataaaaactaatgatggtgatgattataatctctattctccatccttgaaagttcaaacatgccctaattaaagaaacaggctggcatagtgtcatg

SEQ ID NO: 19950 - DNA, 201 bp, Homo sapiens
ggagaatcgcttgaacccaggaggtggaggttgcagtgagccaagatttgccactgcactccagcctgggtgacagagtgagactgtatctcaaaaaaaawaaataaataaataaagagaataaggcatttgatatagtttctttgcataacaaaatacaaataaaaccacattctatttcatctaaacactttctcccaa

SEQ ID NO: 19951 - DNA, 201 bp, Homo sapiens
aagggaagctcttgtttctgattgggggtagtcacacgctgggagttaggaacaccagtgatcgttaggttagtttcctctgtttacaaggcattcctttmggtctgaaatcacttggtggttcagtgcactaggtttttctttaaactttggtgtgtgatttttttgtcattgttgttatatgtatagatgcatgtaaca

SEQ ID NO: 19952 - DNA, 201 bp, Homo sapiens
aattcagctgccaagtataagtgcaattaaaatacttctaaataatggcatcaacttaagaattatggagatttttttcataaagaataagccatttggcygggcacggtggctcatgcctataatcccagcactttgggaggccgaggcggacagatcacttgaggtcaggagtttgagatgagcctggccaacatggtg

SEQ ID NO: 19953 - DNA, 201 bp, Homo sapiens
ccagaaaaggtcagtactttctttcacaccaaagggaagctcttgtttctgattgggggtagtcacacgctgggagttaggaacaccagtgatcgttaggytagtttcctctgtttacaaggcattcctttcggtctgaaatcacttggtggttcagtgcactaggtttttctttaaactttggtgtgtgatttttttgtc

SEQ ID NO: 19954 - DNA, 201 bp, Homo sapiens
gcttgaacccaggaggtggaggttgcagtgagctgagatcacaccactgcacaccagcctgagcaacaaagcaagactccatctcaaaaaaaaaaaaaaaagaaaagatatatgagcaacaattactggggaaacttttcaaacaaagatttcagagagttggtcatgtttcttataaattcttagtggaaatcccagaag

SEQ ID NO: 19955 - DNA, 201 bp, Homo sapiens
aggaattatactctcttgttgaagcctaactgtaacttttaaaaacactcaaacgggttgtttactttaagtaatgacaataaatacatctttaaatgatyacagatatatggagttggatgattaaatcaaaaatttactgtcataataaaaaaacctctgtgttcggtttagagtggtgcacccttatgcacatgatgc

SEQ ID NO: 19956 - DNA, 201 bp, Homo sapiens
ccattctttgatgaacatactttatttggctctcctggacaacattttgataaatataaaatgactttaacacaagaatcaaagggaaaaaaatttcagawttaaagaacaatgacctgaaatccatggaagaggagcacgtgtaacaaatttacttgacatcttgctctgcaagttgcttttgctgtatttgaacttctc

SEQ ID NO: 19957 - DNA, 201 bp, Homo sapiens
atttgtctttagatggtcaatacaattgaaatgggaagtttgaacaatatgttgaggaattatactctcttgttgaagcctaactgtaacttttaaaaacrctcaaacgggttgtttactttaagtaatgacaataaatacatctttaaatgattacagatatatggagttggatgattaaatcaaaaatttactgtcata

SEQ ID NO: 19958 - DNA, 201 bp, Homo sapiens
tagcaggagacaattcttaaacttaaattaaactgaaaaagccacagaaaaaagggtttgacaccctaaagccagtgtccaaatgaacgctacggttgacmtcataggtgtgttatgaatgtttaccctgacctcctagaagaaaaggaaaaagaaaggaaagagagagggagaaggtgagggaaggggggaagaaaagaa

SEQ ID NO: 19959 - DNA, 201 bp, Homo sapiens
atatcagtaagcagtcaagttacaaataaatatgtttactttgattctagttatgtaaaattctgtgtgtgtgtgtgtgtgtgtgtgtgtgtgtgtgtgtttatgtagagaaatgtctacaactgcaccattcaacttggtagacactggcctcatgttgctacttaaatctgaattaatttaatttcaaccaaattaaaa

SEQ ID NO: 19960 - DNA, 201 bp, Homo sapiens
acttgtcaagaaaaacaagtctatatgtggactttattcattagagtctgcttcagtgaattaatatattttaaaataacattttttctgatttttttccraaatttaagtacccatttctcatataattattttttaaatcaagaaatatataacgaagaaaatgcagaccaccgtcccaaaactaataggaatatttag

SEQ ID NO: 19961 - DNA, 201 bp, Homo sapiens
tatatcagtaagcagtcaagttacaaataaatatgtttactttgattctagttatgtaaaattctgtgtgtgtgtgtgtgtgtgtgtgtgtgtgtgtgtgtttatgtagagaaatgtctacaactgcaccattcaacttggtagacactggcctcatgttgctacttaaatctgaattaatttaatttcaaccaaattaaa

SEQ ID NO: 19962 - DNA, 201 bp, Homo sapiens
gtatatcagtaagcagtcaagttacaaataaatatgtttactttgattctagttatgtaaaattctgtgtgtgtgtgtgtgtgtgtgtgtgtgtgtgtgtgtttatgtagagaaatgtctacaactgcaccattcaacttggtagacactggcctcatgttgctacttaaatctgaattaatttaatttcaaccaaattaa

SEQ ID NO: 19963 - DNA, 201 bp, Homo sapiens
acataaaagtcagaactgagtgggcagaaggtctgtgagttctccagcttagtctcaatattgactggaggccgatgctgctgaggataaaggcagtaggyggaagggaaacagcacatgtgagcagatgctggcataatcaagaaaatattctgaagtcaggtgaatgatagagatgaggacatggaaacaggaatataa

SEQ ID NO: 19964 - DNA, 201 bp, Homo sapiens
tctggggagtctggagggagtgtggcactgacagtggtgtggagcctgacaccaaaccaacataaaagtcagaactgagtgggcagaaggtctgtgagttmtccagcttagtctcaatattgactggaggccgatgctgctgaggataaaggcagtaggcggaagggaaacagcacatgtgagcagatgctggcataatca

SEQ ID NO: 19965 - DNA, 201 bp, Homo sapiens
tcaatttatcaatattttatcttattgcttttggcatttgagtcacagttagtaagtctttattcatgcctagtttataaagaaaattcacctatagcttytttttttttttctagtatgacttcgtgattttccatttagatcttggagcatcttggaggttttttttgtttgtttgtcatgaggtatgaacccaatttt

SEQ ID NO: 19966 - DNA, 201 bp, Homo sapiens
gtcctcattctttttctagaggttgtagagtattatttcattttatagatgtgccataatttatgtacttagtcatttgttaataggcattttattgtttycggttttttgctgcctcaaacaatgctttgatgtgtatatatatgtatatataaaatatcatctttgggcacaatacaggtatattcgaatttcctattg

SEQ ID NO: 19967 - DNA, 201 bp, Homo sapiens
aaactacaggtgtacctcacatcctctctttgtagcataaaaaagagataaattattgatgcccatataaaatcccattgccaatttaatgtgagttgggyggtagtggcatactatttaatattaacaaaatcataatattaattattctgtctcctggaggttcagtagacaaaatttaaataaaaatagtaaatgccg

SEQ ID NO: 19968 - DNA, 201 bp, Homo sapiens
acaagcgtgaagttttattccccagggcctttctgttaactccttaaaaggtttggaacattgagctgggagagttatcatgaatggcaaacaaaccagcmaaaagtaattgagatgtgtctgttcctttgggacagaaaagaaaatcataccaaaagtgaaaattaaatgttgtttactaccattcagtttaccacatac

SEQ ID NO: 19969 - DNA, 201 bp, Homo sapiens
gaggttgtagagtattatttcattttatagatgtgccataatttatgtacttagtcatttgttaataggcattttattgtttccggttttttgctgcctcraacaatgctttgatgtgtatatatatgtatatataaaatatcatctttgggcacaatacaggtatattcgaatttcctattggtgaaattgctaagtcca

SEQ ID NO: 19970 - DNA, 201 bp, Homo sapiens
tccattttcctgatagctaaaaaaaaattagaactaataaaaactgtaattttttataaataaattcacactgtgtatgctttttttctctctgggttggwtcactcaacattatatgcatatattgttgggtgttactgtagattgtccattttctttgctgtgtagagttttattgtatgaatataccaaatgtattta

SEQ ID NO: 19971 - DNA, 201 bp, Homo sapiens
ccttttattattaaattaaatttatataatttatttttattgaatttgatgtgcgtattatgcccagttataagtcctgatgcatgaaccacacttgacaygtgagcctctactcataggcccatgcaacctgcttttttttatttttaagttaatttgtaatttttaattgtaatgggttgaatagcagtccccaaaaag

SEQ ID NO: 19972 - DNA, 201 bp, Homo sapiens
attgaagtgtagccttttaaagtatattttaaaattaggctagtcattttgagatggtttcattgcagcttctttggaatcatttttagagtagaaatgcrttagtataatttttatgtcacaatcaccacacttcattatgggcataacaacagcaatgcttgttttaatatattgtaaccagagtttagaaacatgtaa

SEQ ID NO: 19973 - DNA, 201 bp, Homo sapiens
attcttttagtctttgttcacccaatgaaagagtagacttttattgggcttctgttttcaagttctgttgcacagattggggtataaatatagagatcctkcattccatttgtgtaaactattggggtctatacagagaccccaatagcagaagagcatgtggatctgctacctgacaaacagaggcattttcctgcataa

SEQ ID NO: 19974 - DNA, 201 bp, Homo sapiens
tattgacatgtaacagattctgaagatggtgtctggacattttcatgccatttgttgctagttgagttgaaggaatgctgttggcacctacaacattagcrtctacatcctttgctgtgtcataaaggatagatgtaaaatacaatgaactatgaaggagggaggtaggaagtatgacatcatattctctcagggcataaa

SEQ ID NO: 19975 - DNA, 201 bp, Homo sapiens
agcatagaacagtgttcctaaatataaattttgaaaagttttttttttttttttttgagacggcgtctcgctctgtcacccaggctggagtgcagtggtgygatctcagctcactgcaagctctgcctcccgggttcatgccattctcctgcctcagcctcctttagaagttttattctgctcacttaaatatttgattgt

SEQ ID NO: 19976 - DNA, 201 bp, Homo sapiens
accacgaaaattcattactcctaatataatttaattacaaaattgttccttggtttcataagttgcatatatttagctcttcccactactttaggagaaawtaaattggatactttccatgctatgaagctattataatggaatatttgtactttttgatgccaaaaaatggttcgagccattggattggcagaatatgtg

SEQ ID NO: 19977 - DNA, 201 bp, Homo sapiens
tagtcttgccacagcactggcatacggagttgcattttaacgaagaagatcaggaataaacccatgtatttgtttcaaataataaagtttactgtagttgrtgggcacacatgtaatacaaagagaaattaattattttaaatttgaagaattgtataaattttactaaatactatgaataaaatgtataaaataacttct

SEQ ID NO: 19978 - DNA, 201 bp, Homo sapiens
agtatatcagtaagcagtcaagttacaaataaatatgtttactttgattctagttatgtaaaattctgtgtgtgtgtgtgtgtgtgtgtgtgtgtgtgtgtgtttatgtagagaaatgtctacaactgcaccattcaacttggtagacactggcctcatgttgctacttaaatctgaattaatttaatttcaaccaaatta

SEQ ID NO: 19979 - DNA, 201 bp, Homo sapiens
taccactttacccacaaactttctgagaactgaaaatagtttatttgcaccaaattcccttgatttaaggcttattaacttgaaaagagctcagtgacatytggaattgtataatagtcttgccacagcactggcatacggagttgcattttaacgaagaagatcaggaataaacccatgtatttgtttcaaataataaag

SEQ ID NO: 19980 - DNA, 201 bp, Homo sapiens
accagaaacacagtggatgtcctgttgagatttctttttaaaacatgatattactgcacattgttggggataaataaggcacttgaacttgtatcctggcygacgtgatccactagaataacatattcctttagaagatgctactctttagaaatcacagttgctagcctgaagttaccctaattgttaaaaggtagtact

SEQ ID NO: 19981 - DNA, 201 bp, Homo sapiens
cagtatatcagtaagcagtcaagttacaaataaatatgtttactttgattctagttatgtaaaattctgtgtgtgtgtgtgtgtgtgtgtgtgtgtgtgtgtgtttatgtagagaaatgtctacaactgcaccattcaacttggtagacactggcctcatgttgctacttaaatctgaattaatttaatttcaaccaaatt

SEQ ID NO: 19982 - DNA, 201 bp, Homo sapiens
gctagatttaattgtgctctgtaaatagatatattaccagaaacacagtggatgtcctgttgagatttctttttaaaacatgatattactgcacattgttrgggataaataaggcacttgaacttgtatcctggctgacgtgatccactagaataacatattcctttagaagatgctactctttagaaatcacagttgcta

SEQ ID NO: 19983 - DNA, 201 bp, Homo sapiens
atcagtatatcagtaagcagtcaagttacaaataaatatgtttactttgattctagttatgtaaaattctgtgtgtgtgtgtgtgtgtgtgtgtgtgtgtgtgtgtttatgtagagaaatgtctacaactgcaccattcaacttggtagacactggcctcatgttgctacttaaatctgaattaatttaatttcaaccaaa

SEQ ID NO: 19984 - DNA, 201 bp, Homo sapiens
aaatatccactaattagcaaaaaattttggccatattcacaagaggtattttaaacaagccacggaagaaaagggttatataaatcatagttggttctgcrtaaatgggagcatattttgtagccaagtcatttaagctagatttaattgtgctctgtaaatagatatattaccagaaacacagtggatgtcctgttgaga

SEQ ID NO: 19985 - DNA, 201 bp, Homo sapiens
aggtaatttttcaacgttcactctcctctcatcctccccacatgaggagtccccagtgtctattattgtcatctttctgtccatgtgtacccatggtttarctctcgcttgtaagtgagaacatgtggtatatgattttctgtttctgagttatttcttttaggataatggcctccagcttcatccatttcatccatttta

SEQ ID NO: 19986 - DNA, 201 bp, Homo sapiens
tccggtcatatatccaggaagtggtgcagtatatcaagagggtatgtgggctcatcacgctctctcctttgcaaaacatgtgtgaacatttggtgagctcrctgtgagcttctggaaggaaatgtcatgccttgccataactttttatcactagcacctagcagagctgtttcacagggtgggcactccttaatcaacatt

SEQ ID NO: 19987 - DNA, 201 bp, Homo sapiens
tgcaaagcttcatatggaatgaggttaattctgtcacagtgggcctattggagtgctgtggcataaagactagatttttacagtggaaaaatggctgaagrtcagcatatccaggtcttgctcgtaatggccataagcaaagcaattatgctccaatcccaattcttctctgtgatgtatggatctaaagtgtaggagccc

SEQ ID NO: 19988 - DNA, 201 bp, Homo sapiens
ttacttggatgacttatagaattagaatgctttttaaaaatctaaaaaccaaagactgtttcagagctaggaaataaatgtttctgtgaactgactatgaygtatcaaaactctgttttaaatctctgtgataatttcattcctacataacaatgactctagaaaatatccactaattagcaaaaaattttggccatattc

SEQ ID NO: 19989 - DNA, 201 bp, Homo sapiens
ggctgctttgtttacctaagcaagcctgggcaatggcgggcgcccctcccccagcctcgctgccgccttgcagtttgatctcagactgctgtgctagcaaycagcgagactccgtgggcgtaggaccctccgagccaggtaagggatgtaatctcctggtgcgccgttttttaagcccgttggaaaagcgcagtattcggg

SEQ ID NO: 19990 - DNA, 201 bp, Homo sapiens
attgtaattttctaaacaactggattctgagcagtcaataaatacacattgagtaatctactatgtttattatatgttcaaactttcagaccaatgtcaaytgcaggcaaatttaaaaggaaaatgagattcaaataacatgagttatgtttaaattagaaaaaattatctctaacaaattaaatgtaatgataattatct

SEQ ID NO: 19991 - DNA, 201 bp, Homo sapiens
gccctgcccccagaggtggagcctacagaggcaggcaggcctccttgagctgtggtgggctccacccagttcgcgcttcccggctgctttgtttacctaakcaagcctgggcaatggcgggcgcccctcccccagcctcgctgccgccttgcagtttgatctcagactgctgtgctagcaaccagcgagactccgtgggcg

SEQ ID NO: 19992 - DNA, 201 bp, Homo sapiens
aaacacctactttgctcatacggtggtaaagtaggtgagaggacaagcatgtaacatgctttcatttttatgcctgacacacacaaggtacatcatatacrttaaccacctcaaataaaataatttgctttcattttgattcatttctacatgactggctctaaaatgatttgttactattgtttctggaagtccattgca

SEQ ID NO: 19993 - DNA, 201 bp, Homo sapiens
actgaaaattggtaccaagaggtggggtttttgctgataacaaatatctgaaaatgtagaagcagctttggaactgggtaatgaacagaggctgaaaaaartttatagagctagctagaaacagccaagacttggtgaggcctcttttcactcctataaccccagtatttcaatctagaatgacccttgctttttgtagat

SEQ ID NO: 19994 - DNA, 201 bp, Homo sapiens
aagcccatgtggccaatctttgaccactatcatccctgtctctgaatttatatgttactgatgagcaatcatcttcttacacttattcacacctaagtacytagtaaaaaaattgacaaaccattaatacagtaaaaaaaataatgtgttcaggataactaagcagcaaagtagcatcaccagattacttgtattttatca

SEQ ID NO: 19995 - DNA, 201 bp, Homo sapiens
agatgtgccctctccaccttggacttcccagcctttgtaactgtaggaaatacattttgattcctatatattatacagtttcaagtattctgctatatgcrtcagaaaacagagtaagactgaaaattggtaccaagaggtggggtttttgctgataacaaatatctgaaaatgtagaagcagctttggaactgggtaatg

SEQ ID NO: 19996 - DNA, 201 bp, Homo sapiens
tgttttgtctttgggcttagttgtgcacttctctcattttatcagggtagacagaacgaagacatgaacaatgttttgaaactcactccttcattcattcaaccaataattgaacactgggcacagttctaggtgactgagttacatcggtgaccaaaacagactcatattctacctttggaatttacactctagtagcat

SEQ ID NO: 19997 - DNA, 201 bp, Homo sapiens
gctcacacatttcaatttcaaaacccagaaccatggtattaattctaaaatctgagctactaaagctggggccctcaagtaagtacaccatggaatctgcragatagaaattcctagcctcgcattttagtttaaaaagttttagtttgaaagtatgggggatgagctggtggcataagctgtataacaatgatattttta

SEQ ID NO: 19998 - DNA, 201 bp, Homo sapiens
ctgttttgtctttgggcttagttgtgcacttctctcattttatcagggtagacagaacgaagacatgaacaatgttttgaaactcactccttcattcattcaaccaataattgaacactgggcacagttctaggtgactgagttacatcggtgaccaaaacagactcatattctacctttggaatttacactctagtagca

SEQ ID NO: 19999 - DNA, 201 bp, Homo sapiens
tgactgaatgtttctgataattattcaactcctctcctcatgtataagttcttggctgaagaaaagttctaaaaatgatttaagacctagctgtacccttsccagtcatctgctacaaacccagactttgagcacccctcctctctttcccatctctcccactcatttagcccttagcatatgcaacgttttatcatttgt

SEQ ID NO: 20000 - DNA, 201 bp, Homo sapiens
agctttcctcatcaatgtttatatatttctttcttttttctgaaacttgctctttcactctgtctctcccctagggaacactaaaaatagcctgtaggttraggaatctccaaaacacaggtgtgatttgtttgaaattctgtttgactcatgtgtgttgagttacttctaaattcaaggtattgtgactacttgaatgat

SEQ ID NO: 20001 - DNA, 201 bp, Homo sapiens
gggagccactgaggttaaaaaattcagcctactgccatctctttactttgggctgtatggaagttgttcatgacctccataattgttcttttgtaggatamcctgtatcagattatagactctgaaatccaactcccagggttcaaaacctgccttgaacactatgtatctctgaggaagacatttaactcattctgagct

SEQ ID NO: 20002 - DNA, 201 bp, Homo sapiens
gaaacttaatccccaatatgacagttttgagaggtagggcctttaagaggaaattaagagcttccatgattaatgggttaatgaattaatggattatcatsggagaggaactggtggctttataagaagagaaaaacagacctgagctagcatgttcttccccctcaccatctgattccctgtgccacctctgccaaagtg

SEQ ID NO: 20003 - DNA, 201 bp, Homo sapiens
agtacaccatggaatctgcgagatagaaattcctagcctcgcattttagtttaaaaagttttagtttgaaagtatgggggatgagctggtggcataagctrtataacaatgatatttttattaaatttgaaggcctaaaaatatcctgtagtaggggaaagtacttttacccaccataaatgttattaggtttgtgtaatt

SEQ ID NO: 20004 - DNA, 201 bp, Homo sapiens
aaggggacagaattaataaggatgtttattttagtgcttaatattagagattatttaatgcaatattttttaattgggtcagcaccataatcctaaaataytgattttatactagacaccttaattttaaaagcacgcagttgatctttcagaagacagatgcaaatgcatggaggaatggttatcttttagttctttaaa

SEQ ID NO: 20005 - DNA, 201 bp, Homo sapiens
actgttttgtctttgggcttagttgtgcacttctctcattttatcagggtagacagaacgaagacatgaacaatgttttgaaactcactccttcattcattcaaccaataattgaacactgggcacagttctaggtgactgagttacatcggtgaccaaaacagactcatattctacctttggaatttacactctagtagc

SEQ ID NO: 20006 - DNA, 201 bp, Homo sapiens
tcctgaagtagaattcccaatgtatgcatccatcaacagtgacctagagttctcattctgagaatgaatatataagcaaacaataagcaaaatatggttarttctcagaaacatgctattgagtgaaagaagccaaacacaagagtatgattccttcatgtaaggtgcaaaaacaggcaaaagtaatctatgctatttgta

SEQ ID NO: 20007 - DNA, 201 bp, Homo sapiens
cactgttttgtctttgggcttagttgtgcacttctctcattttatcagggtagacagaacgaagacatgaacaatgttttgaaactcactccttcattcattcaaccaataattgaacactgggcacagttctaggtgactgagttacatcggtgaccaaaacagactcatattctacctttggaatttacactctagtag

SEQ ID NO: 20008 - DNA, 201 bp, Homo sapiens
gatgtctccctatgaatagctactatggacatgtcttttagtgaacatattgttaatatttttgttgcacacatctagctttgggattgctgggccttagygtgtgcagcttcctgaagtagaattcccaatgtatgcatccatcaacagtgacctagagttctcattctgagaatgaatatataagcaaacaataagcaa

SEQ ID NO: 20009 - DNA, 201 bp, Homo sapiens
tccatccatttatccatccatccatccattctttcatccacctatccacctatggtatgtacttgcatgtgtgtgtgtgtgtgtgtgtgtgtgtgtgtgtgtaaacatatttaaaaggcaggtttactcattgcttttggtacagttctctaaactaaagaagcttatgttggtacttttattgtccatgaaattatatta

SEQ ID NO: 20010 - DNA, 201 bp, Homo sapiens
ccacaagtagaaacattaataggtggtcctctattttgtttaacagagttctgtcttccctcttcttatgtaagacatacccatcattccagacctaatayctcagccacattcctttattttactcttctatgaattccttttgcttttagtcaatacctcaggtcttcatttaagggcttttttatgggatcgcctcct

SEQ ID NO: 20011 - DNA, 201 bp, Homo sapiens
attctcccaattgttttttattttaaaccagaacattgccctgtagacttaatgtttccagcttctcttgcagctaggtgtggttgaggtcaatgaggtayagtaaatgctgtgtggtatatcttggtactttttaaatggatctgttaagctatgagggtctttctgccttgctttcttctttccaatatagatgtgatg

SEQ ID NO: 20012 - DNA, 201 bp, Homo sapiens
ccatgttagctcacctctagttcttttcccagttttctctgctcgggattccctcttttcttccccatcactctatgttccctgctcctccagttccatcytgaatgttactgtacacatgacagcgtattatcggtgccttaagtcaggaagcaaaaaaaagacaaatcaaacaaaagtagaaacaacaaaaaaacaggt

SEQ ID NO: 20013 - DNA, 201 bp, Homo sapiens
aacatttcacactgacatatttccatacaatcatttaaatttattatttccagtttttagtgtaaatatacatatacacatagtctctctttatatataaytaaaaatctaagctcatcctagaaatattttgggaatatgtattttataaagaaacagaatcagaatataatttgttactcatctctctttccaaaggca

SEQ ID NO: 20014 - DNA, 201 bp, Homo sapiens
ccccctccctcttttctaattcctattagactactttttgtttgctctaactcctgccatgttagctcacctctagttcttttcccagttttctctgctcrggattccctcttttcttccccatcactctatgttccctgctcctccagttccatcttgaatgttactgtacacatgacagcgtattatcggtgccttaag

SEQ ID NO: 20015 - DNA, 201 bp, Homo sapiens
aattagccaggcatggtggcgagcacctgtaatcccagctactctggaggctgtggcaggggaattgcttgaagacaagaggcagaggttgcactgagccragatcatgccactgcactccagcctgggtgacagagcgagactccttctcaaaacaaaacaaaaaaatgctgtgtttaagaagagggtatctgaggatca

SEQ ID NO: 20016 - DNA, 201 bp, Homo sapiens
cattgaaagcaaggaaatgtagtcctcatctccatctgttgaaggggacaataactattgaagaaggccactgaattaacaaatatatcacattctggaamcttcttaccctggaggttgaagggaagacaataatgataaatatgaaaacaggcaattaatcatcagccactgcaagatgaaaaattcttcagaagtttg

SEQ ID NO: 20017 - DNA, 201 bp, Homo sapiens
aggagtttgccaataaataaaaaacaaatataaaatattaaaaaataggacctttacatgtctcaccaatattaaaatatcttgtttaaaattattatatrtcccagtaacttttaaatattaattcaatagaggacgagataaatagtgaaacacagagaatttttagggcaatgaaactactctgtgtagttaaatctc

SEQ ID NO: 20018 - DNA, 201 bp, Homo sapiens
gctgaaatcccagtgaaggaagacaggcaataagcaaatgagttcatgatcaggaaaaatggtatgaagtaactaaagcaaggtgccagttggagtaaccrggtgtattttgttttcttttgagtggttagaggaggactctttgaggaggagacatttaagctgagatctgtatgaaaagaagagccatccaggcaaaga

SEQ ID NO: 20019 - DNA, 201 bp, Homo sapiens
accatatgtgacaactcttggtgaagttggtggccatggggaagaacccgtcagtaaggaaaagaaaaatgccctcaggaagagagcagagtaatagcaaycaagaaagcccttttgcattcagtctccaaattcctgatgatcatgtatttattataaatgcattttttggctgcagtttgtccagtttttccttcaatt

SEQ ID NO: 20020 - DNA, 201 bp, Homo sapiens
gatctagaaccagaaataccatttgacccagcaatcccattactgggtatatacgcaaaggattataaatcattctactataaagacacatgcacatgtakgtttattacggcagtgttcacaatagcaaagacttggaaccaacccaaatgcccatcaatgatagactggataaagaaaatgtggcacatatataccatg

SEQ ID NO: 20021 - DNA, 201 bp, Homo sapiens
gtgaatcaaaaccacaatgagataccacttgacaccatttggatagctattattgataataaataaataaaataaataaataaataaataaataaataaaataaataaaaaaaataataaaaatggaaataaaacaagtgttggtgaagatgagggaaactgtaacccatgtatgttcctagtgatgataggaaatggtgc

SEQ ID NO: 20022 - DNA, 201 bp, Homo sapiens
cctttcctggcccctgaagatacttgcatttattgcctgtcttttaaggaattgttatagttagagattgggttgtgtgaaattgccttttgcataggtgraaaacagcaaatattacaaatttcatatcatttgacctaatcagaacataagaatcaaacaaaatgctgctgtctttggtgatcttccagtttcaaaaca

SEQ ID NO: 20023 - DNA, 201 bp, Homo sapiens
ttgtgaattatgagtgatgaaattctagattacaaattgcagacaaagaagtctgtgccttttcccaggcatagcgtcagctggtgaagtttatagagccrgatgtatttagtagaaatcagagcgtgactaacacttcaagaagaagatttgcagatgcacaaaaaagagcagagaagtccagaattgcagcttggcttt

SEQ ID NO: 20024 - DNA, 201 bp, Homo sapiens
gggggctgtagcatagactctgaattattgattctgggttcaaatctgagcctagttcccagtgacccagcacatgtgatttgacctttctgtgccttagyttccctatttataaatggcaatgataaaaatatttccttcacaggaacgtttggaagaccaaatgatttaatatttgtgaagaacttagtatagttctgg

SEQ ID NO: 20025 - DNA, 201 bp, Homo sapiens
ctttaatctacctggagtcaatttctatgtttggtatgataggaactgaattatacctcttttgttatagaaaatgtgtaccatcagcaatatttatcaawgtaactaactttattaagtccttgaacttcccattttatttctatgtgctttcaaaattttattattacagagaatgaaattgttttattgcctttcaaa

SEQ ID NO: 20026 - DNA, 201 bp, Homo sapiens
caaagtgcaaagatggtgagatgaaagcatgcttgatgtattcaaggaaaagcaacaagatcaatggactgtatccaggtgacagagagggagaggaaaargagatgtatttaaagaaatggcaggtgccagatcaagttaggctgtgtagattatgataatgaatttggatttcattccatgtgaaatgggaggtcattg

SEQ ID NO: 20027 - DNA, 201 bp, Homo sapiens
tgtgaatcaaaaccacaatgagataccacttgacaccatttggatagctattattgataataaataaataaaataaataaataaataaataaataaataaaataaataaaaaaaataataaaaatggaaataaaacaagtgttggtgaagatgagggaaactgtaacccatgtatgttcctagtgatgataggaaatggtg

SEQ ID NO: 20028 - DNA, 201 bp, Homo sapiens
atgtgaatcaaaaccacaatgagataccacttgacaccatttggatagctattattgataataaataaataaaataaataaataaataaataaataaataaaataaataaaaaaaataataaaaatggaaataaaacaagtgttggtgaagatgagggaaactgtaacccatgtatgttcctagtgatgataggaaatggt

SEQ ID NO: 20029 - DNA, 201 bp, Homo sapiens
aaatgtgaatcaaaaccacaatgagataccacttgacaccatttggatagctattattgataataaataaataaaataaataaataaataaataaataaataaaataaataaaaaaaataataaaaatggaaataaaacaagtgttggtgaagatgagggaaactgtaacccatgtatgttcctagtgatgataggaaatg

SEQ ID NO: 20030 - DNA, 201 bp, Homo sapiens
aaataacgtcaccaccacccacccagttatgcaagcaaggaacttagacagtatcctttttacctccctcttcctcattgcccatatctaacccgttctatgttctgaaatagtacttctggattcattctgtcctgttgtatttttggatccatccatttttctctttctcaactaccccacttgtcagtccaccttgac

SEQ ID NO: 20031 - DNA, 201 bp, Homo sapiens
taaataacgtcaccaccacccacccagttatgcaagcaaggaacttagacagtatcctttttacctccctcttcctcattgcccatatctaacccgttctatgttctgaaatagtacttctggattcattctgtcctgttgtatttttggatccatccatttttctctttctcaactaccccacttgtcagtccaccttga

SEQ ID NO: 20032 - DNA, 201 bp, Homo sapiens
caggctactaagcatcaagcaatttgttttctgtgttcagtctgtcatcttacggctcgctctaatgttcactgaagccctacggcagactttgggactaytgtttttttaaataaacaattatggcattttcagatatggatattatcaaaggaatgatctaattgtccaccacagatttggatcagatagttattcctc

SEQ ID NO: 20033 - DNA, 201 bp, Homo sapiens
tcttctctgaagaacccagagtggcagactatcacttcacaaaactttctcatttccccaaacttgtaataaagccagctcattgtttcttcaggctactaagcatcaagcaatttgttttctgtgttcagtctgtcatcttacggctcgctctaatgttcactgaagccctacggcagactttgggactactgttttttt

SEQ ID NO: 20034 - DNA, 201 bp, Homo sapiens
ttcttctctgaagaacccagagtggcagactatcacttcacaaaactttctcatttccccaaacttgtaataaagccagctcattgtttcttcaggctactaagcatcaagcaatttgttttctgtgttcagtctgtcatcttacggctcgctctaatgttcactgaagccctacggcagactttgggactactgtttttt

SEQ ID NO: 20035 - DNA, 201 bp, Homo sapiens
agcaggttccaggtacgctgtggcatgaggaagctggagttgagctaactagatgtgaacatctgatgtggttggtttgggaagcagatcttgcttcctcyggttgattctgagttgaaaggagggagccaagaatagggaagctggcagtcattgactgtatcgtgactgttggggccagttgctgtagaggttgtggtt

SEQ ID NO: 20036 - DNA, 201 bp, Homo sapiens
attcttctctgaagaacccagagtggcagactatcacttcacaaaactttctcatttccccaaacttgtaataaagccagctcattgtttcttcaggctactaagcatcaagcaatttgttttctgtgttcagtctgtcatcttacggctcgctctaatgttcactgaagccctacggcagactttgggactactgttttt

SEQ ID NO: 20037 - DNA, 201 bp, Homo sapiens
atcagttgcatttggcacagacttaaaggaacacagaaagataggaaacctttagagtgaaacaaagagcaggttccaggtacgctgtggcatgaggaagstggagttgagctaactagatgtgaacatctgatgtggttggtttgggaagcagatcttgcttcctccggttgattctgagttgaaaggagggagccaaga

SEQ ID NO: 20038 - DNA, 201 bp, Homo sapiens
gaagctgaggcaggagaattgcttgaacccaggaggcggaggttgcagtgagctgagatcgcgccactgactccagcctggatgacaagaacaagactctrtctcaaaaaaaaaaaaaaaaaaaaaaaaagaaagaaactgaaatttgtgatttcctggtccagtgatcatttctaattgataccaatgaatccctctgat

SEQ ID NO: 20039 - DNA, 201 bp, Homo sapiens
taaagttatttttaaatatgcttgtgaaaataaatgaagatcacatgaacaagaacagaggtgatttatttagagtttgcaagagaatcaaccactatcarttgcatttggcacagacttaaaggaacacagaaagataggaaacctttagagtgaaacaaagagcaggttccaggtacgctgtggcatgaggaagctgga

SEQ ID NO: 20040 - DNA, 201 bp, Homo sapiens
gtaagtgtaagagactcagctggaagcaagttcaagtgtgaagcactgtcccctctctacctgggacatggtgcatacaaatgggagtaacatgagctttrcaggggtcatcttggcctcctgtcccacctccaccacttaccagtcatcattcattattgttattccatgaacaatgccacccacaaacccagagtgact

SEQ ID NO: 20041 - DNA, 201 bp, Homo sapiens
tgtgaccagatggaaagtgactcattaatggaagagtattaggatggagaaattgttttatttttaaaataatttccagtgtagtgatgaaaagaaaaagwtactgaattttattttgaacatactgagtttgaggagcctgcttaactatttaggtggaaatgtcactttacctaaggaaaatgagtttgggctctgaaa

SEQ ID NO: 20042 - DNA, 201 bp, Homo sapiens
ggcagtagttggtccatgagaattcaaggcctgaaaaataccttaaacaccagtcttaggttttataatagtgatgttatatataggagcaattagggagkttacgaatcttgtgacttcagtcctaaaccataattccaaccttgtggttaatttgttagtcttacaaaagttgttttggtccccaggaaaggaggggat

SEQ ID NO: 20043 - DNA, 201 bp, Homo sapiens
cttgctggactcaggaatgccacaaaccttcaatttgtaaaaacaaacaacaaaaaacccccacaatatctgcaaagcacaatgaagcaaagtgcaataaratgaggtgtgcttgtagctattgtagtcaaatccttagagatagaaagttgcgtggtggttgctgggcctgggggaggagaaaatggggagttattgttt

SEQ ID NO: 20044 - DNA, 201 bp, Homo sapiens
ttacataaaagaaaatagcacagggaaaaagtgtgcagtgtcaataaatgggacaggattattcactcctggtttgtattccccatcccaagagaacgacsatttcactgcaaaggcattttaagagccatgtagaggaattgtggccgattgaataggaagttctacctggttcaaatgagttcacatctctcggggaag

SEQ ID NO: 20045 - DNA, 201 bp, Homo sapiens
ctgaagcgtgaggagggccgggtttattgggtgaaagagggaaacagggacgctccgcaaggccagaatccctgctacagcgcttcctgcctgaagattgratcccaggttccacccaggaataggaggggccaggcttcccccgctgcaaacagcaccaactcccgtggctccatgccagtgcgcaatcctcccagtgtg

SEQ ID NO: 20046 - DNA, 201 bp, Homo sapiens
tataatttaactttctaataactgtagaacaagaaaggattctagaaaaatcttgggaaaaattattaatgaggggcctgagggcttaagtttggggagartgggcttcttttgatttgcaatgtggaagctgcttttgctcatgctttctgaaggtcttccataaagaggggaactgcgaattgcaaagtaaagcccctg

SEQ ID NO: 20047 - DNA, 201 bp, Homo sapiens
ctgtgatgattgaataattgaccaagaaacccagataatgaaaggaagaaagagaaagaaagaaagaaagaaagaaagaaagaaagaaagaaagaaataaagaaaggaaggaagatagtaatgaaatgtgggcatggttgactaatgtatgagagttcatcagatgtataacttacttttcttttgaataatttgtattta

SEQ ID NO: 20048 - DNA, 201 bp, Homo sapiens
actgtgatgattgaataattgaccaagaaacccagataatgaaaggaagaaagagaaagaaagaaagaaagaaagaaagaaagaaagaaagaaagaaataaagaaaggaaggaagatagtaatgaaatgtgggcatggttgactaatgtatgagagttcatcagatgtataacttacttttcttttgaataatttgtattt

SEQ ID NO: 20049 - DNA, 201 bp, Homo sapiens
gactgtgatgattgaataattgaccaagaaacccagataatgaaaggaagaaagagaaagaaagaaagaaagaaagaaagaaagaaagaaagaaagaaataaagaaaggaaggaagatagtaatgaaatgtgggcatggttgactaatgtatgagagttcatcagatgtataacttacttttcttttgaataatttgtatt

SEQ ID NO: 20050 - DNA, 201 bp, Homo sapiens
tgactgtgatgattgaataattgaccaagaaacccagataatgaaaggaagaaagagaaagaaagaaagaaagaaagaaagaaagaaagaaagaaagaaakaaagaaaggaaggaagatagtaatgaaatgtgggcatggttgactaatgtatgagagttcatcagatgtataacttacttttcttttgaataatttgtat

SEQ ID NO: 20051 - DNA, 201 bp, Homo sapiens
tctttctttctttccttctttctttctttctttctttctttctttctttctttctttctttctttctttctttctttttctttttccttccttccttcctttcttttcctttcccttcctttcttctttctcttttttctgtcctctttccttccttctttccttccttccttccttcctttctctcttccatttgttgtt

SEQ ID NO: 20052 - DNA, 201 bp, Homo sapiens
ttctttctttctttccttctttctttctttctttctttctttctttctttctttctttctttctttctttctttctttttctttttccttccttccttcctttcttttcctttcccttcctttcttctttctcttttttctgtcctctttccttccttctttccttccttccttccttcctttctctcttccatttgttgt

SEQ ID NO: 20053 - DNA, 201 bp, Homo sapiens
tttctttctttctttccttctttctttctttctttctttctttctttctttctttctttctttctttctttctttctttttctttttccttccttccttcctttcttttcctttcccttcctttcttctttctcttttttctgtcctctttccttccttctttccttccttccttccttcctttctctcttccatttgttg

SEQ ID NO: 20054 - DNA, 201 bp, Homo sapiens
ctttctttctttctttccttctttctttctttctttctttctttctttctttctttctttctttctttctttctttctttttctttttccttccttccttcctttcttttcctttcccttcctttcttctttctcttttttctgtcctctttccttccttctttccttccttccttccttcctttctctcttccatttgtt

SEQ ID NO: 20055 - DNA, 201 bp, Homo sapiens
tctttctttctttctttccttctttctttctttctttctttctttctttctttctttctttctttctttctttctttctttttctttttccttccttcctycctttcttttcctttcccttcctttcttctttctcttttttctgtcctctttccttccttctttccttccttccttccttcctttctctcttccatttgt

SEQ ID NO: 20056 - DNA, 201 bp, Homo sapiens
ttctttattttctttctttctttctttctttccttctttctttctttctttctttctttctttctttctttctttctttctttctttctttctttttctttttccttccttccttcctttcttttcctttcccttcctttcttctttctcttttttctgtcctctttccttccttctttccttccttccttccttcctttc

SEQ ID NO: 20057 - DNA, 201 bp, Homo sapiens
aactttctaataactgtagaacaagaaaggattctagaaaaatcttgggaaaaattattaatgaggggcctgagggcttaagtttggggagagtgggcttsttttgatttgcaatgtggaagctgcttttgctcatgctttctgaaggtcttccataaagaggggaactgcgaattgcaaagtaaagcccctgctgtggag

SEQ ID NO: 20058 - DNA, 201 bp, Homo sapiens
ggaaaaattattaatgaggggcctgagggcttaagtttggggagagtgggcttcttttgatttgcaatgtggaagctgcttttgctcatgctttctgaagrtcttccataaagaggggaactgcgaattgcaaagtaaagcccctgctgtggagtgaatttgcttatgtcacactctatctgagtgacccttaggaagttc

SEQ ID NO: 20059 - DNA, 201 bp, Homo sapiens
gcttcttttgatttgcaatgtggaagctgcttttgctcatgctttctgaaggtcttccataaagaggggaactgcgaattgcaaagtaaagcccctgctgwggagtgaatttgcttatgtcacactctatctgagtgacccttaggaagttccctaatctcccatgcctgttttctgggttgtaaatgcaagtaataaaag

SEQ ID NO: 20060 - DNA, 201 bp, Homo sapiens
tgtggtagacctaattctgagatggccttcagaatcccatccgttggtgtccatgccctgcccattaagtgtgggcaaaacctaaggtttgcttctacccrgtagaatatgacaaaggtgaagggattttgcagctataattaaagtgtcatgtcagttgattttgagtaaatcaaaagggagattatcctgggtgagcct

SEQ ID NO: 20061 - DNA, 201 bp, Homo sapiens
tgtttacatatttataaaaaggtaagaacagtgcagtccattgatcaccacctcccacccttatgtttctgtcacctagcttcaacacttactacagtttyctatacttgtaagtgtagttcttgatcaggagatcaaataatcaaatgtaagccatagatctgaaaagctttcggtattttctgaaaacgtgcactttta

SEQ ID NO: 20062 - DNA, 201 bp, Homo sapiens
ttgttttaatattgattgcctctctgtgaagcatgagaacgtttgtccccttgtgtgtccctccctctctgcctctgtttggatttttgttacttgtgtcrttttttttttacactgtgtatctctaaaacattcatggtgacttgaaccatgatttccatatttcattagtactagcactatatttaaataagatcaatg

SEQ ID NO: 20063 - DNA, 201 bp, Homo sapiens
gcgtgaagttttattccccagggcctttctgttaactccttaaaaggtttggaacattgagctgggagagttatcatgaatggcaaacaaaccagcaaaaagtaattgagatgtgtctgttcctttgggacagaaaagaaaatcataccaaaagtgaaaattaaatgttgtttactaccattcagtttaccacataccttc

SEQ ID NO: 20064 - DNA, 201 bp, Homo sapiens
agcgtgaagttttattccccagggcctttctgttaactccttaaaaggtttggaacattgagctgggagagttatcatgaatggcaaacaaaccagcaaaaagtaattgagatgtgtctgttcctttgggacagaaaagaaaatcataccaaaagtgaaaattaaatgttgtttactaccattcagtttaccacatacctt

SEQ ID NO: 20065 - DNA, 201 bp, Homo sapiens
cagtgtaaaagtgttcctatttctccacatcctctccagcacctgttgtttcctgaccttttaatgatcgccattctaactagtgtgacatggtatctcaytgtggttttgatttgcatttttctgatggccagtgatgatgagcattttttcatgtgtctgttggctgcataaatgtcttcttttgagaagtgtctgttc

SEQ ID NO: 20066 - DNA, 201 bp, Homo sapiens
ttcaaagaatgttaaacaaaaggaatgagaagattcctgaataatatagttatgcatactcagagcttctttcataagggcatttgaaatgtatgctgatyacctcaaggtcgccatgaaatgggaagatttaaactagtggtgtttggacagaaacaacttttaccttgaaagccagcaatcaatgactgaaaaatgtat

SEQ ID NO: 20067 - DNA, 201 bp, Homo sapiens
tttctttattttctttctttctttctttctttccttctttctttctttctttctttctttctttctttctttctttctttctttctttctttctttttctttttccttccttccttcctttcttttcctttcccttcctttcttctttctcttttttctgtcctctttccttccttctttccttccttccttccttccttt

SEQ ID NO: 20068 - DNA, 201 bp, Homo sapiens
ttttctttattttctttctttctttctttctttccttctttctttctttctttctttctttctttctttctttctttctttctttctttctttctttttctttttccttccttccttcctttcttttcctttcccttcctttcttctttctcttttttctgtcctctttccttccttctttccttccttccttccttcctt

SEQ ID NO: 20069 - DNA, 201 bp, Homo sapiens
gctgggcatggtgggtagtgcctctaattagagcactttgggaggctgaggtaggcggatcacttgatgtcaagacttagagaccagcctgggcaacatgrcaaaccctatctctactaaaaatataagaagtagccaggcatggtgacacactcctgtggtcccagctactggggaggctgaggtgggaggatcgcttga

SEQ ID NO: 20070 - DNA, 201 bp, Homo sapiens
tcttttctttattttctttctttctttctttctttccttctttctttctttctttctttctttctttctttctttctttctttctttctttctttctttttctttttccttccttccttcctttcttttcctttcccttcctttcttctttctcttttttctgtcctctttccttccttctttccttccttccttccttcc

SEQ ID NO: 20071 - DNA, 201 bp, Homo sapiens
gttagtagtgaaataagaaataaaataattgttgacatttttgtcaattttcctgattattaccccagtgggattcaaacacacacacacacacacacacacacacacaaagatccaaatccatatagttttcaatttgcttcttttacttagcattatgccatggtgatttttcatgtcatgctttttaacgctttttca

SEQ ID NO: 20072 - DNA, 201 bp, Homo sapiens
ctcttttctttattttctttctttctttctttctttccttctttctttctttctttctttctttctttctttctttctttctttctttctttctttctttttctttttccttccttccttcctttcttttcctttcccttcctttcttctttctcttttttctgtcctctttccttccttctttccttccttccttccttc

SEQ ID NO: 20073 - DNA, 201 bp, Homo sapiens
cctcttttctttattttctttctttctttctttctttccttctttctttctttctttctttctttctttctttctttctttctttctttctttctttctttttctttttccttccttccttcctttcttttcctttcccttcctttcttctttctcttttttctgtcctctttccttccttctttccttccttccttcctt

SEQ ID NO: 20074 - DNA, 201 bp, Homo sapiens
gcctcttttctttattttctttctttctttctttctttccttctttctttctttctttctttctttctttctttctttctttctttctttctttctttctttttctttttccttccttccttcctttcttttcctttcccttcctttcttctttctcttttttctgtcctctttccttccttctttccttccttccttcct

SEQ ID NO: 20075 - DNA, 201 bp, Homo sapiens
tgcctcttttctttattttctttctttctttctttctttccttctttctttctttctttctttctttctttctttctttctttctttctttctttctttctttttctttttccttccttccttcctttcttttcctttcccttcctttcttctttctcttttttctgtcctctttccttccttctttccttccttccttcc

SEQ ID NO: 20076 - DNA, 201 bp, Homo sapiens
aagcaaaagatgttagtagtgaaataagaaataaaataattgttgacatttttgtcaattttcctgattattaccccagtgggattcaaacacacacacacacacacacacacacacacaaagatccaaatccatatagttttcaatttgcttcttttacttagcattatgccatggtgatttttcatgtcatgcttttta

SEQ ID NO: 20077 - DNA, 201 bp, Homo sapiens
acgtggccacatttcttgacaatgttccaattattattgatatctacaattagaattaaatcgttgtttctaaccagtaatattccaagtaaagtagtaayattgtttattcattggcattaggcatctatggttagctctacagaattatagttgaaatctatgtgaaaatatcaatttttacacttaccgaccataata

SEQ ID NO: 20078 - DNA, 201 bp, Homo sapiens
ataagcaaaagatgttagtagtgaaataagaaataaaataattgttgacatttttgtcaattttcctgattattaccccagtgggattcaaacacacacacacacacacacacacacacacaaagatccaaatccatatagttttcaatttgcttcttttacttagcattatgccatggtgatttttcatgtcatgctttt

SEQ ID NO: 20079 - DNA, 201 bp, Homo sapiens
gacaaataagcaaaagatgttagtagtgaaataagaaataaaataattgttgacatttttgtcaattttcctgattattaccccagtgggattcaaacacacacacacacacacacacacacacacaaagatccaaatccatatagttttcaatttgcttcttttacttagcattatgccatggtgatttttcatgtcatg

SEQ ID NO: 20080 - DNA, 201 bp, Homo sapiens
aaatgacaaataagcaaaagatgttagtagtgaaataagaaataaaataattgttgacatttttgtcaattttcctgattattaccccagtgggattcaaacacacacacacacacacacacacacacacaaagatccaaatccatatagttttcaatttgcttcttttacttagcattatgccatggtgatttttcatgt

SEQ ID NO: 20081 - DNA, 201 bp, Homo sapiens
gaaatgacaaataagcaaaagatgttagtagtgaaataagaaataaaataattgttgacatttttgtcaattttcctgattattaccccagtgggattcamacacacacacacacacacacacacacacacaaagatccaaatccatatagttttcaatttgcttcttttacttagcattatgccatggtgatttttcatg

SEQ ID NO: 20082 - DNA, 201 bp, Homo sapiens
agaaatgacaaataagcaaaagatgttagtagtgaaataagaaataaaataattgttgacatttttgtcaattttcctgattattaccccagtgggattcmaacacacacacacacacacacacacacacacaaagatccaaatccatatagttttcaatttgcttcttttacttagcattatgccatggtgatttttcat

SEQ ID NO: 20083 - DNA, 201 bp, Homo sapiens
tatcccacggtgtacatataccacattttctttatcaaatccacccttgacaggcacctaaattaactccgggactttgctattcacacatatattgaaarcatttatactaaacaatatgtttgttatgaatagtgctatattgtacacatttcagagaaccttttccctgctaaatcttcacgtgactcttggacacat

SEQ ID NO: 20084 - DNA, 201 bp, Homo sapiens
tgtggttttgatttacatttctctgatggccagtgatggtgagcattttttcatgtgttttttggctgcataaatgtcttcttttgagaagtgtctgttcrtgtccttcacccactttttgatggggttgtttgtttttttcttgtaaatttgtttgagttcattgtagattctggatattagccctttgtcagatgagta

SEQ ID NO: 20085 - DNA, 201 bp, Homo sapiens
ctcagccacagatgtgctcgacccaccattttgtcttctttcttcttcctcctttttagcggctttacaaagagatttcctcatttctttcacagttaccrtatgtgttatcctctgcagagccttgctttgcttcactttgctttgcttcctgtcttttctcccctttcccatatctcccacatgttctaatcacatcca

SEQ ID NO: 20086 - DNA, 201 bp, Homo sapiens
acatttgggttggttccaagtctttgctattgtgaataatgccgcaataaacatacgtgtgcatgtgtctttatagcagcatgatttatattcctttgggyatatacccagtaatgggatggctgggtcaaatggtatttctagttctagatccctgagaaatcgccacactgacttccacaatggttgaactagtttaca

SEQ ID NO: 20087 - DNA, 201 bp, Homo sapiens
tcattgttggacatttgggttggttccaagtctttgctattgtgaataatgccgcaataaacatacgtgtgcatgtgtctttatagcagcatgatttataktcctttgggtatatacccagtaatgggatggctgggtcaaatggtatttctagttctagatccctgagaaatcgccacactgacttccacaatggttgaa

SEQ ID NO: 20088 - DNA, 201 bp, Homo sapiens
taatttcagcaataatcaaagaaatacatactataacaataattattttcacccataaaatttcccttattttcaaaactaaaagttccagtggttgacartggggaggttaaataccactccaaggtattttgcagataatttacattggttcagcttttctggtagcctttggcatatttatcacaagcatgaaagtcc

SEQ ID NO: 20089 - DNA, 201 bp, Homo sapiens
atagcattccatggtgtatatgtgccacattttcttaatccagtctatcattgttggacatttgggttggttccaagtctttgctattgtgaataatgccrcaataaacatacgtgtgcatgtgtctttatagcagcatgatttatattcctttgggtatatacccagtaatgggatggctgggtcaaatggtatttctag

SEQ ID NO: 20090 - DNA, 201 bp, Homo sapiens
tgccatgttgcccaggctgatcttaaactcctgagctcaaagcgatcgtcccgcctcagcctcccaaagtgctcggattacaggcatgagccaccatgccyggctcacttacaaataatttaatacctctcactattgccggtgctctcactattgctggtgctctctaggtactttgcatctttacatctactacgcacc

SEQ ID NO: 20091 - DNA, 201 bp, Homo sapiens
agcctaggtcaattgtttttaataacttcgttttgctaatcggtcatggcacttgtttctctccttaaatgcaaattaggatgagaataaccttgtaaacrtgtctttgtcttctcaaggtcatgtttggccaacagtatcagtcagggtttctttttccttttttaagcaggcagccatgttctgattaaatatttataa

SEQ ID NO: 20092 - DNA, 201 bp, Homo sapiens
gtgtgtgtgtgtgtgtgtgtgtgtgtgtgtatggagagagacgacaacaaatatatatatatttggctctctctctctctctctctctctctctctctatmtatatatatatatatatatatggagagagacaacacctccaaagaaaagagaaaaaaaggaaagcacatgaccgtgaacgaatctagcagtatgagaatt

SEQ ID NO: 20093 - DNA, 201 bp, Homo sapiens
atgtgtgtgtgtgtgtgtgtgtgtgtgtgtgtatggagagagacgacaacaaatatatatatatttggctctctctctctctctctctctctctctctctmtatatatatatatatatatatatggagagagacaacacctccaaagaaaagagaaaaaaaggaaagcacatgaccgtgaacgaatctagcagtatgagaa

SEQ ID NO: 20094 - DNA, 201 bp, Homo sapiens
agatttcacaaggagtgagtttaaccactggacagcagagtgggtgctagagctgactcttgaaggatcagaaaaaattcaccacaatagaggggttgggygttccacatatagagatgacattgggctgcattcggggagcccacaagtaatggcatagaagtgtttgtgtctgatatccccttccagacatcccacaac

SEQ ID NO: 20095 - DNA, 201 bp, Homo sapiens
tacaaacattggaattgcatggtttcttttagaatctaaggtttttatagaaaatataacatcatatatatatatatatatatatatatatatatatatatgtattccattttgatgctatatactactagtcagtcacctgtaagagtttttgactaaagttttcggcaagatagatatagttgagtcatggtcaaggtg

SEQ ID NO: 20096 - DNA, 201 bp, Homo sapiens
gctagaacaaggatctgcaatatgaaagtcaggaagagccattaaataaactgatatcaatattttacttttaaattagaagacaagaaaaaaaaaaaaaactgtgtttaagagtcactattccaaggccttcacaggcagtgagaatggtcaaagatggaacaatcaaggccaaagacaaagaatcgttcttatagcaga

SEQ ID NO: 20097 - DNA, 201 bp, Homo sapiens
aaaaaaaaaaaaaaaaaaggaaagaaaactgttttaagtatgatatcttcagtgtaatatatagttaacatatactattttgttgtaattagaatatgcarttattatatattaaacatatctacatctgtagtaaaatgtgttgtcctacatttcagaaaactataaggcttttgggaaagaaaatttaggagtatacat

SEQ ID NO: 20098 - DNA, 201 bp, Homo sapiens
caggttcaggcacaaatgcaagttcccagttcccatctcctcagtgtgtgcccgctgacctccctgcaacagttctgcccattgaccagtaggggataatycagatgaacaccttcgtgcttggaatatgagcacttagacttctagattttaaaaggatttctgagcccgatctttacacacatgctttagtttgtactg

SEQ ID NO: 20099 - DNA, 201 bp, Homo sapiens
cataagaaaatgggcaagtcaaattatagatgaggatgatagtgattttttttcacatttcatgagattattgaatataatttcataaaaatgagaatacyctttcagataaaagtgtgcaaaatattttatttatgaatgtaaatttttccatccaaagccactgatcaattagttaagtaaaatagaaagcggaagaaa

SEQ ID NO: 20100 - DNA, 201 bp, Homo sapiens
gcctaccttctgatgcctggcagctaagtaagccctgattgcattaccggtgtgcctagcctggaagcaagaacatgagcaccacaaaaaaaaaaaaaaaatcaccgtgactttttggaaggaagaggagttctaagaaaatctggcttccttgtttaaatttctccctccacatataaaatattggtgttggcaggggaa

SEQ ID NO: 20101 - DNA, 201 bp, Homo sapiens
catcagtggatgcatctgaggtcctaagagtgtgatctccaagctttgcagggtgtcattaatggccttggaaataaagggttcttttagtacatgcctcstttaatgattccggtaggttcttttagtacatgcctcctttaatgattccggtaggttatgtgactttaggcacttcaattcctttctcattgttggatg

SEQ ID NO: 20102 - DNA, 201 bp, Homo sapiens
  misc_feature (1)...(201): n = A,T,C or G, or insertion/deletion polymorphism (see Tables 1-2)
ggtttgcccaggactgaggagtttcttgggatgcatgaaggactgtcaatgccaataccaagagagttccaggcaaaccaggatggttggtcatcctaagnctgctataccttaccacctgcaaagaatagctattgagtatttctactctgaattcagaagtttgtattcctccgaacctctgtatctcaactaccattc

SEQ ID NO: 20103 - DNA, 201 bp, Homo sapiens
agagggctctttggcagtgtcttataaaactaaacatacctcagccctatgactcagcaattccacttctgcatttctaccaatgtaaatgaagacatatraatccacacaatgacttttacatcaatgttcataacagctttattcataacagccaaaaactgaaagcaatctaaatgtctatcaataggacaatggatg

SEQ ID NO: 20104 - DNA, 201 bp, Homo sapiens
tattatgtatatgaaggtgttcaatgcagcatttcctattttagaaaagcgacactgaaaacaatataaaataaatgtctaataatgtggtaacaatgacrtaattgatgatgcatcaattccaaaattatgcagtcatcaagaataactacattatgtaaaatggtgcagccactttagagggctctttggcagtgtctt

SEQ ID NO: 20105 - DNA, 201 bp, Homo sapiens
aaaaagtcataacagtgctcagtaatcccacccctagtttctctattcaatattctgatagcagaactattccagtaacagataaaatattatgtatatgraggtgttcaatgcagcatttcctattttagaaaagcgacactgaaaacaatataaaataaatgtctaataatgtggtaacaatgacataattgatgatgc

SEQ ID NO: 20106 - DNA, 201 bp, Homo sapiens
tgggtaaacgatatgaatgggaaagtaaagccccccaaagaaagaaagaaatgcaaacacaaatagatatgagaaagttattaatttcagcaataatcaamgaaatacatactataacaataattattttcacccataaaatttcccttattttcaaaactaaaagttccagtggttgacagtggggaggttaaataccac

SEQ ID NO: 20107 - DNA, 201 bp, Homo sapiens
attctgtactagcctttataaattaaagaataatagaaatatgggtaaacgatatgaatgggaaagtaaagccccccaaagaaagaaagaaatgcaaacayaaatagatatgagaaagttattaatttcagcaataatcaaagaaatacatactataacaataattattttcacccataaaatttcccttattttcaaaac

SEQ ID NO: 20108 - DNA, 201 bp, Homo sapiens
ctagaggatatttttgatgtaattgttcatatcatgatacgagatgtaaaatgcacaccaagctctgtagactctacttttgtgcaaaaaaaaaaaaaaaaaaaaaaaaggatctgtgtccctagagctctacatctaaataactctacagtctggctactcaaagtgtgaagtgtgggccgtgaatcacctaggagtgtg

SEQ ID NO: 20109 - DNA, 201 bp, Homo sapiens
gtgcaccatcatggtgcccgtgaaaagctacagcactccagcctgtccaacatagcaagagcgcatctctttaaaaaagagagagagagagagagagagaraaaagatcatgctttcagattcctcatttttttctacatctggacactttccttaggtcctactccagccatcattagcatcttaagataaagatagaat

SEQ ID NO: 20110 - DNA, 201 bp, Homo sapiens
tctatctttaagggtggattagagggttaacagttcagcacccacagggtttttaataagtactttgaattttgagaatagacaagacctaaacattaaakattttgcttttgactaataacgtctagattattagtctaataacttcaggctgttcatagtgatcttgctgggttgaggcaattgagactacattttgaa

SEQ ID NO: 20111 - DNA, 201 bp, Homo sapiens
tgagcttctttcaatttttggaggcaatatattgctcatttgggtgtgttactcccactcatttatttagtgacccaagaagctgctagttttgagtggawcccagaacaagagaaggttttataacaggtccaggctgctatgcaagcagctctgtcacttgggccatatgattcagcagatccagtggtgtctagattt

SEQ ID NO: 20112 - DNA, 201 bp, Homo sapiens
aaattgctgtgctgaatcatataaatgtatcccaagaaaatatttcaaaaaaagaaaacatgcacaaagatagtcattataaaggataacaaagtcagcaraaaaaaaaaagattgtcattatagtattttcaggactaaaacaattagacatgaatcaaatgataaaaagtttcaaaaagtaaatacataaatcatgata

SEQ ID NO: 20113 - DNA, 201 bp, Homo sapiens
ttacaaacattggaattgcatggtttcttttagaatctaaggtttttatagaaaatataacatcatatatatatatatatatatatatatatatatatatatgtattccattttgatgctatatactactagtcagtcacctgtaagagtttttgactaaagttttcggcaagatagatatagttgagtcatggtcaaggt

SEQ ID NO: 20114 - DNA, 201 bp, Homo sapiens
ctattttggtaagagtaccatgctgttttggttactgtagccttgtagtatagtttgaagtcaggtagtgtgatgcctccagctttgttcttttggcttargattgacttgacaatgcgggctcttttttcgttccatatgaactttaaagtagttttttccaattctgtgaagaaagtcattggtagcttgatggggatg

SEQ ID NO: 20115 - DNA, 201 bp, Homo sapiens
attacaaacattggaattgcatggtttcttttagaatctaaggtttttatagaaaatataacatcatatatatatatatatatatatatatatatatatatatgtattccattttgatgctatatactactagtcagtcacctgtaagagtttttgactaaagttttcggcaagatagatatagttgagtcatggtcaagg

SEQ ID NO: 20116 - DNA, 201 bp, Homo sapiens
ttagtttcattagatcccatttgtcaattttggcttttgttgccattgcttttggtgttttagacatgaagttcttgcccatgcctatgtcctgcatggtrttgcctaggttttcttctagggtttttatggttttaggtctaacatttaaatctttaatccatcttgaattaatttttgtttaaggtgtaaggaagggat

SEQ ID NO: 20117 - DNA, 201 bp, Homo sapiens
aattacaaacattggaattgcatggtttcttttagaatctaaggtttttatagaaaatataacatcatatatatatatatatatatatatatatatatatatatgtattccattttgatgctatatactactagtcagtcacctgtaagagtttttgactaaagttttcggcaagatagatatagttgagtcatggtcaag

SEQ ID NO: 20118 - DNA, 201 bp, Homo sapiens
ctttgtcagatgagtagattgcaaaaattttctgccattctgtaggttgcctgttcactctgatagtagtttcttttgctgtgcagaaactctttagtttmattagatcccatttgtcaattttggcttttgttgccattgcttttggtgttttagacatgaagttcttgcccatgcctatgtcctgcatggtattgccta

SEQ ID NO: 20119 - DNA, 201 bp, Homo sapiens
aaattacaaacattggaattgcatggtttcttttagaatctaaggtttttatagaaaatataacatcatatatatatatatatatatatatatatatatawatatgtattccattttgatgctatatactactagtcagtcacctgtaagagtttttgactaaagttttcggcaagatagatatagttgagtcatggtcaa

SEQ ID NO: 20120 - DNA, 201 bp, Homo sapiens
ataacaggtaggtagacagatgattgataaagagataggcagatcatagatagatagatagatagatagatagatagatagatagatagatagatagatagcatgaagatggttgaggtgactacaccctatgcttccttctgaagtttcgggaataattgttcattttccaagtgactgctcaatacaacattgctctgt

SEQ ID NO: 20121 - DNA, 201 bp, Homo sapiens
gataacaggtaggtagacagatgattgataaagagataggcagatcatagatagatagatagatagatagatagatagatagatagatagatagatagatagcatgaagatggttgaggtgactacaccctatgcttccttctgaagtttcgggaataattgttcattttccaagtgactgctcaatacaacattgctctg

SEQ ID NO: 20122 - DNA, 201 bp, Homo sapiens
ggataacaggtaggtagacagatgattgataaagagataggcagatcatagatagatagatagatagatagatagatagatagatagatagatagatagatagcatgaagatggttgaggtgactacaccctatgcttccttctgaagtttcgggaataattgttcattttccaagtgactgctcaatacaacattgctct

SEQ ID NO: 20123 - DNA, 201 bp, Homo sapiens
tccatgaatgaagttttaggactttatgccaaataaaataagccaaacacaaaaggacaaatattatacaattttacttatataactacttagaatactcmaattatttaattacctggagtagtcaaattcatggatacagagagtaagactggtggttgccaggttataggggcaagagggaatgaggagttagtgttt

SEQ ID NO: 20124 - DNA, 201 bp, Homo sapiens
tggataacaggtaggtagacagatgattgataaagagataggcagatcatagatagatagatagatagatagatagatagatagatagatagatagatagatagcatgaagatggttgaggtgactacaccctatgcttccttctgaagtttcgggaataattgttcattttccaagtgactgctcaatacaacattgctc

SEQ ID NO: 20125 - DNA, 201 bp, Homo sapiens
cagagagagctgcttcatggtggtaggcccagggggattggagagagtggtgccagaaagttggatagaaaagttaatgcaacaattataaagaagataadaacgtagtatttgaaaataaatattttaacaagataaatataatacaaaaaatggaataagaaaaatacattattatcgaatattctgtattgagttttg

SEQ ID NO: 20126 - DNA, 201 bp, Homo sapiens
aaagagagagtggatatttcagtggctaaacccaaagttttttagcatttagactatggcaccctctagaaaagcaatttaaaatgtgaaaaaagagaggwcagttaaaaaatagattagatagataggtagatagatggataacaggtaggtagacagatgattgataaagagataggcagatcatagatagatagatag

SEQ ID NO: 20127 - DNA, 201 bp, Homo sapiens
aacctgacctgtttgaagtagtagcaattcaacattaaacctcgactagtgttgaataatattttggggctttgtgttgtatgctacagagtgaccccccmcaagttccttgcccatgtgtggctagacaatggaaatagttccgtgcttcaacatgttccccaaacacattccacaggagagcgcatccgagcatcaatt

SEQ ID NO: 20128 - DNA, 201 bp, Homo sapiens
tccattctacccttggcacacatcacttcctaaactgtcttattgcttttaattgtatattttttcccttaatttcaattaaaatctataattcattagcygtcaaaacctgacctgtttgaagtagtagcaattcaacattaaacctcgactagtgttgaataatattttggggctttgtgttgtatgctacagagtgac

SEQ ID NO: 20129 - DNA, 201 bp, Homo sapiens
acaatttttttaattaattgaaaaaataaactagcacagacctttgggaaattaaaaagtcataacagtgctcagtaatcccacccctagtttctctattsaatattctgatagcagaactattccagtaacagataaaatattatgtatatgaaggtgttcaatgcagcatttcctattttagaaaagcgacactgaaaa

SEQ ID NO: 20130 - DNA, 201 bp, Homo sapiens
cttagaataatctaccttaccttttttgactaattgagatttctctaaacatgtttaattcacttctgcaatggttaagatttacattcctagactcattsgaatcatttaaaacttaattgctctgtaatcaacaaatgggcatttttagaattttcatgtttcttcatcataacatcatatcaaagtgtattgaactgc

SEQ ID NO: 20131 - DNA, 201 bp, Homo sapiens
gattttcttgagaagggaggctgaagggaatactgatgtcatatatgttctttctagaatttcaggtctattttctctcccgatactttgttaaatgtccrgtaccaggtttgctttgcatcagcgtgagtgtgtgtgtgtgtgtgtgtgtgtgtgtgtgtgtgtgtgtgtgaagcggcacatggtcaggcttcattagct

SEQ ID NO: 20132 - DNA, 201 bp, Homo sapiens
tgatttgcatttctctgatggccagtgatgatgagcattttttcatgtgtctgttggctgcataaatgtcttcttttgagaggtgtctgttcatatccttygcccacttgttgatggggttgttttttttcttgtaaatttgtttgagttcattgtagattctggatattagccctttgtcagatgagtagattgcaaaaa

SEQ ID NO: 20133 - DNA, 201 bp, Homo sapiens
taacttttcatttacattaggtatatctcctaatgctatccctaccccctcccccaaccccacaacaggccccagtgtgtgatgtcccccttcctgtgtcmaagtgttctcattgttcaattcccacctgtgagtgagaacatgcggtgtttggttttttgtccttgagatagtttgctgagaatgatggtttccagcttc

SEQ ID NO: 20134 - DNA, 201 bp, Homo sapiens
gaatctttgaaatctcataagcaaatagaaaacacttatctttgtttaagaaattaagaacatgttgcaaacaaattttccctttttttttttttttttttggtagcactgggctttgtaagaatttttttaaaattatacagtacactgtcctatatttagaaaagtcagtacctaaatggccaacacggaatgttggct

SEQ ID NO: 20135 - DNA, 201 bp, Homo sapiens
ctgtctaaggaatgaaaggaaccagcctctgacgctgcctgctgtctttgtctacatagaagtgaaagactatgtgccagacacatatgcaggtaaacaayttaactcaaataccactttactcaaaggggtatttctgtctgagtcaccatatatttttgggttagtgaaaggaaaactgaaccaaacaaagcaggagat

SEQ ID NO: 20136 - DNA, 201 bp, Homo sapiens
atacacacatgttatagatgttgatggagaggtaaaggattaaaatatagaccatctgagagctgtcttcatcattctacagtcaaaggtcccaagagtcrcaacccatctgcagctcctttgtcaatgaaggatggtcatatatttcaagtttcaaacctgggcatatgttctgacaattaagaatatttgggatctggg

SEQ ID NO: 20137 - DNA, 201 bp, Homo sapiens
tgagtttccatttcttacctatcagattgtcaacatttcgaaagtttggcaatacctttattattattattattattattattattattattattattatwctttaagttctgggatacatgtgcagaatgtgcaggtttgttacataggtatatatgtcccatggtggtttgctgcacccatcaacccgtcatctgcatt

SEQ ID NO: 20138 - DNA, 201 bp, Homo sapiens
tttgtttttcatctaaagtaacctgaaatacatgctttcatcacatagatgcgcataattataactaacattggaaaggaaatatgtgctacacagcattmttctcaccttccaggctatcactatatctgtctaaggaatgaaaggaaccagcctctgacgctgcctgctgtctttgtctacatagaagtgaaagactat

SEQ ID NO: 20139 - DNA, 201 bp, Homo sapiens
caatattgaagtgtcatgggggatgattagaaaaataaaaacctaaaaagcctcccttgcagggcaataatggaaaaagttgagaagcactgttatagagygcgtacttgaaggtttaatttccagtgcttcccataccagcttaactggctttccttgaggaagtcacttagcccaagccttggtctaggtatctgtaaa

SEQ ID NO: 20140 - DNA, 201 bp, Homo sapiens
ctgagtttccatttcttacctatcagattgtcaacatttcgaaagtttggcaatacctttattattattattattattattattattattattattattatactttaagttctgggatacatgtgcagaatgtgcaggtttgttacataggtatatatgtcccatggtggtttgctgcacccatcaacccgtcatctgcat

SEQ ID NO: 20141 - DNA, 201 bp, Homo sapiens
cttttgagtgtatgctgtataaaaattgaccaaattatccacaaatcttcctgtaccacttgtcaaggttgaaaacccaagaaaaaataagattctttctmtcactggagtgatattactgagcttttcagagtctattctcatgccaagatgtatgtttgttaaattttgagccggatgtggttttcattcagaaagtat

SEQ ID NO: 20142 - DNA, 201 bp, Homo sapiens
atagtcagggctgtattgctcatgtttagtttgacaagcatcacatctgattttctgtgacccttagaactctttgcccgttgcatagctgttttcccccsagtgtctctatttgctgtatttggccctgctgcttcctgatgcaagtcttgggcaatccctgtggaacatcgcttgttacttttcctgttgactctgtgg

SEQ ID NO: 20143 - DNA, 201 bp, Homo sapiens
cactgagtttccatttcttacctatcagattgtcaacatttcgaaagtttggcaatacctttattattattattattattattattattattattattattatactttaagttctgggatacatgtgcagaatgtgcaggtttgttacataggtatatatgtcccatggtggtttgctgcacccatcaacccgtcatctgc

SEQ ID NO: 20144 - DNA, 201 bp, Homo sapiens
aacacaaatgatacttaccgtatttcacatggttgttatgttgaggactgagccgcattatgtgagaaggctaaacatcatgtccttaatactgaatataygttcttttccccttttccccttttctttcttctttgctgtcccactctgagactcctttcttccaactctgagatgtagttttaaatcttttatgaaaaa

SEQ ID NO: 20145 - DNA, 201 bp, Homo sapiens
agacactcctggaggaaaagtctcatcaatgctgatacacgtggatgttttactccaatgatcttaattcctcacctggcatccaagactacgtttataakgttttcatttcatagtcagggctgtattgctcatgtttagtttgacaagcatcacatctgattttctgtgacccttagaactctttgcccgttgcatagc

SEQ ID NO: 20146 - DNA, 201 bp, Homo sapiens
ctgatttagttatgaactggtaaatttgttttcatgactcaatttctacaaagcaaactttattatatatatatatgtgtgtgtgtgtgtgtgtgtgtgtgcatttttaatgtatgttcatttttttctgttgattttttaaattatgttcattacataagttcctaactgatagcattctcatcgtaaacaggtcaaact

SEQ ID NO: 20147 - DNA, 201 bp, Homo sapiens
ccctctactctggaccttcttcatctcttctgcttttctttattttgggaaatttcagagtagagacactcctggaggaaaagtctcatcaatgctgatayacgtggatgttttactccaatgatcttaattcctcacctggcatccaagactacgtttataatgttttcatttcatagtcagggctgtattgctcatgtt

SEQ ID NO: 20148 - DNA, 201 bp, Homo sapiens
gctgatttagttatgaactggtaaatttgttttcatgactcaatttctacaaagcaaactttattatatatatatatgtgtgtgtgtgtgtgtgtgtgtgtgcatttttaatgtatgttcatttttttctgttgattttttaaattatgttcattacataagttcctaactgatagcattctcatcgtaaacaggtcaaac

SEQ ID NO: 20149 - DNA, 201 bp, Homo sapiens
ctggaaaattctatttatgacaagtgggatttaggccagcatgagtagaagaatgtgtcaggtggagggaacagcaggtgtgggtattccaaagagccaargaacacaagattttgaaggagagaagcagaattagcacaggagagtgtggctcagataatgtggttggatggcaagggcctgcatatatactgcgtaggt

SEQ ID NO: 20150 - DNA, 201 bp, Homo sapiens
tttcagattttgagagttgttggctcatatatataggcatatatatatatatatgtacacatatctatatgtacacatatatatgtgtacatatatattarcatatatgtgtgtgtgtttttcttaatacaaatcctttctttagatatatgatttttcaaatattttctccaagtctgtggcatgtcttttcattcttat

SEQ ID NO: 20151 - DNA, 201 bp, Homo sapiens
tcttctcagccttccaaagtctttttctgccctcaccactactttgaaatttctttatcatggctgtgggcaacatggctcccagcaaccccaactgatgyttttcagaatcttccttgtttttatttgctgcagtaccttccaccccttcatccattcattcaccagtcatactttaaaaatgtactgatgtctctttta

SEQ ID NO: 20152 - DNA, 201 bp, Homo sapiens
tatgctgattttaggagaatagtttcttttcttattttcagattttgagagttgttggctcatatatataggcatatatatatatatatgtacacatatctatatgtacacatatatatgtgtacatatatattagcatatatgtgtgtgtgtttttcttaatacaaatcctttctttagatatatgatttttcaaatatt

SEQ ID NO: 20153 - DNA, 201 bp, Homo sapiens
ttctcatattctaaattttaccattagttcctattttctgaaaaatatgctcacccatacacccaaatattgcaatgaaaagcccttaaagaaattcagargcgttgggagtgacagaacaaaagatgcatggttgtgaaaacatcctatcacgataatgattcacaaagagaaaaaagaatacttgtgctttattgctaa

SEQ ID NO: 20154 - DNA, 201 bp, Homo sapiens
ttatgctgattttaggagaatagtttcttttcttattttcagattttgagagttgttggctcatatatataggcatatatatatatatatgtacacatatctatatgtacacatatatatgtgtacatatatattagcatatatgtgtgtgtgtttttcttaatacaaatcctttctttagatatatgatttttcaaatat

SEQ ID NO: 20155 - DNA, 201 bp, Homo sapiens
ggaacaccttgctccttgtccttccattccatctgaaatctcctagggtcctaagggactctgtgaccttcttaaatgggatttctccatgtgtgtttgaraaggaaactatttattggcaatgcagagctcactgctgttacagtgctgatttcatttaaggtccaaatatgtcttaagattgagtgtatactacactgc

SEQ ID NO: 20156 - DNA, 201 bp, Homo sapiens
aaagcgtctgtttatgctgattttaggagaatagtttcttttcttattttcagattttgagagttgttggctcatatatataggcatatatatatatatawgtacacatatctatatgtacacatatatatgtgtacatatatattagcatatatgtgtgtgtgtttttcttaatacaaatcctttctttagatatatgat

SEQ ID NO: 20157 - DNA, 201 bp, Homo sapiens
cccggaaggtgatgttgcagtgagccaaggttgcaccattgcactccagcctgggcaacaagagcaaaactccatctcaaaaaaaaaaaaaaaaaaaaaaaggaatagcacataaaggtataaagctgtcatgtgtttgccaaaggataatgttttctattatgatagaagattggccccaagagtagtcatcacataaat

SEQ ID NO: 20158 - DNA, 201 bp, Homo sapiens
cttcgtgacctttgaggtgttgtgttacattggttggaacaccttgctccttgtccttccattccatctgaaatctcctagggtcctaagggactctgtgrccttcttaaatgggatttctccatgtgtgtttgagaaggaaactatttattggcaatgcagagctcactgctgttacagtgctgatttcatttaaggtcc

SEQ ID NO: 20159 - DNA, 201 bp, Homo sapiens
acccggaaggtgatgttgcagtgagccaaggttgcaccattgcactccagcctgggcaacaagagcaaaactccatctcaaaaaaaaaaaaaaaaaaaaaaaggaatagcacataaaggtataaagctgtcatgtgtttgccaaaggataatgttttctattatgatagaagattggccccaagagtagtcatcacataaa

SEQ ID NO: 20160 - DNA, 201 bp, Homo sapiens
  misc_feature (1)...(201): n = A,T,C or G, or insertion/deletion polymorphism (see Tables 1-2)
taggccacttttttgtgacttagattggatcctattcttaaccacagcatctctcatcccctataaaggaaagagagacagaataatataaaaagaaaatnttttggatgtctccaggttccatttttaaacatgtaacttgaaaattagagaataagggagacaaatcatgcctttgggccaaatttaaaagtcaagaag

SEQ ID NO: 20161 - DNA, 201 bp, Homo sapiens
atttgatctttctaggaggcttgatgtacttgataaggtttcaacttgttagtgaaagtgagatttcagttatattaggcagagctttgaaatggggttttctttcttcataactttcctgaaaaggtgacttttcatgcagccaaacagagaaagttttattaactaaagagagaattaatggcaccaagtaaagtaact

SEQ ID NO: 20162 - DNA, 201 bp, Homo sapiens
aggaattttcttagagttgccctaaaataatagtattagctatttaaaagtgacctcaagagacatgaggttcttatatttatttttattctgggaacatrtgcattgaggtaagaattttgaaacacttgcgtatattctgtacaaaatgtgcgctttatctcgtttctattttgaatttcaaacaaatttatgatgagt

SEQ ID NO: 20163 - DNA, 201 bp, Homo sapiens
tcaggctcttttttgattccatatgaattttagaatatttttttctaattctctgaagaatgtcattggcagtttgataagaatagcatcgagtttgtacrttgctttgggcagtatggccagtttatcaatattgactcttcctatccataagcgtggaatatatttctatttgtttgtatcatctctgatttctttgag

SEQ ID NO: 20164 - DNA, 201 bp, Homo sapiens
tcgttgcaattgcttttggcatcttcgacacaaaattgttgccagggcctatgtccagagtgatatttcctgggttttcttcaggggtatttacagttttyggttttacgtttaagtctttaatccatttggagtttatttttgtatatggtttaaagaaatggtcctgtttcaatcttctgcatagggctggccagttat

SEQ ID NO: 20165 - DNA, 201 bp, Homo sapiens
tttgttttcgttgcaattgcttttggcatcttcgacacaaaattgttgccagggcctatgtccagagtgatatttcctgggttttcttcaggggtatttayagttttcggttttacgtttaagtctttaatccatttggagtttatttttgtatatggtttaaagaaatggtcctgtttcaatcttctgcatagggctggc

SEQ ID NO: 20166 - DNA, 201 bp, Homo sapiens
catgtgggaaagaaggagagggaagagaatctgaaagaccgttcagcaggcaggtgcaactcagaattaagagagaataatatactctacctaaggacagscctcaaccagtggaatgatggggatggtttccgggtaaactccgaccctcattgtcccgaaggagaacacttccggggcacatactacaatcgtttctta

SEQ ID NO: 20167 - DNA, 201 bp, Homo sapiens
tttgtcaatttttgttttcgttgcaattgcttttggcatcttcgacacaaaattgttgccagggcctatgtccagagtgatatttcctgggttttcttcargggtatttacagttttcggttttacgtttaagtctttaatccatttggagtttatttttgtatatggtttaaagaaatggtcctgtttcaatcttctgca

SEQ ID NO: 20168 - DNA, 201 bp, Homo sapiens
taaatacggagtaatgggaccaaagaatgttacccttaatagagagatttatgcttttgaagtcttaaatatatgtacattttgactgccttgttactttwcacatataataaatatgcatgtattgtaatatataaaaataaccatatgagaaagtattctatggtgttctccaaaaatatttaatagggctacaggcca

SEQ ID NO: 20169 - DNA, 201 bp, Homo sapiens
tctgcaaatcacattattttctattctgattctcccacttacattttgaatgaaactgattactccagttatattttcgagtgcttcccccttcttacctytgattttagatagagtttatgacacatgctctgtaaatatcaagtgaagttattttagtatatggtgcaacattttataaataacaagaaagagtatgct

SEQ ID NO: 20170 - DNA, 201 bp, Homo sapiens
tagccgggcatggtggtgcatgcctgtaatcccagctacggaggctgaggtaggagaatcacttgaacctggaaggcggaagttgtggtgagctaagatcrtgccattgcactctagcctgggctacaagagcaaaactccatctcaaaaaaagaaagaaaagaaaagaaaaaagataattcaatgttaactatgtcatgc

SEQ ID NO: 20171 - DNA, 201 bp, Homo sapiens
agagttcaagaccagcctggccaatatgatgaaaccccgtctctattagaatacaaaaattagctgggtgtggtggcgcacacctgtaatcccgaccactmgagaggctgaggcagaagaatcacttaaacccaggaggcaggcagaggtttcagtgagccaagatcgcgccactgcattccagcctgggcgacagagcga

SEQ ID NO: 20172 - DNA, 201 bp, Homo sapiens
agcatgttcgagccctcatccccaggagccggtgaggggctggtgggctctccccgtcatgttttgtgttggtttaagaattgctgctctgggctgtgcgyggtggctcatgcctgtaatactactacttttggaggctgaggcaggtggattatgaggtcaggagttcgagaccatcctggccaacatggtgaaaccccg

SEQ ID NO: 20173 - DNA, 201 bp, Homo sapiens
aggcaggtggatcacttgaggtcaagagttcaagaccagcctggccaatatgatgaaaccccgtctctattagaatacaaaaattagctgggtgtggtggygcacacctgtaatcccgaccactagagaggctgaggcagaagaatcacttaaacccaggaggcaggcagaggtttcagtgagccaagatcgcgccactgc

SEQ ID NO: 20174 - DNA, 201 bp, Homo sapiens
caatgccctatcttttcccaaagcactactacagattctatttgaaattgagccattaccttctggtatgttgaggcagaagaaaggcaaagaataactgstgcagctcttagactctttgttttcctgttattgaggagcctttctaagaaagcaccacggtcatccttgcttcatgggaatctggggtttgttttgttg

SEQ ID NO: 20175 - DNA, 201 bp, Homo sapiens
tgaagaaatgcctttatgccctggttacaatgatttcctgctatataagatcattcaggccgggcgcggtggctcatgcctgtaatcccagcactttgggrggccgaggtgggcggatcacctgaggttgggagtttgagaccagcctgaccaacatggagaaaccctgtctctactaaaaataaaaaaattagccgggca

SEQ ID NO: 20176 - DNA, 201 bp, Homo sapiens
acgcctgtaatcccagcatattgggaagccaaggcaggtggatcacttgaggtcaagagttcaagaccagcctggccaatatgatgaaaccccgtctctaytagaatacaaaaattagctgggtgtggtggcgcacacctgtaatcccgaccactagagaggctgaggcagaagaatcacttaaacccaggaggcaggcag

SEQ ID NO: 20177 - DNA, 201 bp, Homo sapiens
ctcagcctggaccttattgttcatatcattatcagcatttttgtcaaagccattcaacaagtctctaggaagttccaaacttttccacattttcctgtctycttctgagccttccaaactgttctaacctctgctttttacccagttccaaagttgcttccccatttttgggtatcttttcagcaacaccacactactggt

SEQ ID NO: 20178 - DNA, 201 bp, Homo sapiens
cattgctgctttgagacaaaaagggcaggccagccgcagtggctcacgcctgtaatcccagcatattgggaagccaaggcaggtggatcacttgaggtcargagttcaagaccagcctggccaatatgatgaaaccccgtctctattagaatacaaaaattagctgggtgtggtggcgcacacctgtaatcccgaccacta

SEQ ID NO: 20179 - DNA, 201 bp, Homo sapiens
ctcagcctcccaaagtgctgggattatagatgtgagccaccgaacgtggccaacaaaaagcttttaatagagtctaaatgaatacaagtttgaagagattsatagacttttccaaagaatctctgttatttttaggattcatacatatgaagcttagatccctgcaaactcagtttttgagctattgtcttcaaaatagct

SEQ ID NO: 20180 - DNA, 201 bp, Homo sapiens
tccacccgcctcagcctcccaaagtgctgggattatagatgtgagccaccgaacgtggccaacaaaaagcttttaatagagtctaaatgaatacaagtttraagagattgatagacttttccaaagaatctctgttatttttaggattcatacatatgaagcttagatccctgcaaactcagtttttgagctattgtcttc

SEQ ID NO: 20181 - DNA, 201 bp, Homo sapiens
gcgcaatctcggctcaccgcaacctctgcctccccggttcaagcgattttcctgcctcagcctcctgagtagctgagattacaggcttgtgccaccacgcmcagctaattttgtagttttagtagagatagggtttctccatgttggtcaggctggtctcaaactcctgatgtcatgatccacccgcctcagcctcccaaa

SEQ ID NO: 20182 - DNA, 201 bp, Homo sapiens
gaataggaatttaaaactacgtcttctggccaaattcagtgtcctttccagtctaccatgatgtccccgaacagggtccttttagtaacaacaacaacaamaaaaaactttttatttttttatttttttttttagacggagttttgctctttttgcccaggctggagtgcaatggcgcaatctcggctcaccgcaacctct

SEQ ID NO: 20183 - DNA, 201 bp, Homo sapiens
tggctgatatggccttttgcggttctaggatttcacagctttcagtcctaaatataataatcatctaagtatcctacatagttttctccttcagtactacygttgagtaaaatgaagttttgctgtaatatttcctctggaattcaaaatccagactaagtcctaatagcaggcattcatgcttatatagcagccctgctt

SEQ ID NO: 20184 - DNA, 201 bp, Homo sapiens
tggtagagctcctggaacattcatttgcatataggtgaatcaattattgtaggagaggtcgcttcagtaaatgttcagagttttcctgggattctatgacrtaaagatccacaagtcagctttgaagaaggcagctctcaagccctcatctttgccgtccattggatggaggaagggtggcatagcaacaatggttgtttc

SEQ ID NO: 20185 - DNA, 201 bp, Homo sapiens
ggaagggacggactgcagaagaggaacctgtcatcacccatggcttcaccatgacaactgaaatatctttcaaggtagagtatatgaatgttactaagagrggcagctggagacacctgattccttttggttaaagcctcctaaggtagaaagtcccagtggtcacaattaagtccaaaggctgttaatcatctttgcaat

SEQ ID NO: 20186 - DNA, 201 bp, Homo sapiens
ggtataagcttttgtgtggacatgttttcatttctcgtaggtatatacctaagaatgtaattgctgggtcatatgatggctgtgtttaacatcttaaggarttgcaaactgttttccaaattggctatgacattttaccttcccaccagcagtttatttgataaattcctttcagatagaattcataaatattttctccca

SEQ ID NO: 20187 - DNA, 201 bp, Homo sapiens
ttgatagacatttggattgtttttattttttggctattatgaaaaatgctgctatgaactttcaggtataagcttttgtgtggacatgttttcatttctcrtaggtatatacctaagaatgtaattgctgggtcatatgatggctgtgtttaacatcttaaggagttgcaaactgttttccaaattggctatgacatttta

SEQ ID NO: 20188 - DNA, 201 bp, Homo sapiens
gtcaacgctgagacatagaaatgactgtgatttcagactgtgggttactgttagtacaagcccacctctcccctgaaagagaaaacagaaaactgcatcarcaatagcatctcttctttccttccatccactccattgcagagacaagctactcttctgcatacctccatctgcctaccttctgatgcctggcagctaagt

SEQ ID NO: 20189 - DNA, 201 bp, Homo sapiens
atttcagactgtgggttactgttagtacaagcccacctctcccctgaaagagaaaacagaaaactgcatcagcaatagcatctcttctttccttccatccrctccattgcagagacaagctactcttctgcatacctccatctgcctaccttctgatgcctggcagctaagtaagccctgattgcattaccggtgtgccta

SEQ ID NO: 20190 - DNA, 201 bp, Homo sapiens
aaagaaaccccctacccattaataagcattcttccctccttcctcttcccagaccctggtaaccatttacctttctgtctctatgtgtttaactattctagaaatttcatataaatggaatcatataaaattatgttggtgcaaaagtaattgatgtttttgcttgtgaaagtaatggccaaaactgcaatcacttttgca

SEQ ID NO: 20191 - DNA, 201 bp, Homo sapiens
ttcttccaccagataccctaaatcatctctctctagttcaaagttctctaaatctccagggcaggggaaaaatgctgccagtctctttgctaaaacataamaagagtgtcctttgctccagttcccaatgagttcctcatctccatctgagaccacctcagcctggaccttattgttcatatcattatcagcatttttgtc

SEQ ID NO: 20192 - DNA, 201 bp, Homo sapiens
tcctgaaaacacctcagataaatgaatggatgggcattatgtacattgaatttgtttccttccttccttcgttccttccttccttcgttccttccttccttccttcctttcgacagggtcttgctcttttgctcaggctggagtgcagtggcatgatcacaactcactgcagtctcgacctcctgggctcaatcaatcctc

SEQ ID NO: 20193 - DNA, 201 bp, Homo sapiens
aatcctgaaaacacctcagataaatgaatggatgggcattatgtacattgaatttgtttccttccttccttcgttccttccttccttcgttccttccttccttccttcctttcgacagggtcttgctcttttgctcaggctggagtgcagtggcatgatcacaactcactgcagtctcgacctcctgggctcaatcaatcc

SEQ ID NO: 20194 - DNA, 201 bp, Homo sapiens
aaatcctgaaaacacctcagataaatgaatggatgggcattatgtacattgaatttgtttccttccttccttcgttccttccttccttcgttccttccttccttccttcctttcgacagggtcttgctcttttgctcaggctggagtgcagtggcatgatcacaactcactgcagtctcgacctcctgggctcaatcaatc

SEQ ID NO: 20195 - DNA, 201 bp, Homo sapiens
aggatagagaattccaagtttgtcaagtaatgaactgcatgatattcctggtctctttattcaaagtcatctcctacttatacccctaatgtgtgcgcgcrcacacacacacacacacacacacacacacacgtacacaccatcttgccttccaggcaccctcagccacctttactactcctggcatgctgtctcctgcac

SEQ ID NO: 20196 - DNA, 201 bp, Homo sapiens
tgcaataaaatcctgaaaacacctcagataaatgaatggatgggcattatgtacattgaatttgtttccttccttccttcgttccttccttccttcgttccttccttccttccttcctttcgacagggtcttgctcttttgctcaggctggagtgcagtggcatgatcacaactcactgcagtctcgacctcctgggctca

SEQ ID NO: 20197 - DNA, 201 bp, Homo sapiens
tatgcaataaaatcctgaaaacacctcagataaatgaatggatgggcattatgtacattgaatttgtttccttccttccttcgttccttccttccttcgttccttccttccttccttcctttcgacagggtcttgctcttttgctcaggctggagtgcagtggcatgatcacaactcactgcagtctcgacctcctgggct

SEQ ID NO: 20198 - DNA, 201 bp, Homo sapiens
ctgtgtggagctggactgctggaagggacggactgcagaagaggaacctgtcatcacccatggcttcaccatgacaactgaaatatctttcaaggtagagyatatgaatgttactaagagaggcagctggagacacctgattccttttggttaaagcctcctaaggtagaaagtcccagtggtcacaattaagtccaaagg

SEQ ID NO: 20199 - DNA, 201 bp, Homo sapiens
atatgcaataaaatcctgaaaacacctcagataaatgaatggatgggcattatgtacattgaatttgtttccttccttccttcgttccttccttccttcgttccttccttccttccttcctttcgacagggtcttgctcttttgctcaggctggagtgcagtggcatgatcacaactcactgcagtctcgacctcctgggc

SEQ ID NO: 20200 - DNA, 201 bp, Homo sapiens
ttgctgaactgatcctcttgaacaacagcaacaaaagtgacttacagtcagtttagatggccattgattgggttcttgtctgtcccaagtctgggaagtayagcaggtatagtaaatgccctgaaggagcaaacagttcaacaaaaccctagtaatttacagaggaaatgtaatgccttcaggctgttattggcatggcaa

SEQ ID NO: 20201 - DNA, 201 bp, Homo sapiens
gatatgcaataaaatcctgaaaacacctcagataaatgaatggatgggcattatgtacattgaatttgtttccttccttccttcgttccttccttccttcgttccttccttccttccttcctttcgacagggtcttgctcttttgctcaggctggagtgcagtggcatgatcacaactcactgcagtctcgacctcctggg

SEQ ID NO: 20202 - DNA, 201 bp, Homo sapiens
tcttgacttctaactttatagtttggttttgcttgtttttaatctaataagctatttttactttgaatgaaaactttaaaaaaaacctcttcagcctaaarcatttttattattgctgaactgatcctcttgaacaacagcaacaaaagtgacttacagtcagtttagatggccattgattgggttcttgtctgtcccaag

SEQ ID NO: 20203 - DNA, 201 bp, Homo sapiens
ttgtattagtccattttcatgctgctgataagacatacctgagactgggcagtttacaaaagaaagaggtctcacccacaacatacgggaaatcaagctgrgatttgggtagggacacagccaaaccatatcattctgcccctggagcttcccaaatctcatgtcctaatatttcaaaacaaatcatgcctttccaacagt

SEQ ID NO: 20204 - DNA, 201 bp, Homo sapiens
tcgtccaacaatttttttaatgactagaatatacagggagctgggagtgtgtgctctatctctatgtacttgggtgtgattacaggatgtgtaaaatgtaragatcatcaagttgtgtacttaaaattaatgcattctgtgctctttaatgcatgcatgttatttctttaaaaaataaaaccataaatacatgtttaaaat

SEQ ID NO: 20205 - DNA, 201 bp, Homo sapiens
caattacttagctgagtgcgtctgtgtctatattttgtccagctggaagcgcaaacggaacttggagtatgaaccacagcttccttgaaagctcgtgccarttattaaatgctgtaggcaaggatgtaaacatacatctttttaccatgggcttcacacttttcttctttctgttccagtctaattgtactgaatgtttct

SEQ ID NO: 20206 - DNA, 201 bp, Homo sapiens
ttttccacctagtaaattatagcctgttatcctctagggtatttttctttaatcttcttaagccattttccagtgtctgaaaacaatttaaatattccagktagtgaatccaattacttagctgagtgcgtctgtgtctatattttgtccagctggaagcgcaaacggaacttggagtatgaaccacagcttccttgaaag

SEQ ID NO: 20207 - DNA, 201 bp, Homo sapiens
actgtataaccctgtaatcccacacacacacatctattatagacataatacattactatatagaatactggaaaatatcgtaaaatacattaaaaaaacartttcccttactctcagaactgagaagtaaaatctgttgtatcttgtgagagtatatatgtatgtgtgaacacatatcacacatatatagagtacagttaa

SEQ ID NO: 20208 - DNA, 201 bp, Homo sapiens
tgcattatatgaaggacaccgaaacacagaaaatgaaaggtctacggtgtatgacaaacaggacaaatgctctagcaaaaataaattctactttctctcaraattagcatacttgttatttaaagaaatgtgccagaagagaaatacaagattttcttttcttttttctcattgactttaactctctctgaatggcaccta

SEQ ID NO: 20209 - DNA, 201 bp, Homo sapiens
tgagctattgttcttgatgatttagaaaacctgtgtgctgcaagtttaactgctttaattacagtgatgtcaaatacataggcctttctatttaaagggaktttaatttctgtggcttatgaaagagaaactgaaagcatagttaaaagtgaatatgttagttgagaaagttcctgttcttaccaagcaataaaattttcc

SEQ ID NO: 20210 - DNA, 201 bp, Homo sapiens
tggcatcacatcatcactcaaaaagtttcagattttgaagcattcagattttggagttttggattcaggatgctcaatttgtatttctgtttttaatctarcagttacactgagggccaagactctatgttaaatgcccaccatatattatctgatttaaacatcacagtgatgctgcagggaaggccctgcagtggccat

SEQ ID NO: 20211 - DNA, 201 bp, Homo sapiens
aatttatttcttacagtactagaggctgggaagtctaagatcaaggtgccagcagatttggggtctgatgagagcccacttcctggttcgtagacagaagrccatcttcttattgtgtcctcacatggtggaaggggtgaaggctctctctggggtcaatctctctcttttttttttttttttttttttgagacagagtct

SEQ ID NO: 20212 - DNA, 201 bp, Homo sapiens
tctcttctccagactttggtgtagcccctttttcttttatctaatgttcctaccccaatccactcattattttaccttaccccattttattttcatcattracttcttctctgaaatgttcttgttcattacagttgtgtgtttattgctcttctacctgtaagcattatatgcattatttacatgtgcctgacacatgtt

SEQ ID NO: 20213 - DNA, 201 bp, Homo sapiens
gacttaagaaactattttctgctttgtaattttgttatgtaacaagggcgatgagatttagttacatgtttttgtgacatgttgtagtattaatgttagtyaactctttcaacaataattatgtgtaacaaacaatctgaaaacttatatgcaaatatttatcttcgtgctcataggtctgtgggttggccgggtttggct

SEQ ID NO: 20214 - DNA, 201 bp, Homo sapiens
ccgaataaactgtgtgttgtgcacctgcattttgacggtgactcgtcacatgtgatcaggagtggaattttccactgtggcatcacatcatcactcaaaaagtttcagattttgaagcattcagattttggagttttggattcaggatgctcaatttgtatttctgtttttaatctagcagttacactgagggccaagact

SEQ ID NO: 20215 - DNA, 201 bp, Homo sapiens
caccaagattttgattagaattttgtcagatgctctgataagaaaagaaactgacctgaaaaagataagttacacctacagtttattctaaagtcctctaraagtgggaatgtgtgctgtgtgcagcctgtcaaaacttttattttggcaacttctagaagtaacaaaacaggactgaaaatattgctatgatttattgga

SEQ ID NO: 20216 - DNA, 201 bp, Homo sapiens
actttgatccatcttcctttttagaaacgagagaaaaggcatctgtgattgtgcctctgattgggtggcatccaaaatcttgtttctcagggtgagcttarggttcatctctattaaacgtatcatttgtcagacattggcatgtctagtgattcggaaagcccttggagtagcacagaaatgctatcataactccggagt

SEQ ID NO: 20217 - DNA, 201 bp, Homo sapiens
gggttcatgccattctcctgcctcagcctcctttagaagttttattctgctcacttaaatatttgattgtatgggatccttgcagggaatcgccaccaagattttgattagaattttgtcagatgctctgataagaaaagaaactgacctgaaaaagataagttacacctacagtttattctaaagtcctctagaagtggg

SEQ ID NO: 20218 - DNA, 201 bp, Homo sapiens
ggaataagctagaaatggaagtatctgaaacaaactaggcagcatagaacagtgttcctaaatataaattttgaaaagttttttttttttttttttgagayggcgtctcgctctgtcacccaggctggagtgcagtggtgcgatctcagctcactgcaagctctgcctcccgggttcatgccattctcctgcctcagcctc

SEQ ID NO: 20219 - DNA, 201 bp, Homo sapiens
tcaacatgtaatgagtcagtgtggaatattgattattcatctgaatatttaaatcttgttttgtttttggttttgtttgcatgtgggttttcttggctcaraaaaataaataattgcatgtaaaaaccatttattctttaatttcagaagtatttattcagcatttcttctattcaaatctctgatggtattacatagcac

SEQ ID NO: 20220 - DNA, 201 bp, Homo sapiens
ttagtcttatgtactatgaaccccaaaaatctgagacagttaatttagcaagtttatttagtaagttcatttttccaaggttcaggacgtgcgcctgtgayagcctcaggaggtccagatgacatgtgcccaaggtgttcagagcagtttgtttttatacattctagggagacatgagacatcactcaacctatgcaagat

SEQ ID NO: 20221 - DNA, 201 bp, Homo sapiens
taaaaaatgaatgaactactgctacatgcagcaacatcttgaaatcttagaaatataagccttaaagataaaagaaaaatgcaaaagactacgtgcagtaygatacattatgttcaaagcaaacataactttaaacatattatagtggataatacctgttggataaaactatacaatgaaacaggactacatttaacacag

SEQ ID NO: 20222 - DNA, 201 bp, Homo sapiens
tgaatttctgctttagtcttatgtactatgaaccccaaaaatctgagacagttaatttagcaagtttatttagtaagttcatttttccaaggttcaggacrtgcgcctgtgacagcctcaggaggtccagatgacatgtgcccaaggtgttcagagcagtttgtttttatacattctagggagacatgagacatcactcaa

SEQ ID NO: 20223 - DNA, 201 bp, Homo sapiens
tgagtgtgtagaatgaataatcaaatgatttctggtacactggaagtctggtgccattgtcttgatttgtatgaagacataagcagttttttttttagcaytgcttttgtataaagtgcagatttcatctcagtgaaaaaggcaataacctcttaatatcattatgaaattattttgacctcagggaccctcaaagggtct

SEQ ID NO: 20224 - DNA, 201 bp, Homo sapiens
taaacccaggaggcaggcagaggtttcagtgagccaagatcgcgccactgcattccagcctgggcgacagagcgatactccgaaaaaaaaaaaaaaaaaaaggagggggcaatgtatgctctatagtctttaaagatattctacatcagtcagtcagcgtggaaacatgcatgtggaaagacaggtattcaggtatggtgt

SEQ ID NO: 20225 - DNA, 201 bp, Homo sapiens
aagcacagttgtgctttttagtgaaatgtaaccaattgcttaagaaaagggtctcaagaagtagaaggcctgagtttgattcccagactcttcatagatayttagcaatgacaaattacataaagtatttgaccttcagtttgttcatgtttaaaatgggtgcataatctgtacctaaccttataggttcagtgtgaggac

SEQ ID NO: 20226 - DNA, 201 bp, Homo sapiens
ttaaacccaggaggcaggcagaggtttcagtgagccaagatcgcgccactgcattccagcctgggcgacagagcgatactccgaaaaaaaaaaaaaaaaaaaggagggggcaatgtatgctctatagtctttaaagatattctacatcagtcagtcagcgtggaaacatgcatgtggaaagacaggtattcaggtatggtg

SEQ ID NO: 20227 - DNA, 201 bp, Homo sapiens
gagtgcagtggtgcgatctcggctcactgcaagctccgcctcccgggttcatgccattctcctgcctcagcctcctgagtagctgggactataggcgcccrccaccacgcccagctaattttttgtatttttagtagagacggggtttcactgtgttagccaggatggcctcgatctcctgacctcgtgatccgcccacct

SEQ ID NO: 20228 - DNA, 201 bp, Homo sapiens
tatttctgttagtgacgttttacccttgcccctccacacctttgtgtttaggctcacacatttcaatttcaaaacccagaaccatggtattaattctaaartctgagctactaaagctggggccctcaagtaagtacaccatggaatctgcgagatagaaattcctagcctcgcattttagtttaaaaagttttagtttga

SEQ ID NO: 20229 - DNA, 201 bp, Homo sapiens
aaaagtaataaaatcatctcttttttttttgttttttgtttttgagatggagtctcactctgtcatccaggctggagtgcagtggtgcgatctcggctcactgcaagctccgcctcccgggttcatgccattctcctgcctcagcctcctgagtagctgggactataggcgcccgccaccacgcccagctaattttttgta

SEQ ID NO: 20230 - DNA, 201 bp, Homo sapiens
agcaaatcctggacctgtggcagagccaggcttgataattacgtcccttacattggccggcctgataaagcttggatattcacagtgacaagtagcaaccygctatagaccttagtggtcactcacaaataggaaaaaaatcttggaatgttaaattcgcagattagagaatccccttttcacattttctgcaaaatccat

SEQ ID NO: 20231 - DNA, 201 bp, Homo sapiens
tgcatgcagagctgagtggataagcaagcctccttgattaatcacatcaattaaactgggtcaaagatgttttgttatattggttccattatctgactttyggaaaagcaatgtgacctacagagttgacatgcccttgatatggcaaaagatgagtttcatcctcaaatatcccattagcattttattttccctgcttag

SEQ ID NO: 20232 - DNA, 201 bp, Homo sapiens
ttaagtgttatgttttgactaatttacacaaacacacacacatacacacacacagacacacacacacacacacacacacgtggagcccccatccatattgmaatagagaatttctagtgccccagcaaccctccttaattacctccccaccaagagaccactactatagatcttcctaaattttcacgcttccatggaaga

SEQ ID NO: 20233 - DNA, 201 bp, Homo sapiens
ttaatatgctttaataatgatttactgcacaactactgggtgctaggcactatgataggtgctgggggatttcagtcaaatgccatttatgctttcaaggractcatagtttaatgagcacaaattatatgaaaacaaatgattgagctatggtgagcagtcaactctgttggaattagtcagaaagcttcagggaggaga

SEQ ID NO: 20234 - DNA, 201 bp, Homo sapiens
gttttctgtgagtcatgattttttttttccccaagctggagttgaaatctacttgaatatctctctcctatgacaaaggcaaaattaagtatcatgataamtttcaggattcgaataaaataatcacttaatagtgatgtgaattttcatgaacattcgcagcttgaagaattattttagtatgccatgtatttatagttt

SEQ ID NO: 20235 - DNA, 201 bp, Homo sapiens
ctatactgtcctctttcgagggttttctttccaatgatcaacattgattgatgtaggaccttcttagcgttctgctaaatatgtgggaaaaatacatggcrtgtttcctgaatttgtggaatttttgcaggggaagcaataagagagaaatagaaggcaatgtgaacttaatatgctttaataatgatttactgcacaact

SEQ ID NO: 20236 - DNA, 201 bp, Homo sapiens
gtcatgattttttttttccccaagctggagttgaaatctacttgaatatctctctcctatgacaaaggcaaaattaagtatcatgataactttcaggattmgaataaaataatcacttaatagtgatgtgaattttcatgaacattcgcagcttgaagaattattttagtatgccatgtatttatagtttaataaaacata

SEQ ID NO: 20237 - DNA, 201 bp, Homo sapiens
ttaaacttttcccatttggcagaggaatgtcaagaggactgggacatactagaactggcagcctgaactcttccttagagtatcaggataccatttagaasaatattgcttcacttacctgaaaaaaagatacttgaacaacagttcttcagaatacagcccaaaacatcaaccaaagcataataagtatgtctacatagc

SEQ ID NO: 20238 - DNA, 201 bp, Homo sapiens
tcttgattggatttccgtttggattaacatcacgtaagagttgatatccactctaccatcagagattgtggtctatgctacttcttttgtccctttgtttwatataagtaacgagcttggagatgtaaatcagtcaccattttaaactgattgatcaaactcagtaagaaataaaaccttttcatggaactcactcagcct

SEQ ID NO: 20239 - DNA, 201 bp, Homo sapiens
ggggagttttaatttttcccgtggaagaattttctttaagttcattttcatttcatttcaccacgttaaacttttcccatttggcagaggaatgtcaagargactgggacatactagaactggcagcctgaactcttccttagagtatcaggataccatttagaagaatattgcttcacttacctgaaaaaaagatacttg

SEQ ID NO: 20240 - DNA, 201 bp, Homo sapiens
ggaatcaaggccaaagaacaatcttatttaaaatgctgtggttggcctggcatagtggcttatgcctgtgatcccagcactttgggaggctgaggcaggcrgatcacctgaagtcaggagttcaagaccaaccaatatgggtgaaaccccatctctattaaaaatacaaaaattagccaggcatggtggcgagcacctgta

SEQ ID NO: 20241 - DNA, 201 bp, Homo sapiens
atgtttgtaattttccccattccctctccagtcacaaaactagaacacaatcttgggaaaggacacttgttcccacctcccatccccagcacaaaaatctwcaaacacatatcggacaagacaacccacattgggccagtgtcttgtgaggggtgtccgacatcatggtaagtcagcaagggggagagactgcacttctaa

SEQ ID NO: 20242 - DNA, 201 bp, Homo sapiens
gagaggctgcaggagagaccaaacctgtccacaccttgatttttgacttccagcctccaaaactgaaagaaaatacaattctcctgtttcagctaccaagyatggtgttatggtgtggcagcccaagcaaactcatgtagctgatttcatgaactttcatgttttctgcactgtggcttttctgatgtttgtaattttccc

SEQ ID NO: 20243 - DNA, 201 bp, Homo sapiens
tggtcatgtttcttataaattcttagtggaaatcccagaagctcttttccagaattgttttctactctgagcacctactctgggtggtctttacttgcctygagttcctttatcttaaggatgattcaagagaatccctgacccccaaacctagtatctgcaattctgagaggtggcgatctttaaccaatcatctgttta

SEQ ID NO: 20244 - DNA, 201 bp, Homo sapiens
ataaattcttagtggaaatcccagaagctcttttccagaattgttttctactctgagcacctactctgggtggtctttacttgcctcgagttcctttatcytaaggatgattcaagagaatccctgacccccaaacctagtatctgcaattctgagaggtggcgatctttaaccaatcatctgtttatcaagttttgagca

SEQ ID NO: 20245 - DNA, 201 bp, Homo sapiens
tgtcacagacctaagtaactactaatattgagattttctctctaattcttctgacacttcttctttttcttttttatttatttattatggtttttttttttgcctaaaaagcgtcatctttctggatcacgtcaccgactctagcctttggctttctatccagggacatttttcacaaagaaacaaaactgtttagtgatg

SEQ ID NO: 20246 - DNA, 201 bp, Homo sapiens
agtaaatatattgatggactctgtaatcactgatttaaaacgtgtgatttataattacaagtttcaggtgatttctgagaatgctttttctcttctgagtrtaccaaaaagaaccccacaaaattacaagtactaatatgttttctctttgaaccttgtctcaatggtgttcaaaaactttgatgcaattaatcaattcat

SEQ ID NO: 20247 - DNA, 201 bp, Homo sapiens
cagaggcagactccattgccaagactccagttcactgacccttaattgtgcacagctcagaagaggtcacagtttggctcagacttcttgaatagcttctrgaagaattgtttgaaatgagaagatgttggaaagaactagaaactcttctttcatgatctactccacacacatttcactccaataatactaaacagcttc

SEQ ID NO: 20248 - DNA, 201 bp, Homo sapiens
acccgagcattgcaaattcaatatgtgagcagggcagcaaagaacaatggacatgtatcttgcacatatctcctctgcttatgtgcattctccattgttcsatcagacttcagttacaaaacacaagctcaaagataaaatgatggagaatttcaggacaatgactgcagaacattaaactaagcatgggtccttctgagt

SEQ ID NO: 20249 - DNA, 201 bp, Homo sapiens
gtggacgaatcatctcagtttctatcgggttttcagcatgtgaacctagtgtttaccttgtcaaaaagttgattgtttctaataagcaggataacagataytctagcaccttcaaagtcgaacagagctgagaaatgaagtgtgacttatcctgtggaatgtaaaaaacaacattttttaggaagcatgtgaatatgaatg

SEQ ID NO: 20250 - DNA, 201 bp, Homo sapiens
agcaccttaaaaattgtaatgacaagaccccactgtaggattctaatatacttgggctgagatgcagtccacactatgtgagtgtgaaaagctgctcagcrgtcctaatgtttggtcgtggttaagagctgctgctttacagtaagcagtactttgcctgtggccaggtaaggcaaaaatgtgcctggggactttgggaaa

SEQ ID NO: 20251 - DNA, 201 bp, Homo sapiens
aactcccctggcatgaggttgaacaaagtctagttaagcttgctatttttttccttttagtagaccctcccttgagtaaaaaaagatagagaagagcaaasggtcttcgctaagtgaactcatagcttagccaaagtctttcagagctgagtacggaggggctgcctcagtgggaagcagaaattaagacctgctcctcca

SEQ ID NO: 20252 - DNA, 201 bp, Homo sapiens
gagccccagcactagtattgttgaaaaacgtctagtgttgttcaactaatttgaaagtttaaccagagctgaactccatctaagcaaaggtaacatacaawgagtgaaggagagaggtaattttaaatgtcatctttttttgtttgtccttttaaattatcaagaagcagacaggaacataaatggaaaaccaagtctccc

SEQ ID NO: 20253 - DNA, 201 bp, Homo sapiens
taattgtatactcttgaagttaagttggtgttaaatcaagccagattataagtttaagatgttagttgtaatccccaggataactactaaaatattaactrtaaaatatacagaaaaagaaatgaaaagtatacttcaaaaatcaaacacaaaagaaggcagtaatgggggaattgagaaacaggaaagataagacatata

SEQ ID NO: 20254 - DNA, 201 bp, Homo sapiens
catatgatttaaaagacagatatatcaaatgatgaataaaaatctatgttagtttagtttacatacaatgtataaagatatagtctgtgacaaaaacaatwtaaagaaagagatatggagaatataagagcaaagtaattgtatactcttgaagttaagttggtgttaaatcaagccagattataagtttaagatgttagt

SEQ ID NO: 20255 - DNA, 201 bp, Homo sapiens
agacacaagtgttctgtgtttattataatcattagttgaggttaatctttgatttgtcaaggaggtgtttgaatttcctcaaataatattttcagattttraagagtcacacacacacacacatatacacaataacacatttatacagacacacgaacaactttatacaattggagagaagcttagcagattaaccatttt

SEQ ID NO: 20256 - DNA, 201 bp, Homo sapiens
aaaaaatagtttccaggccgggcgtggtggctcatgtctgtaatcccagcactttgggaggccgaggcaggcggatcacaaggtcgggagatggagaccakcctggctaacatggtgaaatcccgtccctactaaaaatacaaaaaaaaaaaaaaaaattagccaggcgtggtggtgggcgcctgtagtcctagctactcg

SEQ ID NO: 20257 - DNA, 201 bp, Homo sapiens
aaatggtgcagccactgtagaaaatggtattgtattttttcaaaaataaacatagagttaccatataattcagcaagttcacttccgggtatatatctcaracaattaaaatcagggactgaaacaggcatttgtacactcatattcatagcagcattattcacaatagacaaaaggtgaaaacaacccaaatatccatca

SEQ ID NO: 20258 - DNA, 201 bp, Homo sapiens
caaaagggaatgcctttggatttctgtaaaagggtctgcttcaaggagaaatgcaacctgagagagaaggtcatggttttcacaaaaggctgtggttacartgagatttgaggcttaaatccaggcttgtgtaagactgttatgtgttactagttgttaaaatattgagtgcttttatgcttgtttgcaaatagctacttc

SEQ ID NO: 20259 - DNA, 201 bp, Homo sapiens
ctcctagcaacaactcctaaagagtttggagacttcttctggtggcatctctcttgctcttgtaccctctctctctttttctctattcctctccccaagtstctgaataataaaatttctatcaggagtggattaaaagatacatctatcagttcaccaatttagattctataacaggaatgacaggcattaagacattgt

SEQ ID NO: 20260 - DNA, 201 bp, Homo sapiens
gagctcaaagcaatctgcctgcatggacctcccaaagtgctgagattacaggcatgagccaccacacccgcggagatctgatggttttataaggtgcatcsccctacctttggcactcattctttctcctgctgccctgtgaagaggtgacttctgccatgattgtaagtttcctgaggcctttggctggattttggactt

SEQ ID NO: 20261 - DNA, 201 bp, Homo sapiens
ggttttgccatgttgcccaggctggtgtcaaactcctgagctcaaagcaatctgcctgcatggacctcccaaagtgctgagattacaggcatgagccaccrcacccgcggagatctgatggttttataaggtgcatccccctacctttggcactcattctttctcctgctgccctgtgaagaggtgacttctgccatgatt

SEQ ID NO: 20262 - DNA, 201 bp, Homo sapiens
atgtatcctagaacttaaagtaaaattttaaagaagaataaccagaaaataaataaataaatatatatttttttaaaacctgctttgtcaggtactgttayagttgatatagatgaagtgaaatctaagaagaatgtctaggcccaagatgcctagtgcttgcttttaactattttcattttttagccaattactaattaa

SEQ ID NO: 20263 - DNA, 201 bp, Homo sapiens
gccagctcattgtttcttcaggctactaagcatcaagcaatttgttttctgtgttcagtctgtcatcttacggctcgctctaatgttcactgaagccctayggcagactttgggactactgtttttttaaataaacaattatggcattttcagatatggatattatcaaaggaatgatctaattgtccaccacagatttgg

SEQ ID NO: 20264 - DNA, 201 bp, Homo sapiens
tccccaaacttgtaataaagccagctcattgtttcttcaggctactaagcatcaagcaatttgttttctgtgttcagtctgtcatcttacggctcgctctmatgttcactgaagccctacggcagactttgggactactgtttttttaaataaacaattatggcattttcagatatggatattatcaaaggaatgatctaa

SEQ ID NO: 20265 - DNA, 201 bp, Homo sapiens
atagattaagtcatgtcatagaatcaggaaaatacaaggcatttctggaatgatgtggtggcctgtttggctgggagacagcttatgtttggggcactagygtgatatggaagaggaggctaaagaaggttaattgaagacaggaccatggaaggttttccatgctagcctttctaggctggaaatggaaaaccactggag

SEQ ID NO: 20266 - DNA, 201 bp, Homo sapiens
aaccaaccttcacctaacttggtgataggaactagtcagtcatgttttaaagacatagcatggtccaacaactacaagattcttaggatagaaaactgatratgataggaaccaaaatattaagcaagatcagaaacttccatggtacattgaccttgctatcaattataaagagtaccacagtcttggcaaatagcattc

SEQ ID NO: 20267 - DNA, 201 bp, Homo sapiens
gggcaatctaaagtgaaaagtaatttgaaatacatgagggactgtaagagtattcatattcttaaatcaagaattccccttctgagaattcattcccagawaatcaatcaagatattagggaaaaaatgaagctgttctctgtagaattatttgaatgacagctctgaaaatgtagctgtccaacagttggggaatggtta

SEQ ID NO: 20268 - DNA, 201 bp, Homo sapiens
tcaccacctggaaagtggaagcatctctaaaaacaacttccacagaatgcatgaatttacagatgatatgaaaacatgtgcatattgaattttctgaaaartggcttatcacaaaatttaaaaaaagtatttatcaaaggaactttgggcacataaggaaataaatccaatagtatgctcatgacaattagttatataaat

SEQ ID NO: 20269 - DNA, 201 bp, Homo sapiens
tcccaagaagtggaggaaggcagaactcccactagccatatcccagcctccttaagatgggcctgtggtcctgggaaatctgctcttctaacctttccttygtccacagaagccacatcagtagagggtcagttacagacaaggggcacacagtgaataaggaggcactcacttcttggattaattggcttagtgtgagaa

SEQ ID NO: 20270 - DNA, 201 bp, Homo sapiens
ctaatgacagaaactactctgagttaccttattcctgatattccaggactgacatcagggcctctgtcccaagaagtggaggaaggcagaactcccactarccatatcccagcctccttaagatgggcctgtggtcctgggaaatctgctcttctaacctttcctttgtccacagaagccacatcagtagagggtcagtta

SEQ ID NO: 20271 - DNA, 201 bp, Homo sapiens
atctacaacaacaaaaaaagaagccagatgcaaagaactatagactgtatgactgtttatataaagttgcaaaataggctgctgtctcagttcattcctgytgccaggttttatctctgcctcctaattattctgtcatttcagccacatctggggttactaagtgtcatttctaaattgtacctactgacattagcgaat

SEQ ID NO: 20272 - DNA, 201 bp, Homo sapiens
attcctgagaaagcagaccaggctccctttactgggttaggaaaagataaaaggctaaacttcccaaggcagttgactggtgatttttcattctaacatcygaaaaaataggaataaagttgctatggtttgaatatatgtgtcccttcaaaattcatgctgaaatttaatccctagtaaaacagtattaagtgaggactt

SEQ ID NO: 20273 - DNA, 201 bp, Homo sapiens
aagcagcccggccctagaactcatgtgctctaaaccactactctaaaccagctctttaaaacacgtaagtgtaaatgtgcacagatttcaatttagagctrtgtgactcccagcagatttcttttttcttgagcaaaggagatgccactgtgaatattaatgtctgtcatagccagagcagacactcttcagcttttgggc

SEQ ID NO: 20274 - DNA, 201 bp, Homo sapiens
ctcagaaaatccactttacttacatttagatttacagtttatcaagaaggatacagatcaacagccagatgaagaggtatatagggtatcgtagtctgctytgtgctgctataacaaaatgcctgagactggcaatttatacgaacagaaatctattttctcacagttctggaggtttgaaagtccaaaatcaaggcgcca

SEQ ID NO: 20275 - DNA, 201 bp, Homo sapiens
agcactttgaaaggcctaggtgggaggattgcttgaggccaggagttcaataggggcctgggcaacacagggagactctgtctctacaaaaaaattttaarattagctgggtgtggtggtgcacacctatatttccagctactcagaaggctgaggctggaggatggcttcagcatgggaggtcaaggcttcagtgagcca

SEQ ID NO: 20276 - DNA, 201 bp, Homo sapiens
tcaataatttactagaacagctcacagaactcagaaaatccactttacttacatttagatttacagtttatcaagaaggatacagatcaacagccagatgragaggtatatagggtatcgtagtctgctttgtgctgctataacaaaatgcctgagactggcaatttatacgaacagaaatctattttctcacagttctgg

SEQ ID NO: 20277 - DNA, 201 bp, Homo sapiens
agcacaacactggtacaacctactactcagggatcctcaaactttaatatgcatgctaatcaacttgaggttctattaaaatgcagattttaatagagtargtctaggtgcactttgtaacaagtacactttgttactgactttaaaacgagctcccaggtcatgctaatgttactggtccgtggaccacactttgagtag

SEQ ID NO: 20278 - DNA, 201 bp, Homo sapiens
cagatcatgagttcttttggtgactagggtgttgtggcattttggaggcaggaaagatacaggaagttcccatgctataagccttgtctctttgaacatayctaagcatattagatctgttaatttttgcttcatatagtttgaaggtataattattgggtgtatacatttttagtattgtttctcaaatacattgatctc

SEQ ID NO: 20279 - DNA, 201 bp, Homo sapiens
acagatcatgagttcttttggtgactagggtgttgtggcattttggaggcaggaaagatacaggaagttcccatgctataagccttgtctctttgaacatrtctaagcatattagatctgttaatttttgcttcatatagtttgaaggtataattattgggtgtatacatttttagtattgtttctcaaatacattgatct

SEQ ID NO: 20280 - DNA, 201 bp, Homo sapiens
cagtgagccgagatcacgccactgcactccaacctgggcaatagagcaagactctgtctcaaaaaaataaataaataaaataaaataaagtactagattaygtttttcttcccaattaaacagatcatgagttcttttggtgactagggtgttgtggcattttggaggcaggaaagatacaggaagttcccatgctataag

SEQ ID NO: 20281 - DNA, 201 bp, Homo sapiens
ggagcttgcagtgagccgagatcacgccactgcactccaacctgggcaatagagcaagactctgtctcaaaaaaataaataaataaaataaaataaagtaytagattatgtttttcttcccaattaaacagatcatgagttcttttggtgactagggtgttgtggcattttggaggcaggaaagatacaggaagttcccat

SEQ ID NO: 20282 - DNA, 201 bp, Homo sapiens
attaaccttaaacaaaggcatttgaaaaactatgtaaaaagctttctataacagcttcactaatttctttctaccctaagcagttgagcacatttttaccwtaaaactttcgtcactttatatcaagggtttaaagaataaaatttcagtgaagtgtctcataattatatcttttgaaattacttcaagccacatgtataa

SEQ ID NO: 20283 - DNA, 201 bp, Homo sapiens
tgaagttattttagtatatggtgcaacattttataaataacaagaaagagtatgctactttcaacaatatcatgtttaatatacataaaatatataagcaygtaaaatatatgtaacatatatacttaaaatgcatatacattatatacatttaactaagtacaaatataaatgttgcctaagaggtaagcttcaaattgg

SEQ ID NO: 20284 - DNA, 201 bp, Homo sapiens
tggtaacctttagcaaggatgggcccttcattcatctttctgacctccatagcaggttacctgaatgagtgagcacaggatataagacctttaccttaaayagtaacatcttttgattgaatttttagttgaatgtcaagaacttcccccctttaatcactggatgttgtcagaacttattcttcagaaagttaggtttat

SEQ ID NO: 20285 - DNA, 201 bp, Homo sapiens
tctttccttttatcctctgaacatatgcatgcatcttaaaagactacggatttaaagtactagattaggccaggcacggtggcacacacctgtaatcccarcactttgggaggccgaggcgggcggatcacgagatcaggagattgagaccatcctggctaacatggtgaaaccccatctctactgaaaaaaaatacaaaa

SEQ ID NO: 20286 - DNA, 201 bp, Homo sapiens
actggatctggggtagggcctgggactcagcatctctaataagcccccaagtgatgggatactgctggtccttggagcacagtttaacaagcatctccacmacacacacgcactacctctgtaacaaagctgtaattttctggtaacctttagcaaggatgggcccttcattcatctttctgacctccatagcaggttacc

SEQ ID NO: 20287 - DNA, 201 bp, Homo sapiens
ttgccctgtgccacacaattagtaaagaaaggagttaggatgaaaacccaggcaatctggttctgcaactcatgttccacatcagcacttctgcatgttamgtgtgaagaccagggcatcatgataaattgctgatcctggttcactggatctggggtagggcctgggactcagcatctctaataagcccccaagtgatgg

SEQ ID NO: 20288 - DNA, 201 bp, Homo sapiens
gatcatttctgtaatgactaggggaaaatgtcactctaaagaatgagagacataaggcctttgaggttgtagggctcttttcacaaattgatgtcctttgraaaccttatctttgcaccatcaaaaagttattttaggaggataaaatgtacaaaaatacagaagtagagttttaggtcaatcttatttttgtttttcttt

SEQ ID NO: 20289 - DNA, 201 bp, Homo sapiens
attgattgatttgcatatgttgaaccatccttgcatctctgggataaatcccacttgggagaatcatagctcagtaccttgcttgtggtgggcaacttctrtgttgcaattcatgctccagagaaccctgtgggatcagtctgagactggagtttgcctgaggccacatttcgacttatcttcttccctgtcttaacctgc

SEQ ID NO: 20290 - DNA, 201 bp, Homo sapiens
aatgtctgaaatctatagataacacaagcagttagctcaggggttgatttttaactaccaggcccagggcgcggtgctgggctatctgcctgtggattccrtttctgccttttagtttttacttcttctttctttggaggcagaaattgggtataagacaatatgatgggtggttgcctcccttaatagttaaatgatttg

SEQ ID NO: 20291 - DNA, 201 bp, Homo sapiens
tgttgatatgatgtatcacattgattgatttgcatatgttgaaccatccttgcatctctgggataaatcccacttgggagaatcatagctcagtaccttgyttgtggtgggcaacttctatgttgcaattcatgctccagagaaccctgtgggatcagtctgagactggagtttgcctgaggccacatttcgacttatctt

SEQ ID NO: 20292 - DNA, 201 bp, Homo sapiens
gacgggattttcacgatacttttccatacaatgtctgaaatctatagataacacaagcagttagctcaggggttgatttttaactaccaggcccagggcgyggtgctgggctatctgcctgtggattccgtttctgccttttagtttttacttcttctttctttggaggcagaaattgggtataagacaatatgatgggtg

SEQ ID NO: 20293 - DNA, 201 bp, Homo sapiens
gggtgacactaatattaaaaatagtgataaaaatttgctattttcatattttattcagaggaaaaactcgagaaaaaagatagaaaatggagaactgtcartattgggggaaaaaaccttgaaaattgttttaataagtataactaatagttatccattaaatagtccatttaaatagtctattaaagttgacattgttaa

SEQ ID NO: 20294 - DNA, 201 bp, Homo sapiens
gttttaaacacataaagtgcttcatggcaatgcaaaatcttctactgaagtgttttgtattatttcgatttgaacttaagagattatgtggattctgtacrtaataggttttattcatagacttgatagtgtagcaggacgagccgcagacaagaacccctcagacaccgagttgtagaaggaaagggctttattcagctg

SEQ ID NO: 20295 - DNA, 201 bp, Homo sapiens
ctatttcagatgaaactttctacatgattccatgctaattaaaggtgatgagcgcatttaaaaaggaagataatcatcaaatcatttagggtttccctttrtctttaatgtagcatgcaggattttcaaagtgcttttctgatttttatagtacataaaatatttaacacaatacctggaaaatagtatgagtcataaaga

SEQ ID NO: 20296 - DNA, 201 bp, Homo sapiens
ttagaacttcttgctaatgattactgattttgactgtttgtaagtctagccttacaatttattcagaagtgtggttttaaacacataaagtgcttcatggyaatgcaaaatcttctactgaagtgttttgtattatttcgatttgaacttaagagattatgtggattctgtacataataggttttattcatagacttgata

SEQ ID NO: 20297 - DNA, 201 bp, Homo sapiens
gggcccagcacttaccaactcatgttatccattacaacaaatgtctaggtctgtacactgaatttgtcttccaccaattttagaatgctgattcttttcaygggtgacatcctaaatttaaggaattaaccaagaatcataagtgtaaatgcttatagtgccaagtagcttgggtgtaagacactggggagtagtggagac

SEQ ID NO: 20298 - DNA, 201 bp, Homo sapiens
gcccagggataagcaaacaatcagtaaaaaatgcttacatagaaagcgcatgatattttaatatgaatttttaatatttaattaattttagtggctattgyctaccttttatcaaataaacagctatttattattagaacttcttgctaatgattactgattttgactgtttgtaagtctagccttacaatttattcagaa

SEQ ID NO: 20299 - DNA, 201 bp, Homo sapiens
aggggaaaaacaattcatttaaatgagtgtatattggctacatatgaagctgaattatttctgatggagttagatttccaatcatgctgatatttaaggasttacccatgttatcctgccctcttaaaaataatatcagcattttctacgatatgcacttcgttgtgatgacaatacatccatcaaataagcttgcagaca

SEQ ID NO: 20300 - DNA, 201 bp, Homo sapiens
tgatggttgtttccaggagacatcaactctcttgcacttccagcctgttaggccttaagcaggctctggccatggaaaaatcacttcaacagaaaagatayaaaggctgatagttagaagtcgagtccaaattcaataagatggtaaagagagacacagctggggaatcaacagaggcctgtaatcggtatggaagggaca

SEQ ID NO: 20301 - DNA, 201 bp, Homo sapiens
gaactgagacagatgcccatgcttagctgcaagggaagttggaaaatgtagcttaatgcaagagttcaaccaacagactcagaagttgctcttgccaaaasgaagaaaggaaaacctgggtattggaaaacagcctctgccatagaaggcctctaccatagaaggcttgttagcggcctcttccatagaaggcctgttcat

SEQ ID NO: 20302 - DNA, 201 bp, Homo sapiens
ccgcagcatagctgtgcttcaggttctgggttgggtctatgtctgtcccacatgcgctcactctggggtccaggctgaagtggcagttgcttctacaatakggacttctcttggcagaacactggaatgtctaactctgcatgtgcattttaagcctctacctacaccaaattactaatatactgttgactaaagcagagc

SEQ ID NO: 20303 - DNA, 201 bp, Homo sapiens
cattaacattgcccaacccctattatagttggtgttaataatctttgcctataggtttggaagtaccttggcttatataaccactattcagataaaacaargaaatgatgacatcagtgtaagattgaatgagatttgaccactgcacatgccatgctttgcaatagtctaaaaacctggacagaatgatcagaaccatct

SEQ ID NO: 20304 - DNA, 201 bp, Homo sapiens
tagtcccagctacttggaaggctgagacaggagaatggcttgaacccagaggcggaggttgcagtgagccaagatcacgccactgcacttcagcctgggtracacagcaagactctatctcaaaaaaagaaagagaaaagaaaagctagtcctgattgaataatacctttctaattatttcttggaattgttcattcttat

SEQ ID NO: 20305 - DNA, 201 bp, Homo sapiens
aaagtccaggatgccaatgaaggaaataagctctgaaccacgcaggtcacagtttctgttggttgtatttgtgtcagggagctgtcagactctgcagtttsaaatttaagttctcaatggactctgagcgcatatccttgatgtgtgattcacacctgtggtatcatcatggggtcattttattgaaatgttgaacttgtt

SEQ ID NO: 20306 - DNA, 201 bp, Homo sapiens
cttctagttggatctgaaaagctggtcctggccaggcgcagtggctcatgcctctaatccgagcactttgggaggccaaggtggtggatcacctgaggtckggagttcgagaccagcctgaccaatatggtgaaatgctgtctctactaaaaaagtacaaaaattagtcaggtgtgggggcatgcacctgtagtcccagct

SEQ ID NO: 20307 - DNA, 201 bp, Homo sapiens
aacctatatagagaaatagcctggtgttatcctacaagacaatttccttaaaatgtgtgagtaatggctattaaatcattttatggagccatttctaaaayaatactctttgtcactgttaccataattacttttagttgtggccatattttaaagaacagaatgctttatcgtgactgttataaatacaaattatttttc

SEQ ID NO: 20308 - DNA, 201 bp, Homo sapiens
ttcaccaggtttgctctgtcagcacttgcttcctgctttccccttcctggtatacagcagaagcacatcttgtttgcctccgctaacctttatgacagctrgtggatagttcagattttgaaaatttgcatagaaacagaggcagacatggaagacatttataaatacgtaatattaaaaatctcttttaagtctataata

SEQ ID NO: 20309 - DNA, 201 bp, Homo sapiens
aagtgctgggattatagctgtgagccactgcacccagccatcagcttttatttcatatgcatgcatagcatcctacaacaataactttaaaaaaaataagwcatcaccattttctatgattgcaacctatatagagaaatagcctggtgttatcctacaagacaatttccttaaaatgtgtgagtaatggctattaaatca

SEQ ID NO: 20310 - DNA, 201 bp, Homo sapiens
tttccgtaagagtcaggcaaaagttcccaacaaacttctaaatctataatcaatccaaaggaaattataaacaataggctttgtatagagagagtaggtgkatcatattaggcaataatcacatagttgatttcttactataaattatgatttatgtatcataaatagcatacaaatgtttgttaaatgaatgagatctta

SEQ ID NO: 20311 - DNA, 201 bp, Homo sapiens
tgttcatatcacatagaatcactgagaattcttctctgacattcacagggcccctaagtactgcttcacagactgaactgaagcaatattaatgggtctcytcctagataagcccaagcctcaagcatagccctgcgcctcagtcagccaatctagaaatagggcaagcttctaaagatgaaagggcacagtctctgcttt

SEQ ID NO: 20312 - DNA, 201 bp, Homo sapiens
ggagagattttccggtctttttttccccgtttggttcttagaaaattagagacagaacattccctcaataaattatcaaatgttaaacaaaagctttcaarttactttaaatggtttttgaaaatcttccagagtattcagagattttaaaacacatattaatgatcattaaataaaagagttgctttattaaatatatat

SEQ ID NO: 20313 - DNA, 201 bp, Homo sapiens
cattggttctactgatctgagcatatcccatcagggctcattcacatgcctacactcagctctgtattagcttgttggtttcatttgacttggaggggcartgatgtggctgggctctcagcagagaagaatgggctctgctccacatggtacctcatcctccaagaggctagcactgggtttttctcaggctagtccagt

SEQ ID NO: 20314 - DNA, 201 bp, Homo sapiens
gagagagttcagttttcctcagttccatggtcatcaggtacctgaacaaaactgatattttatcatcaaagaaatagaggggaaatagcaactgggtagamaggttacatacagtgtacgttacagccatgtttataacaattttttgtttcttcctttttggccccttggaaagagatctgaagtgtttctatgaatttt

SEQ ID NO: 20315 - DNA, 201 bp, Homo sapiens
taagattcactcacaaggctagagagagttcagttttcctcagttccatggtcatcaggtacctgaacaaaactgatattttatcatcaaagaaatagagsggaaatagcaactgggtagacaggttacatacagtgtacgttacagccatgtttataacaattttttgtttcttcctttttggccccttggaaagagatc

SEQ ID NO: 20316 - DNA, 201 bp, Homo sapiens
acaggcaattaatcatcagccactgcaagatgaaaaattcttcagaagtttgtgttaatggaggaattgctatttttgatcttctggttttttctatcccyggatgccttgggtaatctgagacaaagctcaagggaatgtaaccagccacccaaaatgaatgcactcaagtgagaagttgcagagctgtgacttggggca

SEQ ID NO: 20317 - DNA, 201 bp, Homo sapiens
cttcccttggtttaatgtagagggagggattaaatgacttagagacattgggatgttagagtgggtttgtcattcaagaatgactcactcacattgggagrgtcctggagacatacctttcaccataactgtgggaagtaagtttgtgagggagtcccagcatccttgaagagctctgtgacactctactctgtaggccag

SEQ ID NO: 20318 - DNA, 201 bp, Homo sapiens
gaccgtgaactcagtcatgagatggctgccctagctccacacatcataaccttacatgaaaccactcaaaggacgtgcagcaaatgtcttcattttgtaamcctttctaggattgagaaaaaccttcctacatcccccctagctggtgtttcctcattgggtacaatggcctcatattcccattcttaaaccaatcatggg

SEQ ID NO: 20319 - DNA, 201 bp, Homo sapiens
caggcaattaatcatcagccactgcaagatgaaaaattcttcagaagtttgtgttaatggaggaattgctatttttgatcttctggttttttctatccctrgatgccttgggtaatctgagacaaagctcaagggaatgtaaccagccacccaaaatgaatgcactcaagtgagaagttgcagagctgtgacttggggcag

SEQ ID NO: 20320 - DNA, 201 bp, Homo sapiens
agagggtatgtgggctcatcacgctctctcctttgcaaaacatgtgtgaacatttggtgagctcgctgtgagcttctggaaggaaatgtcatgccttgccrtaactttttatcactagcacctagcagagctgtttcacagggtgggcactccttaatcaacatttctgcaagttgaattgcaaaccactttgtaaaagga

SEQ ID NO: 20321 - DNA, 201 bp, Homo sapiens
gaactcaatgccaattccattgcatgtgtgggaggccaggtgccttgtcacactgggggtgttggagcagataaaggcaaacagaggagttaaaactgtaytctagaaggcactccaagagacgtcccagacaaataattggaaacaccagatgacttagaaatcaatttcattgccacaaaaatgacagcctcccttttt

SEQ ID NO: 20322 - DNA, 201 bp, Homo sapiens
gagtaaagtgtaaaatttttaaaaaaaatcagtaggtagaatattacactggaatcttaatagttcttgctgatagtgcccttaaggttaaaaaaaaaaaactcattaaattccaagagagaagatggttataaaaactgaatgaaaagatagaagttattccacaagcatttcttaaattagtttgttaagagccttaga

SEQ ID NO: 20323 - DNA, 201 bp, Homo sapiens
ggcaacaatgtgagaccctgtctctaaaaaaaaaaaagaaagaaagaaagaaaagaaaagaaattaatttaaaagtaaacaaattaaaaattaaatttatwaatgcaatgtacaccttggggcaatgggtagtagcagcaaggggacagaattaataaggatgtttattttagtgcttaatattagagattatttaatgca

SEQ ID NO: 20324 - DNA, 201 bp, Homo sapiens
tgttcaattcccatctatgaatgcacacgggaaggggaacatcacactctggggactgttgtggggtggggggagcggggagggatagcattaggagatayacctaatgctaaatgacgagttaatgggtgcagcacaccagcatggcacatgtatacatatgtaactaacctgcacattgtgcgcatgtacactaaaact

SEQ ID NO: 20325 - DNA, 201 bp, Homo sapiens
aatgctgaacttcccttggtttaatgtagagggagggattaaatgacttagagacattgggatgttagagtgggtttgtcattcaagaatgactcactcayattgggagagtcctggagacatacctttcaccataactgtgggaagtaagtttgtgagggagtcccagcatccttgaagagctctgtgacactctactct

SEQ ID NO: 20326 - DNA, 201 bp, Homo sapiens
aaggtgacgtacaaagtgcaactcatgaggatttatgctatactccaaataagtattaagtatttaaattttctaatttataatagaaaagtttggaaaaytgtgagggaatgcatattaagaacataggataatggtaggagaaacacaaattagatcaaaatgaatttattgatatggataaaggaagcagacagcatg

SEQ ID NO: 20327 - DNA, 201 bp, Homo sapiens
tccccatgtgtcttttttccctgcagtccaagattatttagccccatcctacaaggtcaagtattttatacaccagctaaggagtaaagtgtaaaattttwaaaaaaaatcagtaggtagaatattacactggaatcttaatagttcttgctgatagtgcccttaaggttaaaaaaaaaaaactcattaaattccaagaga

SEQ ID NO: 20328 - DNA, 201 bp, Homo sapiens
gtgtttcctgcatttctacaatgactctcttccaagggaatacagtcacaaaagtggactgggatcaactttactttacaatcttactttcttaccccaartatagataaactcacaataaggcttgtgtttttgatactcagacctggctatgcaaataaatatggggatgtatgaatacaacgggaagagtggctacag

SEQ ID NO: 20329 - DNA, 201 bp, Homo sapiens
gcaggatctcatcctgtgactggctgaaccaacacaatttgaaccctcagcctcacaaggtgtctactgttaaagtcagtgtattaactaggaaggaatgygttgctcaaagttggaatggagatcagcttcagccccgatgaagctgaggacattgagcccctaaattatgatgagggttctttgccagcagaagagccc

SEQ ID NO: 20330 - DNA, 201 bp, Homo sapiens
tcaggtcaggctgattaatgtttaattaaaagttcttggtttacttgtatgattacagcctcctcaccccaggatgaaagccttgtgctcccatttttctsatggtttcttttttatttaaccttttcaaccatcaaaatttaattttggtccatagtctcagtgagatcaatccttttttttcatcctaaacaatcatcc

SEQ ID NO: 20331 - DNA, 201 bp, Homo sapiens
atgtttcttggtttttgtatttctgcttttatgaattacatattcaggactatcgtcaattttcttgttgatttataacagcactttttatttaaagggtrtattgtcttttgtgaaacagagacaattcagtggatcaggtcaggctgattaatgtttaattaaaagttcttggtttacttgtatgattacagcctcctc

SEQ ID NO: 20332 - DNA, 201 bp, Homo sapiens
tattttgtaagtgtttcagaggaaaatattgctataaagcaactgatttagaaattgaaatgagaaatgtcccaagaggtgaatagttgtaatatttattyaaaagtaatgttgcctatcctgctcctgataaccactatttcattctctatctctgtacatttgactgtttccttctaggattccgcatataagtgaatc

SEQ ID NO: 20333 - DNA, 201 bp, Homo sapiens
ggctgaaaaaagtttatagagctagctagaaacagccaagacttggtgaggcctcttttcactcctataaccccagtatttcaatctagaatgacccttgmtttttgtagataaaaaagtcacctaatcaggtaatatttttaaaatagtcaaaaaaggctaacattatcaagatgacaatttgaaatgtggtttcaaact

SEQ ID NO: 20334 - DNA, 201 bp, Homo sapiens
gtcactgcatgaccacctgaatgtcaattttctcacctgttcaatggagataaaaatatctcttacctcatgaaactgtaaggaggaacaacaagataatrcacctaaaatattgtttttaatgaaagcctttttctgtacaatacctgaattgactaggaaatctatatgcacttcaaatataaacaagtattacagttt

SEQ ID NO: 20335 - DNA, 201 bp, Homo sapiens
cagaatgaacacagctgaagtcttgtgctatttgttcatttggttttttaataaggagaaagatgcataaaatggcttaagtatatagcctggggcggatraatagtttcaggtatcatatacaatgctgggcggggtagtctggcctatagaacaaaaaactggtcttggaataaaggaagcgtagatttcaaggttgcc

SEQ ID NO: 20336 - DNA, 201 bp, Homo sapiens
gaaaatgtggcacatatataccatgaaatactatgcagccataaaaaaggatgagttcatgtcctttgcagggacatggatgaagctggaagccgtcattytcagcaaactaacacaagaacagaaaaccaaacaccacatgttctcactcataagtgggagttgaacaatgagaacacacggacacaggaaggggaacat

SEQ ID NO: 20337 - DNA, 201 bp, Homo sapiens
acgtattagattcttctgagctattgagcagtatcagatccttcagcaagaaagctgttttatcatttactaagtacctaggcacagcatcaccttgcccrttaaaagccctgtcaggtacacatttgggttgctaggcagctgctggggaagcaatctcttccacacatatggtttatgccacctggcctgcatttcaca

SEQ ID NO: 20338 - DNA, 201 bp, Homo sapiens
agtttttgactaaagttttcggcaagatagatatagttgagtcatggtcaaggtgaaaagggtattcactcaacaagaaaaccatccatcaaagatttccyatgtgccctttgttacggctgtgcagctaagtacaacacagttccaggctttacagttcttagagtgtttacagacaaataagtaagatgctcaatatga

SEQ ID NO: 20339 - DNA, 201 bp, Homo sapiens
gttttatcccctcacggcatttatcaccttctctcataaaaaatttatttatttattatgttttatgttgtttgcctactttctgtctatacccaccccckgcccagataccctcaaacaagaaagtaaaacccaccaagatgaagttctttggtttgttcaccagtggatttcaaacacataatagatggcaataaatgc

SEQ ID NO: 20340 - DNA, 201 bp, Homo sapiens
tataatagtccttaattaccattttgggggggaattcttttgtatagtaattgttctcccccaactagagtttatgtgccttctctgtccttctctgtccytcacctgaataatataatgctgaccatcatggagtaagcactgaacttataaatcatttgaattggttttttgatctgaaattcacagctgatgaaagca

SEQ ID NO: 20341 - DNA, 201 bp, Homo sapiens
ttcaccatggtgtaggtactgtctttattcccattttacagatggggaagttgaagcactgagaaattgtcatggtggtattatcatgaaaataacattaagattgatgaaatgtatatattaactaattttgactcacaggttaatccttctgcccttccctgatcctatcccagatggcttttggaatgctttccaata

SEQ ID NO: 20342 - DNA, 201 bp, Homo sapiens
tgtacaatcatgatttatgtataggttgaactaggggcatcgccatttaagaacgattaagacaaatcaaggcatttctgaaagagaacagattgattttstttcttaaagtatttatagcttgtaaggcagctgtctgcttttgtatattcttaaacaagcatcatagaccttattcaataatttaagtgttttctttag

SEQ ID NO: 20343 - DNA, 201 bp, Homo sapiens
tgtaaaaaatcttcaatggatgaggtgggtacttagggcttctggtccctaaggcattccaccaccctgtactctcctgggtctgtctcatggtcactttstgccatctagtggcaaaaagtagatttgtgccttccaattgccagcttcaatttttgaggcaattaaatggcttatgaaatgttccacaatccggagaag

SEQ ID NO: 20344 - DNA, 201 bp, Homo sapiens
agtgttgagttaggaggcgagactcaactctggtggtggggtatgaacaccggaccaaattaaggaccagctaaaacagggggagcggaagcagctttccmtaagatatgtccatgtcagtttaccattgccagggcaacaccgaggaattaccaccgctttccacggtaatgatccaatgacccaaaaattgccactcct

SEQ ID NO: 20345 - DNA, 201 bp, Homo sapiens
caaggttattttgcaaatcaccgctttgcatggtacaaccttcggagtttctagaaattgcctggagtgataaaccagagtatattcaacaataggatttmctagaattagtgggagaggtgtaattaagttactgtgtaatatatttcccccaaatgataaatatcaatatgtgaacactgaatatgtgctcctatgaag

SEQ ID NO: 20346 - DNA, 201 bp, Homo sapiens
catagaaatttctgtattaaccaccccttaatctacatgtgattaaaagtaagtataaatacaacctcaaaactgcctgagctgctactctgagcacactrcctatggagtagccctgctctgcgggaacaggcatggagctgtaacactgctgcctcagtaaagttattttcttctaccctaccactggctcgtccttga

SEQ ID NO: 20347 - DNA, 201 bp, Homo sapiens
ataatcaggcataccagtagatctcagactgtgttcccatttgattaccattgttttgctgcttaaatccaaaatatgccaattttaaaaataattttcasaattagtacattgcatttcatcaatcttaagttttcctctaataaatcatttgaaatacttgggtatctcacagaggatcccgtgttacctggtttggca

SEQ ID NO: 20348 - DNA, 201 bp, Homo sapiens
cccgtgttacctggtttggcacacaatcattacattgattttcctgaagttgaatctagtaatttttgggtgtctcacataagcatgtaactttcagactytctctccctaaaaaaggagtgtcacaagaacatattctaaatcagtctatctggatgtgaaaataggactcttcttgtgttcacagtggccaaggaataa

SEQ ID NO: 20349 - DNA, 201 bp, Homo sapiens
caaggtagaaaaggagatgtctaactaagctatttagggaaacataccttaaggctattaaactctttccttcctataagattccagctttgcggttgatsttgagccttatgaagagaagctttaacgtgaaatgaacgtgatctttccatgagccattaatggttgaccaggggatctgggagagtataactagaaaat

SEQ ID NO: 20350 - DNA, 201 bp, Homo sapiens
aggtagaaaaggagatgtctaactaagctatttagggaaacataccttaaggctattaaactctttccttcctataagattccagctttgcggttgatctygagccttatgaagagaagctttaacgtgaaatgaacgtgatctttccatgagccattaatggttgaccaggggatctgggagagtataactagaaaattt

SEQ ID NO: 20351 - DNA, 201 bp, Homo sapiens
tgggagagtataactagaaaatttatggagacttttatctaggagcccaagaataaccaacccacctaatttattgaaggtgacagtggggtagagtgcaygatatctcctgagtcttgcctatttggttacctgttatcctaaaacaattgaaaggacaaaaacataataaatgctgaatcctgacaaatgaagacagaa

SEQ ID NO: 20352 - DNA, 201 bp, Homo sapiens
tagagacggggtttcaccatgttggtcaggctggtctcgaactcctgacctcaggtgatccacctgccttggcctcccaaagtgctaggattacaggtgtragccattgcacccggcctttcttcccttcttaacacaaggaaatacccaaatattagagggatgcagcagtggggaatgtataatccatggtgtctttgt

SEQ ID NO: 20353 - DNA, 201 bp, Homo sapiens
gacctaatctaaacctaattacctcacaaaggccccacctctaaatataatcacattggggattaagggcttcaacaaatgaatttgggggaacacataarcattcctaatgcaggacaggcaacatttcagctctgccactgactgcccaaataatcctggacaacttacttaacctctctaagcctcagttttgtcatc

SEQ ID NO: 20354 - DNA, 201 bp, Homo sapiens
ggcatagcttattgctcctaggtacaaacttgtacagcatattactgtgctgaatactgtaagcaattgtaacataatggtaagtattcatgtatctaaaygtatgtaaacatagaaaaggtacattgaaaatacgatataaaagataaaagaacaatggacctgtataaaacacttaccatgaatggagctcctaggcct

SEQ ID NO: 20355 - DNA, 201 bp, Homo sapiens
ttctctatcttgcgtttctatccagatgccaatatgaactaaaatagagcttcttgttagtcagcttcttgtccttgaggggcctggaggctacaaaaaaatgagaagtagccattcatcttgatatctggaactcttgccctgggaggctgtcaaagaaagaaaattctggaaagaagaggagaagttactattttttgt

SEQ ID NO: 20356 - DNA, 201 bp, Homo sapiens
cttcacgaagccttagtaggaaaaaggaaagagctgggctgtttgctctgggtccttttatgtgctgacatggatgcatttgaaggatttgaaatgtgctkcagtttgaaacttgggttccttttactgtttattcttttttgtgttttcacccattggtacccttgattgatagtgtttaagtcaggggacaagccgggg

SEQ ID NO: 20357 - DNA, 201 bp, Homo sapiens
tttgcttgtaccagcaataccataaacgcatgagtgatgtgttgctctgcaacgttatggcagccatgacatcactaggttataggaattttttcagctcygttataatcttatgggaccactatcatataggcagtctctcatggactgaaatgtcattatggggcacatgactgtgtgtgtgtatgtaggtacacacac

SEQ ID NO: 20358 - DNA, 201 bp, Homo sapiens
ccacaagcgaatggcgaagtaccatttaagacttgccaatgggtgggggaggcatttactatccaaataattatatcactgatcatgtctaactgaacacrtttttggctagaagggaacttggataaaatataaaaacagagctttcacaggcatttttgttatttcatttatgctttgaaaaaaatattttggggcacc

SEQ ID NO: 20359 - DNA, 201 bp, Homo sapiens
catttttggctagaagggaacttggataaaatataaaaacagagctttcacaggcatttttgttatttcatttatgctttgaaaaaaatattttggggcayctactattatgggtagctaactgcatctcaaatttatatcttaatgtgttcttgtcctttaatttttattctgcaacatatgaacttcagtaatttctaa

SEQ ID NO: 20360 - DNA, 201 bp, Homo sapiens
catggaggctattaattggggtgctaatgaaaccaatctaccacagatggcatggatccactgcatatggaagccaccacctttcaggaagacctccccamctggacttttaaaatagcctttctctccagatgccctacctatcatctcatctgcctgttaagaatgggtacatctgggccgggtgcagtggctcacgcc

SEQ ID NO: 20361 - DNA, 201 bp, Homo sapiens
tgctcaacttgattctctgtattctcatatgcaaaatggtaataataattactattgcaagggattttgttgagaattaagttaaatgagataatgcatgycaaaggagtttcaagggctacagatatgctatttttacttgtagactgtattttcttataactcagagctttagaaacccgatgcaactacctaatgcca

SEQ ID NO: 20362 - DNA, 201 bp, Homo sapiens
aattaagttaaatgagataatgcatgtcaaaggagtttcaagggctacagatatgctatttttacttgtagactgtattttcttataactcagagctttaraaacccgatgcaactacctaatgccagtaaaatggagtcgtaaagtaataaagaaaactgattgtcttgtttcctattttttttgaaaactgattttgtt

SEQ ID NO: 20363 - DNA, 201 bp, Homo sapiens
aaaatggagtcgtaaagtaataaagaaaactgattgtcttgtttcctattttttttgaaaactgattttgttgcttactgtttttatcatttggtcaaaaytgaaacgtaagttttgtatctctatccagatacaaagacagatttttggctttcgttacaacagcacagtaagatacaaaaatgttcacttcattttaat

SEQ ID NO: 20364 - DNA, 201 bp, Homo sapiens
ataaatgggaatgcaaatctccaagactgttgatactggacaaggtttggggaattttggacagagattttcatatatgttacagcatcttcagttaatgmggagaaactatatgtgcttagattgatagataagtagattgattaatcagtcaatatactgattaatctgaaaaaaataggaatcacattcttcaaagaa

SEQ ID NO: 20365 - DNA, 201 bp, Homo sapiens
ttagtcctttcatatagtagtccattggtcattttataaggaatccaagaagcatagcataagagaaaaggataaattttcatcctggcacagtggctcaygcctgtgatcccagcactttgggaggccaaggcaggcagatcacctgaggtcaggagttcgagaccagcctggccagcatggctaaaccccgtctctaca

SEQ ID NO: 20366 - DNA, 201 bp, Homo sapiens
tcacccaggctggagtgcagtgtcgtgatctcagctcactgcagcctcctgagctcaagggattctctgacctcagcctctcaagtaactgggattacagrcacctgctaccacatctgggtaatcttgtatttttggtagagatggggtttcaccatgttggacgggctggtctcgaactgctgacctcaggtgatctgc

SEQ ID NO: 20367 - DNA, 201 bp, Homo sapiens
cgcaaagtaaacggcaagaaaaactcgtagagaaacacaaggaaatacgtcagcagatcctggatgaaaagcccaaggtaaacggaactgaattaaaatgmacaattattttatttgatttccatttagtaagagtaaaaccttcctggtttacataagtaccttgtacacagtctcagatcagttcttgcatatgaaact

SEQ ID NO: 20368 - DNA, 201 bp, Homo sapiens
cacctcctgagtttaaggatttgcctgtttctcctgcctcagactcacaaatatctgggacaacaggcacatgccaccacgccaggctactttttttttttattgtattttcagtagagacggggtttcaccatgttggtcaggctggtctcgaactcctgacctcaggtgatccacctgccttggcctcccaaagtgcta

SEQ ID NO: 20369 - DNA, 201 bp, Homo sapiens
atatttatcagataaacaaagtgactccaataagctagctgcaaccaccgcaactgtcatctacaacttaaccagttttatttttttacagcacttatccytctttaagatgatcttattttgaataatttatttgcatgtcattgtcagttgcccacccacctacttcataagccccaagacataagggactgatctgtt

SEQ ID NO: 20370 - DNA, 201 bp, Homo sapiens
ccctcaaactcctagactcaagcaatcttatagcctcagcctccttatcagctgggactacaggcacacaccgtagcacccagcattttttttttttttttctgttagagacaaggtctttccatagtgcccagactggtctcaaactcctgggctcaagcaattctcccctcctgagcctcccgaaatgctgggattaca

SEQ ID NO: 20371 - DNA, 201 bp, Homo sapiens
catatccaaatttttcatctaatattttaatatttaactttttaatccaacaggattttatgttgaattttttgtgataagagagatttaaaggaatgtaytttcctcagaaaacaagacaaattctacagtggtgtctattaaatatttcctacctattcatgtgtgactctttactctatatcccaaaacaatctcacc

SEQ ID NO: 20372 - DNA, 201 bp, Homo sapiens
tgctaaaccaaagaacttctctatctgaggtgtaactgtctattatatttcttccactgacttaggctagttgcagaggaccctccaatcggtacattggraattcttggctgaacttgaaggctgtgttttaggtctgcccttctctatcttgcgtttctatccagatgccaatatgaactaaaatagagcttcttgtta

SEQ ID NO: 20373 - DNA, 201 bp, Homo sapiens
ggaatcttgaacgagcatgactcaatgggagactgttccactgtcagtttctcttccagcctcccatgactccaaaccattaggctgcagttttgacagtrtttcccaatggcttgaaagtaactaatgagtgagtgccagtgcctaatagaggtggatgatggcagttataatttctcaaagatcatttgattcatcttt

SEQ ID NO: 20374 - DNA, 201 bp, Homo sapiens
cttgaacgagcatgactcaatgggagactgttccactgtcagtttctcttccagcctcccatgactccaaaccattaggctgcagttttgacagtgtttcycaatggcttgaaagtaactaatgagtgagtgccagtgcctaatagaggtggatgatggcagttataatttctcaaagatcatttgattcatcttttgtaa

SEQ ID NO: 20375 - DNA, 201 bp, Homo sapiens
tcatttttatccaagggcactgtatttcattctgtctatacccactcctgtgtttattttttttgggttgtgtgacaatattatgttcctggaaaagcaamtaagaaaaaattgaaaaaataaatgttttcagtgggccaataagatggttacttttgtgcatatttttgtggtctgatgttcaaataatacaatagtcag

SEQ ID NO: 20376 - DNA, 201 bp, Homo sapiens
aactgcacgttgtacacatgcaccctaaaacttaaagtataataataataaaattttttaaaaaaagaaagaaagtgtttagcacgaggttttgggtgaakaagatgagacatgtgaggtccgggggcatggcattttggctgcctagatatcccaggatttaggggaatgcataactttctcactaagtatatgatgaat

SEQ ID NO: 20377 - DNA, 201 bp, Homo sapiens
gattattgaatctagtgttacaagtctctgaaaaacaattttggcttgataaagagcaatggagcattaccgtactttcacatccaatgtccaccaattayagcaagtatgaaagaatgtaacttaaaagctataactggttttctcatcctaactgatcacgcacaccatacaaaatatttcaaaggcacaaaagcatga

SEQ ID NO: 20378 - DNA, 201 bp, Homo sapiens
ggcagcttacttcatctgtcagaggaaaggaagtagctgttactgaccagacgacatgtgttgaattgtttgaggctgtaccgcatgtcaagctttgacasaactgacataaaaaatatacctcacattgtgttagaattgaagagaacagctcttgttcattagaaggtgaggctcttcaaagaagcttcctgatgcagc

SEQ ID NO: 20379 - DNA, 201 bp, Homo sapiens
atgaggttttcagtttggcaacaaacctgctggcccaaaacatgtccagggatgcatttctggaaaaagcgtaagtcactctaattttattgctaagggckttgcttcttctgagtcagtttcctttctcctttgtgagtcttccgtttatgccatactgacttctcacattgataaacacaaattttcctttgggattta

SEQ ID NO: 20380 - DNA, 201 bp, Homo sapiens
caacagggtgggactagatcaggcagacagatctcagagggcatttttttttagcactgcctagagccttggttattaggaagccgagaatcttgcagagstcccaggcctcaggggctctgaacaagcaacagagagttctgtgatttcttcttcattctaagtaatatttcttccaataacaccatggtgtttactaaa

SEQ ID NO: 20381 - DNA, 201 bp, Homo sapiens
tttaaaaggatttctgagcccgatctttacacacatgctttagtttgtactgtctttctgtacatcctcagttaagagatgctttctggagtgttttgtaratggatttgaagacttctcactgcttcagtacagaatgccctggcaatgcacgcctggaaggagtccatggactgatattttctagccaaagggagctaa

SEQ ID NO: 20382 - DNA, 201 bp, Homo sapiens
atcttacctcaccaatgctagatcctacaggtaacagaagcacagtataccagaatgatcacatccaatagcccctggctggctccaggtgtcatgaagtracctctgattttgttactgcccctgagtggtggccagaagttacattatgtcagtttacagtgtggcagcccccatatccattggggacatgagtgtcag

SEQ ID NO: 20383 - DNA, 201 bp, Homo sapiens
ttccttagtaatgttttaaggtctttatcatatagatcttacagttaaagttaagcttccgctgagtgttacatcactttgatgttttaagtggagctttyatttacatttctaaccaccttttattaaataaaaggaaactaatttttgacataatattatgtatccatgtacttcaccgaatcttttaaaaaatagttt

SEQ ID NO: 20384 - DNA, 201 bp, Homo sapiens
caaatgtaagccatagatctgaaaagctttcggtattttctgaaaacgtgcacttttaaatgtttagatgaaagtaatgtttcttgtaactttcttatagytagaagaagcgcaaagtaaacggcaagaaaaactcgtagagaaacacaaggaaatacgtcagcagatcctggatgaaaagcccaaggtaaacggaactga

SEQ ID NO: 20385 - DNA, 201 bp, Homo sapiens
gatttatatatttatagttacgttcagttttagagattaaaatgctctattgcttttatcaattttacatttggaaagtataaaatattcctttgcctcarcattcaaaattatataaagaagaatgctcagggaagtcactctcatccatatccttccaccctattcctacccaccttctggttttccttaccatgtttc

SEQ ID NO: 20386 - DNA, 201 bp, Homo sapiens
atatgatttgctggaacttggattcaaacctgtctgtccttagagtccatgcttttgtgagactccacctctggctgttcctgaggagttcctagttaagygggaatgggggtgggcaagccagtgatgacagggttaggtggatactggaatattcaggaagtgccagaaagtacagaggatgaaaggcttgacttcacc

SEQ ID NO: 20387 - DNA, 201 bp, Homo sapiens
ttcaaccaacagactcagaagttgctcttgccaaaacgaagaaaggaaaacctgggtattggaaaacagcctctgccatagaaggcctctaccatagaagscttgttagcggcctcttccatagaaggcctgttcatcatagctcagttcagaatatcagggtcttcctaaatttatgtcatgataattctaatttctaat

SEQ ID NO: 20388 - DNA, 201 bp, Homo sapiens
tttaacccaggcagtcagattgcatataaacactcaagaagctgcattttatagccgtagaagagccatgctgcattgataaaatgtgctccttagcaggygctcaaatgttacaccagctcactggcttgagtaatcagtcctcctttcactggttcagttgcatcagacgagtgttcatttttcacacccagcaaccac

SEQ ID NO: 20389 - DNA, 201 bp, Homo sapiens
attctgtggattttttgtgtttgcttcatatggcttaatatcacttcactctgcagaattatggaatgtaaggtaatacacatcaaagcagcataggtaaracaattggatcgagaattagcaaatgtaggatttaggcttatgtgtcccatttaaccatggacttttctggacttttgtctcctcatctgtaaaacaagt

SEQ ID NO: 20390 - DNA, 201 bp, Homo sapiens
tagtttattggtcaagtaaataactggtttccagagaaaaataaaacactcaagttaatattcaactctaattcatgccattccagttttaattccagtcrcttcttgacaaagaattggtgaaccttttgacagccgtgacttagagaaatgttgctatcctgaaacaggtccaaattctttcttctgtggtcattctgg

SEQ ID NO: 20391 - DNA, 201 bp, Homo sapiens
gctcctgcaatgtcttccttcaagcatgatgcacattataattattctgttctgcttcaggaatgcatatcaagttctatgcaattaatgccattacaagrcaaatacagagctcttcttggcatctccaggacatctgtaacgctgcagaagcaaagcattgtagtaatttatgtgacttaggaacttcttttttctatg

SEQ ID NO: 20392 - DNA, 201 bp, Homo sapiens
gtccatactatactataggaagtaggaaaatcttcaggacaatcaatctggtttagtcaacaaataaattccaagaaaaaaataagacagaaggggaaacratagtttagaacacatacagctcatcttaaacaattccaatgtatggctttcatttagattgggatttttaaaattatggcacttgtgagataatttgaa

SEQ ID NO: 20393 - DNA, 201 bp, Homo sapiens
cacctatatacgtacatgtttttaattatgcgtatatatttaagaatagttttacaaaaatgggattatggcccatgtattttccttaaactgggaatcamatttggatttcatataataaagacattctatgaattgggagtatctaggattctcagtgggatagtattaccagtggaacagactgcctcatgagtagca

SEQ ID NO: 20394 - DNA, 201 bp, Homo sapiens
ccatttttatagtttataaaatactagtgatagtccttctccttcatataacttccttcaagagttgagaatatgaatctaagaaaactttgagttctgcrtataatatatgtgccttacagagcttctcatgtcatgcatcacaactacagggtcacttcatgtcagtgtgcattgtctaagtattgtgatctacaattt

SEQ ID NO: 20395 - DNA, 201 bp, Homo sapiens
aatggacaaatgaggttttcagtttggcaacaaacctgctggcccaaaacatgtccagggatgcatttctggaaaaagcgtaagtcactctaattttattrctaagggcgttgcttcttctgagtcagtttcctttctcctttgtgagtcttccgtttatgccatactgacttctcacattgataaacacaaattttcctt

SEQ ID NO: 20396 - DNA, 201 bp, Homo sapiens
accagtaggggataattcagatgaacaccttcgtgcttggaatatgagcacttagacttctagattttaaaaggatttctgagcccgatctttacacacakgctttagtttgtactgtctttctgtacatcctcagttaagagatgctttctggagtgttttgtagatggatttgaagacttctcactgcttcagtacaga

SEQ ID NO: 20397 - DNA, 201 bp, Homo sapiens
ctgcccattgaccagtaggggataattcagatgaacaccttcgtgcttggaatatgagcacttagacttctagattttaaaaggatttctgagcccgatcyttacacacatgctttagtttgtactgtctttctgtacatcctcagttaagagatgctttctggagtgttttgtagatggatttgaagacttctcactgct

SEQ ID NO: 20398 - DNA, 201 bp, Homo sapiens
taaaacacatattaatgatcattaaataaaagagttgctttattaaatatatatgtatatatacaagtatgtcataaatatataaaaatcatagatatatwcacatacatatgtatatctgaccctaaacaattctaaatttttttagtctttgaaattgattttatatcagatataattttttagctaccagaaaatatt

SEQ ID NO: 20399 - DNA, 201 bp, Homo sapiens
ggtttttgaaaatcttccagagtattcagagattttaaaacacatattaatgatcattaaataaaagagttgctttattaaatatatatgtatatatacawgtatgtcataaatatataaaaatcatagatatatacacatacatatgtatatctgaccctaaacaattctaaatttttttagtctttgaaattgatttta

SEQ ID NO: 20400 - DNA, 201 bp, Homo sapiens
cattagggtaaatggggtatccatcacctcaagcatttatcctttccttgtgttagaaacaatccaattatactcttctaattatttttaaatgcacaataagttaattgactgtactcaccctgttgtgctatcaaacactagatcttattcattctgtctaactacatttttgctcgtattaatcatcctcactccctc

SEQ ID NO: 20401 - DNA, 201 bp, Homo sapiens
actgccatcagtctattactgctgcttaaattcacagcaccgtggacaagaggagaaggtagcctagctgtttcattggcccccgcatctctctgccacaygatggacagccatatcagattgcattagaatgttgactgcatgttaactggtgatccttcttcctctcaatacttattttaaaatcactctaaacgccct

SEQ ID NO: 20402 - DNA, 201 bp, Homo sapiens
cccttgattttcagacatagccattagaagcacactgatcttcacaggtggaggcctccactgccatcagtctattactgctgcttaaattcacagcaccstggacaagaggagaaggtagcctagctgtttcattggcccccgcatctctctgccacatgatggacagccatatcagattgcattagaatgttgactgca

SEQ ID NO: 20403 - DNA, 201 bp, Homo sapiens
aattgtagtaaaatctctctgaaggctggcatcagtatgtctgggcaggatgtatattctagcccagattttgcatagatgtcacaaggagtccagaatcycttgattttcagacatagccattagaagcacactgatcttcacaggtggaggcctccactgccatcagtctattactgctgcttaaattcacagcaccgt

SEQ ID NO: 20404 - DNA, 201 bp, Homo sapiens
acagatctacctagaattgaacttaattgcacaatattgtatttcctttgccaattaacccaatggaggtttgaagtaatatatttgaaaaatgctttgtmatctgaaaagcaccaggcacttgttaatcgttgtcattactatattggaaaaactacctgtggccacttgcaatggagaaaaaagtcttaacactgagca

SEQ ID NO: 20405 - DNA, 201 bp, Homo sapiens
taagaaggcaatgattagtatttgaaccacaaggaacaggagaagtgaggggtcaatgtggtcagacttactaaggagtacttaaaggccactgcaaaacyaggcacctgatcctctaattgagaggggaagtttgcaagggaaaggtgtttgatatatggcaagttgaaagggtggagaggctgagcgccagaggtgagc

SEQ ID NO: 20406 - DNA, 201 bp, Homo sapiens
aagtgattctctcacctcagcctcccacagaatactggaattacagatgtgcaccaccacgccccactaatttttttttgtatttatttatttatctattwgtagagacaaggttcatgttgctcaggctgaactctccacttgtttttcagtttttaattttttaattggcatataataattgtacatatttatgaggta

SEQ ID NO: 20407 - DNA, 201 bp, Homo sapiens
ggcttaagtgattctctcacctcagcctcccacagaatactggaattacagatgtgcaccaccacgccccactaatttttttttgtatttatttatttatytatttgtagagacaaggttcatgttgctcaggctgaactctccacttgtttttcagtttttaattttttaattggcatataataattgtacatatttatg

SEQ ID NO: 20408 - DNA, 201 bp, Homo sapiens
tgtacttcctacatatgattggttttccaactctctaattccccttaattgataattctagtgaaataccctcctgggaacggacctaggaattcctgccyaggcctctgcctttccaaggctcatcctcaaaccgttactctgagacaattgtaatgaaacaagcaccatttatacggcaaactttaaagctcctgctag

SEQ ID NO: 20409 - DNA, 201 bp, Homo sapiens
tgtcacctgtacttcattgtttcactgtcaccagaattatcctttaaaattctaaaaataattactttgtacatgttttaaaaactgctaacgattctcartggatcatttagtatacttccaggcttcttggcatgctgtaacacacagttaggtataagcagccctaagaagtttttcagaggcctgcccctctggtta

SEQ ID NO: 20410 - DNA, 201 bp, Homo sapiens
attttcccatttcatgcgcaagttctaggcttctcatggtgttccaccctttgtggcttcagccttcctttccagcttcacctcccagtactgcagcccayctgctccagcgattccctgaaaaagtcacgtcccctgtagtatatctgctcccggtgctcaccccaacaggattaagcccacacttgtaggcctaaccag

SEQ ID NO: 20411 - DNA, 201 bp, Homo sapiens
acacacttataaagcaattaccttttgaaagccattctgaaaacccttcaagaattctgttaatcactggtttggattttcagaattgtattgtaaatcarttcattctagtatgcctcaaatggacggccataaaaacatatacatttaactcatatcatctgatagtacaaatgataaatgatacattttaattataac

SEQ ID NO: 20412 - DNA, 201 bp, Homo sapiens
ggtgttccaccctttgtggcttcagccttcctttccagcttcacctcccagtactgcagcccacctgctccagcgattccctgaaaaagtcacgtcccctstagtatatctgctcccggtgctcaccccaacaggattaagcccacacttgtaggcctaaccagatcctaaactcaatcttgttgagcccaatgaaaatca

SEQ ID NO: 20413 - DNA, 201 bp, Homo sapiens
caggattaagcccacacttgtaggcctaaccagatcctaaactcaatcttgttgagcccaatgaaaatcaggtggtgtaactcacaaaggcaattgacttkaactcctctaggttttgcttttgtctggttttcaaaggaaagtgcatgagggagcagggaagtgtttgctgcaagcaaatgtttgaacgttcaggacagt

SEQ ID NO: 20414 - DNA, 201 bp, Homo sapiens
ggtggtgtaactcacaaaggcaattgactttaactcctctaggttttgcttttgtctggttttcaaaggaaagtgcatgagggagcagggaagtgtttgcygcaagcaaatgtttgaacgttcaggacagttaaaagaagaaaagatataagcattggtgaaagtgagcacaatagatgcaaatttggcacgctgaaagga

SEQ ID NO: 20415 - DNA, 201 bp, Homo sapiens
gcatgagggagcagggaagtgtttgctgcaagcaaatgtttgaacgttcaggacagttaaaagaagaaaagatataagcattggtgaaagtgagcacaatwgatgcaaatttggcacgctgaaaggaatttttgccccttaatgatctgtgttttctttatgcagcataacccgaggcaattaaaggcaggaaactactct

SEQ ID NO: 20416 - DNA, 201 bp, Homo sapiens
ggagcagggaagtgtttgctgcaagcaaatgtttgaacgttcaggacagttaaaagaagaaaagatataagcattggtgaaagtgagcacaatagatgcaratttggcacgctgaaaggaatttttgccccttaatgatctgtgttttctttatgcagcataacccgaggcaattaaaggcaggaaactactctaaccaac

SEQ ID NO: 20417 - DNA, 201 bp, Homo sapiens
tgctgcagtttgaaacttgggttccttttactgtttattcttttttgtgttttcacccattggtacccttgattgatagtgtttaagtcaggggacaagcygggggtttagaacattgatgtcctcagcgaatgaccctaagcttaaaagggagcccaaactcatcaggcctcgtgtttaaaaatagtttatttttgatga

SEQ ID NO: 20418 - DNA, 201 bp, Homo sapiens
ggcacaaatgcaagttcccagttcccatctcctcagtgtgtgcccgctgacctccctgcaacagttctgcccattgaccagtaggggataattcagatgarcaccttcgtgcttggaatatgagcacttagacttctagattttaaaaggatttctgagcccgatctttacacacatgctttagtttgtactgtctttctg

SEQ ID NO: 20419 - DNA, 201 bp, Homo sapiens
tggcacatgtatacatatgtaactaacctgcacattgtgcgcatgtacactaaaacttaaagtataataataataataataataataataataataataataataaaagttttggtagggtcgggcgcagtgactcacgcctgtaatcccagcactttgggaggccgaggcaggtggatcacgaggtcaggagatcgagac

SEQ ID NO: 20420 - DNA, 201 bp, Homo sapiens
aaggggtccgtgtgttctcattgttcaattcccatctatgaatgcacacgggaaggggaacatcacactctggggactgttgtggggtggggggagcgggragggatagcattaggagatacacctaatgctaaatgacgagttaatgggtgcagcacaccagcatggcacatgtatacatatgtaactaacctgcacatt

SEQ ID NO: 20421 - DNA, 201 bp, Homo sapiens
ctttttatttatattatatttttaacagattgtttctggatatttatatttgtatatttgtttattttataaatgattgtattttacaaatgatcatcttyctaaactcttataatagcctattttttgcagtacattccgttggaatttttagacacacaaagacagtaatttaatcatatctcatttctccacctgcct

SEQ ID NO: 20422 - DNA, 201 bp, Homo sapiens; identical to SEQ ID NO: 3320

SEQ ID NO: 20423 - DNA, 201 bp, Homo sapiens; identical to SEQ ID NO: 3322

SEQ ID NO: 20424 - DNA, 201 bp, Homo sapiens; identical to SEQ ID NO: 3323

SEQ ID NO: 20425 - DNA, 201 bp, Homo sapiens; identical to SEQ ID NO: 3325

SEQ ID NO: 20426 - DNA, 201 bp, Homo sapiens
tgggcacctaggttgattgaatgtctttgctattgtgaatagtgctatgataaacatacaagtgcatgtcacacactttttgatgtgaaaaaaaaaaaaaaacaagtcatttaaactagatccataatctgttatctgagattcttggggcctgttgtttttcagaattttaacttttctgattttagaaaggcaatgtga

SEQ ID NO: 20427 - DNA, 201 bp, Homo sapiens
atgggcacctaggttgattgaatgtctttgctattgtgaatagtgctatgataaacatacaagtgcatgtcacacactttttgatgtgaaaaaaaaaaaaaaacaagtcatttaaactagatccataatctgttatctgagattcttggggcctgttgtttttcagaattttaacttttctgattttagaaaggcaatgtg

SEQ ID NO: 20428 - DNA, 201 bp, Homo sapiens
ggcacattctcctagacagaagcaaataacaagcaaataacaatcctaagattgttattggcttcatattttatattacaaagtggtatatatactatacrtagtatatataatatacataatataaatattaatatatgtaatacattatattaatttattatgtttatattataaaatatttatataacatataaaata

SEQ ID NO: 20429 - DNA, 201 bp, Homo sapiens
ccagagcacaggatcttcaaagacttagaacatcttttggtatttcaaatacaatagtaactttctgtttgacaaacgtctttgggttattatcttgattwtttttttttattatactttaagttttagggtacatgtgcacaacatgcaggttatttatcatttttgtacaatcaaaatttgtttcctaattcacaatca

SEQ ID NO: 20430 - DNA, 201 bp, Homo sapiens
gctcacagaactcagaaaatccactttacttacatttagatttacagtttatcaagaaggatacagatcaacagccagatgaagaggtatatagggtatcrtagtctgctttgtgctgctataacaaaatgcctgagactggcaatttatacgaacagaaatctattttctcacagttctggaggtttgaaagtccaaaat

SEQ ID NO: 20431 - DNA, 201 bp, Homo sapiens
agtctttataattgaaagcacccatcatactttgtgcatggacttctattcacagaatgaatttagcaaagctattgggcaatataaaattttaggataggaaaacatagctcaaatgctatggtcattgtggatctcagactgagtacaaggctgcaatattcactcctgaagctagaaacaaacctcaatctgaaacca

SEQ ID NO: 20432 - DNA, 201 bp, Homo sapiens
gaacagctcacagaactcagaaaatccactttacttacatttagatttacagtttatcaagaaggatacagatcaacagccagatgaagaggtatataggktatcgtagtctgctttgtgctgctataacaaaatgcctgagactggcaatttatacgaacagaaatctattttctcacagttctggaggtttgaaagtcc

SEQ ID NO: 20433 - DNA, 201 bp, Homo sapiens
ctgggcatggtggcgcgcgcctgtagtcccagctactcgggcggctgaggcaggagaatcgcttgaacccgggaggcggagcttgcagtgaggtgagatcrtgccactgcactccagcctggtgacagagtgagactctacctcaaaaaaaaaaaaaaaaaaaagagatcaacttgggcaatgtagcaaaaccccatcttt

SEQ ID NO: 20434 - DNA, 201 bp, Homo sapiens
catgagaagtcactcactattatgagaacagcaagggagaaatctgcccgcatgataaaatcacctcccagcaggcccctcctccaacactggggattacwattcaacatgagatttgagggaggacacaaatccaaaccatatcacctatggtttgggttttggtagcacaacactggtacaacctactactcagggatc

SEQ ID NO: 20435 - DNA, 201 bp, Homo sapiens
tccctgccccaaggagtttgtatatgctttttggtgcacatacacaaacataagaaaatgggcaagtcaaattatagatgaggatgatagtgattttttttcacatttcatgagattattgaatataatttcataaaaatgagaataccctttcagataaaagtgtgcaaaatattttatttatgaatgtaaatttttcca

SEQ ID NO: 20436 - DNA, 201 bp, Homo sapiens
ttcttgtttcaataactgcctcctttctcctcctgcagcttttaaattgtagataaatattttcaggtgctaacctagagtcttactcttccatgttcatrtggggtatctgcatgctgggggaaggaagaggttgaggagggaattggccttttgctgggggtttagtgcactggaaggcatttttagaacatctggaga

SEQ ID NO: 20437 - DNA, 201 bp, Homo sapiens
ctgctttgaagggtccagtgaggtttggtatggtcctcacataaagtaaagaggccaaggatatttgtgttttacgttaggtcttggcaaggtaaaaattwtaagagaagttttatagtgtaccagatttctatcgtgtttttaaaaagaaaataacttattgaatataattgccagacaaggtgaagatagtaaaagtat

SEQ ID NO: 20438 - DNA, 201 bp, Homo sapiens
ttgcaggggagctgagtaagatagagcaatgtgacaagcaggtcttataagactaggtagaagatcaatactctgagaaggagatatggaggggtcagaayggtctgtggaaaaagtactgaatgtggtccagttgaagaggaagagaatcaatatattaaaaaagacccaaatgaaaaaaagaaataaagctgtctttat

SEQ ID NO: 20439 - DNA, 201 bp, Homo sapiens
tataagactaggtagaagatcaatactctgagaaggagatatggaggggtcagaatggtctgtggaaaaagtactgaatgtggtccagttgaagaggaagrgaatcaatatattaaaaaagacccaaatgaaaaaaagaaataaagctgtctttatttgcagatagcataattttctatggagggacaccaaagagtctat

SEQ ID NO: 20440 - DNA, 201 bp, Homo sapiens
gagaactcatatgatttaagacttactataaagctacaataatcaagaaagcatggtgttggcaaattagatacatagatcaatggaaaataatagcaagyccccatatagacccagataagtatagtaaactgacttttttatgaaagtgcaagaataattcaataaagaaaggatagtcttttcaaaaaatagtgctgg

SEQ ID NO: 20441 - DNA, 201 bp, Homo sapiens
acttttttatgaaagtgcaagaataattcaataaagaaaggatagtcttttcaaaaaatagtgctggagcaattgggtgtccatatgcaaaaatatgaacwtagagttcatactttacaaaaaaaattaactcaaaatgagtcatagacatatatgtaaaatgcaaaccaattaaacttctagtagaaaaatagaataaat

SEQ ID NO: 20442 - DNA, 201 bp, Homo sapiens
tcctgctgccttagcctcccaatgcactggtgagacaggagagttccctccaccccttctgggacatggaacaggggtatggctcatttactctttaagcyacactcaaacagctttcgagagggggagcatgcaggtgagggggtgcaggagctggggcgagtgcctttgggctccagcaggaaggaaccctttaccagc

SEQ ID NO: 20443 - DNA, 201 bp, Homo sapiens
ttaactgtaaactaaaatagtttgcatgttttcatttaaattcaggagagatagatgagaactaagagaagatttaggaaattcagtactttctcagttcycctgagattcaggaatggagtaatatacaacatagctttattaggagctttcattttcatccagaactttacagaaaaggccagcatccagccaaaggct

SEQ ID NO: 20444 - DNA, 201 bp, Homo sapiens
  misc_feature (1)...(201): n = A,T,C or G, or insertion/deletion polymorphism (see Tables 1-2)
tattttttattgggttctgaacttggcagcacacattccccattcgtgcctgcagggcaaagtgaaaacaatttgaacactgtatttcccaactggttcantgacatttgagaataatgtagtacagacagaatcagcatgtttggcaggtgagtgatacttaacatgaccttggaaagttacttcccaccagtttgcaga

SEQ ID NO: 20445 - DNA, 201 bp, Homo sapiens
gagaacagctccagcattcgttcttcccggcaaaggtgaacatatggccatggtgtctcctgctatcaacatttttgcccctgagggagactagcaagtcrgaactggttagagaccatcagagagaatgagagatcatctgcatctcaaaggattaaacaagcattggatagagaggaacagaaggcttcaggtagagac

SEQ ID NO: 20446 - DNA, 201 bp, Homo sapiens
gttctactataaagacacatgcgcacatatgtttattgcagcactgttcacaataacaaagacttggaatcaacccaaatgcccatcaatgatagactgcwtaaagaaaatgtggcacatatacaccatgaaatactatgcagccataaaaaaaggatgagttcatgttttattgcagggacatgaatgaagccggaaacc

SEQ ID NO: 20447 - DNA, 201 bp, Homo sapiens
tatcatgcattaacaactacatcactctagcaaggctccccagtcacattagagtggaaatgctgaggtttggtacacctctttgcttgccccacacttgwaacagaagacactgtttggaaatttttttcatgtaaaggagacaacctctctatgctatttttggctttataagtgtcatgactataaatgataatattt

SEQ ID NO: 20448 - DNA, 201 bp, Homo sapiens
atttatgtcccataaactcagggctcattcacttattcagcagctatttcctgagtgtctaccttgtgccagttgctgtgctagtgctgaggatacagccrcgaaacaaacaaactgttaggacatttgggaggaagaatcagataaacatcatatcaacacatcaacaattgccacagtattgggcagggataaaagtca

SEQ ID NO: 20449 - DNA, 201 bp, Homo sapiens
ttcttgctgatttttctttctcaaatattctgcatattctccatgcagaaaattcttccacctttttctgcatatggagaataagaaacagaaaatcagagtgaagagtctgattgactctaaatttttgcgacatgtcagaatgcctatttcaaactgccacaaagtatcaaatgaagagtgtcagttgttcttttaatt

SEQ ID NO: 20450 - DNA, 201 bp, Homo sapiens
cccaacagagaagtgaagtaagtactttgaaagcagcactcacccaatcacgagtatttgtgatatcactggttttctgaagaaaatttgctaacattgayttgattgatgggaaagtgaatattctggaaatgttgggaagaaaattatttttaaaagaaagcaaaatccttttggatacattacatttaaacacaaaat

SEQ ID NO: 20451 - DNA, 201 bp, Homo sapiens
tttcttgctgatttttctttctcaaatattctgcatattctccatgcagaaaattcttccacctttttctgcatatggagaataagaaacagaaaatcagagtgaagagtctgattgactctaaatttttgcgacatgtcagaatgcctatttcaaactgccacaaagtatcaaatgaagagtgtcagttgttcttttaat

SEQ ID NO: 20452 - DNA, 201 bp, Homo sapiens
  misc_feature (1)...(201): n = A,T,C or G, or insertion/deletion polymorphism (see Tables 1-2)
accatctgtctgttcctcaaataaaacaagagtttaaaaagttacatcattcctttaagtaattgcataagagttcagagggagccgtggtaaggaggccnatgaggaaggaaaatggagcaactcggaatatttacatgtctttagagaaaatgaagcaggcttatggctgcgcggtcacaaaatctcctcattcccttt

SEQ ID NO: 20453 - DNA, 201 bp, Homo sapiens
aaggatagattctcctaggttagcaccacacaaaaagctgttcacatttctcagagttctatagaacagaatgggttagcagagttctctgtccaatctcctcaggctaaaattaagttgttagctggggctgccatctcatccgacgttcagatccttgtccacatgctttcgttgtggttgtagacagaattcagtttc

SEQ ID NO: 20454 - DNA, 201 bp, Homo sapiens
aaccaaaatagacaatggcaggtctggagccagtctagtctgataccttaatgggcctttagagacttttaatacactgactactggaataatagtcagtctactgaatgactttgtatattttgatttttttaaactcttgaggtacaaaagaaagttcttagaggaaggaacattaagagtaacaatcacaatgccata

SEQ ID NO: 20455 - DNA, 201 bp, Homo sapiens
tgaaccaaaatagacaatggcaggtctggagccagtctagtctgataccttaatgggcctttagagacttttaatacactgactactggaataatagtcagtctactgaatgactttgtatattttgatttttttaaactcttgaggtacaaaagaaagttcttagaggaaggaacattaagagtaacaatcacaatgcca

SEQ ID NO: 20456 - DNA, 201 bp, Homo sapiens
agataggaattttgtctagatggacctttacggccagagagaggagctgagattcagttcttgagttaatggagattggagaggtttaaacagaaaaaagrcatgattgaaaatacatattagaaatatcagcctgacttcagtgaaaaggtgagtcaaagtatgcaggaacgtgtgatggagctgaatgatgacagggga

SEQ ID NO: 20457 - DNA, 201 bp, Homo sapiens
tcctgactttttaatgattgccattctaactggtgtgggatggtatctcattgtggttttgatttgcatttctctgatggccagtgatggtgagccttttytcgtgtgttttttggctacataaatgtcttcttttgagaggtgtctgttcatgtcctttgcccactttttgatggggttgtttgtttttttcttgtaaat

SEQ ID NO: 20458 - DNA, 201 bp, Homo sapiens
atatcagactggaaagaggttccaaatggtgtccttgaaaaggtctctgcccttgccctgttcttgtgttgcaaagttatcaatggttagaatgagaacabaaatggcaagcatatcagatttagggaggagaaaagaccggaagagatagccaatgtttggagggaagatagagcatgaagaaatagatgacccaaaatt

SEQ ID NO: 20459 - DNA, 201 bp, Homo sapiens
gtcttaaaaaacaagtcagttaagaaggttgaggcgacggatgttgttgcagaattgtcagtttgcaagaaaacattctttggaaaaaaatacagcccccrgttgcaaatctaatcagtggcgggtatgggaggtggggaagagagcatagagagaaaaaaacatgtctcaaagagaaaaaaagagcaagaccctaattga

SEQ ID NO: 20460 - DNA, 201 bp, Homo sapiens
ttaaaaaataaagtggtaagaggatgtactcactgatgtccttgaagaaaaaaaaatcaatttttttatagctccaagttttgcagcatgaccttaagctbtttttttcattttgttttgtggggtttttttgtagtatggtaatattaattgaattgaaggtactgatctcagtaaacagtctaccacttcagggtggaa

SEQ ID NO: 20461 - DNA, 201 bp, Homo sapiens
tatattaaaaaataaagtggtaagaggatgtactcactgatgtccttgaagaaaaaaaaatcaatttttttatagctccaagttttgcagcatgaccttawgctgtttttttcattttgttttgtggggtttttttgtagtatggtaatattaattgaattgaaggtactgatctcagtaaacagtctaccacttcagggt

SEQ ID NO: 20462 - DNA, 201 bp, Homo sapiens
tagactacatggcagaggtagagatgataggctggaaaacacttaggaggatagattaattaataaaagtcagagttcatgaaggcttaagcgggcagaaratggtgcccccttttcagagttaagtggatatcaactagcatattagctgtatattattaataatgtatgggcatgatttggcaagtatttctttaaaag

SEQ ID NO: 20463 - DNA, 201 bp, Homo sapiens
ataccttaattttttaaaaaaactttattgctagaaagatgttctttagcaagttatcatatttttgcttgttgagggtcttgccttgatgttgatggctrctgactaatcaggatggaggttgttgaagactgggttgactgtggcaatttcttaaaaataagagaacagtgaagtttgccgcaacaactgactcttctt

SEQ ID NO: 20464 - DNA, 201 bp, Homo sapiens
tttgtgatttgttttctgtttgttttgcagtcatcttctcttccttctttccattctccctgtcttccttttagtgaaggttttttcctcagttggcattyttaaatttctttgttttttattttattttgtgtatgttttctgatttgaggttatcatgaggcttgtaaatgatatcttgtcatccattattttaaacag

SEQ ID NO: 20465 - DNA, 201 bp, Homo sapiens
tatatattacataaatataatataaaaatatatattatatattacataaatataatatataaatatatattatatattacataaatataatatataaatawtatatattacataaatataatatataaatattatatattacataaatataatatataaatattatatattacataaatataatatataaatattatatat

SEQ ID NO: 20466 - DNA, 201 bp, Homo sapiens
cagacacacacacacacatacacacacacacaggattttataaacttggtacaaggaaaaaaatgtaaaatatatcctcaataaaatttaatgttgaatayattttgcaataacaatattttggacattttgggttaaataaaatatatcattaaaattcccttgttactttttacttttttaaagtgatgacttgaaaat

SEQ ID NO: 20467 - DNA, 201 bp, Homo sapiens
attttccaatttattagaatatagttgctcacagtagactccaatgatcctttgaatttctatagtatcaggtgtaatgtctcctttttcaaaaaacttttgaaaatgaaaccaacttttgtttcattgatcttttttattgttttcttcatttcaatatcctttatttctgctccgatctttattatttcttttcttcta

SEQ ID NO: 20468 - DNA, 201 bp, Homo sapiens
atatataattacatatataatatataaatattatatattacataaatataatataaaaatatatattatatattacataaatataatatataaatatatattatatattacataaatataatatataaatattatatattacataaatataatatataaatattatatattacataaatataatatataaatattatatat

SEQ ID NO: 20469 - DNA, 201 bp, Homo sapiens
cattttccaatttattagaatatagttgctcacagtagactccaatgatcctttgaatttctatagtatcaggtgtaatgtctcctttttcaaaaaacttttgaaaatgaaaccaacttttgtttcattgatcttttttattgttttcttcatttcaatatcctttatttctgctccgatctttattatttcttttcttct

SEQ ID NO: 20470 - DNA, 201 bp, Homo sapiens
gatatataattacatatataatatataaatattatatattacataaatataatataaaaatatatattatatattacataaatataatatataaatatatattatatattacataaatataatatataaatattatatattacataaatataatatataaatattatatattacataaatataatatataaatattatata

SEQ ID NO: 20471 - DNA, 201 bp, Homo sapiens
agatatataattacatatataatatataaatattatatattacataaatataatataaaaatatatattatatattacataaatataatatataaatatatattatatattacataaatataatatataaatattatatattacataaatataatatataaatattatatattacataaatataatatataaatattatat

SEQ ID NO: 20472 - DNA, 201 bp, Homo sapiens
tagatatataattacatatataatatataaatattatatattacataaatataatataaaaatatatattatatattacataaatataatatataaatatatattatatattacataaatataatatataaatattatatattacataaatataatatataaatattatatattacataaatataatatataaatattata

SEQ ID NO: 20473 - DNA, 201 bp, Homo sapiens
ttatttatataagtatatatcctatagatatataattacatatataatatataaatattatatattacataaatataatataaaaatatatattatatattacataaatataatatataaatatatattatatattacataaatataatatataaatattatatattacataaatataatatataaatattatatattaca

SEQ ID NO: 20474 - DNA, 201 bp, Homo sapiens
tacagccgcgaaacaaacaaactgttaggacatttgggaggaagaatcagataaacatcatatcaacacatcaacaattgccacagtattgggcagggatwaaagtcaccaagaagaatgaaatggtgcgtaaggagacggatcacagtcagggaagtattctttggcaaagcaacagtagagagtgctcctggatgcgtg

SEQ ID NO: 20475 - DNA, 201 bp, Homo sapiens
tttaaaatttagtattatgaattcatacatatacatggatagacttcttgaaaattcaagttataaagaaatacgaaaaacaccaaaaaaaaaaaaaaaaacaccacatggacagttccatccaccaacaagagcataaaatgcagttacccacagacaatcccagtggaggtacttgctggtaacttgtgactcctactc

SEQ ID NO: 20476 - DNA, 201 bp, Homo sapiens
  misc_feature (1)...(201): n = A,T,C or G, or insertion/deletion polymorphism (see Tables 1-2)
taattaaggttcataaacagttgacactgtgtgtattagtctgttttcacattgctgataaagacatacctgagactgggtaatttatgaagaaaaagacntttaatggacttacagttccacatggctagggacgcctcacaatcgtggcagaagacaaaaggcatgacttacatggtggcaggcaagagagaatgagag

SEQ ID NO: 20477 - DNA, 201 bp, Homo sapiens
  misc_feature (1)...(201): n = A,T,C or G, or insertion/deletion polymorphism (see Tables 1-2)
acagaagatatttagaaagagaaagggggggaaagtgagcattgaggaaatgttttgcccatgcggtaatggttaaaaaacagcaatggattttcttgaangcggttatattttatggtatttcagcatatagccttttctctattcactcacctaaaaaaaaacccaaggctctatcaacttgattgaggaaaggattgt

SEQ ID NO: 20478 - DNA, 201 bp, Homo sapiens
acagtaaactttgattaacaccatgggacctacatgaagtgccactagtaatgctgaaagtgctcccaagaagcagaaaaaaagtcatgacattacaaggratagttgacttgcatgatatataccatagcttgaggcctgcagctgcaatttcccatcatttcaagataaatgaatacagtttaaggacgattgtaaaaa

SEQ ID NO: 20479 - DNA, 201 bp, Homo sapiens
gtaataatggtgtagccacctcctgttgctattgcagtgagctccagtgttaaaagatccactaaaaacactctttgatgctatttatatctgcatgagcmatttgtctctccagtaaattgtgtaccacggtaaaagtgatgtctctgggttcccacatgtttattttcttgtttagtgcaatacagtaaactttgatta

SEQ ID NO: 20480 - DNA, 201 bp, Homo sapiens
atttgtgatctttttatttcagtggagcataagggatatgataaaaatttgctacaaataaacgacagctttgttgaacaggaacacatttttttttttttagattttacaacaatagaacgggccaaatatccttgtaaattacattaatgagacagattgctacttttaatggaggctctgtgctctacattgtgcctt

SEQ ID NO: 20481 - DNA, 201 bp, Homo sapiens
gatagcctttttgcaaataagatacttaagaataacacacttcaatttaccatggattatacctgtatcaggacaacatgaaagaaaatttaaccattgtaaaggacagatcaattttaagtggaatttgctcttatcacaaagtctaaagataaatgcaggcaaatttctcagcaaaaaagagaaaaggatacaacacat

SEQ ID NO: 20482 - DNA, 201 bp, Homo sapiens
agactaaacatctgagagacaggcactctaactttctaactgaagacggtgaacctagctgtggtaaaaaagaggtggctatttaataatgtcactaacataaacataattaaatgacaacattttgatttttctgtgtaccattatgaaaaactgaacatcaacctccctgtccaacttgattcattcattcacactggg

SEQ ID NO: 20483 - DNA, 201 bp, Homo sapiens
cttgggataatggattctgaaactacaatgcagtcagttctttgttatctgtaaatgttggtcatctatttttttgttatttgctgtagtacctacagcargagtgcatgcatctctccacctcttagcatctttctgtactatctcatattgctaccagctcttatccctaggtaaatcgaagataatatttgccaaaag

SEQ ID NO: 20484 - DNA, 201 bp, Homo sapiens
gtggtgaggtatatttcctctatactcagtttgttttagtctttctatcatgaaaggatgttgaattttatcaaatgggttttcatcgtcatatgttgttkattttcattctctcaataggatgtatcacactgatttgtgtatgttgaactatccttgaatgcctgggataaatcccactgggcaatgatgaattatctt

SEQ ID NO: 20485 - DNA, 201 bp, Homo sapiens
  misc_feature (1)...(201): n = A,T,C or G, or insertion/deletion polymorphism (see Tables 1-2)
taggatggcttaacaaactaagatgaaataatttttactcctgctttcttattttgaagcataacatagttcaacatcagagggacattaatggaagctcnccacccccttcccacatttgtaaaatgaatcagtgtctttccatcccatattcaacagctaagctatttatgtcccataaactcagggctcattcactta

SEQ ID NO: 20486 - DNA, 201 bp, Homo sapiens
gacttctagtactatgttgactaacagtgatgaaagtgggcatccttgttgttttctatatcttagagaaaaagctttcagatttgtcccatttagtatgrtaccagttgtgggtttgttgtatattacttttagtgtggtgaggtatatttcctctatactcagtttgttttagtctttctatcatgaaaggatgttgaa

SEQ ID NO: 20487 - DNA, 201 bp, Homo sapiens
tgatgctattaaaacacagctcttattatagctcagatcatgttgcaaggcctaataaataataacctaggtggcaacctttcacatctttgtgtagcccyctgaactaaatgtataactaagtgttcattcactgtttcagcaaatggttgtgggacacacaccctgagccaggcccactggaatacagtgggaagcaaa

SEQ ID NO: 20488 - DNA, 201 bp, Homo sapiens
tggtatttcagttaattttttttaatggaagcaaaatcgcggagttgcagactggtgataatcccctgcagatataggactttcagagctagcccaagagmtctgaatacagggagtcaatggaggaaagttattgatttgctcctccagttctgaggactgttttactgtgttgtacctacggtactttgtccccttggc

SEQ ID NO: 20489 - DNA, 201 bp, Homo sapiens
ttggttgcctgtgcttgtaaggtattattcaagaaatctttgcccagcccaatgtcctgcagagtttccccaatctttatttttagtggttccatggtttraggtcttagattcaattctttactccattttttattcaatttctgtatatggtgagagataggggtctagtttccttcttctgcctacggatacccagtt

SEQ ID NO: 20490 - DNA, 201 bp, Homo sapiens
ctgcttgccgtttgtgtgtcttcttttgaaaaatgtcttttcaaatcttttgctgattatttaattagattattagattttttcctgtacagtttgagctmcctatctcttctagttactaatctcttgtcagatgggtagtgtgcaaatgttttctatcattctgtaggttgtctcttcactttgctgattgtttccttt

SEQ ID NO: 20491 - DNA, 201 bp, Homo sapiens
tctctaagagtagctgacagaactaacgaaagcctgaggcagcgcagccatcttgtcacctccgtatcttagcgcctctgccctctcggactccttatcgsgcctaagaagtaccaagccgttcttattctgatggctgcggagagctgatctaccaccatgtgaaactaagtcatgtgaaactaaatccaaaattccaca

SEQ ID NO: 20492 - DNA, 201 bp, Homo sapiens
ggtgaagggcaaatacaacatttgaaatgaattataaggaatgcaaagttttttggtacttgggataatggattctgaaactacaatgcagtcagttcttygttatctgtaaatgttggtcatctatttttttgttatttgctgtagtacctacagcaagagtgcatgcatctctccacctcttagcatctttctgtacta

SEQ ID NO: 20493 - DNA, 201 bp, Homo sapiens
tgatagcctttttgcaaataagatacttaagaataacacacttcaatttaccatggattatacctgtatcaggacaacatgaaagaaaatttaaccattgtaaaggacagatcaattttaagtggaatttgctcttatcacaaagtctaaagataaatgcaggcaaatttctcagcaaaaaagagaaaaggatacaacaca

SEQ ID NO: 20494 - DNA, 201 bp, Homo sapiens
atgatagcctttttgcaaataagatacttaagaataacacacttcaatttaccatggattatacctgtatcaggacaacatgaaagaaaatttaaccattgtaaaggacagatcaattttaagtggaatttgctcttatcacaaagtctaaagataaatgcaggcaaatttctcagcaaaaaagagaaaaggatacaacac

SEQ ID NO: 20495 - DNA, 201 bp, Homo sapiens
  misc_feature (1)...(201): n = A,T,C or G, or insertion/deletion polymorphism (see Tables 1-2)
tggaaacaacttgaccaaaaatctgtcacagaattttgagtcccatgaaaacaaagtttaatgaggaaaaagatgggggacagtccctttttggggaccantgcagtcataggaccaacataggtgtactttcagggtggtagggaaagcagaggtggctggaagaaaattccatctcttagggacatggataagggtgtt

SEQ ID NO: 20496 - DNA, 201 bp, Homo sapiens
tatgatagcctttttgcaaataagatacttaagaataacacacttcaatttaccatggattatacctgtatcaggacaacatgaaagaaaatttaaccattgtaaaggacagatcaattttaagtggaatttgctcttatcacaaagtctaaagataaatgcaggcaaatttctcagcaaaaaagagaaaaggatacaaca

SEQ ID NO: 20497 - DNA, 201 bp, Homo sapiens
agctaagtttctagggagtgaagggagttatccttgcttaaaaattgggtaattttttaaacttacccagtttttaaggttagcttttctagggcttaaasatacatttctgtaaaaaatactcatttgtttttcaacctacattaaaagaatattatgattacctcttttttattttgagatggagtctcactctgtcac

SEQ ID NO: 20498 - DNA, 201 bp, Homo sapiens
ttatgatagcctttttgcaaataagatacttaagaataacacacttcaatttaccatggattatacctgtatcaggacaacatgaaagaaaatttaaccattgtaaaggacagatcaattttaagtggaatttgctcttatcacaaagtctaaagataaatgcaggcaaatttctcagcaaaaaagagaaaaggatacaac

SEQ ID NO: 20499 - DNA, 201 bp, Homo sapiens
gatacgtcccatcaatacctaatttattgagagtttttagcatgaatggttgttgaattttgtcaaaggccttttctgcatctattgagataatcatgtgktttttttcttttgttttgtttatatgctggattacatttattgatttgcgtacattgaaccaggcttgcatcccagggatgaagcccacttgatcatggt

SEQ ID NO: 20500 - DNA, 201 bp, Homo sapiens
attcagtgtgatattggctgtgggtttgtcatagatagctcttattattttgagatacgtcccatcaatacctaatttattgagagtttttagcatgaatkgttgttgaattttgtcaaaggccttttctgcatctattgagataatcatgtggtttttttcttttgttttgtttatatgctggattacatttattgattt

SEQ ID NO: 20501 - DNA, 201 bp, Homo sapiens
cgtttgcaaaaggggattgtttgttacacacagaaaggtaagaaaaatgtcattatagaaaatctgggatttagttcgcagggtttttgttttgttttgtwttttgtcttttctgggtaaatggtgatcttaagaagttatgttaaaaatagtttgtaggccaagcgtggtggcttatgcctgtaatctggtgatttggga

SEQ ID NO: 20502 - DNA, 201 bp, Homo sapiens
tcttgtgccagttttcaaagggaatgcttccagtttttgcccattcagtgtgatattggctgtgggtttgtcatagatagctcttattattttgagatacrtcccatcaatacctaatttattgagagtttttagcatgaatggttgttgaattttgtcaaaggccttttctgcatctattgagataatcatgtggttttt

SEQ ID NO: 20503 - DNA, 201 bp, Homo sapiens
caatggggttttctagatatacaatcatgtcatctgcaaacagggacaatttgacttcctcttttcctaattgaataccctttatttccttctcctgcctrattgccctggccagaacttccaacactatgttgaataggagtggtgagagagggcatccctgtcttgtgccagttttcaaagggaatgcttccagttttt

SEQ ID NO: 20504 - DNA, 201 bp, Homo sapiens
gttttttccaattctgtgaagaaagtcattggtagcttgatggggatggcattgaatctatagattaccttgggcagtatggccattttcacgatattgaktcttcctacccatgagcatggaatgttgttccatttgtttgtatcctcttttatttcgttgagcagtggtttgtagttctccttgaagaggtccttcaca

SEQ ID NO: 20505 - DNA, 201 bp, Homo sapiens
gtttcagtatggtatttcagttaattttttttaatggaagcaaaatcgcggagttgcagactggtgataatcccctgcagatataggactttcagagctakcccaagagatctgaatacagggagtcaatggaggaaagttattgatttgctcctccagttctgaggactgttttactgtgttgtacctacggtactttgt

SEQ ID NO: 20506 - DNA, 201 bp, Homo sapiens
accatgctgttttggttactgtagccttgtagatagtttgaagtcaggtagagtgatgcctccagttttgttcttttggcttaggattgacttggcgatgygggctcttttttggttccatatgaactttaaagtagttttttccaattctgtgaagaaagtcattggtagcttgatggggatggcattgaatctatagat

SEQ ID NO: 20507 - DNA, 201 bp, Homo sapiens
aataagaaaactgcaagatgttttgctctctattattgacatatatgattagacaattccttaaccaatcatagggttaacaagtttgtgtatcagaaggscaaaggatgccaaaagtggtttttggagctgagaacctctcattgttagcatggtcctgaccaaagtccacctatctctgaagtatctctgcaaagaatt

SEQ ID NO: 20508 - DNA, 201 bp, Homo sapiens
  misc_feature (1)...(201): n = A,T,C or G, or insertion/deletion polymorphism (see Tables 1-2)
tttcatttgttaacaaataaatcctaaactctaaaaacaggttaccctttaaatgattattaggagacatccttatatgcatctgacactattgccctaantgaccccgtgtcctacaagtccaagcacacattaatttgacaagtggcatagctgccagtttggtggtggtccttgttggcctccaaactacactgagtc

SEQ ID NO: 20509 - DNA, 201 bp, Homo sapiens
  misc_feature (1)...(201): n = A,T,C or G, or insertion/deletion polymorphism (see Tables 1-2)
tgtgcaccttacatatgtattttccattccatgatgaagtcatagacatacctaaaagccatgcccacacaccttgcataaaaacacattttaggagtaanaggtgtcaattagtttcatcctataaactttccatcaagtcctacattttccactttttgtttctgctagaacaaagcctattggttgctaatgaagtat

SEQ ID NO: 20510 - DNA, 201 bp, Homo sapiens
agtttcgcttgagtccagaagttcaaggctgcagtgagctatgatcctgtgcattgcactctggcccaggtgacagagtgaaacctgtttttttttttttwaaaaaaaaaatgttttgatacttcaaactcttaaaaattcctttgttaagtatataaattatgcccaaaatttgtgccattttaaaactgagtaagcatt

SEQ ID NO: 20511 - DNA, 201 bp, Homo sapiens
gagtttcgcttgagtccagaagttcaaggctgcagtgagctatgatcctgtgcattgcactctggcccaggtgacagagtgaaacctgttttttttttttwtaaaaaaaaaatgttttgatacttcaaactcttaaaaattcctttgttaagtatataaattatgcccaaaatttgtgccattttaaaactgagtaagcat

SEQ ID NO: 20512 - DNA, 201 bp, Homo sapiens
cctaggttttcttctagggtttttatggttttaggtttaacattgaagtctttaatccatcttgaattaatttttgtataagatgtaaggaagggatccastttcagctttctacatatggctagccagttttcccagcactatttattaaatagggaatcctttccccattgcttgtttttctcaggttcgtcaaagatc

SEQ ID NO: 20513 - DNA, 201 bp, Homo sapiens
tgccattgcttttggtgttttatacatgaagtccttgcccatgcctatgtcctgaatggtaatgcctaggttttcttctagggtttttatggttttaggtytaacattgaagtctttaatccatcttgaattaatttttgtataagatgtaaggaagggatccagtttcagctttctacatatggctagccagttttccca

SEQ ID NO: 20514 - DNA, 201 bp, Homo sapiens
ccaaaacccaggcatatacgattagcagaaggtcttgaaaacaaggtagtcatgggctggtactttttttttttattactgcatgtgtttttattattattattattattattattattattattattatactttaagttttagggtacatgtgcacaatgtgcaggttagttacatatgtatacatgtgccatgctggtg

SEQ ID NO: 20515 - DNA, 201 bp, Homo sapiens
tcaaattctatcttctgtgatacccatttacactccagccatatatgcaattgcacatttcttcacctcctcatcagtcattgagtattttttagctaatytggtaagcaaaaattttcttttgcaaaaaacatcacattgcatttattaaattatttgcaaaagggggtaaatgtgtttgtgtgaaaatgtcttctaaga

SEQ ID NO: 20516 - DNA, 201 bp, Homo sapiens
gagccaaaacccaggcatatacgattagcagaaggtcttgaaaacaaggtagtcatgggctggtactttttttttttattactgcatgtgtttttattattattattattattattattattattattattatactttaagttttagggtacatgtgcacaatgtgcaggttagttacatatgtatacatgtgccatgctg

SEQ ID NO: 20517 - DNA, 201 bp, Homo sapiens
agagccaaaacccaggcatatacgattagcagaaggtcttgaaaacaaggtagtcatgggctggtactttttttttttattactgcatgtgtttttattattattattattattattattattattattattatactttaagttttagggtacatgtgcacaatgtgcaggttagttacatatgtatacatgtgccatgct

SEQ ID NO: 20518 - DNA, 201 bp, Homo sapiens
gccagtgggcagtctaatataccagagccaaaacccaggcatatacgattagcagaaggtcttgaaaacaaggtagtcatgggctggtactttttttttttattactgcatgtgtttttattattattattattattattattattattattattatactttaagttttagggtacatgtgcacaatgtgcaggttagtta

SEQ ID NO: 20519 - DNA, 201 bp, Homo sapiens
ttccttccttctttcttccttccctcctccctccctcctcctctccccctccccctttcctgcctccctctctccctgcctcccctcttcccttcctttaktcctgtcttcttttggaatatactcatttttattaagtcatgataccctcatccccttggtgcataacacaatttaacatagcagagaataaatacatgc

SEQ ID NO: 20520 - DNA, 201 bp, Homo sapiens
gtatggggcctctgttatcatatcctgctaacaatacagtaaatggaaatttggggaaagcaacagtaggaactgctgtgtatctgcggttaagttaatcwgattttgataccccaaaaccaacacagcccacaagactgatagcccaatgctgcagtaaattgtttcttagcaggaaatctacagtagcagtgtaatttg

SEQ ID NO: 20521 - DNA, 201 bp, Homo sapiens
tttctcagagttctatagaacagaatgggttagcagagttctctgtccaatctcctcaggctaaaattaagttgttagctggggctgccatctcatccgaygttcagatccttgtccacatgctttcgttgtggttgtagacagaattcagtttcttgtgttgtaaagcagaattcgctgttttcttgctgtaagtcctta

SEQ ID NO: 20522 - DNA, 201 bp, Homo sapiens
catgtctcccagttttcccttttatttcaggtgatttagcacttactgagtctccttcataatgaattagtatgatactttttactgtagcaactagaatrgagattatgatcgaaaaataatgtcatttcagtgagttttggggcatactattacactattttcaagacaattaatgaacttacagtcatactttctagc

SEQ ID NO: 20523 - DNA, 201 bp, Homo sapiens
ctctctgcttccctgcccatcttgatactatgccactcagtgtttgtaccaagttaacaatgcagtagctgagaatataacattatccttgccttctggcrctctccaaatacctacatcttcttcaaggtatgatatatttatttctagaattgcttcctcctcttcctgtcctctatcactagctgagttcaggacccc

SEQ ID NO: 20524 - DNA, 201 bp, Homo sapiens
gccaagtatcctgctatgcaaagaacaactgtaccgcaaagaattacccagtccccaaaattaaaagggttgaggtttaggaaccatgatctagactactrtacttttcagtttgaatgtttcatagatatgccaaacctaacatgtaccaaaatgaatttatctttctctctgcttccctgcccatcttgatactatgcc

SEQ ID NO: 20525 - DNA, 201 bp, Homo sapiens
tccccttaggggacatttggcattgtctgaaggcacttattttgttaaggttgggatggggttctaatggtctctagcaggtagagtccagggatgttgcyaagtatcctgctatgcaaagaacaactgtaccgcaaagaattacccagtccccaaaattaaaagggttgaggtttaggaaccatgatctagactactata

SEQ ID NO: 20526 - DNA, 201 bp, Homo sapiens
atgctgtgttgttcctgtccctgaactacaggaacctactggcatcgatttgccgctgctggatcctgcgaacaccatcaccacggtcacggggcccagtrctttcagcatccctctccctatccggcagaagctctgtagcagcctggatgccccccagacgagaggccatgactggaggatgctggcccataagctgaa

SEQ ID NO: 20527 - DNA, 201 bp, Homo sapiens
aagctgaacaagaacattctagagattgaagataggattcttagagaacaggtcccaaattttaaattctaataggtagcagatctggaattaaatgccakgaaggccttggttttaggcttcataatcttaagtgctaatcccatgattttatagaatttgatcaaagcagcttttgtccttatttagtggaaacttttc

SEQ ID NO: 20528 - DNA, 201 bp, Homo sapiens
  misc_feature (1)...(201): n = A,T,C or G, or insertion/deletion polymorphism (see Tables 1-2)
tggagaagaatgggtccttgttgattttacagaatttctaaggaaattgttttctgctcatttcatctttcctctggataacacgtcacattatcttgtanggtagtgtctgctgttcgcttctcagtgccattaacatacatctgggccaccctttgtgtggaactgtcccctggtgaaaccctccgtggtctggggtgg

SEQ ID NO: 20529 - DNA, 201 bp, Homo sapiens
ttgaaaaaaaaaaaatctaccatagtacctgaaagaacaacaagcattcaaatagatgttcgataaatatgttggatataatttatttttacttttccaaytttgttgaaaaatagatgtatcctagaaatgaagggtggcaatgtaggccagagaacagtgggcttattggggtctcccctgttctctcttatgctgtct

SEQ ID NO: 20530 - DNA, 201 bp, Homo sapiens
  misc_feature (1)...(201): n = A,T,C or G, or insertion/deletion polymorphism (see Tables 1-2)
ggattggaaatctcatgctgctctttagggaaaatgaagtatgtgggattttttttttatcagaaagttatatgcaaagagttgactgcaggatttcaaanaaattgttacaccatattcatttcttgttaacgagtacttttcactagggaaaaatacttttgtgtgaaaaattaatatatggaagcaaaatgtatcagc

SEQ ID NO: 20531 - DNA, 201 bp, Homo sapiens
ttcataaacgtgtgtttgtcaaacatgattatatttcataatctgatgagaactattgtgttaacaattagcagtgtgtgtgtgtgtgtgtgtgtgtgtgtaaaagagagtgtatagtaggagtatgaagcaatcttggttttaacattctgattcttgttttgaatgaaatatcaaataatagatatctccttaagagca

SEQ ID NO: 20532 - DNA, 201 bp, Homo sapiens
  misc_feature (1)...(201): n = A,T,C or G, or insertion/deletion polymorphism (see Tables 1-2)
ggaaaatgaagtatgtgggattttttttttatcagaaagttatatgcaaagagttgactgcaggatttcaaataaattgttacaccatattcatttcttgntaacgagtacttttcactagggaaaaatacttttgtgtgaaaaattaatatatggaagcaaaatgtatcagcattgaagcaaatttaaaataatgtacca

SEQ ID NO: 20533 - DNA, 201 bp, Homo sapiens
attcataaacgtgtgtttgtcaaacatgattatatttcataatctgatgagaactattgtgttaacaattagcagtgtgtgtgtgtgtgtgtgtgtgtgtgtaaaagagagtgtatagtaggagtatgaagcaatcttggttttaacattctgattcttgttttgaatgaaatatcaaataatagatatctccttaagagc

SEQ ID NO: 20534 - DNA, 201 bp, Homo sapiens
  misc_feature (1)...(201): n = A,T,C or G, or insertion/deletion polymorphism (see Tables 1-2)
agagtcataaatatttgctttaaaaggttatctttaaattgtttggttgctttttgttactttccacctaacatattcttttctgacttacagacacgacnatgtttcaagagctatcacggtcatgttgattttggaaacggaaattttgggtcagatattttagtgtttaagacatatagtataagatagaaaacaaat

SEQ ID NO: 20535 - DNA, 201 bp, Homo sapiens
  misc_feature (1)...(201): n = A,T,C or G, or insertion/deletion polymorphism (see Tables 1-2)
gccactgacaagatcagattaacaagacttccacgttgagatttaaagtgacttctaaatgctacaaacactctactagtgatgctcaactaattgctacntaagtcatagatttttcatatttttatgaaacaaatgtagtttttacattgtatggaatcaatatgaatacctttactttaatcactaacatttattgaa

SEQ ID NO: 20536 - DNA, 201 bp, Homo sapiens
  misc_feature (1)...(201): n = A,T,C or G, or insertion/deletion polymorphism (see Tables 1-2)
taacagtggtctttctttttgttaccaggtatggatgttccctctgggtcctgccaggtctagaacaaagtagcaatatttcaagtgtcttttttgttganataatttgttttttttttcccagtaggagcaagtttgcataatcagtatgtggggatgtgtggggagtaaggggaaggcaatggatatggggtcttacct

SEQ ID NO: 20537 - DNA, 201 bp, Homo sapiens
tgttacacttgccaccattttctctcaactccaccctgagttaaagctgcttttcccaggatttggagacattttgcttatctttccttaactcgatccaytatgtgccatcactagaatttaaaattgatttcatatccatttaaattaatttgatcctcacaataatcccaagaggtagacagagtggattgtattgtt

SEQ ID NO: 20538 - DNA, 201 bp, Homo sapiens
  misc_feature (1)...(201): n = A,T,C or G, or insertion/deletion polymorphism (see Tables 1-2)
tcagtgaagttttgaagcttaaaacatgtaaatagttaagcaaaatgtgtgatacatataaagtgctcaataaatgggacctgctattatttttggatttngtatctctctggagtttaattcagatattcattttcctatgaatctagaatagtaattgaatatagaattttataacaatacatatatatgtatttctaa

SEQ ID NO: 20539 - DNA, 201 bp, Homo sapiens
tctgaatgaggccggtctctttaggcactctcttgagacaaagtgtgtccttcctttattctaggtactttataaaatctacctttataaaaaccactccrcccccccacgttgttttttttgtttgtttgttttgttttgttttttttgcaggctctttgttatcttccagaaacgtgatattcttagtaagtaacttcc

SEQ ID NO: 20540 - DNA, 201 bp, Homo sapiens
gtctgttttgtgtgtccatgtgtgttgtgcatgcacacatgtttaatccactttttactgtttgcctcctttcagtcaacggtggctggtccacctggacrgagtggtctgtgtgtaacagccgctgtggacgagggtatcagaaacgtacaaggacttgtaccaacccggcaccactcaatgggggtgccttctgtgaag

SEQ ID NO: 20541 - DNA, 201 bp, Homo sapiens
  misc_feature (1)...(201): n = A,T,C or G, or insertion/deletion polymorphism (see Tables 1-2)
atgaatgctcagagaggccaggaagaatctagacccacagtcttgctgggcctctccacttagtctgttaacattaggtcagattctttttgtccaatcanatttctacatggctgtccagactttgttgaacggaagcataaaaatggacaattatccctggatctttatgtcttcattccaaaggctcccatgtgtaca

SEQ ID NO: 20542 - DNA, 201 bp, Homo sapiens
ttttctgacaggaatggccacattattctgaaccattctgttttacatctaattcccagctgacaagtgttcgtttttcattcttattcattcgtcacccytgtgttcactctgcctgcaaggcaactggcctgccttctatcacatctctccagatgataaaagatatgcttaaaatcttatctaccctcccttcgcaga

SEQ ID NO: 20543 - DNA, 201 bp, Homo sapiens
ctgaaatgagcggcttctgtgctgcacggccgcgatatatcctatgctcattacacaatctgaaagccagagaggaggttttacggcaggaattaaaagcrtttttcaggaagaagtattgccttgtagggggttaaatgtgagatcattctagaaattagataaaatttacatagagcttaaagccaaacccttaaaata

SEQ ID NO: 20544 - DNA, 201 bp, Homo sapiens
ccctgatccttgaaggaaaaagaaaaacatcagctgacagtcttttgtttgtaaacaataatgcctgagcaaagagaaccccttttgtgaattggtttcaytgatgctttgtccctaaagtcaggaagtaccttgccaaaaagggactgccttttaaagttctttttttattgaacaatgttgctggccacccagaacccc

SEQ ID NO: 20545 - DNA, 201 bp, Homo sapiens; identical to SEQ ID NO: 3402

SEQ ID NO: 20546 - DNA, 201 bp, Homo sapiens
atcacgaggtcaggagatcgagaccatcctggctaacacggtgaaaccccgtctctactaaaaatacaaaaaattagccaggcaaggtggcaggcccctgyagtcccagctactcgggaggctgaggcaggagaatggcgtgaagccaggggggcggatcctgcagtgagcggagatcgcaccactgcactccagcctggg

SEQ ID NO: 20547 - DNA, 201 bp, Homo sapiens
aacagaaaaatcactaaaaggcttgtatttacccacatcaaatattcatttttttcattcccaatgcaaagcaacattcacaggccctcaaagctcccttmttttgcatcaggagaaaagaagatcagcaaactccaagatctctttattttattttatttttctttctctcttccagagtcaaggttagcattaagtaca

SEQ ID NO: 20548 - DNA, 201 bp, Homo sapiens
gaaaacatgccagctgaatccgaacggaacagaaacctaaactgcattcagctgcattccctccccttttcactgcaatttatctaaaagaaaaaaaaaaagattcatttctctaattaattcatctaggaaaaaaagggttggagggcagatgaaattcaggagaaaaaaactaagaatggaaatgatgtatagttgcaa

SEQ ID NO: 20549 - DNA, 201 bp, Homo sapiens
tattcataaacgtgtgtttgtcaaacatgattatatttcataatctgatgagaactattgtgttaacaattagcagtgtgtgtgtgtgtgtgtgtgtgtgtgtaaaagagagtgtatagtaggagtatgaagcaatcttggttttaacattctgattcttgttttgaatgaaatatcaaataatagatatctccttaagag

SEQ ID NO: 20550 - DNA, 201 bp, Homo sapiens
atttctacatagggagatttttaataagcaaattctgaaattttgattataagttatagcctaaattttaatagggagagaactaagataagacaaaaacmattttgtataccataggaaagaatgaggaagaacgaggaatctgttttttttttgttttgtttttttttttttttttttgctacagggtcttcctctgtc

SEQ ID NO: 20551 - DNA, 201 bp, Homo sapiens
ttattcataaacgtgtgtttgtcaaacatgattatatttcataatctgatgagaactattgtgttaacaattagcagtgtgtgtgtgtgtgtgtgtgtgtgtgtaaaagagagtgtatagtaggagtatgaagcaatcttggttttaacattctgattcttgttttgaatgaaatatcaaataatagatatctccttaaga

SEQ ID NO: 20552 - DNA, 201 bp, Homo sapiens
ggttgttttttaatttacatcatccttcatgttcctagactcctatttctcagagcccttttctgtattattattattaatgtggcatgtttaatgtttayagtatttccataaaaatagttcatctctgctaggtagttttcaatgttaaagcaaatgtgcttactcattgaatatgaaaaatatccctctggaacaaat

SEQ ID NO: 20553 - DNA, 201 bp, Homo sapiens
aacttgttgaatcgttggttacttaagaacagatgagttctgaatgaggccggtctctttaggcactctcttgagacaaagtgtgtccttcctttattctrggtactttataaaatctacctttataaaaaccactccgcccccccacgttgttttttttgtttgtttgttttgttttgttttttttgcaggctctttgtt

SEQ ID NO: 20554 - DNA, 201 bp, Homo sapiens
ctatccaacctgcttgccatatccagcctcctacattagctgtttcctctccttgggatgttcttatagcagattttgtattatttccttattaatatcawctagtcctcccttaatcagtctggctaaaatatccccagcttctcactctttctttttttggaattagcttatctcctcatgctccccaactggaatgcg

SEQ ID NO: 20555 - DNA, 201 bp, Homo sapiens
ttgaaccaaaatagacaatggcaggtctggagccagtctagtctgataccttaatgggcctttagagacttttaatacactgactactggaataatagtcagtctactgaatgactttgtatattttgatttttttaaactcttgaggtacaaaagaaagttcttagaggaaggaacattaagagtaacaatcacaatgcc

SEQ ID NO: 20556 - DNA, 201 bp, Homo sapiens
  misc_feature (1)...(201): n = A,T,C or G, or insertion/deletion polymorphism (see Tables 1-2)
agatgaaggaaggaatgaatgctcagagaggccaggaagaatctagacccacagtcttgctgggcctctccacttagtctgttaacattaggtcagattcnttttgtccaatcatatttctacatggctgtccagactttgttgaacggaagcataaaaatggacaattatccctggatctttatgtcttcattccaaagg

SEQ ID NO: 20557 - DNA, 201 bp, Homo sapiens
aaaccctgtttcaaaacaaacaaacaaataaacaaacaatcaaaaaacagtagggtccttcaagactttgaaagtcttgaagtcttcaaagataattcaayctctttctctctacccctgcgctactactgttaagagagttaaaactcaaaaagttgacatggttcacagcgtcacatgtctagtagactatacaagcaa

SEQ ID NO: 20558 - DNA, 201 bp, Homo sapiens
  misc_feature (1)...(201): n = A,T,C or G, or insertion/deletion polymorphism (see Tables 1-2)
tgaaaggtaacttagtgagttaaaggattatacgaccattttccttctaatataaatgcattcattatttaatatttcatttatttgtttaaagaatcttnaagcataaaaataggataaagtgaaatattgatcttaaaggaaaaccagcaggtaaaactcatgtgttttgtaataattagatcagtcgttgggagatga

SEQ ID NO: 20559 - DNA, 201 bp, Homo sapiens
cctttctttgctctgtgctgggtgatccaccaactgacctgcttagcgtgttaatcttactagtttactatactatttagcttcatgagagcaacttattytgaacagtgctcaagagtccagcctcctgaaacagactgtttgggtttgaattctgactgtaccattcactagatatattgccttagttaggtaagtcac

SEQ ID NO: 20560 - DNA, 201 bp, Homo sapiens
  misc_feature (1)...(201): n = A,T,C or G, or insertion/deletion polymorphism (see Tables 1-2)
ctatcacagccattcatatctctatgagtcaatgcaaagaactcaaaggaaattttaatgaaattcctttttttttactttgaaagagagttatttttttnccttaatttggcatctcatgccaattgtatcagagattttgcttgatagtagctatttcattcaacagcatcaaaaccttatctcgcagcactaagacac

SEQ ID NO: 20561 - DNA, 201 bp, Homo sapiens
  misc_feature (1)...(201): n = A,T,C or G, or insertion/deletion polymorphism (see Tables 1-2)
gcttagaattttataggtgacctttcctatataaccctgtgaaattatacccatttataagctgatgaaactaaggcaggaagaggttaagcaatgtgctnaaggtcaaatggatagtcaagtggtagggtcaggacctaaacccagggttttgtatgccaaaaccttgttctcagccacagtgttagcctacccagtggt

SEQ ID NO: 20562 - DNA, 201 bp, Homo sapiens
  misc_feature (1)...(201): n = A,T,C or G, or insertion/deletion polymorphism (see Tables 1-2)
tgataatcacagagtcctccttcgttattcattaaataattttaatattatcttttgaaacatacaattttgaaagtgaaatttacgcaaagagcataatncattcatttgaagttcatttggaaggatttctgtattagcagttccactgcttccttttgttgagctaggaaatgaggacatagccatatttgttcagga

SEQ ID NO: 20563 - DNA, 201 bp, Homo sapiens
  misc_feature (1)...(201): n = A,T,C or G, or insertion/deletion polymorphism (see Tables 1-2)
taagtagagtcttctactcatactttaattaaaagtcataccaatatttgaaataatcatgaaagtactgaataactggagagagcctaacatcctctctnaatggtaaatgatactaaattgctgttaatgaaggttgaaaaaattggtctgttttgtttgaatttcttacatttggagagcaaaatattttttaagatg

SEQ ID NO: 20564 - DNA, 201 bp, Homo sapiens
gtcttctactcatactttaattaaaagtcataccaatatttgaaataatcatgaaagtactgaataactggagagagcctaacatcctctcttaatggtawatgatactaaattgctgttaatgaaggttgaaaaaattggtctgttttgtttgaatttcttacatttggagagcaaaatattttttaagatgtgactaaa

SEQ ID NO: 20565 - DNA, 201 bp, Homo sapiens
gttgacttgcatgatatataccatagcttgaggcctgcagctgcaatttcccatcatttcaagataaatgaatacagtttaaggacgattgtaaaaaaaaagaaaggaaatatgtgaaaccgtcactgcagttatgctagcaggcatgaaaaccttgtactttttgcaaaatacatttttatcttgtactgaaaatgcagc

SEQ ID NO: 20566 - DNA, 201 bp, Homo sapiens
gcatgtgtttaatgatataaattttcttcctgtactttgggagcaaggatgtatgttatccactgtagcattttacataagcaaaaaaaaaaaaaaaaaaagctacatttggctacttctcattgggaaattgtgtcccaagggtgcaataaatatgccaattttatgcaacagatgtaggactggacacattgaattatg

SEQ ID NO: 20567 - DNA, 201 bp, Homo sapiens
tttggttttgtaatcaaaatctaagcaattgattaaaatcaggttgcagatattttcagtataattgtccctaatcacacattccaagaggaagttgtaaygaaacttttgagtagaaagtcaaaacacaaaagaagagttggcatgaattacccttgggtgagtgtatcatgaggttagattttgaggaacacattagga

SEQ ID NO: 20568 - DNA, 201 bp, Homo sapiens
actttttaaaaaaattagggctttaggcccatgtagagagacagtatagcaaagaaattaaaagcatgattctggagtcagaaccatttagaaatgatatraatttgtctgaagttactttaccattccaagccttagtttcctcattctagaatggagataagattaggacctactcaatgaagttattggagaattaaa

SEQ ID NO: 20569 - DNA, 201 bp, Homo sapiens
ctctgagttaaataagtggaagtggtgctatggaaaatgtaaagcattatgtaagtgtcaccttcttagaattcgtgtagaatcaccaactttagaactawaagtttgtagagaccccaagcctctctgactccattatggaaataaggaaataggcccagggaggtggggacaattgcaggacttggacctcaattcaga

SEQ ID NO: 20570 - DNA, 201 bp, Homo sapiens
gtccaaaaatattctatttccctttgatggttagatctaactgaaatgtgggatatacctggacctctccccaagaacgttgtgaaaataagcagcaattwtaaatggcttaagaattgtatacagttgcattattaatttatgttttttgtccattggtgatataaaataaaagcgattcttttcaaaaaaaatggaaga

SEQ ID NO: 20571 - DNA, 201 bp, Homo sapiens
tcaagaaaaagcctgtcaccaagttgctctgagttaaataagtggaagtggtgctatggaaaatgtaaagcattatgtaagtgtcaccttcttagaattcrtgtagaatcaccaactttagaactaaaagtttgtagagaccccaagcctctctgactccattatggaaataaggaaataggcccagggaggtggggacaa

SEQ ID NO: 20572 - DNA, 201 bp, Homo sapiens
taattcagatattcattttcctatgaatctagaatagtaattgaatatagaattttataacaatacatatatatgtatttctaatctctagctcttcaatwttttactagacaaaatagattcagatctaagaagatgtatctagataaaatacaacattatgatcatgctacagaggaacacatcttgattctataactc

SEQ ID NO: 20573 - DNA, 201 bp, Homo sapiens
  misc_feature (1)...(201): n = A,T,C or G, or insertion/deletion polymorphism (see Tables 1-2)
tttgagtggggacacagccaaatcatctcactgggcatggtggtgtctcaagcctgtagtcctagctactctggaggctgagatgggagaatctctcgagnccaggagtttgagcttgcagtgagccatgattgttccactgtactccagcctgggaaacagagcaagaccctgtgtcaagaaaaagcctgtcaccaagtt

SEQ ID NO: 20574 - DNA, 201 bp, Homo sapiens
ttttagtccctctgaaccaataatatatgtttactgaattggattataaaacatattataaattaaaattatcttattttctttcttaagatgctttttartactttgtagtgataagatttctgtagtggaatagtctatcgaaaaagcgtttcagccaggctccgtggctcatacctgtaatcccaccactttaggagg

SEQ ID NO: 20575 - DNA, 201 bp, Homo sapiens
gcttgaacctgggagaaagaggttgcagtaagccgagattgcgccactgcactccagcctgggtgacagagtgagacttcgtctcaaataaataaaaaaawaaataaataataaaattaggcaggcctgacttttattttcagaactgtcactttaactagctatgtgacactgggctagttgttacattttgtaatataa

SEQ ID NO: 20576 - DNA, 201 bp, Homo sapiens
gctttcagtgcccagtaattacccattggaattttctgctaccacgtgtgtagctacaagacagagttttggttatgatatgattctcagccttgaagacyggttttcaaaagtattaggttcccttactagcagtcagccttcaagctttgctttggtccaatcaacattcgccaaagtcacctccttattatgatcatc

SEQ ID NO: 20577 - DNA, 201 bp, Homo sapiens
  misc_feature (1)...(201): n = A,T,C or G, or insertion/deletion polymorphism (see Tables 1-2)
tggcatgatttttaatcacatgcccagggatctatccaatggtctaaaattccatatcacctaagcccacatagaaacggtgatcacagtttttaatcaanaatagagacacacagtgaggaagaatgtacatataaagttaatggaatataatatttgaaatcaagacaaatctggacaatgaaaattcatataactctt

SEQ ID NO: 20578 - DNA, 201 bp, Homo sapiens
  misc_feature (1)...(201): n = A,T,C or G, or insertion/deletion polymorphism (see Tables 1-2)
aagcaaatccaaattgacatcagcatctcccaaatttatttgacctcagaacaccttttttcccaaaacaccattaacatcctgcttctagaatgcacttngggaaatgatgctttttatacaatcaaaaaagtttcaattacatattcaacttatcacattaacacggaagtatgtgacatgtttttggaaggtttcctt

SEQ ID NO: 20579 - DNA, 201 bp, Homo sapiens
cacctccttcgggctctgggctacttgttatgccccaagtaggggctctgactcagcttctcagggttagactgaaaatatcacgaagaggcgctgaacayatatgttgagttcttaggattattacccaatctgtattaaattactggggtgaggcacagtggctcactcctttaatgccagcacgttgggagaccaaag

SEQ ID NO: 20580 - DNA, 201 bp, Homo sapiens
  misc_feature (1)...(201): n = A,T,C or G, or insertion/deletion polymorphism (see Tables 1-2)
gccataactgtgcaggcacattgcatatcaggagtttctgtgcagtgaactctaggctgaggatgcagattcattgcatcttgcctgttaatccctgctcngctgtggcctcccagagtcctgtgttggagcagatcctgaagctaaatccagactctggagaaaagaatatcgtggtcagttaggtatagacacacgagc

SEQ ID NO: 20581 - DNA, 201 bp, Homo sapiens
ttgggaactgaatttaactcagcatttactaaggcactgctatatacccagcaccaagcaccaagatttatttgatctcaaagtattttttaaattttaawatgtagcattcaaggctgggattaagtttgttttttgaagtaaaactaagcagtgacatgatatcggataaaaacatggccataactgtgcaggcacatt

SEQ ID NO: 20582 - DNA, 201 bp, Homo sapiens
ttttatagttatatatcataagggaaattgtttccaggccttcagtaaagggaattgccagattattttgggaactgaatttaactcagcatttactaagrcactgctatatacccagcaccaagcaccaagatttatttgatctcaaagtattttttaaattttaatatgtagcattcaaggctgggattaagtttgttt

SEQ ID NO: 20583 - DNA, 201 bp, Homo sapiens
  misc_feature (1)...(201): n = A,T,C or G, or insertion/deletion polymorphism (see Tables 1-2)
atatcaggggatcactgcttgccgaagcgtacataataaataaataaatacactttatgttgagttaggaccagatttaaccagatctaactttcattctntttaagctttaaatgatgtatctgaaaaacatcccgtcttaatccgaagtgatcctaaattattcgcatgattctcttcctattaccctatccatttctg

SEQ ID NO: 20584 - DNA, 201 bp, Homo sapiens
  misc_feature (1)...(201): n = A,T,C or G, or insertion/deletion polymorphism (see Tables 1-2)
taggaccagatttaaccagatctaactttcattctgtttaagctttaaatgatgtatctgaaaaacatcccgtcttaatccgaagtgatcctaaattattngcatgattctcttcctattaccctatccatttctgggtttgagtagttacaataacaacgacattaacaataaactgagcagatgagggaagtagaagag

SEQ ID NO: 20585 - DNA, 201 bp, Homo sapiens
atgacttgctttaattctgtattctcagtggctggtacacagtgggcactgaaaaaatagttttgaataaaaaattaaggaaaaaaagaatgattattagmtatagctagtgtttttaaggcagctatagtcattcacgtatttataactgagagcagagtgtggcttgccctctagtggtctgttttagcgaactttaat

SEQ ID NO: 20586 - DNA, 201 bp, Homo sapiens
aataacaacgacattaacaataaactgagcagatgagggaagtagaagaggacagtcctcatgaaagcccccttgtacttgtgagtgactgggacgtgggyatcgttactctttggccatgtcttctaggaagctttctgcaccatgtcaccactaggggataccggaggctttcctttgtcctggagaaagcagctgctt

SEQ ID NO: 20587 - DNA, 201 bp, Homo sapiens
  misc_feature (1)...(201): n = A,T,C or G, or insertion/deletion polymorphism (see Tables 1-2)
aattctgaaggactaaataacattaaaggaatgtattaaaaccattttcaaatctatatgcctatgtgtatatgaagagagaactagtacagagatatatntatatgacttgctttaattctgtattctcagtggctggtacacagtgggcactgaaaaaatagttttgaataaaaaattaaggaaaaaaagaatgattat

SEQ ID NO: 20588 - DNA, 201 bp, Homo sapiens
agtagaagaggacagtcctcatgaaagcccccttgtacttgtgagtgactgggacgtgggcatcgttactctttggccatgtcttctaggaagctttctgyaccatgtcaccactaggggataccggaggctttcctttgtcctggagaaagcagctgctttccaggtgtcctttgggactggaataaacctggaggttct

SEQ ID NO: 20589 - DNA, 201 bp, Homo sapiens
gactggaaggttgatccacttctaggccacctcaggttgtttgcagaattcatctcattgtgggccgggcgcggtggctcacgcctgtaatcccagcactytgggagaccgaggcgagtggatcctgaggtcaggagattgagaccatcctggctaacacggtgaaaccccgtctctactaaaaatacaaaaattagctgg

SEQ ID NO: 20590 - DNA, 201 bp, Homo sapiens
  misc_feature (1)...(201): n = A,T,C or G, or insertion/deletion polymorphism (see Tables 1-2)
gctagatagtccatgatttatttggagtgagaaaatgggccttgttttttcagacactatccccagtgacacataggccaaacataaaggagattgcctanccttagttctggaattctgatggagcaaggccttctctctggtgctttattagttcttggacaaggactgaagggttatgttgaataacacgttcactat

SEQ ID NO: 20591 - DNA, 201 bp, Homo sapiens
agcccccttgtacttgtgagtgactgggacgtgggcatcgttactctttggccatgtcttctaggaagctttctgcaccatgtcaccactaggggataccrgaggctttcctttgtcctggagaaagcagctgctttccaggtgtcctttgggactggaataaacctggaggttctgagcttctctcttttcctttttagg

SEQ ID NO: 20592 - DNA, 201 bp, Homo sapiens
tgacccagtcgttgttggagaatgaagccctcagcctgaagaaccagagtctagcaaggcagactgatccatcctgtaccgcatttggcagcttcaactcrctgggaggtcaccttattgttcccaattcaggtaattcctagaggtttaaattgcaaagaggcagcttgaaacatatttttccataccaaaatctttttt

SEQ ID NO: 20593 - DNA, 201 bp, Homo sapiens
cactgactttaccaatgtctaacttggaggagaattgtacaatagacacaataaacccaacatatttttgtctcaagtgccttgcttctggcatacattckttttcccttgacctacaaaaggtcaggttttacttctctttgtctttgaggctccagacgcttttgcagatcttgaatatgggtagaaggctagagatct

SEQ ID NO: 20594 - DNA, 201 bp, Homo sapiens
cacatttttagttggacttggcacgatgtcagaagcatacacgcagtcctatgtgtgcacactcacctactcacctactcattccctttgtgcctgccccygttccttcctgccttggctctgcctcatacataatcatcttatgcataaggaaatacaactatgaaatgttatgtcaattatagagattttatgtattgc

SEQ ID NO: 20595 - DNA, 201 bp, Homo sapiens
tgggaggctgaggttgggggatcacttgggcctaggggacggaggttgcagtgggctgagatcttgccactgaactccagcctgggcagtagagtgagacycctgtttcaattaataaattaaataaataaataaataaaagaagtatactgacccaacaacaacaaaaaaagtaacagagaaatgtatcttacgtgtcat

SEQ ID NO: 20596 - DNA, 201 bp, Homo sapiens
cagtgatggtgtattcagccacagatgccccctgtgaaagataagataatgttttctacctttttattgaaaccagtttttcgttgaaattgtttactctwataggtcattgttgtaaaatctaaaaggcaattccatttaaaagaaggaaaacaaatggactaatgagtttaggccaatttagaactctaaaaaatattt

SEQ ID NO: 20597 - DNA, 201 bp, Homo sapiens
tcataattgcaccatttagtgttatcccttgcattctgtgatatataaaaatggataggaactttaaaaaatatacaatcatttctttttagagtccacawttttggcaagtattttggaaggtttatgaatatctacgtagctttctcacatttttccaatggatgtttgctatggactgaatgtttgtgtctctccaca

SEQ ID NO: 20598 - DNA, 201 bp, Homo sapiens
tgaggccatgctgatatatgagctgtttacactgattcctcccaagggctactttgtttaccttccttgatttcttttaatgaaaaatttagaagaatttrgcaacgagacccgtggatggtaaataatctgcttccatgtttatctcagctgcgttcttcctataaaaggaattggcataattgctcacactgtatgttc

SEQ ID NO: 20599 - DNA, 201 bp, Homo sapiens
acccacagtgatggtgtattcagccacagatgccccctgtgaaagataagataatgttttctacctttttattgaaaccagtttttcgttgaaattgtttrctcttataggtcattgttgtaaaatctaaaaggcaattccatttaaaagaaggaaaacaaatggactaatgagtttaggccaatttagaactctaaaaaa

SEQ ID NO: 20600 - DNA, 201 bp, Homo sapiens
  misc_feature (1)...(201): n = A,T,C or G, or insertion/deletion polymorphism (see Tables 1-2)
taggtaaaaatagtaattacaaaagcaattataaatctttactatgttaaatatatatgcacacaactatgtattgaattgacagctatatgatagcaacntaaagaccatgaggaaagacggaggctgagaaatactccaatatttaaaaaaactcaagtttgcacagcttaccaattaagtatcaggagtctttcttta

SEQ ID NO: 20601 - DNA, 201 bp, Homo sapiens
ggatatagtaagtgcctttgaagaacttatgatatagaaggaggaataaaagaagtatgccaaggttgaggaggtaagtcagagggtgagaaatgccacartggctgacatgcaaagtgctatatgggagctcaggagacggaggcatcattactttgaggaaatctgaaaaggagctaatatttgatgattggccctaat

SEQ ID NO: 20602 - DNA, 201 bp, Homo sapiens
aattcctgtcagtctactcacatgatttttaggctcaggaaattctctctagcaaaagatacaatcctctcatatagtaagtgttatggttgcaatggggyttgtcaagggatttgtctgcattaataaaggtattccctggggtagtgggaaaacgtctcattgttgagcagagaccatcaccactttatgtatatttaa

SEQ ID NO: 20603 - DNA, 201 bp, Homo sapiens
  misc_feature (1)...(201): n = A,T,C or G, or insertion/deletion polymorphism (see Tables 1-2)
atcagaaattttaacacaacgaagtctttactgatactagtataaaagcaaaaattaattaaactgaaatttccaagcaaggtcaaagttctacatttgcnaggggacacattatagtataagcaaaaaagaaattaattaggtaccctactcttaaatatatatgttttgactgacacatattgcatttaataaaatatt

SEQ ID NO: 20604 - DNA, 201 bp, Homo sapiens
ccaaacttgagggtcattccaatttctaaactatcttcattggaatttaactttttaaaaaatgtctccaaagcgtcataacctcacttctattcatttcyttttacatctcttacatttgtttccctaggctttctgttcttgtgcttgagatcattattacttgatacggggcagtgacaaatgagggaagcaatttgt

SEQ ID NO: 20605 - DNA, 201 bp, Homo sapiens
cacactggagtctattagtgtaatcagttctcagcagaagattctacttttaaagttttttaagatttgtggttgacttaactgacataaaagaaagaacrattgtttctttgaaagtagctaagggtacccaagagtctcagtgtattcagtagtttagattctaacttgtttctgtgaaaatgtaagtagcatagtgtg

SEQ ID NO: 20606 - DNA, 201 bp, Homo sapiens; identical to SEQ ID NO: 3399

SEQ ID NO: 20607 - DNA, 201 bp, Homo sapiens
  misc_feature (1)...(201): n = A,T,C or G, or insertion/deletion polymorphism (see Tables 1-2)
tcctgggtgcatagcagtatcatctaaggaaacatatctcttgcttctggcatgatttttaatcacatgcccagggatctatccaatggtctaaaattccntatcacctaagcccacatagaaacggtgatcacagtttttaatcaaaaatagagacacacagtgaggaagaatgtacatataaagttaatggaatataat

SEQ ID NO: 20608 - DNA, 201 bp, Homo sapiens
agatcaagaccatcctggctggcacggtgaaaccccgtctctactaaaaatacaaaaaaattagccaggcatggtggcgggtgcctgtagtcccagctacwcgggaggctgaggcaggagaatggtgtgaaaccaggaggcagagttttcagtgagcagaggtcgcgccactgcactccagcctgggtgacagagcgagac

SEQ ID NO: 20609 - DNA, 201 bp, Homo sapiens
cttgagcccagacatttgaggttacagtgagccattattgcaccactgcactccagcctgggtgacaggacaagaccctgtctcttaaaaaaaaaaaaaawatatatatatatggaagagttaggtaaaatacgatagaaaagtcattgaagacagaaggtgtagaaactgcgtgttgtgtgcataggatgatacagggtc

SEQ ID NO: 20610 - DNA, 201 bp, Homo sapiens
agcaaattcacatcatggagtaatccacttctaaatagctggtgagcttgaatgagtgagttagcctctcacagttctagttatataatctgtaaagtgcygggcacggtggctcacgcctgtaatcccagcagtttgggaggctgaggcaggcggatcacaaggtcaggagatcaagaccatcctggctggcacggtgaa

SEQ ID NO: 20611 - DNA, 201 bp, Homo sapiens
ggcagagcagatccaggctccatgcttgtaaccaccacagcaggatagataatgacccccaaaggcatcaggtcctaatctctggaatttgtaaatattaaccttatgtggaaaaaggatctttgcagatttggttaagaatcttgagatggagagattttctgacattgcccaggtgggctttaaaggtcatcacaaatg

SEQ ID NO: 20612 - DNA, 201 bp, Homo sapiens
gcaagctgatgactgcagatataactgggtatccaattatagggtagcttacttcagggaattgtcccacctcttggtctaattactcagaaaataactcyaccagatgtcttcaaaatctcaagtggattgagttttatttgtttcagctcatgtatttgtatagatttcaaacaaataagctttaatgataaaaggaaa

SEQ ID NO: 20613 - DNA, 201 bp, Homo sapiens
gctctcaagggtgacactctataatgggaaatgtagtgatacattgggaagatcatggtttttaattgagatacacatgaattccagtttcagctctgctwtttactacctatgtgctcagggcaacttacttatcctccctgatgttgagttttgctgtgtatagaaatgggaataataatccatatccttaaatgacca

SEQ ID NO: 20614 - DNA, 201 bp, Homo sapiens
atgggattcaggatgtttttctggaagaagaaatacatttaaaacattttcatcagagggtaactcaagccatcagatttgcattttggaataataactcrggtagcagtttggaggctgttgggaataaggccagactggagatatggacacccattcttgggagatcagcgtgttaagtgtaggataatggatagtata

SEQ ID NO: 20615 - DNA, 201 bp, Homo sapiens
gagggtacccatagataaaagctaacttctggaatatgtaataaataatacgtaaaccatagacaaaaactagagaaaaatccatttcaagtgaccattgmaattataaaggaatttgatgtgtcccttgtcatatatatgtgaattccatcaaaagatgtgaaccaaacaatgtccattttaatgggtttatatttggtg

SEQ ID NO: 20616 - DNA, 201 bp, Homo sapiens
aatacaagatttctaggtggagggaacagcgtgaataaacacagaagcaaacaataaataaagaccctcggccgggtgtggtggctcacgcctgtaatccyagcactttgggaggctaaggcgggtggatcacgaggtcaggagatcaagaccatcctggctaacacggtgaaaccccgtctctactaaaaatacaaaaaa

SEQ ID NO: 20617 - DNA, 201 bp, Homo sapiens
aaatccatttcaagtgaccattgcaattataaaggaatttgatgtgtcccttgtcatatatatgtgaattccatcaaaagatgtgaaccaaacaatgtccrttttaatgggtttatatttggtggaactaaatagctcaaagtattgatatcagactggaaagaggttccaaatggtgtccttgaaaaggtctctgccctt

SEQ ID NO: 20618 - DNA, 201 bp, Homo sapiens
ataggcaaatggcctctccaacataccgaagagacaattatttcagtcacgccatctcttcctcacacccacgcttgaattggaaatttggggctgattarctcaaaaagccctttattactaaaactctgccttcttggcgccctgctaatgttcccaacatactctctcccatctcgctacttctctaaccactgttgc

SEQ ID NO: 20619 - DNA, 201 bp, Homo sapiens
gctgattagctcaaaaagccctttattactaaaactctgccttcttggcgccctgctaatgttcccaacatactctctcccatctcgctacttctctaacyactgttgcccagaaatacttcctcttgcaacacacctcctgaaggcctccttctccttcaggcctgcccccatcctgactcacgctcatgctcttccaaa

SEQ ID NO: 20620 - DNA, 201 bp, Homo sapiens
  misc_feature (1)...(201): n = A,T,C or G, or insertion/deletion polymorphism (see Tables 1-2)
actaagaacaaactttcctacaacctcacgtcattccctttcccattgctccacctgctctcattaactgccagtggatcttcctggtaacacctcacaangcctccagcgaagactgtacccctaacaaaccccaaggccaagaggaaatgtgccagtacttctcataccccatgaccctttctggggcatctcttcact

SEQ ID NO: 20621 - DNA, 201 bp, Homo sapiens
  misc_feature (1)...(201): n = A,T,C or G, or insertion/deletion polymorphism (see Tables 1-2)
ctaacaaaccccaaggccaagaggaaatgtgccagtacttctcataccccatgaccctttctggggcatctcttcactgcccaggctggatggttctactnctactcatgcccacttcagttcctttgcacagagctctgtggatcctgccctaccagtacttgccttgtggtctgtctttccatccattttattcccatc

SEQ ID NO: 20622 - DNA, 201 bp, Homo sapiens
agcatatctcatcactttaaagaaatcattttaaattatttgcatcattttacattacttaaactatcaaatctttgatgaggtatttctttgactaagtrtaaacacaaatctcttagactagaatgcatcaatcctcaactgtccacccagtacctgtcagtgtggcagaaaggaggtgaacacactggagtctattag

SEQ ID NO: 20623 - DNA, 201 bp, Homo sapiens
cgtaatccttttatttagctcttcttgacttacccgattcccacggcagttcttccatgtatcttctgctctcaggaagtccctggctgttttaaagcccrcatcttgcctagcagtgacctaaccactcaatgaaagctcccccagctgcggtcctctactctccaaaccttttacttcagcctcttctcacttcatctg

SEQ ID NO: 20624 - DNA, 201 bp, Homo sapiens
tgtcatgctcaaatttttccctgttagtaattcatgtttttaaaataagagttatgacagaagactaaacatctgagagacaggcactctaactttctaaytgaagacggtgaacctagctgtggtaaaaaagaggtggctatttaataatgtcactaacataaacataattaaatgacaacattttgatttttctgtgta

SEQ ID NO: 20625 - DNA, 201 bp, Homo sapiens
tcttctgctctcaggaagtccctggctgttttaaagcccacatcttgcctagcagtgacctaaccactcaatgaaagctcccccagctgcggtcctctacyctccaaaccttttacttcagcctcttctcacttcatctgactctgatgaaaaggatctctgcttccttgtttgtgctttaatccaattcctgaccacctc

SEQ ID NO: 20626 - DNA, 201 bp, Homo sapiens
aatattatatattatttaatagaggggtacttcctccatttcagaaaaatatactatgggttattactttttatctagctgttaatgattgatcctatgarttttctctttggattttttttttcatcagataaattataatttctcatctctccagttattaccaactctgaaaatgggtaatctgtggatattattgga

SEQ ID NO: 20627 - DNA, 201 bp, Homo sapiens
tagaatatatttctataaaactactacttcataaattttaatgaaaaaaataagtttgtgcttttctccactgtacatttgctgtattcgtaaagacaaawataattagaaagcaggaagaatagttagcaaactttttaccctttgctaacatttaaactctttataaaggaacagaaacaattaaccttcctcactgta

SEQ ID NO: 20628 - DNA, 201 bp, Homo sapiens
attggaaaaagcgaattttccaggaaccagaataaaaagtaactatgtccggctaacaaatggcatgcaatattgctttttcatgagcaagggttgattcwatcacttatatggaagggaaccattacttagttttatcagaaagcacaaaagagcactctaaactcctcacagagtcaaaacaagacttctaaaatgtaa

SEQ ID NO: 20629 - DNA, 201 bp, Homo sapiens
gactataatttgttgaccaaaggagactgtcgacttttatgcatgcagtgcacgcaggagtaaaatcctttcttcacatttatgaacccctctctgggtgytctctggaagagacagcatgtccctggtaagcaccctacatgaggtgacctctcatgtgggctgattgaagaagaggtcagttgtactgttcttctctga

SEQ ID NO: 20630 - DNA, 201 bp, Homo sapiens
atcacattaacacggaagtatgtgacatgtttttggaaggtttccttcaaataaaatattttgtttccagaagtatttctctttcatctatcaaaagcatrtctgtgactctaaccatatccaataacaaaggggatgcttgtgctttgtgttaaataaactttcccttaaaacataagaaggagaagaggaaacaaaaaa

SEQ ID NO: 20631 - DNA, 201 bp, Homo sapiens
  misc_feature (1)...(201): n = A,T,C or G, or insertion/deletion polymorphism (see Tables 1-2)
ctgatttctgaatgaagaattatatcttacttttctgagaaaagttgccttgctcttggcaaattgcgaagtcatttccccagtttccaaagagatgtttntgtctcattagtgcagtggcttatctgatggaaacaagttctctcctgtcatccaagtgacagagactaggggatctccactttcactgacttgtttcaa

SEQ ID NO: 20632 - DNA, 201 bp, Homo sapiens
aaattgacatcagcatctcccaaatttatttgacctcagaacaccttttttcccaaaacaccattaacatcctgcttctagaatgcacttcgggaaatgaygctttttatacaatcaaaaaagtttcaattacatattcaacttatcacattaacacggaagtatgtgacatgtttttggaaggtttccttcaaataaaat

SEQ ID NO: 20633 - DNA, 201 bp, Homo sapiens
tggctccgccgcccaaggtaagggggtccgccaagctccgcggccacctcccttagcttcttccttccctccttcctctcctcctccccagttctcttgayttcctcaatttgcctcgttgctttcaactggaaaccactctaaattccactttcccaactagtcaagaagctttgattataataataataattattatta

SEQ ID NO: 20634 - DNA, 201 bp, Homo sapiens
gtgtaatcagttctcagcagaagattctacttttaaagttttttaagatttgtggttgacttaactgacataaaagaaagaacaattgtttctttgaaagtagctaagggtacccaagagtctcagtgtattcagtagtttagattctaacttgtttctgtgaaaatgtaagtagcatagtgtgaaggctgtggagcagat

SEQ ID NO: 20635 - DNA, 201 bp, Homo sapiens
ctttaagtaccaataccatgctctatatttactactgaatatacgtacatttaaagaacttgtaaaaaaattttaattttgacatcagagttttcaattaygtatttgtaaccagtttggggaattagtaatagctctgttctcctctgtcccaattggaagattattattaggctgaacttatttatggtgtgttggaaa

SEQ ID NO: 20636 - DNA, 201 bp, Homo sapiens
ttgaagatcggaatttttatattactattgatcacaacctcatcataaagcaggcccgactctctgatactgcaaattacacctgtgttgccaaaaacatygttgccaagaggaaaagtacaactgccactgtcatagtctatggtgagtggcccttcagggtctcaatctagttcatgtttaactgcagtttctcgttgg

SEQ ID NO: 20637 - DNA, 201 bp, Homo sapiens
ttttaatcatgtttaaaaagaacaaaaagcaaatgtttcagtcaaagatttaattgaattcaaaatcagtttcaaactgtaatcaaaggaggcacaaggawagaaagctattcttttatctttcatttctatgtattcattaatagcaagcacaatatatacttaaaattgccagtctacattccacactacattgacttg

SEQ ID NO: 20638 - DNA, 201 bp, Homo sapiens
tatggatttatttctgggcgagctattttgttccattggtctgtgtgtctgttttcatgctagcattatgctattttgatactgtaactttatagtagatrtggagatcaagtagtgtgatgcctccagctttgttctttttgctcaagattgcattagctattcagggtcttttgtgattctatatgaattttaagattg

SEQ ID NO: 20639 - DNA, 201 bp, Homo sapiens
caacttatttttgtgtttttagtagagacagagtttcaccatcttggccaggctggtttcaaactcctgacctcaggtgatctgcccgcctcagcctcccraagtgctgggattacaggcgtgagccaccgcacctggccttccattaatgtttttcttcttcaatttatttctttcatgttttattgtttgcagtgtaca

SEQ ID NO: 20640 - DNA, 201 bp, Homo sapiens
aagtctattgaaaaggttgagtttggtatatcagagcttttctttttcccccgtcttcaggtgattaatgaaaaaggtgttttcctttcattatttgcaawgacttaaatcctagtataaatagaccagaaattaaccaagagcaaggttatatttggagtaagtttaaaaacacctaggagaaacatacgtctatgtgga

SEQ ID NO: 20641 - DNA, 201 bp, Homo sapiens
agcaaggttatatttggagtaagtttaaaaacacctaggagaaacatacgtctatgtggaaataagtcatttctgtcccagtatccaaagggtacaatacmtgacagtctctttttggaataaagggttttatactaaactctgagattcagaacctaaaaaaggagttattttcatacattatgggcagtgtatgatatt

SEQ ID NO: 20642 - DNA, 201 bp, Homo sapiens
tttcttatggcaacagtagaaaactaatatagaagtttaaaaataatgtgttaacaggagaaaagaaacacaagatgacttcaaaagtcctagaaaaacckacaaagtcctgttcctaatacatagatgtgagagagaactgttgtcctaagagcacgcccagaggtagacaagtgacacgctgcttgcctgagcaccacc

SEQ ID NO: 20643 - DNA, 201 bp, Homo sapiens; identical to SEQ ID NO: 3395

SEQ ID NO: 20644 - DNA, 201 bp, Homo sapiens
ttgccagagaacagcagaggcagaaccaccaatggaaagcagaagcagcaacaggtggccgattttgcacaaaatgcaggagagaaatgtctcctagtgcrtaagggaaaataaacagcatgattgagtaggtcagctcttagcttgtcctctcttcctgtattctctctttttttcctctccttttctaacatttcaacc

SEQ ID NO: 20645 - DNA, 201 bp, Homo sapiens
ttaagtcttcctaaatcttctgacattaaatatattttgttcatattctattttaaggtgtgtgaaatatcctaacctttgtgattcaagagcagcctgtytggaagtggttttagacctgagcacactgtgttgtggttacatgtttacaggtcaccccccaacccccatgaaccattagcccattagcagtttaaagca

SEQ ID NO: 20646 - DNA, 201 bp, Homo sapiens
cattttataaatggtctgatagtcagacctccttttccttcttattcttcttctttctcctttccttggactagaacactagcccataccctcaaggtatratttccttgtggtgatgacttaaagatccaaatgaactatttcttatgaatgaaagtccaagagcaattaacatgggaaagttactttaagcactttaca

SEQ ID NO: 20647 - DNA, 201 bp, Homo sapiens; identical to SEQ ID NO: 3397
  misc_feature (1)...(201): n = A,T,C or G, or insertion/deletion polymorphism (see Tables 1-2)

SEQ ID NO: 20648 - DNA, 201 bp, Homo sapiens
tgctcaatgttttgactggtagactattctggcaaacatgtttatagcctctgctctaagcatgggtgtgtcctgatgggcagtttgtctttccccagggyttatgtcccattggaagggagaaaaaagtcaggttccttccagccctgtgctgcagctttgtgtcactcctgggtgatggagaaatggcgagcttaagtc

SEQ ID NO: 20649 - DNA, 201 bp, Homo sapiens
gtaagtgattagcaaggctttgtgaattagcgatagcttcttcggaagtaaattttcctgctgccctgctaagtggccctgctcataaatccttccttccyttctcgccagatgcctcccatccctgaggttctgctctggttttcttatgcacacctccagagttcatctgtctgtctatttaaaaaggaatctccaccg

SEQ ID NO: 20650 - DNA, 201 bp, Homo sapiens
aaatgtatgtgactgtacacaggaaagaaactatgaggtaaatatgctttttctggtgcactgactttaccaatgtctaacttggaggagaattgtacaayagacacaataaacccaacatatttttgtctcaagtgccttgcttctggcatacattctttttcccttgacctacaaaaggtcaggttttacttctctttg

SEQ ID NO: 20651 - DNA, 201 bp, Homo sapiens
  misc_feature (1)...(201): n = A,T,C or G, or insertion/deletion polymorphism (see Tables 1-2)
aggagtgtgttctgtggccccactgtctttaaaatggcacttggtactttctatccaaaaaagggctcctccaagccagtctaggctttttccccactagngagaattcttcaccatgacttttcaaatcattgctgaagaaacaaaaaactgagcctgattcttgggctgactcccatgaagactctgcactcaaaatgc

SEQ ID NO: 20652 - DNA, 201 bp, Homo sapiens
gtctttaaaatggcacttggtactttctatccaaaaaagggctcctccaagccagtctaggctttttccccactagggagaattcttcaccatgacttttsaaatcattgctgaagaaacaaaaaactgagcctgattcttgggctgactcccatgaagactctgcactcaaaatgccgtgttagatttcctgacttcaag

SEQ ID NO: 20653 - DNA, 201 bp, Homo sapiens
tgctgggtgatccaccaactgacctgcttagcgtgttaatcttactagtttactatactatttagcttcatgagagcaacttattctgaacagtgctcaasagtccagcctcctgaaacagactgtttgggtttgaattctgactgtaccattcactagatatattgccttagttaggtaagtcacatcactgtgcctcac

SEQ ID NO: 20654 - DNA, 201 bp, Homo sapiens
gactaaacatctgagagacaggcactctaactttctaactgaagacggtgaacctagctgtggtaaaaaagaggtggctatttaataatgtcactaacataaacataattaaatgacaacattttgatttttctgtgtaccattatgaaaaactgaacatcaacctccctgtccaacttgattcattcattcacactgggt

SEQ ID NO: 20655 - DNA, 201 bp, Homo sapiens
cctgccaagaaaactgataatgctcttcatatcctctggcagtctatgttgattgtaggaatggggtgtggattatacattgttgggtacaattacctccrggaatacaatgcatcttcttttagacatcccagggagataatttcgacataatgaagatctatagtaatcagataattactatcgattgctctttagacg

SEQ ID NO: 20656 - DNA, 201 bp, Homo sapiens
ctgaacccaggaggcagagcttgcagtgagccgagattatgccactgcactccagcctgggctacagagcaagactgtctcaaaaaaaaaaaaaaaaaaaatcctggaaaaaaactgctcccagatttctgcatttgagccacatattcctcttaggtcgccaagatttcattttatttttaattttcttttttatttttt

SEQ ID NO: 20657 - DNA, 201 bp, Homo sapiens
gagagcagcttagtaactggatgctttctgctaagattattccatgttaattttaacaggaagcagaaacatattcaaaaattgatacgacaaaacgctawgcacattctaatttttaaagaaattaacaataaatggcggaagtagcatgatagaagcaaacacatataaagagttatgagctatcataatcttggctac

SEQ ID NO: 20658 - DNA, 201 bp, Homo sapiens
attattaaatgtcttgaagtagtcttatttgggttaaacctgcttgatgttttgtagccttcttgtgcttgaatgttgatatctttctctaggtgtaggamgttctctgttattatccctttgaataaactttctacctttatatctctctctacctcctctttaaggccaataactcttagatttgtccctttgaggcta

SEQ ID NO: 20659 - DNA, 201 bp, Homo sapiens
  misc_feature (1)...(201): n = A,T,C or G, or insertion/deletion polymorphism (see Tables 1-2)
gatgttaattattttatagtgattagaataaattaacataggggttttttatatattaattaaaagttcacaatgggagcagctaagcaataaaatgtgantgaatgcttattttactatgaactttaggtttattggcagaactgtcttgaaaagttcaaactttttagagttgtcactttttaatgcctttttttcttt

SEQ ID NO: 20660 - DNA, 201 bp, Homo sapiens
caagcatttaattaggcttcctgtaattgctttaagtaaaagtgggggagaatgagacctgaagttatcatcttgggacaccaaatatttggatgtggttmtaatatcctgagcatattagttgctgctctgcatcgtataaagaaccattatagttctaaggaaacacatattgcaaatttatcagccctttggtgactg

SEQ ID NO: 20661 - DNA, 201 bp, Homo sapiens
tttgtgcaatatttcatctataatctactgtcaccttctggggagaaaaaaatagctcagtctgtcatccccaaactgtgacattccttttatgactgcawagtaccctgtggagatggtagatgccaggctttttaagactttacaaagactggaggccaactgctttcaaacagaaatatttaccgagaagctaatcca

SEQ ID NO: 20662 - DNA, 201 bp, Homo sapiens
gtggagcataagggatatgataaaaatttgctacaaataaacgacagctttgttgaacaggaacacatttttttttttttagattttacaacaatagaacrggccaaatatccttgtaaattacattaatgagacagattgctacttttaatggaggctctgtgctctacattgtgccttatgcaaatttgccagttaata

SEQ ID NO: 20663 - DNA, 201 bp, Homo sapiens
acttattcaatgagagagctgacagaagtgatccaaatcaataacgtgctttgggtttggggcatgtcattataggaaattttacatcttgagagacagaygggaggacagctcctagaagaacctaaggctcttcattttaaaggcagcacccacaacctgcgcctgtcaattcacgatatcgcccattccctctggaag

SEQ ID NO: 20664 - DNA, 201 bp, Homo sapiens
ctttttgaaaaacaagtcttaatttttatgacatgaattttaagaattatgttctaacttgtaaaaacagatctgaatttcaagtaaaggtttaatttaargagcgtgcacatggagtaacttctccccatgcatcccttagcgtgccatgttcccccatcctccatctgtctctcctccctttctgcttctttctcagca

SEQ ID NO: 20665 - DNA, 201 bp, Homo sapiens
ttgtcgtgtaactgctcagattaaatgtaagtctagcacaaaatgtttgtccatataagtcaaaaaatgttggccgagcacacccctataatctcaacacyttgggaggctgaggctggaggccggcttgaagccaggagtttaaagaccagtctgggcaacaaagcaagaccacatctctaccaaaagaattttaaaaat

SEQ ID NO: 20666 - DNA, 201 bp, Homo sapiens
tttaaaaagagagagacagccgaataggaacagctccagtctacagctcccagcgtgagcgacgcataagatgggtgatttctgcatttccatctgaggtrccgggttcatctcactagggagtgccagacagtgggcgcaggtcagtgggtgcgcgcaccgtgcgtgagccgaaggagggcaaggcattgcctcactcgg

SEQ ID NO: 20667 - DNA, 201 bp, Homo sapiens
tgcatttccatctgaggtaccgggttcatctcactagggagtgccagacagtgggcgcaggtcagtgggtgcgcgcaccgtgcgtgagccgaaggagggcraggcattgcctcactcgggaagtgcaaggggtcagggagttccctttcctagtcaaagaaaggggtgacagacggcacctggaaaatcgggtcactcccc

SEQ ID NO: 20668 - DNA, 201 bp, Homo sapiens
actgaagaatgcaacacatttatcaaattcctggacgtttgttgacttcctactctgcttctaaaattgtaatgattttcaggtgatttaagtgcaatttstagtcatttagtgtatatgtgtgtttctgtgtatatgcacatactatttattatttgttatttgtattataccttgcatgtataatatttattaatatct

SEQ ID NO: 20669 - DNA, 201 bp, Homo sapiens
tcttcctataaaaggaattggcataattgctcacactgtatgttcctctggtgtgctgcttcatttatatgctttcctattctttttatgagggctgtgayggagcgggttagcatttgacaacaggctgctgctttgcagaataaatgagcttaattcctggtgtgattattgccattcattttatcccattcgaagctt

SEQ ID NO: 20670 - DNA, 201 bp, Homo sapiens
aagaagccattcttcctaagaagaataacagcattcattcttttcttatcactcaaagcaaggcattatgttgattggttcaatagagattgcttttgtcytcagaaataatgctgtgttgttcctgtccctgaactacaggaacctactggcatcgatttgccgctgctggatcctgcgaacaccatcaccacggtcacg

SEQ ID NO: 20671 - DNA, 201 bp, Homo sapiens
  misc_feature (1)...(201): n = A,T,C or G, or insertion/deletion polymorphism (see Tables 1-2)
aaaaatcagctgcacactggaatcaccagagaggccttaagaactaacgccagggtcacacctccagagattctgatggaagtggtctgggggtagcctgngtcttgggtgttaaaagctcccgggtggtactaatgagcggttaagggtgagaaccaatgtcttagaacttctgcagaattctctggggcgggagcttct

SEQ ID NO: 20672 - DNA, 201 bp, Homo sapiens
gaggccatgactggaggatgctggcccataagctgaacctggacaggtgggtatggtctggccccaagactagcttctttctgttagtgccctccaggacygataactattagacgtagggttagcttcatttttttttccatccacacatctatttaatttttcattttgcaaatatgcattaagctctgtccttgtacc

SEQ ID NO: 20673 - DNA, 201 bp, Homo sapiens
gcatatctgtgactctaaccatatccaataacaaaggggatgcttgtgctttgtgttaaataaactttcccttaaaacataagaaggagaagaggaaacamaaaaaaaaaaaccaaaacctcatgtaacacttctttttgctaaatgattcagatttttcctcttgagtttatggttcaaacagcctttgaacccttcttt

SEQ ID NO: 20674 - DNA, 201 bp, Homo sapiens
  misc_feature (1)...(201): n = A,T,C or G, or insertion/deletion polymorphism (see Tables 1-2)
ggtcatgttgattttggaaacggaaattttgggtcagatattttagtgtttaagacatatagtataagatagaaaacaaatacagtttctgaaatagttanattgataatttaacatttatctcatttgttataatgtttattatttcactaaagagaggtgtttatcaaaagaattctttcttgaaaaatatagttgctt

SEQ ID NO: 20675 - DNA, 201 bp, Homo sapiens
atatggcaggccactctatcctggcctgtaaagtttccactgagaagtctgctgccaggtgtactggagctccattttatgttgtttttttctcttgctgygtttaggatcctttttttatccttgagtctttgggagtttgattattaaatgtcttgaagtagtcttatttgggttaaacctgcttgatgttttgtagcc

SEQ ID NO: 20676 - DNA, 201 bp, Homo sapiens
attttttttccttcagcactttaaatatggcaggccactctatcctggcctgtaaagtttccactgagaagtctgctgccaggtgtactggagctccattktatgttgtttttttctcttgctgcgtttaggatcctttttttatccttgagtctttgggagtttgattattaaatgtcttgaagtagtcttatttgggtt

SEQ ID NO: 20677 - DNA, 201 bp, Homo sapiens
agattttttttccttcagcactttaaatatggcaggccactctatcctggcctgtaaagtttccactgagaagtctgctgccaggtgtactggagctccaytttatgttgtttttttctcttgctgcgtttaggatcctttttttatccttgagtctttgggagtttgattattaaatgtcttgaagtagtcttatttggg

SEQ ID NO: 20678 - DNA, 201 bp, Homo sapiens
  misc_feature (1)...(201): n = A,T,C or G, or insertion/deletion polymorphism (see Tables 1-2)
atatttaaatacatgaaaaagaatgagacaaaactattacttaaaaaacacaactttgcattgcattaatgaattaaaagttatgtagttgaaagatgagnattcctctccccctcatgatcctcatacctgggagatagtggcaaaaagggcatatcaattaaatacctttgaatctatctcatataagaatattttgga

SEQ ID NO: 20679 - DNA, 201 bp, Homo sapiens
  misc_feature (1)...(201): n = A,T,C or G, or insertion/deletion polymorphism (see Tables 1-2)
tcttcctgaacgcccttcctcttagcggcagagccttcttgttctccctgttagggatgtgtccacatattcagcggctctgcagtccccgcagccacccntctgcgggtgtaggtcacagttaggcactgcagcctggctgacactccaatcactggccatattcatcagccctttctttagtgctctatgtggctagaa

SEQ ID NO: 20680 - DNA, 201 bp, Homo sapiens
ccaagcccagggttgtcattgttgttattttcatagaaaaagactaaggataatgtaacagaaacaattcaaatggccagaaaatataggaaaatgtgtcwttgttaacagttaattctattaatcagcttgagatatttgtaaggtaaaattgaaatggtatttagattagatgttggaaaaggactgtatcacatctta

SEQ ID NO: 20681 - DNA, 201 bp, Homo sapiens
  misc_feature (1)...(201): n = A,T,C or G, or insertion/deletion polymorphism (see Tables 1-2)
aaggactgtatcacatcttaacttcatgggaagaatcaatcaaacattaagtgaattattatacattgcatgccttgcactatccttggaggaaaaagatnctttgcattaagaagtcttcccttcaagtctttctgaaaaagtaaatgatctatttatatcttcagagtacttaactaagcagaataactatcattgtca

SEQ ID NO: 20682 - DNA, 201 bp, Homo sapiens
  misc_feature (1)...(201): n = A,T,C or G, or insertion/deletion polymorphism (see Tables 1-2)
tgctatttataatttttgtgaataataagcatctttcatatacctatgtggcagttagaactctaggatggaccacatgatggcttcctcctgatatacanactctgtgtaatcctatcccagtaatagtgggtggacccaggaatgtgatgaagtatcactcccatggttatgttacattgtttgtcaaaagggattttg

SEQ ID NO: 20683 - DNA, 201 bp, Homo sapiens
ctaccctgaaaatgagttttaatcttgaaagaccttagaagaggtctcactgaagtcttttccattcttcaattagctctggtaaggaaggctatcaattkttgtggttcaaaggaaagaaatgaaaaacaaattttaaaatttttgaaagaaaaaagagatggaaaagacaaactgaaactacatatttgtcagctccat

SEQ ID NO: 20684 - DNA, 201 bp, Homo sapiens
acttagagagaggtctttctttgctggcaaagaaggagtgcatttagactaatcattaaaacccattacctaacaaagtgcatgttcttagggaacacagwgatacttgccaatgaattaatcagcaaaataggctaggagaaggtgggattagcagtctcagaaaagatcagaatccatgagatgccaaagcggtttcac

SEQ ID NO: 20685 - DNA, 201 bp, Homo sapiens
aatcccatgtcttggctattgtgaatagccaagtgctgcagcgaatgtaggggagcagatatccctttcaaatactgattcatttactttgggtatacacytattagtggaactgctggatcatatggtagttttatttctgttttgttttgttttaaggaaacttcatacagtttttcatatggctgtattaatttacat

SEQ ID NO: 20686 - DNA, 201 bp, Homo sapiens
  misc_feature (1)...(201): n = A,T,C or G, or insertion/deletion polymorphism (see Tables 1-2)
taaaaatattctggccctatattaataatgagcagcttggagcctcatttccttgtaaacttgcattgaaattatgtaataaaaaatttaagtgacggagnaaatgtacacacacactacacaaactgatcttagattggaaattgtggactcttttctaaggatagattctcctaggttagcaccacacaaaaagctgtt

SEQ ID NO: 20687 - DNA, 201 bp, Homo sapiens
cactagaaatccccccccaacccagttacacaatccagtgaatattcttctcagttctagacaaaacaaaaatataacaaagcacagatcctcatttgacacaggctgccacacagagccaagttcctaaaaactatggccataaaaaggaattgagtcaatgacctagaaatgcttccaagcaaatcccttgaaccactc

SEQ ID NO: 20688 - DNA, 201 bp, Homo sapiens
  misc_feature (1)...(201): n = A,T,C or G, or insertion/deletion polymorphism (see Tables 1-2)
tttttgtgcactcacaatattgtgcaactaccaccccatctagttttgaaactttttaaccccgcagaacatcctctaccctttaagtagtaactccatanttctccctcttcccttcttctggcaaccaccaatgtgctttctgtctctatggatttgcctattctggatttcaatcgttttaattttaaatatgtacaa

SEQ ID NO: 20689 - DNA, 201 bp, Homo sapiens
  misc_feature (1)...(201): n = A,T,C or G, or insertion/deletion polymorphism (see Tables 1-2)
tcaaatcccttccttcctgtatattttccgtaaaatctgattattttgcatggaatagtaggaaatatgatcatatgaaaacccagtgtcaaccacattcnatttcctataagacagcttccttttaatgggcagattgcccacaacaaagagtagtgagtatcatttcagcaatggataagataagcactttcttttacc

SEQ ID NO: 20690 - DNA, 201 bp, Homo sapiens
  misc_feature (1)...(201): n = A,T,C or G, or insertion/deletion polymorphism (see Tables 1-2)
tttgcatggaatagtaggaaatatgatcatatgaaaacccagtgtcaaccacattcaatttcctataagacagcttccttttaatgggcagattgcccacnacaaagagtagtgagtatcatttcagcaatggataagataagcactttcttttaccttaccctctttctttcacttcatgtttgaagataatgaatgctg

SEQ ID NO: 20691 - DNA, 201 bp, Homo sapiens
aaatttattctatgcctgggattaaacactttattttctgttgtaactatatatatgtacagatcattcacttatttaacatatattaactggacaaatawtatgtgccagttactgtactgatggatacagaatgcataggacagggcctatgctcaatgaacaactattttatctctagtcttagtatcttctgaaggg

SEQ ID NO: 20692 - DNA, 201 bp, Homo sapiens
  misc_feature (1)...(201): n = A,T,C or G, or insertion/deletion polymorphism (see Tables 1-2)
atgggctttaaagtttaaaagaaagttaggttaagcaatttatgagctctaaaattaaaatctatgtattcgcaaaacaaatgaatttcccaaataagttngacatacatttaagagacttgtcatgatggttgacaatacatgagcgtccaagaaaaatatatcgaagtttgaatatttcaaactcccagaatattcaaa

SEQ ID NO: 20693 - DNA, 201 bp, Homo sapiens
ttgcatcttgcctgttaatccctgctccgctgtggcctcccagagtcctgtgttggagcagatcctgaagctaaatccagactctggagaaaagaatatcytggtcagttaggtatagacacacgagctggaagggaatgtagtggttccaaatatttgccattcctactctaaagaacaataattcagatcataaccact

SEQ ID NO: 20694 - DNA, 201 bp, Homo sapiens
gtctcagctacttgggggctggggtgagaggactgcttgagcccaggagttggaggccagcctgggcaacatagcacgaccccatctctaaaaaacaggcrggcttgatgggtcacacatgtaatcccagcactttgggaggccaaggagggaagatcgcttgagaccaggaacttaagaccagcctgggcaacatagtga

SEQ ID NO: 20695 - DNA, 201 bp, Homo sapiens
cttgggatccgctaagtgctacaagtgtgtagaggaagaaaaatcagagaggaaactaatattttaaaaaggaaattgtaatgttgcagagccatgtagayaaatatccttaaaatgatgacatgcaacactgtaaaaaaggacaaaaaagagaaccaggaagaggggtggcagttaaaccatctcattggtttggactgt

SEQ ID NO: 20696 - DNA, 201 bp, Homo sapiens
  misc_feature (1)...(201): n = A,T,C or G, or insertion/deletion polymorphism (see Tables 1-2)
aatagaaaattatgtttactttttcataattgcaccatttagtgttatcccttgcattctgtgatatataaaaatggataggaactttaaaaaatatacantcatttctttttagagtccacatttttggcaagtattttggaaggtttatgaatatctacgtagctttctcacatttttccaatggatgtttgctatgga

SEQ ID NO: 20697 - DNA, 201 bp, Homo sapiens
gaacctgagtcttttataatgaggagtagacaggcctgccatttgctccagaagtagacattgtctttatctttcaaggtaattgctatacaaacatccaygcataaacatgagaaatccatggataattgtcttccaacaatattaacaataataacaactgctaccattcattgagtgttcaacgagggtacccataga

SEQ ID NO: 20698 - DNA, 201 bp, Homo sapiens
agcagtgagatttccatcaggaacatatgaaattacagccattctctgtcattatttttctttttaggacctcagatccctcttcactttttatagggatrataccttgaagtattgctaaaggatctcctacatgattgactttttaaaaaacttgctgaataccaagaaactttgaggtgggatggattgacatttata

SEQ ID NO: 20699 - DNA, 201 bp, Homo sapiens
tattgaaatgtaatgagtaaacctcaaaggcaagcaggacacctcctaaaactctacctatctcttttttggccaagtatctgatactaatgtaaagacarggttttaatgcccagacacctacatatagactttagagggcataaaaagtaccatatcttatatggtagtttaaagatatttcagatttcattttaattc

SEQ ID NO: 20700 - DNA, 201 bp, Homo sapiens
gttcacatttcctcacaaattagaaacaatggcttctatggatagagtatggtattagaagtaaagttcttaagcaattattgtgcactcatattgcatcytaggctgaatgctatttgttagaaacggaatgtaaccaggcagtttaagccctacaggaagacagaagtagaaccatggaattataattcactttcttaa

SEQ ID NO: 20701 - DNA, 201 bp, Homo sapiens
cagtgtggcagaaaggaggtgaacacactggagtctattagtgtaatcagttctcagcagaagattctacttttaaagttttttaagatttgtggttgacmtaactgacataaaagaaagaacaattgtttctttgaaagtagctaagggtacccaagagtctcagtgtattcagtagtttagattctaacttgtttctgt

SEQ ID NO: 20702 - DNA, 201 bp, Homo sapiens
tcaagatataatttatatctgactgtagtaattcagggacatatcatcatcattcagttttcaagtgcttatattgttaaatgcacagagcaaatataagktgttcgactaatttgtggtgttaatgttagtttcctttggtgccacatgaaggttcttacatatcatgctcttaaaaacactataaagtggtttacataa

SEQ ID NO: 20703 - DNA, 201 bp, Homo sapiens
catacttaaatcataattataggaaaagattgaaagttaagaaatggaacttacagtattgttgagtatgtaggtatgtatgtatgtatgtatgtatttatttagagacggagtcttgctctgtcgccaggctggagtgcagttgcactcggctcactgcaacctctgacttcctggttcaagtgattctcctgcctcagc

SEQ ID NO: 20704 - DNA, 201 bp, Homo sapiens
ttgtttgatatttcttcactgggtattttaacacacatctatccttttgaatttcaagggcattggaaattttgaataagcctgtaaataaaagttcacgyccttattcttacaaaataaacagaaaacatcctcttaatgtgattctttctgcacagctagacttattttcagacttaacagagacacttgaggcctaaa

SEQ ID NO: 20705 - DNA, 201 bp, Homo sapiens
  misc_feature (1)...(201): n = A,T,C or G, or insertion/deletion polymorphism (see Tables 1-2)
aaattttgaataagcctgtaaataaaagttcacgcccttattcttacaaaataaacagaaaacatcctcttaatgtgattctttctgcacagctagacttnttttcagacttaacagagacacttgaggcctaaaatacctctaacctagctggtcttactctatgttttaaggctatttggaatttaaaaagagaaaaga

SEQ ID NO: 20706 - DNA, 201 bp, Homo sapiens
aaggaaggctatcaatttttgtggttcaaaggaaagaaatgaaaaacaaattttaaaatttttgaaagaaaaaagagatggaaaagacaaactgaaactayatatttgtcagctccatgaaaaaagaaagagatatctaacgggaaaagcagaaaattctactgtatgtatttttcaacaatttttttacttgacagaaca

SEQ ID NO: 20707 - DNA, 201 bp, Homo sapiens
  misc_feature (1)...(201): n = A,T,C or G, or insertion/deletion polymorphism (see Tables 1-2)
atattatgacttcaatattctcagtgatgaacatgcagtaacttcagaaatgttttgtgccttaagattaatataataataatttctgtaatggtcataanttctaaaaatatatgttttattttatgtatatttgacttttaaccttgaacaaatcagaaactaaaaagataagcctggttttttaatcaaagctgatta

SEQ ID NO: 20708 - DNA, 201 bp, Homo sapiens
  misc_feature (1)...(201): n = A,T,C or G, or insertion/deletion polymorphism (see Tables 1-2)
tctgggaacattgaacttagaaatgaacatagtattaacatcttattgcccatgttacttaaaatattaaaagtcagtcatttcttcagtgaaaataattntagtcatagaaaatgttctaatttgcttttaattttctaaacaaataaatctcaacctcatatttgcatagggaactgaatcttttaatagtatttgtat

SEQ ID NO: 20709 - DNA, 201 bp, Homo sapiens
attgcagaagaccagaaaccacagatcttggagtgtttgaatagaacaattacgagaacatgtgacatagaatacaggatagtctccccagcagttccaarcacagataaaaactcactattaggagaaaaagaaagaagaggttaagattaaaatattgtaatgatttcaaaaattattctggggactataaagcccttt

SEQ ID NO: 20710 - DNA, 201 bp, Homo sapiens
ctgttgctttcctgtcctatctcctttactggcccagtgcacacatcccccagctgctgtcctgttggcggctaaaggctcacagctgcccccttctcccytctccaaggaatctcctttgactgaagcaagagctgctttgcctggtaggtttcctcaaggtgagaacaattctgttgggcagttcatgctccagagggt

SEQ ID NO: 20711 - DNA, 201 bp, Homo sapiens
  misc_feature (1)...(201): n = A,T,C or G, or insertion/deletion polymorphism (see Tables 1-2)
tttccttaatgtatatttatgatgagaatttccaatttctctactttaccaaatagtaactattagggttattactatatcactattgacttatggttaanatatcgagattttacattttgaagcatttggagatgaagggataaacttggtgaggtttttcagtaacatttcagaaatgacagactactttttcttata

SEQ ID NO: 20712 - DNA, 201 bp, Homo sapiens
cacctttcagcagcagttttcaattttcacttttttttctgaaaagtcctttctaaatacaacttatgaagaataataagccatatgataagatgctgtaycttcgatagaaacttgtaatcatgttataaaggaactgttaaatgtcaattgatgatgccagcaccacttttagaaatgcacttagcgttgttattttga

SEQ ID NO: 20713 - DNA, 201 bp, Homo sapiens
aagaaaatatgcactacagaccatgaaccaagaaacaaacacaggaggataacagtttcagataaatgagaagtcttctcttcactagttttctgttatgwaccagatgcatttttattgtaaaacacaatggcaagaatgtgctttaggatatagtcataaaacaaagcatccctgcccttcatccagcaaactcttaat

SEQ ID NO: 20714 - DNA, 201 bp, Homo sapiens
aaatgtttaattttaagtacagctactcttgctttcctttgcttatggcttactgaatgatctttccttttgctaaaataattaatactatataattctgmtttgaggctagaaaataagaaactcaaagatcattacaactggtaagcaaagttgtgcatggggctgaataaaacaactcaaaaagaatgattattcaaa

SEQ ID NO: 20715 - DNA, 201 bp, Homo sapiens
ctgttctctaatgtatgctaggttctccaattagtgccaacagcaagtgtgctctattaggccttaactgcgtttaacacttttctgatttaggtcatggytttgcagaagcagcagagggagtcactctcagaagaaacattaaaattacaggctgcaaccactttaggaagataatggggaaaattgtgggggttgaga

SEQ ID NO: 20716 - DNA, 201 bp, Homo sapiens
  misc_feature (1)...(201): n = A,T,C or G, or insertion/deletion polymorphism (see Tables 1-2)
ctttggaagaagactctgtgaggacatcaggagctgtgatgttactatgcattcgtaggaaaattctgagcatttttctccattttccttctctctgattncttttattgcatcccaaactgggtatgtttccagctggatggtatccagctggtcatctgcggatgtgaattgtctgaagggaggcgtgaacttaattac

SEQ ID NO: 20717 - DNA, 201 bp, Homo sapiens
gcgtctataaagcaccttccaagaacttaagtaagaacattaatttgtacctgtattttaatgcagaagtagaattccatctctttcagtgcttatgagtytggtgttttaattccaccccaaattacctaaattctacaaatatttattaacacacagggagtagtattattctaagagtttttcgactaatgatcatgc

SEQ ID NO: 20718 - DNA, 201 bp, Homo sapiens
ttagaattattgttgagacttaaacataactgttctctaatgtatgctaggttctccaattagtgccaacagcaagtgtgctctattaggccttaactgcrtttaacacttttctgatttaggtcatggctttgcagaagcagcagagggagtcactctcagaagaaacattaaaattacaggctgcaaccactttaggaa

SEQ ID NO: 20719 - DNA, 201 bp, Homo sapiens
cataaaaaggctaacagtgggagttagtgagtccaggtatattgaaatcttatcctcatactgttcttgacaatgttcatttattgaaatcctacttagaragaaatgcttcaagatagtttacgaaaacacttctcaataagagaaataaatttaaataagtggataaaaaaggtaagaaaatggggaaaataaagttat

SEQ ID NO: 20720 - DNA, 201 bp, Homo sapiens
tgccactctccgcagccgcttcgtcccctggtctgtctcgcctcggcttcagcgggcaaacccacagctggtctcctgggcgctgatctccctgcaatccktgcttacataaggcgggcgggcgtgctcccgcccccggttaccccccagaggagttgtgctgcgccctctacgcctccttggcgagcgccttcgcgcacc

SEQ ID NO: 20721 - DNA, 201 bp, Homo sapiens
ttgcagaatgagtttccgtcgagcttttagtttctgttccactgcaaaggggtcatacgcgctcagaacataaagcagtctgactggcgctgacaaccccrggacagcagccggctggggcagtgcaaaagcttcatgccttcttccccaaccaagaaggacttcagttcgagcccgcaccggcttcgtcaaccgcgagac

SEQ ID NO: 20722 - DNA, 201 bp, Homo sapiens
atggagaaatggcgagcttaagtctatggaaggagtgtgttctgtggccccactgtctttaaaatggcacttggtactttctatccaaaaaagggctcctycaagccagtctaggctttttccccactagggagaattcttcaccatgacttttcaaatcattgctgaagaaacaaaaaactgagcctgattcttgggctg

SEQ ID NO: 20723 - DNA, 201 bp, Homo sapiens
atagacttattagcttattgaatttgcttttctaaatatctcagtattgaattgaactactcatttatgatataatttcatacatcacagatagctagacrgtgttattttagacgtcaaaatgtttttaaatcatgaaaggggtattcatacgctatgctaacaggctgtcagcacaccagagactgatttagactgtgt

SEQ ID NO: 20724 - DNA, 201 bp, Homo sapiens
cctgtgcccattcacatgagctctacttgctgtatatttaaagcaagtcagttatcgagaaggaatccttcagaataccgcgaacatatggaaactagctrcttatacatattgtctaactcttttaaaagttattttgactttaaaagaccaaatccacagaatgaccttgagctactattaatccacctaactgtaggg

SEQ ID NO: 20725 - DNA, 201 bp, Homo sapiens
ggtttgcaacattttaaaaagcagtatggatttttctcatcttttatgtttctttttatttcatgtccgtttttctgtcaagatataacctatggagaaaygttatgaaacagcattacactgaggagactatcacagctaggggaaggctgcctcactgaagtgttactgaaaacagacaggctttcaatccatgttttt

SEQ ID NO: 20726 - DNA, 201 bp, Homo sapiens
cattttacaatcaacttcatgactaggttagtatttgattgttttattcaaatagaagattttggaatgtgaagcaatttctcaaaacatagagccatccwggaaagagattgggattttaattgtgttgccttcattattgttggatgctccaggcagttagagttcctcaagaagtttaggataaaagaatacagtgac

SEQ ID NO: 20727 - DNA, 201 bp, Homo sapiens
tagacctataactaataaatagatgttggtatctccttgggaaactccacagagtttattattcatcagatggttctctaagtctatgtattgagtatttktcaagcaaaaagggaatgtttgctacttactagctttataaacattgggcaagttaatggacttctctgtgcctgttttttaatcttcagaatggcagta

SEQ ID NO: 20728 - DNA, 201 bp, Homo sapiens
gttaagaaggttgaggcgacggatgttgttgcagaattgtcagtttgcaagaaaacattctttggaaaaaaatacagcccccggttgcaaatctaatcagyggcgggtatgggaggtggggaagagagcatagagagaaaaaaacatgtctcaaagagaaaaaaagagcaagaccctaattgaaatgggaagcattctcat

SEQ ID NO: 20729 - DNA, 201 bp, Homo sapiens
actcagcacccatccagcatttactggaatattatccttgttggactttggaaaacatttaaaattttaatcattgttctttgctgaaatttctacttaaytgatgcttctgaagctaatttttgctctatgttcatttccatatcatctgcaattaatatttacagactgcttgaattgcttagaaaacacatgagacat

SEQ ID NO: 20730 - DNA, 201 bp, Homo sapiens
tgaaatgcacagaaacttgttcagataaactctgtttcatgctgggggggtggggcgcagaaaagaacaatgtaatatattactgtgtgataggcacaacrgtgcaatgatgcccattgtgcactggtagcagggggagatggcaacaaccccatgctggaagggcccagaatgacttgctggaggaaataaagcttaagg

SEQ ID NO: 20731 - DNA, 201 bp, Homo sapiens
ttcatgttgggaatacttagagtggttagtttaacaaatttcttaacttccttggagcttcactgcttcattttataaaggaaatgcttaaccatactatytctatcttcccatgtaactggagcctgctaaataatatttgtaagtaattccttgattgggaataatcaacagcaacaattttgtgaggcatgaatacaa

SEQ ID NO: 20732 - DNA, 201 bp, Homo sapiens
  misc_feature (1)...(201): n = A,T,C or G, or insertion/deletion polymorphism (see Tables 1-2)
gagggcatttattttcatctcagcactaactagcacttagttgtgagacttggggcaatccactcaatacctttggaactatatcttcacaaatttactgntaggctaggttaatttatccatttgcttgttgattacagtcctgttagggaaaagattaaaggcaatttttatatataagaataaagaatctgcatattt

SEQ ID NO: 20733 - DNA, 201 bp, Homo sapiens
aataaatgctagatgttggggcttaaaatcatcatcatcatcgccaccatcaccatcatcattagtagaaaatttggcagttggttggttggtttcagtgrtgggcatagtcttttaaattaagacacacaatctataagtcttacaggaaggcattattaaatttgaatatccaaagcaagaaaaccacaaacaaaacca

SEQ ID NO: 20734 - DNA, 201 bp, Homo sapiens
gttctttctgcccagattctctgagcatgaactatacaagagatctcattttaagttgctgtataaatacagttctatattatttctagtcatatttgaamgaatgaatctgctgtactagcctaaattattcctgaaagtcatttggactaagtttagttctagagtgtcctcattctgaaatgattttttaaaactatt

SEQ ID NO: 20735 - DNA, 201 bp, Homo sapiens
cttcattttaacttgatcacctctttaaaagtcttatatcccaatatagtcacatcctgaggaactgagggttagggcttccccatcagaatttgggggartgggatgtagttcagccaataacaactacattttgtggtttacatatccaacctatgtttctagctcggaagggtaaggatttctacattgtaatcacac

SEQ ID NO: 20736 - DNA, 201 bp, Homo sapiens
gcggtgggtaagcttgttcagaggggagtgctgtttgcagtaagtaagaggcagaagccctaagtgttcaaagacaaagaaaaatgaaatacatttgccamaaactggaggaccaggaagtgccatcttatattaccatccactgaatgttcattatttcatagaaaatgtcggtgggacttcaagaataggagtcatgtt

SEQ ID NO: 20737 - DNA, 201 bp, Homo sapiens
agttattttaagattaaatgagataaacttgtaaaacatatgacatagtgccagacacagtgcaaatgctcagcgaatgataataggtgttcataaaaatrgatataaccattttaaacaactttatatgtttattttgaaacatcaatactgagcaaactttgaaaactgaaaagtctgtctttcctttaccatttcatg

SEQ ID NO: 20738 - DNA, 201 bp, Homo sapiens
cctgaattattcagtaccttgatcatgattataatttatgctagctttttcaagagtgctattgagaagtttagtttacaaagatgtgattcatataacamatatatatgttctttacatgtatctgccacagacttgggtcaagaggaaatgatagttgccccaaatggacaactaggaatttgaagacagaaagttaaa

SEQ ID NO: 20739 - DNA, 201 bp, Homo sapiens
ccattctctgctctcctcctaggccacccatggatgactctcagacacttttgacccctgtggtgagctgtgggcccccaggagctctgctcacccgcccmgtcgtcctcactatgcatcactgcgcagaccccaataccgaggactggaaaatactgctcaagaaccaggcagcacagggacagtgggaggtgagctgct

SEQ ID NO: 20740 - DNA, 201 bp, Homo sapiens
aattctgtattctcagtggctggtacacagtgggcactgaaaaaatagttttgaataaaaaattaaggaaaaaaagaatgattattagctatagctagtgyttttaaggcagctatagtcattcacgtatttataactgagagcagagtgtggcttgccctctagtggtctgttttagcgaactttaatcctggcctttga

SEQ ID NO: 20741 - DNA, 201 bp, Homo sapiens
cttttatttataaagcaaaacatgagtggaattttagctcaccctcaaaatgagagagaaacaggcaggcagactagttcctgagtgttatatcttctgaytgacaggcacacagaaaatgatggtcactcattagataactcataggaaaggtgcacataagagttgtagacatgttccttttggaatatagattatata

SEQ ID NO: 20742 - DNA, 201 bp, Homo sapiens
cggaggttgcagtgagctgagatcgcaccactgcactccagcttgggcaacagagtaagattccatctcaaaaaaaaaaaaaaagtatatgtatatatacrtatataatttgcaggtcagaaacattgcaactggatcagaaaatgttaggcacttacttgcagacatgtacctgggatacagttcttgtgaacttaacct

SEQ ID NO: 20743 - DNA, 201 bp, Homo sapiens
gctgagatcgcaccactgcactccagcttgggcaacagagtaagattccatctcaaaaaaaaaaaaaaagtatatgtatatatacgtatataatttgcagstcagaaacattgcaactggatcagaaaatgttaggcacttacttgcagacatgtacctgggatacagttcttgtgaacttaaccttggaaaacagaaagg

SEQ ID NO: 20744 - DNA, 201 bp, Homo sapiens
  misc_feature (1)...(201): n = A,T,C or G, or insertion/deletion polymorphism (see Tables 1-2)
tgattacttatgataattttttaggaaaaaattcttagaaaaaatacacatgaagattccagctcctaatattttaagaaaatatagtattagatgtagangagtaccagagtatccctgggattcactgggatttccttcctatgggcatgttctactcttgaccatatcaggggatcactgcttgccgaagcgtacata

SEQ ID NO: 20745 - DNA, 201 bp, Homo sapiens
aattacttaatctctgctagccttggttttcttatctgtaaactgggagtaagaatagtatacacctaatagagttaagaagtttaaacaagcaaaaaaaatggacaaattcttactgcaataatatgtattatttaatactaaacaactataaattttattatttgaagtagttgcatgcctttcttcaaagcagcattg

SEQ ID NO: 20746 - DNA, 201 bp, Homo sapiens
attctctcactgagatacaaggactttatctttgcacagtgggtctgaactaattgagatgtcttaaaaaacaagtcagttaagaaggttgaggcgacggrtgttgttgcagaattgtcagtttgcaagaaaacattctttggaaaaaaatacagcccccggttgcaaatctaatcagtggcgggtatgggaggtggggaa

SEQ ID NO: 20747 - DNA, 201 bp, Homo sapiens
tagaatcaatgggagccctgagcttatttttctgcaacagtcctatctgggggtgataggagacagtgacagatcatcaggcattagattctcataaggcrcatgcaacctatatcccttgcatgtgcagttcacaatatggtttgtgctcctatgagaatctaatgctgctgctgatctgacaggaggcagagctcagga

SEQ ID NO: 20748 - DNA, 201 bp, Homo sapiens
gccttgtgtcaggttttccacatgcagacctttgtgattctttaacataataacataagctagtgcttagggtctggttttccattcttgaaggcctttgmtctttggccaattagcaaacagtcagccttaatggaaaaaaggaattgatgaagagaagctataattgggcataaatttaagtgaattgcttctaatcaa

SEQ ID NO: 20749 - DNA, 201 bp, Homo sapiens
aaaactttggataaaatgaggtccatggtctcttctggctttgaaattttggatttttataatggtcgcttggaaaaataactctttgtttacatattgtrtctgttttgtgtgtccatgtgtgttgtgcatgcacacatgtttaatccactttttactgtttgcctcctttcagtcaacggtggctggtccacctggacg

SEQ ID NO: 20750 - DNA, 201 bp, Homo sapiens
tgcctctcttcctctcagatctgtccgtctctttctcctttcctggctcttcctcttctccacaactgttaagtgtccaggcctcaggactccatctggggtccccttctcttctctgtgtacacatgtattttccccagttgtgtgccatggttctgattatccttcttaggtaatctcattaagttccatggactgaaa

SEQ ID NO: 20751 - DNA, 201 bp, Homo sapiens
gtaagctggccagcagcagataacaacatgaagctcttctaagtacagaatttccacagatcgagggcctttttgtcaagaccagttcaatttgggaagcwagaagcttatttctgatatttggagtttggcttcttagtaaaatttaaagaaataaatatcagtacaaccatcaactctgtgaacacttgacagcaatgc

SEQ ID NO: 20752 - DNA, 201 bp, Homo sapiens
  misc_feature (1)...(201): n = A,T,C or G, or insertion/deletion polymorphism (see Tables 1-2)
gataaaaggaatatagtgctgttgagaacattcccaagagaagggagtggggagtgtgttagaatcttgttttcagttagttttagaaaataagtgattanttagaaagaaaaaaatagagaacaataatttgccctttgaaatgagaaaaattaatgtagatatgaggcactagggaaacatataaaaattctttccaac

SEQ ID NO: 20753 - DNA, 201 bp, Homo sapiens
  misc_feature (1)...(201): n = A,T,C or G, or insertion/deletion polymorphism (see Tables 1-2)
agaggcaatggttttatcaatttcaggggcagcttttatagaccaatagatcctgacctctgtactgggtacaatttgtcctaaaactgacagagttacangtgataaaaggaatatagtgctgttgagaacattcccaagagaagggagtggggagtgtgttagaatcttgttttcagttagttttagaaaataagtgat

SEQ ID NO: 20754 - DNA, 201 bp, Homo sapiens
  misc_feature (1)...(201): n = A,T,C or G, or insertion/deletion polymorphism (see Tables 1-2)
atctctttccctctggtgttagaggcaatggttttatcaatttcaggggcagcttttatagaccaatagatcctgacctctgtactgggtacaatttgtcntaaaactgacagagttacaggtgataaaaggaatatagtgctgttgagaacattcccaagagaagggagtggggagtgtgttagaatcttgttttcagtt

SEQ ID NO: 20755 - DNA, 201 bp, Homo sapiens
  misc_feature (1)...(201): n = A,T,C or G, or insertion/deletion polymorphism (see Tables 1-2)
ttttgttttgaaactgacaatctctttccctctggtgttagaggcaatggttttatcaatttcaggggcagcttttatagaccaatagatcctgacctctntactgggtacaatttgtcctaaaactgacagagttacaggtgataaaaggaatatagtgctgttgagaacattcccaagagaagggagtggggagtgtgt

SEQ ID NO: 20756 - DNA, 201 bp, Homo sapiens
aatgacaattttggtctcaataaaatgcgtattttttaaaagactgggaaaaacacaagataaaaatggttttcttattatgcttttcacctttgctacartttcttaactttctctaataccattataattatattgctcaaaaacatctatttttaaataataaatggatcaaatggtcaagtagtaaatgagtatgtg

SEQ ID NO: 20757 - DNA, 201 bp, Homo sapiens
agatttggaagctgtgcagcttgtgcattatgccatgactatgatatatctgctcactaagttgaatatcatgtagctatttaaaagcttattaaagaatkatgtaggattatatgaaaatacttgggaggaataaatgacaattttggtctcaataaaatgcgtattttttaaaagactgggaaaaacacaagataaaaa

SEQ ID NO: 20758 - DNA, 201 bp, Homo sapiens
acagtaatcctatacaatatgtaatagaattatcttcattttatggatgaagaaatgaaaacatagcaacctcagtaagtacagaactaggattaaactayggcagagcagatccaggctccatgcttgtaaccaccacagcaggatagataatgacccccaaaggcatcaggtcctaatctctggaatttgtaaatatta

SEQ ID NO: 20759 - DNA, 201 bp, Homo sapiens
  misc_feature (1)...(201): n = A,T,C or G, or insertion/deletion polymorphism (see Tables 1-2)
cactatgcaaaattggaaataaaaatcacaagagtttgtgggggaaataggattggagcataacatgcaaaatttgaattaaatacacacaaatatagaancctaataaaactgatggaatatttctacacatgcaaatggttaagaaatataaacgctacaataaatatggacttcaccttgaaagagacctaagtttgc

SEQ ID NO: 20760 - DNA, 201 bp, Homo sapiens
tttactttgggtatacacctattagtggaactgctggatcatatggtagttttatttctgttttgttttgttttaaggaaacttcatacagtttttcatawggctgtattaatttacattcccaccaacagagtgcaagggttccctttgccccatatcctttgccaacacttgttatcttttgtctttttgatagtagcc

SEQ ID NO: 20761 - DNA, 201 bp, Homo sapiens
  misc_feature (1)...(201): n = A,T,C or G, or insertion/deletion polymorphism (see Tables 1-2)
taccaggggggacttttgaaaacacctaggtcctggccccagccccagagataataatttaattgggaacaggccatagcttttcctctgtgtttgttttnagctctctagtaatgctaatgtacaaccaggcttgaaaaccagggtacaagagagatgttatttattgtaaaagtgtggcagagagggagtacatagatg

SEQ ID NO: 20762 - DNA, 201 bp, Homo sapiens
attagtctgttttcacattgctgataaagacatacctgagactgggtaatttatgaagaaaaagacgtttaatggacttacagttccacatggctagggaygcctcacaatcgtggcagaagacaaaaggcatgacttacatggtggcaggcaagagagaatgagagccaagtgaaaggggtttcccctgataaaaccgtc

SEQ ID NO: 20763 - DNA, 201 bp, Homo sapiens
acttttcggtgtggacacagccaaaccacatcactgtgttggacaaaaggaagataagcatgttgctaactatttaagttattgcttagagaaaagttattattagaatggctatttaaaatttagtattatgaattcatacatatacatggatagacttcttgaaaattcaagttataaagaaatacgaaaaacaccaaa

SEQ ID NO: 20764 - DNA, 201 bp, Homo sapiens
gaaaatgccatagaattctgaaactagaatttgttttgttatatcaaggatacaagtgaaaaattttcactgaatataagtgaaatggtgggggagcagawggaagcggtcttaactgacagccaacaatgaggaatttggaggagtgatgaggggccatgctattttatgcttttcttaaagagttggctaaatggtttt

SEQ ID NO: 20765 - DNA, 201 bp, Homo sapiens
aagttattgcttagagaaaagttattattagaatggctatttaaaatttagtattatgaattcatacatatacatggatagacttcttgaaaattcaagtyataaagaaatacgaaaaacaccaaaaaaaaaaaaaaaaacaccacatggacagttccatccaccaacaagagcataaaatgcagttacccacagacaatc

SEQ ID NO: 20766 - DNA, 201 bp, Homo sapiens
  misc_feature (1)...(201): n = A,T,C or G, or insertion/deletion polymorphism (see Tables 1-2)
ttaagttgctgaaatgtttccacagtttatttttctaggatcttttccatgactgctcgctcataaagacctggctgtggaaggaaattggacaggaactnttgaattggcctcttgtttgcctagttctattgacctgtaccagggtggttacactttggaggccgtaagttgttcatttgctactgttcttaatcaata

SEQ ID NO: 20767 - DNA, 201 bp, Homo sapiens
  misc_feature (1)...(201): n = A,T,C or G, or insertion/deletion polymorphism (see Tables 1-2)
tgattcaaagaaaaatttatttccacaagaaataactggaatctgaattaagtacctgtcagtatattttgattctcgctattatcaataataatctgttnccatttaaaataatgcataagtgcttaatgttataggaattatatttcatgcacattcttaatccatgagtgagtgacaaatatgctatatatttataaa

SEQ ID NO: 20768 - DNA, 201 bp, Homo sapiens
cttttttccagatactaagagaaaaggcacatgtcagcatattttctagtcttctggtagcactttcaataaaaaaaaccctttagagttactctttaccyttgaaatgagttcagtcttgtattctttgtatctactcttggtcttcctcaaagacaagataaatcagagttgtgaccttactcctactctttctagaag

SEQ ID NO: 20769 - DNA, 201 bp, Homo sapiens
gatactaaacatttgacttaattcatggcttcacattgatccagggaagtggagttccctgtatgcgttttagctgatggtagcattaacaacaagatgayagagaaattatgataccactgacaaaactgaggaactcatacagaagaaacagtcataggggaagacgatgagtctgagttttgaagatctttagttgga

SEQ ID NO: 20770 - DNA, 201 bp, Homo sapiens
cattttcaggatttatattgaacactagaaccaaattaatctcttgcactccagaattaagaaggttctaatgacacagtcagtgaaaatgtacagaattrttacagttgagtttaccaaagcaagttagtctatttccatcaccactatgattaagttcctttaactcaatgaattccccattcccacaactgactttcc

SEQ ID NO: 20771 - DNA, 201 bp, Homo sapiens
aaaatcattaacttctctatcactgaaagagcttcccagctattctttctgtctttctgaatcaatatccccagggtatcagtgtccttttatattcaacrgaaattatgaaatcattccacccgtttctcagggcactagctaatggggacctgaagaagactttaattgtctctgacaacaactcaaccacttttttct

SEQ ID NO: 20772 - DNA, 201 bp, Homo sapiens
ttttacttgaacacattttctcttttcatttttttattttactttcttagtcggtggtgtgttcctccatattaaggctttcattgccttataattattaycattatacacacgaaagatacaattgaggggagtacctttacatgcagccactcagcaatataatgagctgtgtgtttttcacatggaacaaagtcccta

SEQ ID NO: 20773 - DNA, 201 bp, Homo sapiens
ctagatttgtcaaaccacttgtggaggttgtgatgctaactgctaccaagaaaatttttgttgttgttgttgaaggacatctttgcaggcggtaatgcacrtagatgcagagcatctgtaatgtaaattaattaatttatcaagtatttttgtgtccttaaaaatatttactacattactggattaatacttctgattaat

SEQ ID NO: 20774 - DNA, 201 bp, Homo sapiens
  misc_feature (1)...(201): n = A,T,C or G, or insertion/deletion polymorphism (see Tables 1-2)
cccttactagcagtcagccttcaagctttgctttggtccaatcaacattcgccaaagtcacctccttattatgatcatcccatactttttggggtgaaaangtatgggaaaaatcccatatttttttctgatatctgcctctaatagttacacacagagatcaccacaagcccagaaacactgtaagccaaattaaaattg

SEQ ID NO: 20775 - DNA, 201 bp, Homo sapiens
agatgtcactcacaggcctcaccgggtagcagtcatttctttggcatatcaactaccatctatccagctggctttcaaacttgtggtttcagacactggtraatttaatctcatttcataggaatactgatgtatcaaaccaaaattgcaatttaaaatgaaaaacatacttgttacctgagtggaatactcctatggaca

SEQ ID NO: 20776 - DNA, 201 bp, Homo sapiens
taatggcagtcacagtcaactgtcactttgcttttagcctcggtcattcagtatgatttacatatttagcaaccatgacgagacctagatttgtcaaaccrcttgtggaggttgtgatgctaactgctaccaagaaaatttttgttgttgttgttgaaggacatctttgcaggcggtaatgcacgtagatgcagagcatct

SEQ ID NO: 20777 - DNA, 201 bp, Homo sapiens
aaatcagaaatactgctttattttgtctggcacttatcatagagagatggtatgacttaacaatgtgccatcaattttattattgttcttgctgatatgcraaaaatgtgagtgtaagaagagagtgtgtttttctgtgtctgtgagcctgtgcaccttacatatgtattttccattccatgatgaagtcatagacatacc

SEQ ID NO: 20778 - DNA, 201 bp, Homo sapiens
  misc_feature (1)...(201): n = A,T,C or G, or insertion/deletion polymorphism (see Tables 1-2)
ataaagtctcattctaccttctagaacacttagtgaagaacctggtaggttaaagagtgaatcaagtatacctgtagctaattttatagtactcctaatcnacctcttcctcagtgtatcatttcccctcctccacaaatcccacttgcttgttttcttgcaaagctgccaagaaactgtgaacaaatttactgtctgaat

SEQ ID NO: 20779 - DNA, 201 bp, Homo sapiens
taaatacaaattttgttactattccttaaccagtcaagcttatctataacagatttgatactgggttgttatttactattgacaatttttgaacaattatsttgtatgaacatgttctgtggaatgagacgatggaaaaatgaggaaaatgttactgtggaaatgacaacactggttattctcagaaagcttctttgagaa

SEQ ID NO: 20780 - DNA, 201 bp, Homo sapiens
tttagggccaggcatggtggctcatggctgtaatcccagcactttgggaggctgaggcaggtggatcacaaggtcaggagttcaagaccagtctggccaayatggtgaaaccccgtctctaccaaaaatacaaaaaattagccaggcatggtggcacccacctataatcccagctacttgggaggctgaggcaggagaatg

SEQ ID NO: 20781 - DNA, 201 bp, Homo sapiens
aaatgacaataaatatttgtttcctacacagatgatccagtccaaaagcatgtacagttacagttaattttttacttgatttgtcctatttcagttcactwcaacgtttttatatgaaatttaatatattcatacatacatgcacatagagcattaatatatgcatacatacaaaataccacatcattagggattgtttgg

SEQ ID NO: 20782 - DNA, 201 bp, Homo sapiens
tccttattgagcctgaagaagcttatattgtgaagaataagcctgtgaacctgtactgtaaagcaagccctgccacccagatctatttcaagtgtaatagygaatgggttcatcagaaggaccacatagtagatgaaagagtagatgaaacttccggtgagttttccattgcatttgcattgcacttcaagattcacttac

SEQ ID NO: 20783 - DNA, 201 bp, Homo sapiens
acatagtccatatgggaagtcctcaaaagctttctatagatcctatttgttaatagaataatatttgtaatgagcaatggaagctagctgcagaaaaaaawatatatatattaagggatcctttttgaaaaacaagtcttaatttttatgacatgaattttaagaattatgttctaacttgtaaaaacagatctgaatttc

SEQ ID NO: 20784 - DNA, 201 bp, Homo sapiens
gttcccaggcaccatttgcttttgcttttccaaccagcacaagtgatcagaaaatgattagaatttctcctgcagatgaaattcagattttgcatttgtgytgttttatgagctgagactatcttaagagccaatttatggttttctctactaaaattagatttttaaaaaataaggatatacagcaattggaggatgcca

SEQ ID NO: 20785 - DNA, 201 bp, Homo sapiens
atcagtatgtggggatgtgtggggagtaaggggaaggcaatggatatggggtcttacctggcgtagccttggatcaaatggccccatgacattagaagagyctacttagagtccccaaagaaaaggggcacctagaacagattaataactacttctgttttcaagttaaactggccagaaaacacatgaaaacaattttag

SEQ ID NO: 20786 - DNA, 201 bp, Homo sapiens
taccatattactgagaaaaaatgacaataaatatttgtttcctacacagatgatccagtccaaaagcatgtacagttacagttaattttttacttgatttrtcctatttcagttcacttcaacgtttttatatgaaatttaatatattcatacatacatgcacatagagcattaatatatgcatacatacaaaataccaca

SEQ ID NO: 20787 - DNA, 201 bp, Homo sapiens
tgtgtaaaaatgtatttcccaggtgtaatgacattagcatatactttcatgtcaaaattctgcaggcttggtagttgtaattcaatttattaaaggaacawacgtggaaaatgttattgctctgttctttctcacaccaccatatgttacacttgccaccattttctctcaactccaccctgagttaaagctgcttttccc

SEQ ID NO: 20788 - DNA, 201 bp, Homo sapiens
ttttagttaaatatgtgctaatttaaatcacattttatttttattcaagcagtataattaactataactgaattatttttaaggattcaatctgaaaacayaggtaaacattactaccatattactgagaaaaaatgacaataaatatttgtttcctacacagatgatccagtccaaaagcatgtacagttacagttaatt

SEQ ID NO: 20789 - DNA, 201 bp, Homo sapiens
aattcaatttattaaaggaacatacgtggaaaatgttattgctctgttctttctcacaccaccatatgttacacttgccaccattttctctcaactccacyctgagttaaagctgcttttcccaggatttggagacattttgcttatctttccttaactcgatccattatgtgccatcactagaatttaaaattgatttca

SEQ ID NO: 20790 - DNA, 201 bp, Homo sapiens
ctttgattacaagagccatggacttagaagcaggacttgggaaagcttcgggagcagcaggagattttgcaaatccattactccctccactctaaaggctycagcgtccactatgaagagggcggccgactgccactggcatttacacacactccgcccccagctttcaccatacaccaatcaaatgtctccgaaaacagg

SEQ ID NO: 20791 - DNA, 201 bp, Homo sapiens
  misc_feature (1)...(201): n = A,T,C or G, or insertion/deletion polymorphism (see Tables 1-2)
tttcattgtgtgtgctaggcaccctacctcaggtagtccgatatttatgcatagtcagcctgaatccagtataaggtcactgggagttagaaatcccctanttcatggattaaaacataattgaacaacagatgaagaagatgcaaatttcaagaagtaagaattgtatttggaggaagcagggattttctgagttggatt

SEQ ID NO: 20792 - DNA, 201 bp, Homo sapiens
  misc_feature (1)...(201): n = A,T,C or G, or insertion/deletion polymorphism (see Tables 1-2)
cctaggcctttctccgtatttatctatgtaacattgggacttcagatagttttctgtataaatatgcatatttaaagtcaatttaaaaaatattttgactntattttgcagcataattatgaaatcagatttttccatttatattatagttttacagagtttacatcttctcattgtatatggagtcttgtctttagtgac

SEQ ID NO: 20793 - DNA, 201 bp, Homo sapiens
agtagggcagacagtgggagaaatgggaaatccataaaaagtcttccctttctgttcccttatgcacactgggcaattaaaacacatttaattgattactmttccaattaattccatcactagtattgacaaaagaaactgtttgctgtgaggcagttaagcaggtaagttgaatttactttagtccaatgagttccagtc

SEQ ID NO: 20794 - DNA, 201 bp, Homo sapiens
atccaaagagataatgaatatctccttaggcgaaagtatttatatcagagttcagatacaaacttccatcatattttcaccattatgcattttggagcttktcacaccaactaatataacctgacaagtacaatgagtcaatcggtgttaaaaaatgaaaaatgtttaagtgttgaattttactcttgacttatatttgaa

SEQ ID NO: 20795 - DNA, 201 bp, Homo sapiens
gattatgctcatttgttatagcagcctgaacccatttaagacaatgtttcttggaggggtactaagatagagaggggcatcattattttcccaggctacayaggaacaacaggtacccaggttacaataaagaggatatactaggctgggcgcggtggctcacgcttgtaatcccagcactttgggggccgaggcgggtgg

SEQ ID NO: 20796 - DNA, 201 bp, Homo sapiens
tggtactggtccgtggtctgttaggagctggtcgcacagcaggaggtgagcaggctagtgagcattaacacctgagctctgcctcctgtcagatcagtggrggcattagattctcacgggagcatgaaccctatgtgaactacagatgcgaaggatataggttgcacacttcttatgagaatcaaactaatgtctgatgat

SEQ ID NO: 20797 - DNA, 201 bp, Homo sapiens
ctaattgagatgtcttaaaaaacaagtcagttaagaaggttgaggcgacggatgttgttgcagaattgtcagtttgcaagaaaacattctttggaaaaaaatacagcccccggttgcaaatctaatcagtggcgggtatgggaggtggggaagagagcatagagagaaaaaaacatgtctcaaagagaaaaaaagagcaag

SEQ ID NO: 20798 - DNA, 201 bp, Homo sapiens
gataagacaaggtacccatcagtgttgatgaaacacactgtaattttctagaaaatgtgcctgcaactgtggggcactttcgtttcttgtgctttgctctrgtccctggcattgcagaagaccagaaaccacagatcttggagtgtttgaatagaacaattacgagaacatgtgacatagaatacaggatagtctccccag

SEQ ID NO: 20799 - DNA, 201 bp, Homo sapiens
atctgtcatagaaattagatgctagaaaattccattaaagatcattatttctaagattataatattggctgtgttctagaaaaatagagcataatgtcatragggcatctttcccacacccttcctcaattgttttattagcttattctgtatttctattggttatagattgactagcattattcttatatatattagcaa

SEQ ID NO: 20800 - DNA, 201 bp, Homo sapiens
agataagacaaggtacccatcagtgttgatgaaacacactgtaattttctagaaaatgtgcctgcaactgtggggcactttcgtttcttgtgctttgctcwggtccctggcattgcagaagaccagaaaccacagatcttggagtgtttgaatagaacaattacgagaacatgtgacatagaatacaggatagtctcccca

SEQ ID NO: 20801 - DNA, 201 bp, Homo sapiens
atctattttgccagagttgatatagcccccttacctcccattcttgttagctcttattccaccactgggaattgtcactaattgactgtcacttttgagtrgagtagttactctatacaacaacagaacacaaaacagagaaaaccttgacagtaactttctgtaaagtttatttgcttgacacttccacatccagtatct

SEQ ID NO: 20802 - DNA, 201 bp, Homo sapiens
  misc_feature (1)...(201): n = A,T,C or G, or insertion/deletion polymorphism (see Tables 1-2)
atagttttttgtggtgattatttaaatactctgggatttaatttgcctttgaagacacaaattaaaaacttgatagataatggaaatgagacatttgtatnacttactaatttggtaattttaacctatttctggccattttttgttattgcttagtagacttaaatttaaagtatagcttgactaaaattagtgtggaag

SEQ ID NO: 20803 - DNA, 201 bp, Homo sapiens
tggcagcattttcagaaaatagggcttgacagtagcagttcatgtgaaaaagatctgggaggttttagttaagtacaagttgaatatgtgccaagattacratgtggtggccagcaacccaatttaatctcgtaatagttacatgtatagaattacaattttctgccctaggatgcatggacactgattgcacattttaaa

SEQ ID NO: 20804 - DNA, 201 bp, Homo sapiens
ggattgtaaaagtaacttgtttgaggatcttcatttttaggaagtttgtgaatagggtaaatgcatgggtatattaactcatttaaatacagagttttgcrtttgatttttaaaatattgtcacttaacttgaaactttatcctaaaaagctatcatactatgcctgtattaaagacatgttttgctttgtattattggtt

SEQ ID NO: 20805 - DNA, 201 bp, Homo sapiens
agaaaatagggcttgacagtagcagttcatgtgaaaaagatctgggaggttttagttaagtacaagttgaatatgtgccaagattacgatgtggtggccarcaacccaatttaatctcgtaatagttacatgtatagaattacaattttctgccctaggatgcatggacactgattgcacattttaaaaattatgtccagt

SEQ ID NO: 20806 - DNA, 201 bp, Homo sapiens
tttggaattcttttttcttacattgtcaagtaaattaaactaagcctgacattaggcacacagtttatgtagttgtaacaaagcatcaaagtaattgaatyctcgctagggaatttttaaattaatttattattaccattttttttttgagacagggtctcgctctgttactcaggccgaaatgcagtggtgcggtcacag

SEQ ID NO: 20807 - DNA, 201 bp, Homo sapiens
ccttctcccctcacttttttctttgagactttatgctagtcactgtccccaagatactccctactgttccactcagttcctacaggctaatactgttcaargatgaactgaggaatgaacctgtcttaaactaaactttctagttctttagggaagctacagtgcacatcacgatgtaagcacttcctcactctaaaaatt

SEQ ID NO: 20808 - DNA, 201 bp, Homo sapiens
aattccttataactcctttccattccattatgacttcagattctagctcccggaacatctcatccctaatagctgcagcccatggtcatttcacatttacytgaatttattattgcattcataatctttattttaatttggaattaagcttacattatttataataatgttggttaccgttaaagctgcctctaaatatgt

SEQ ID NO: 20809 - DNA, 201 bp, Homo sapiens
ccttttttgtttttgttttcaaactaacaagaacgatgcttattttgtgccataatgtattatttatttgctattacttcatcgaggatgtagaagagcarttcagagagccaagttattcaaacaaataaagaattaaattatttcctggagtcccacatatttacatgttcacaaaaaatgtaaacatattcaaacatt

SEQ ID NO: 20810 - DNA, 201 bp, Homo sapiens
cattaatattattcacatagaaaaaaatagttcagtagttttaaatggtcatgtcttaaggtcaggttccccaaaagcacaccctgagccaaagatttgawtgttagcattatacaaaaggagggatttgagtatgatttgtaagctattcagattgtattaagaattggtagaaaaacttaaaaaaaaatttggcttaga

SEQ ID NO: 20811 - DNA, 201 bp, Homo sapiens
agtaaagttcatcacagcaggcctctccattagtaacttaatctccattaaaggtgaagtcaagatttttgtgtgtgtgataacgtgaatttttgtgtggwattattacattttccttttggaccttgaataaaatatacttttaaatcttaaacacagctaaaagcattaatgcataaggtaacataaagataaaccttt

SEQ ID NO: 20812 - DNA, 201 bp, Homo sapiens
aactaactaaataaacaaggacaactcagtcaccacttcaggatgatacccccacaggaaacactttaagtaggtctataaaactgattcacttgtaattktctttgtccgaaaatcaggttaacactcttttatttttttagcccaaccctcctccccaacttcctcaagtgctgtgctgtagggaacgttccacgttta

SEQ ID NO: 20813 - DNA, 201 bp, Homo sapiens
aaacaataaattaattaagatagtgtagctattcataaaataaacctataattccttccccaaactatacattgctatttaaatagcataggaaatatagmctattttatattagagatttatttttatcatccatctccctatttcttttcctcacaactacacacacaccctcacacacacagacaaagcaagctttct

SEQ ID NO: 20814 - DNA, 201 bp, Homo sapiens
ttattccctattgtataggtttctagaaaacaaaatattgggcaaatgctgtgcacatataaggtttgtgttacttgaatggctaatacacttctttagtrtcaggaaacagatgcatatactagttgtattatattttagctacaaggaaataattttgttagaaattgtttaattacaatattgtacagactcacatta

SEQ ID NO: 20815 - DNA, 201 bp, Homo sapiens
tttgtgagacctagacttggaaataagaaccctaaagaaagctgaaactcacaaatgcctgacctacccacaagaaacaactataacatttttgcccaccrgccaagggaagacatagaaaaaagtggtaggaaaagggaaatgaagacttcatttaaataaaacccatagtaaaaccataacctcaccctagctctggta

SEQ ID NO: 20816 - DNA, 201 bp, Homo sapiens
aataccagaaactaacaatttttcttttcagtatgaggctggccccagggctgagtaaataaaaatagaaaattgataaggacccatgtagtacatgaagmctgtttcactgagttaatctgataatgtcacaagatggtagttgctggttagtcataacagaatatcaattgtcccggattgaaaggtgtaatgttttct

SEQ ID NO: 20817 - DNA, 201 bp, Homo sapiens
  misc_feature (1)...(201): n = A,T,C or G, or insertion/deletion polymorphism (see Tables 1-2)
gagagtcagcaataataaatgagttagcagtctactaacatgaactcatagagcaatctgaaggaaactatagagtaaagtagatgtaaaaagacaaaccntatttttaaaaggaacataagcacaaatgaaataacagaatattgttaaaaagacagatttggagaaaaaaacaaatggaatgtctagagaggaaggcat

SEQ ID NO: 20818 - DNA, 201 bp, Homo sapiens
tgatggatttgtcaatagttcagttcctcatccctttgcctttctgagctatgtttatttaagcagtcttgaatgttcttgcatattgactaaaggagctkcaattgatggaaacaaggttattctttagtaagctgacaattttggtccttgatgttcaacaatggaaaaactagaaatgatgccctgccaaaagaaagc

SEQ ID NO: 20819 - DNA, 201 bp, Homo sapiens
atctttttgaaggcccatttgaaaataccatcaatattgaaaggtatatagatttcactgattagttacaaacctaggaactatctgaaaatataattccwaatgtgcacaaagcttgtccattgaaccttcattgctgttgcatagcagggactgtttatccctactgtgatacttttaaatttattttttatttttctg

SEQ ID NO: 20820 - DNA, 201 bp, Homo sapiens
gctgacaaagttgctttaatccttctctactgttcctgtccatgccagcctcacccttttgctacctggcctttctcttaccacctatttcttgcaacgtrtgctctcccattctttctgttgacagcgggaacccaaaaactacttcagggtcagttggtgactcattgtgttaactctcacaagaatatttacatatta

SEQ ID NO: 20821 - DNA, 201 bp, Homo sapiens
ccatcaatattgaaaggtatatagatttcactgattagttacaaacctaggaactatctgaaaatataattccaaatgtgcacaaagcttgtccattgaascttcattgctgttgcatagcagggactgtttatccctactgtgatacttttaaatttattttttatttttctggaaacagtgtcttcctctgtcttccag

SEQ ID NO: 20822 - DNA, 201 bp, Homo sapiens
tttatattgtaaagaaataggtcagatttaaagcagacactgacatgactagaattaggttttaggaaaaaaaaaaaaaaacattccacagcattatggaraagtggtgggagagagtgatgacaagaggccagggaaggccacttaggagactctggcagttgttaggcaagaaatgagaaggtccttaacgaagacagt

SEQ ID NO: 20823 - DNA, 201 bp, Homo sapiens
tttgttttcccaggaagagaagggctgcttcagagtgtcagctgtatgtgcatttttcatgttttatttgccttccttgccttgtgtcaggttttccacakgcagacctttgtgattctttaacataataacataagctagtgcttagggtctggttttccattcttgaaggcctttgctctttggccaattagcaaacag

SEQ ID NO: 20824 - DNA, 201 bp, Homo sapiens
tgttgcttaagtaacaactttattttgaaaaataatatgaataaagaaaaaacctttcagctacaaagaatactcattcttatttgttttggttcactgtracatttcttttatattttttaaaatgtgtcattgtaaaattaaaacaagacaaaacgtaaaaaattcttatcttcagaatgtgtcaacttgataggaaga

SEQ ID NO: 20825 - DNA, 201 bp, Homo sapiens
  misc_feature (1)...(201): n = A,T,C or G, or insertion/deletion polymorphism (see Tables 1-2)
taatatccattgatttgaggatacataaagataaaaggcaattgtgaatgcaatagaaagcttttacacaagtgtgtattttattcatcagagcaacattnatgcacatttgaaaaatagagttatacatatgtgtaggatatattcttgattccttctgaagataatgctggatttgaatttggagttaagaatgtggac

SEQ ID NO: 20826 - DNA, 201 bp, Homo sapiens
cccttataccatagttttcttcactccacctctgtcagcatcttactcattcttaaagaagtatctcaaatgcagtactgtgaatgaatctttctatatayaaacccaagtcataggtaaatatgtcctcatttctgttatttgtacttccattttcattacattcatggtgattgtggaaatattttgataattcatatg

SEQ ID NO: 20827 - DNA, 201 bp, Homo sapiens
cacacagacaaagcaagctttcttgtaacattttgcacaataaatagtaattagataactaacacaccacacttcaagaatttcagtatatttcccatgtwttacacatacattttgatataagccaaaatggtctggctgtccttgatgctcccaaacaatgtcagtgacagcgacattatagagtttggacacatattg

SEQ ID NO: 20828 - DNA, 201 bp, Homo sapiens
cgccgaccttcccctcccctattatcagaccattagtgaagctctgtacaagtaacaacagtggagccctgcttaagcatatgaccccaatagcttgtggrtaagctttgtgagcattttcacaacggtcacttgaattctcattatactttctagtagtcagaattatttattcaatattctaaccagaggcatcacatc

SEQ ID NO: 20829 - DNA, 201 bp, Homo sapiens
cgagattgctctaccaacatgagtttgctcaggctgtttcttcaaatgttcttctcccagcagattccagtttctgcctttgggatttcaataatactcaraggcttatttcatggccttactctgaaaagcctctcctgattatctcaagtagatgcaagctttttctctttttttatttttattgcctaccacacttat

SEQ ID NO: 20830 - DNA, 201 bp, Homo sapiens
ttgcagttgcttctattatatcacgcagatgaatctctgctagctgacttatttgggctcaccttctgcgtataaacgtttttgttttcattctttttctracttacaaaaagaagagaaaattgaaaatttttaggctacacatttagattctttttgtttctaatctattgttgtcatgaagtttttatttttattgtt

SEQ ID NO: 20831 - DNA, 201 bp, Homo sapiens
  misc_feature (1)...(201): n = A,T,C or G, or insertion/deletion polymorphism (see Tables 1-2)
aaaagagagcaagtaaaaacaggaatgtgtcctaatatttttaaggtgatcactataataatccttttgaaagtagtatgatgcattattgctgtctgaantgaaattgaagtttgacacacccatattatctcccccaaaagagttgcttatatatacattttttcatcttttgaatattttctaatcttcatttcaatc

SEQ ID NO: 20832 - DNA, 201 bp, Homo sapiens
gaaaatttttaggctacacatttagattctttttgtttctaatctattgttgtcatgaagtttttatttttattgttatttgttcatttttggtaattccratatttgcaaatatcagtattatagaccctgtatgtactccagagcaccccgactatatcctatttgcagaactatgtaattttaatttaattatatccc

SEQ ID NO: 20833 - DNA, 201 bp, Homo sapiens
  misc_feature (1)...(201): n = A,T,C or G, or insertion/deletion polymorphism (see Tables 1-2)
gtgatttctctaaggacttgtgataacttgctatatttgattttggccaatgtgaccccttccatcttctggaagtgcatctcttgattgccatgaaatcntgttccgcttcccttttgcctctcttcctctcagatctgtccgtctctttctcctttcctggctcttcctcttctccacaactgttaagtgtccaggcct

SEQ ID NO: 20834 - DNA, 201 bp, Homo sapiens
  misc_feature (1)...(201): n = A,T,C or G, or insertion/deletion polymorphism (see Tables 1-2)
attagctaagcccagtttcaatagcagctgatgcagtgtcagctaaatgtacattggaattttttcatataatgcagtaatagcagttctataattttttnccctaaaactacatacattaagtaaaacaaatgtcatctgatagtagtggcagggctgctaataaacaggcagagatttgtgatgaaacaaaagtaacag

SEQ ID NO: 20835 - DNA, 201 bp, Homo sapiens
tccctgccccttctctggcactcagcctcctggcttcctcgaccctgaatgcatcaaacccatgactctgccatagagcctagcacatgagaggggcttcktaaatgttgatatgcttaagctttttgggctttgattcccctacctgtaaacttggtataatgacagtacctacttcataaagcattcatgaagattaaa

SEQ ID NO: 20836 - DNA, 201 bp, Homo sapiens
aggtgagaaaatattacacctttcaatgcaattttagcaagttgtgtttcactaggggaaaagagaaattttctaaaattatatacagtgagagtttttastgtaagaaacataaaggaattctcccctgccaattaacacttagggcaaggttacttgtaacacataactcctcttcctttccacagtgaagatgaaagc

SEQ ID NO: 20837 - DNA, 201 bp, Homo sapiens
gataaatccctgggcactcagggaactactgttgtatgggagaaactgctatgcttttaataacaaaagtcaggactagaaactcccccgattagtaatayagatgaaaactttattttcattagagcagcatatattttttctaacaggactttttaactttgatatgacagaggaagagaaaagacctgctctcaggca

SEQ ID NO: 20838 - DNA, 201 bp, Homo sapiens
gaactcccatctacactgcttttttttcatctgataaccgagataactactaagtgactaccaggtggggagtctatacagcatgggtacattggatgaargagtgattcatgtctgagagattttgtcacgctactcagagctccatgcagtttaaaacttacgaattgtttatttctgaaattttccatttaatgtttt

SEQ ID NO: 20839 - DNA, 201 bp, Homo sapiens
cctacttgagcaatgattgaggaatttttgattcagtttgccctgatctatcccctggtgagcatgggcttgttattttttaatgaaactattttcacagmctgttgtttttggtgtcagagatagaggagagtgaagttatttttttttttattcttattccatttttttcatcaatcctagtgccgcttatgctgctga

SEQ ID NO: 20840 - DNA, 201 bp, Homo sapiens
ttccaggatagagactgtttaaaatgtcatttgggcttaccgtagtttgactgaatgggactaaattgctttgttgattggaccagtgtgttaaccaaagraaggtgaaaggttatcactatcgttagtcctatacaaaacatccgaaaagttttgaagacaatgggatgggatttactaaaattctcttcaaccttcttg

SEQ ID NO: 20841 - DNA, 201 bp, Homo sapiens
cattttaaattaattcataaaatacattctcttagataatagaagtttagtgcaatctaatggggtacgtgatataaaagtatccacttataattacaagyaaaagaaattcatgtgcagcagtccttccttaaatgcaggagatactttccaagacccccaatggatgcctgaaactacagatagtatggaactcccatc

SEQ ID NO: 20842 - DNA, 201 bp, Homo sapiens
gccttactgaatatgtcctgggaattaaagcatatggcagggataaggaaaaaagattttccttatgctaatgacccctgatgtctgaaataaattagatscattagagtttatgctcaataaaagaaagactttaagcactccaaagttagtgactcgagaccagtttttgctctaaaattcaatctgcctgcttattaa

SEQ ID NO: 20843 - DNA, 201 bp, Homo sapiens
tctttatgaacaatatgtttgaaaatattgagctgaaatttcagaattaaaaaaatagttttgtgttgaagttgtactgtggttttttgttttgagcattrctgctccccaaaatgttgctcatatataatgagattttgaaatacacagaagaatgtttccagattttataagtatttaaaacatacctccccttctaca

SEQ ID NO: 20844 - DNA, 201 bp, Homo sapiens
ttggtgtcagagatagaggagagtgaagttatttttttttttattcttattccatttttttcatcaatcctagtgccgcttatgctgctgaattgcatttwactggtgtcttgcagcaaagcatactttctagcaaacaatgcaagaacactaacaaaggataaaaataataccaggcaatgaccaatgagaaaagcacac

SEQ ID NO: 20845 - DNA, 201 bp, Homo sapiens
catttcaagtcattgtcaaaaatttgggggagcaattttggagggtaaggaggctttcctgatgcccctaaaatcaaagcacacccaattctactgctagytctgaaagtaaacctgtattggtcctatgagtgacagggtcatgttgataacagaaagtgtgtccaatgcttcttttctaaggacctctctgcttccctg

SEQ ID NO: 20846 - DNA, 201 bp, Homo sapiens
taataaaaacattttataggaacacttttatgagctaacaagatcagaaatagaaaacttttttttttatcctgtctacctgtatggagccaccagaagamtttctgccttttcatgaaaacccaaaacatatatcatgttgcagatatttggactctttatgaacaatatgtttgaaaatattgagctgaaatttcagaa

SEQ ID NO: 20847 - DNA, 201 bp, Homo sapiens
tggtttagtcctcaaaatgttggcccacacaagtattttgataaagttttaagtagctgacaacatatacagttagaaaaaaaaatctcataaaactccayattaccaacttctgttagtcatcagatttggggtctgtggcccattgagcctgcattcctattggcaccatgcagccggagctaagtaacgagagtaaag

SEQ ID NO: 20848 - DNA, 201 bp, Homo sapiens
tgttacataagcccaaagagtttatatatgcttggatagattatatttgtcattttaagcattgttttaaccaaggatacaaatttatgaagtgtttacasgttcaaaaataatttcctataaaaataacatgaataggtcaaatgatttgactttaccttcaaaacttatccagaatctcaccttcactactttaacctt

SEQ ID NO: 20849 - DNA, 201 bp, Homo sapiens
taaaaaaagaaacttagtaatgggataatttatagtttctcttattttaaatatttgttattttcaaacttacagagattttaataaaaacattttatagkaacacttttatgagctaacaagatcagaaatagaaaacttttttttttatcctgtctacctgtatggagccaccagaagaatttctgccttttcatgaaa

SEQ ID NO: 20850 - DNA, 201 bp, Homo sapiens
cctcaaaatgttggcccacacaagtattttgataaagttttaagtagctgacaacatatacagttagaaaaaaaaatctcataaaactccatattaccaayttctgttagtcatcagatttggggtctgtggcccattgagcctgcattcctattggcaccatgcagccggagctaagtaacgagagtaaagaggaagctg

SEQ ID NO: 20851 - DNA, 201 bp, Homo sapiens
cttatccagaatctcaccttcactactttaaccttggtccaagccactgtcatctcagaactgagttactgtactagcttcccatttagttgatttcttcrgaacaggctaggctttagcagcagttaactctgaactctccaaacctcagtggcttaacaccaaaatattatgcatcttcttcacaaatgtctactttat

SEQ ID NO: 20852 - DNA, 201 bp, Homo sapiens
gtattttgataaagttttaagtagctgacaacatatacagttagaaaaaaaaatctcataaaactccatattaccaacttctgttagtcatcagatttggsgtctgtggcccattgagcctgcattcctattggcaccatgcagccggagctaagtaacgagagtaaagaggaagctgattgattggttttgtacccacat

SEQ ID NO: 20853 - DNA, 201 bp, Homo sapiens
taaagtatgtgaagggtttaagaagagtctcttttactttcttttcttttcttttcttttttttttttttttgagatggaatttctctcttgtcacccagsctggagtacaatggcatgatctccgctcactgcaacctccacctcctgggttcaagcaatcctcctgcctcagcctccccagtagctgggattataggcg

SEQ ID NO: 20854 - DNA, 201 bp, Homo sapiens
  misc_feature (1)...(201): n = A,T,C or G, or insertion/deletion polymorphism (see Tables 1-2)
acccattattctctcaataatttggtcaaaatcttgatgctatttctctctccccaccctatcatttttttggcatctttgaaaacacaacagagaacttnttagttaaaaatttccacaatcgatgaacaatcaaatgtgaacccttgagttgggaggacattgctaaatagctctggatcatgttgtcttcccccgtgt

SEQ ID NO: 20855 - DNA, 201 bp, Homo sapiens
cctgagtcttccctcagctagtgattctcagaccagtcctggggaagcctgttgaaatatccattcttgccagatcctctaaatagtaccttttggagatrtaaaaaccagcccatgtaacatgagcgctaccatttgccaactatcagggtctggcaaaaaagtaagcacagcatgtaggaaatacagtatcttgcaatg

SEQ ID NO: 20856 - DNA, 201 bp, Homo sapiens
agtttctatagacaggaaaagcacatagacttattagcttattgaatttgcttttctaaatatctcagtattgaattgaactactcatttatgatataatytcatacatcacagatagctagacagtgttattttagacgtcaaaatgtttttaaatcatgaaaggggtattcatacgctatgctaacaggctgtcagcac

SEQ ID NO: 20857 - DNA, 201 bp, Homo sapiens
tgttcaaaatccatgacctagatactttacttggtgctgtaagtagagacataaccaagacttgattactgcacttaaggatattccagtctggagggagygaaagagaggagggaaaagagagatgggggaaaacgagtatgctttacgatttgctcaggctttcctctcattctgagaataaattcatgaaaccccttg

SEQ ID NO: 20858 - DNA, 201 bp, Homo sapiens
tggacagtaagtgcccttagtcactgcatttgtctcctaggcttaaaacaacagaaatatattttctcatggttttggaggctagaagtctgaaatccagyagagctgccctcctcggggagctccaggggaaaatctgtttcttgtctcttccagtttatggtggctgccctggcactcctgggcttccagctccatcac

SEQ ID NO: 20859 - DNA, 201 bp, Homo sapiens
  misc_feature (1)...(201): n = A,T,C or G, or insertion/deletion polymorphism (see Tables 1-2)
cttttagattccttctgaaccatctaagtcctccatctgccctactcccaccttgcattttatcatgaagtgacacatagcagaagagcagtataataaanttaagccagtgacttactactttccccaagggtagaaatcccctctgtttcttttctcttttgtttccaggttaaagggtgcatttgcagacatctaata

SEQ ID NO: 20860 - DNA, 201 bp, Homo sapiens
  misc_feature (1)...(201): n = A,T,C or G, or insertion/deletion polymorphism (see Tables 1-2)
aaaggcacttacttacctggctgtttttcctcatttggtcggtatttctaaggtaactataaatggaacaggcaatgaaagcattccctagtgttctttancagctttctgaggcctcccccagtctgctgccttctactcggggccagagacaggaagagaactgctcagcctggctctgcatagcgctcattttcctcc

SEQ ID NO: 20861 - DNA, 201 bp, Homo sapiens
  misc_feature (1)...(201): n = A,T,C or G, or insertion/deletion polymorphism (see Tables 1-2)
tgttattgcttatgtatttgtggaggagggctacatgaatatgagacctttggtattattccagtatctcttagctcaaggatgttttactcacagaaacntggtgctgttttttaatgctactttgaagtagagtaagtttgccttgagcgatattcaaacactagtgtttcccttttttctagttttaaaaaaagaaac

SEQ ID NO: 20862 - DNA, 201 bp, Homo sapiens
gtctatcgaaaaagcgtttcagccaggctccgtggctcatacctgtaatcccaccactttaggaggccgaggagggaggatcacttgaagttagcagttcragaccagcctgagcaacaaaatgagactctctcatctctaaaaaaaaaagttttaaaaacttatctgggcctggtggtgcatgcctgtagtcccagctac

SEQ ID NO: 20863 - DNA, 201 bp, Homo sapiens
gtgggaatctcattcccttccacagtctcttttcttcccttctgttctctctgggaaaattaacctaatattagttctaaaaatgacacgttaagtcactsccagttaagtccttgcaagaagctcgtccttgactttctattttctcaagggatactgaaagataacttttcataaatccatgaacactattacagaaaa

SEQ ID NO: 20864 - DNA, 201 bp, Homo sapiens
  misc_feature (1)...(201): n = A,T,C or G, or insertion/deletion polymorphism (see Tables 1-2)
gctaaatagcatacttttcttggtgtagatttctggagggatatgcaggggatttgcatgcttaattcccattagcacctgtcactgggatttattatccnagagttaattctccactcactgcagccaagaaaaagaaagcccttgtatatggatttaaatgaagcttttcatttttcaagatgagatgaatttcctgtc

SEQ ID NO: 20865 - DNA, 201 bp, Homo sapiens
cctatgtatactctctgtgtaatatatccatttttatgctgaaactcagttttgtttgtcagcatgttgtatgtatccttcaagctaaatattcctatccrttaattttcctttactaaaaacatagctaatcatgcaaatgtcatcatctttattagtgctagtatcattgcaaaatattatttactatgatccatacct

SEQ ID NO: 20866 - DNA, 201 bp, Homo sapiens
ttcccccacccttaaataacctgaaaccaatttcaggttcccaaatgctcttcaaagcaacccaccttagaagtaatgctgatggcatttcaaattcaagrtagtttgctttttccatctccagacttcaagcagatttgaaattataggttcaaagagaaaaaatattatctacttttacccaaaccactaggctctggt

SEQ ID NO: 20867 - DNA, 201 bp, Homo sapiens
ctcttgacttcctcaatttgcctcgttgctttcaactggaaaccactctaaattccactttcccaactagtcaagaagctttgattataataataataatwattattattattatgtttaatctatcttctgagatgggcacgaatggaccagggacgaacggggtgtggacacgcagccgatccgtctccatacgtgtgg

SEQ ID NO: 20868 - DNA, 201 bp, Homo sapiens
  misc_feature (1)...(201): n = A,T,C or G, or insertion/deletion polymorphism (see Tables 1-2)
tatgaagaaatacctgagactgggtaattcataaagaagaaaaggtttaatggactcacagttccacatgactggggaggcctcacaatcatggcagaagntgaagaaggagcaaagacacatcttgcatggcaacaggcaggagagcgtgtgcaggggaactcctatttataaaaccatcagatctcctgagacttattc

SEQ ID NO: 20869 - DNA, 201 bp, Homo sapiens
cctgagtagggaccaggaaagaggaggcaaagtggtgttatttgttaatggcctaggattgttgctgagaggattgttacattagttagacattggctaamataatctactaatcttctttccatagaagggtgatggattggaatatgccacttacttggaaattctttttaaactggttaatatataaacatacaagga

SEQ ID NO: 20870 - DNA, 201 bp, Homo sapiens
ctgttgcagcgaattccattgtgatcatcttaatatgctccttttttgtttttatctgaggtgtaataagtaggctgtgtataatggtagaaaatgacatrgggtggtctttgagaaaattcttcacaagattctattatgtatacatgaaaatggtagcatttattgctcatttctgaggacatgacaactagtattttt

SEQ ID NO: 20871 - DNA, 201 bp, Homo sapiens
aaataagtggaagtggtgctatggaaaatgtaaagcattatgtaagtgtcaccttcttagaattcgtgtagaatcaccaactttagaactaaaagtttgtrgagaccccaagcctctctgactccattatggaaataaggaaataggcccagggaggtggggacaattgcaggacttggacctcaattcagacctctggac

SEQ ID NO: 20872 - DNA, 201 bp, Homo sapiens
taaaaagtgaggaatcaaacatataaggagagagatacaatgaaagaaaatatttccataattaaaatatatgatcaattgtttttgatttaagctttaarctggaaactttttcagtactagttccgagtaaatgatattattatgaagcagcctacatgctaaatagcatacttttcttggtgtagatttctggaggga

SEQ ID NO: 20873 - DNA, 201 bp, Homo sapiens
gtgtaatttccagtctaagtccatgtcagaatccagtggcagaactaatgtcccagctcaaagacattccaggaaagagacagaattttctgttactcagsctttttgttctattcagtccttcaacagattagatgaggcccgttctctatggaaaagacaatatagtttactcagtccattgattcccatgtcaatctc

SEQ ID NO: 20874 - DNA, 201 bp, Homo sapiens
tttactgtagcaactagaatggagattatgatcgaaaaataatgtcatttcagtgagttttggggcatactattacactattttcaagacaattaatgaayttacagtcatactttctagcgtaatgctgtccaatagaaccataatgggcactacatacttaattttaagttttcttgtactcacactaaaaaagcgaaa

SEQ ID NO: 20875 - DNA, 201 bp, Homo sapiens
agagacagaattttctgttactcagcctttttgttctattcagtccttcaacagattagatgaggcccgttctctatggaaaagacaatatagtttactcrgtccattgattcccatgtcaatctcatccagaacacccttacagatatgtcagtaataacatttaatgaaatatctgggcactccatggtccagtcaagt

SEQ ID NO: 20876 - DNA, 201 bp, Homo sapiens
acactaaaaaagcgaaaagaagcagctaaaattatcttaataatattattttaattcaatatgtctaaaatatttcaacatgtaactaatatttttaaacyattaatgatagattttgcattcctttttttaatactgtctgaaattcagtgtctattttatacttacagcacatcaaatgtggattttaaattttcatca

SEQ ID NO: 20877 - DNA, 201 bp, Homo sapiens
tccttttgtttattcatttatattgcctgtaagattctgagccattgctacacaaggactatacctcatgcatatttttccctagggatcctagagtggamccacaatataacaggggggaagtgaaagttttctgaattgaattggatttaattcttccagtcagttaatgggaaaagcaatccacagggggctggctgc

SEQ ID NO: 20878 - DNA, 201 bp, Homo sapiens
tctgttactcagcctttttgttctattcagtccttcaacagattagatgaggcccgttctctatggaaaagacaatatagtttactcagtccattgattcmcatgtcaatctcatccagaacacccttacagatatgtcagtaataacatttaatgaaatatctgggcactccatggtccagtcaagttgacacataaaat

SEQ ID NO: 20879 - DNA, 201 bp, Homo sapiens
agcatcagtcattgatttaaattttaaatcaattattataaattaaaataaaaaattcagttaataagttatatcagccacatttcaaatgctagatagcmacatatagctagtggctaccagatagaataatcgttctagatattcagtgctgtcaccaggattattgctgtagaagagagataaaaagttcatctatcc

SEQ ID NO: 20880 - DNA, 201 bp, Homo sapiens
tactgttcctaaagataacaagagagatatatggtgaatttgaagcagccctgaaccatcgaaatcggtggaagaacgtttagaatctcattagctgatakgcaaagcaaatgtcaggtagagattgagagattgttgagtagtcttggagaaagtggcagctgaaaacaagaaaaatgaaaaaccccaatccttgtcctt

SEQ ID NO: 20881 - DNA, 201 bp, Homo sapiens
gacattttttcttagatatgttattattacttgagcctttggcctggaaatcagaaatctcttcagtgttgcaatttctttcctctgatccattttgtgaycatttcatatagtttaaccctcaccgtgtaatcttatttccaaaaatgtggcctgcctatatatatatatgatacaaaaggaataagaaaatcacttggc

SEQ ID NO: 20882 - DNA, 201 bp, Homo sapiens
tggttatctttagacatttttatttacattaaaatgaacattccatttctcttgctgtctctgtcgcatatttgtgtcttttgtgtgtaaacgtgcacacwcatgcacatagtcacaaacaatcataattcagattctggatatgtccaaatgaatgaatttggtgtgagattctttctccccatacaaggttgtggaaaa

SEQ ID NO: 20883 - DNA, 201 bp, Homo sapiens
ttcttcccacagaagacagtgtccacaaatcaggctttctctctctctctctctctctctctctctctctctcacacacacacacacacacacacacacasagacacacacattagcaaaacttgaatacttgtgacatgctaacatcaccaccattttctctcagccccgccctgacatatcagggtgagactatcagag

SEQ ID NO: 20884 - DNA, 201 bp, Homo sapiens
ttaccacactcctggacgttcttcgtacctgctctgctcagccccctcctggaacgtggtgagtgtttagagtgccctggacacacactcccacctaagtkgctcatctttcaaggttccgcaaaacatgatctcatctaaacttttcccctgcatgcccatctgttccctttgcttcacacttatactattactcctgta

SEQ ID NO: 20885 - DNA, 201 bp, Homo sapiens
gctattactctgtggaggctattactaattagaatttgcaaaaattgtgtttgtttaagtaaatgcaaaaagtccgactcttttcttagcttctgaaatgmtcatcagccacaatacccttaagatataaaaattatgatagttaacgtaggctttcttcagtacttcaacctagcctgatttgagataaaattctgttga

SEQ ID NO: 20886 - DNA, 201 bp, Homo sapiens
tgtgtttgtttaagtaaatgcaaaaagtccgactcttttcttagcttctgaaatgctcatcagccacaatacccttaagatataaaaattatgatagttaacgtaggctttcttcagtacttcaacctagcctgatttgagataaaattctgttgaatttagtaaatgttcttcttattaatagattatatatctaaggat

SEQ ID NO: 20887 - DNA, 201 bp, Homo sapiens
tagcacttcgctggcttaaaacaacagcaaaaaggcagacaaccagaactgttgtaaagggagcactggaggggctcttgggctcagctgagtttccactmaatttgtaagaagaaaccatattttcagtaaaaatacttgcatattaagtggtcaaatgtgaatttttaacaataaaatattggatggatgtagagtgta

SEQ ID NO: 20888 - DNA, 201 bp, Homo sapiens
accctaagtgggttcactagcgggtgaaggaatcaggatttggatatctgttccttgtgactgtccagtggattcctctccaagtaacaactaactgcacrgtaagcagaatgaattatccaagaaaactgaatggctattttactgacttgtctatatatagatgggcagtttttccatatgtaagtctttaaaatgttc

SEQ ID NO: 20889 - DNA, 201 bp, Homo sapiens
  misc_feature (1)...(201): n = A,T,C or G, or insertion/deletion polymorphism (see Tables 1-2)
caagacattattataaatgtaacttcctaaattcctgtgatggcttacaatatccctctgctgccagcaagcctgatggcattgcaaattatacttgggcnaaaacagaaaagttttggtataaattgcctcacaaagaaaagttatttttcttttgaaataacagcctcaatgtttagctctgctgttttaatgtgacaa

SEQ ID NO: 20890 - DNA, 201 bp, Homo sapiens
  misc_feature (1)...(201): n = A,T,C or G, or insertion/deletion polymorphism (see Tables 1-2)
ttaccccttacaaaagcaaaatgcggttataaaacaacaggaaaaaaatcaaagtcgattgtccttattctttcttctttagtctctgtcctagtagccancatttattatatgcttactgtatgcctaactctgttataagacccttgttcatgttaactatcataatcttcatacgacatcctatgaagtaagttctgt

SEQ ID NO: 20891 - DNA, 201 bp, Homo sapiens
  misc_feature (1)...(201): n = A,T,C or G, or insertion/deletion polymorphism (see Tables 1-2)
tgtttgagaatagaacaaatcagtaaatgactcaagaatgccttagtaaaaaataaataaacacaatgcagaaataaaatcatcattttatttggaacacnacatattttactattgctttataattgatagttataattttactattgcttcataattttcaaatacattgtctcatctgatttctggaactatctgatg

SEQ ID NO: 20892 - DNA, 201 bp, Homo sapiens
tgtgacaaaaattcgcttaacaattaaaaaagaaataaaaccaaagttaggtttgactggacttaatcagaagacctcttagggttgtcatctggagctayagcctttgaaaatcattttgcacttaggtttgcaactagcaattttatgttgacaaaggtcctaccaataattgcttcttgttacattttacaatcaact

SEQ ID NO: 20893 - DNA, 201 bp, Homo sapiens
agtgactcatctcttacagtaaatcttggatgaaatataatttgtaagttgatcagtgttttcaggatcacatattttattttatttactttattttattyttgagatggaggtctcactacattgcccaggcttgtcttgaactgctgggctaaagtgattctcccacctcagactcctgagtagctgggactacaggtg

SEQ ID NO: 20894 - DNA, 201 bp, Homo sapiens
atatcaatatgtcacccccacactttatccaaacactttgcccagtatagttcaaatgaggttttcaattgcttcccccagaagtgtgagattcagcatckacgtatggtaggccaattgccccaagcctagggctgatgctaccttgctgtgcaaggaaagaggtgattaggtctaaatttgactcctggagtgaggcct

SEQ ID NO: 20895 - DNA, 201 bp, Homo sapiens
aacttattgggcatgacttcaactatactggttggttaatcttttacttttgatgtagaatttaattacagacctcaaatataactacctccaaatacaayatgaaatcttaaaactttaactgcctttaagcatagccagagtccttggaactttttatttatctgcagacttctacagaataacagtttcatggctgtg

SEQ ID NO: 20896 - DNA, 201 bp, Homo sapiens
tgacttcaactatactggttggttaatcttttacttttgatgtagaatttaattacagacctcaaatataactacctccaaatacaacatgaaatcttaaractttaactgcctttaagcatagccagagtccttggaactttttatttatctgcagacttctacagaataacagtttcatggctgtggaaacatttgtca

SEQ ID NO: 20897 - DNA, 201 bp, Homo sapiens
  misc_feature (1)...(201): n = A,T,C or G, or insertion/deletion polymorphism (see Tables 1-2)
tctcaccttgaattgtaatcatccccatgtgttgtgggagttaactgaatcatgggggtggattttccctatgctgttctatgatggtgaataagtctcangagatctgatgcttttataaaggggagttcccttgtacatgccctcttgcctgccaccatgtaagatgttccttgctcttccttcatcttccaccatgat

SEQ ID NO: 20898 - DNA, 201 bp, Homo sapiens
  misc_feature (1)...(201): n = A,T,C or G, or insertion/deletion polymorphism (see Tables 1-2)
atatatgttgattatctgcttttagaagtcttgtttattgtctgttaccttcactagattttaagctccgcaacggccaggatttttgcctattttgggtnaggcagtatccccaaactatgacattgtgtgactctatgagtaggtactctatgaatgtttattaaatgaattaattaaaattttcactaagctaaggat

SEQ ID NO: 20899 - DNA, 201 bp, Homo sapiens
gtcctgtgcagaacccttactgtaatacagctcccagtgtcatcatggggttgtttcttccagtgtctcttgttacaggctgatgagtgaatcccaaagcwtaaggttcaggcaaaatattaacatacaaggtctttcctcaggaacaatttgggtttcaatagtgccgctcttgatgttaccattgttgacaatgttgtg

SEQ ID NO: 20900 - DNA, 201 bp, Homo sapiens
gtataaccatgtgccctgctttataaatactttcagtttaacctgctttgtttcacttgattgctctagtatggttaaagacaagtgtttttgaataacarcaggcctatcaaattgccaactgggaaatccatggaatatgcttagggcagctttttgcagcatttcctgtatctggcaaagaatttttgaaaaaaatgt

SEQ ID NO: 20901 - DNA, 201 bp, Homo sapiens
gttaaagacaagtgtttttgaataacaacaggcctatcaaattgccaactgggaaatccatggaatatgcttagggcagctttttgcagcatttcctgtayctggcaaagaatttttgaaaaaaatgttaaatagcacaatggattcttaactggcagactctaggaaacacttttatatataatatataggcttactagt

SEQ ID NO: 20902 - DNA, 201 bp, Homo sapiens
acatatgaaactcaagtcctgtgctagacaatgtcagccatcagctggtacaaaagtgagctctgggactctgtggacacaccaacacggacccagtaaascaggcatttagagccaccgtgcagaagcagatctgcatggctccccacagcctcctacagtgcccacagtgccatgcgtaacttggtgttccataatcaa

SEQ ID NO: 20903 - DNA, 201 bp, Homo sapiens
tgactcaaaattagaaatgtcaggatcttcaattttgaggtatggccatttattcttaaagatactgcattcaaacaaaaaggagtcagctgaggtggctyacgcctgtaatcccagcactttgggaggcctaggagagaagatagcttgagctcaggtcatcgagaccagcctgggcaacatagtgaggcccccatctct

SEQ ID NO: 20904 - DNA, 201 bp, Homo sapiens
  misc_feature (1)...(201): n = A,T,C or G, or insertion/deletion polymorphism (see Tables 1-2)
ctgtgctagacaatgtcagccatcagctggtacaaaagtgagctctgggactctgtggacacaccaacacggacccagtaaagcaggcatttagagccacngtgcagaagcagatctgcatggctccccacagcctcctacagtgcccacagtgccatgcgtaacttggtgttccataatcaacgaatcaattcatcaacc

SEQ ID NO: 20905 - DNA, 201 bp, Homo sapiens
ttacattaaaatgaacattccatttctcttgctgtctctgtcgcatatttgtgtcttttgtgtgtaaacgtgcacactcatgcacatagtcacaaacaatsataattcagattctggatatgtccaaatgaatgaatttggtgtgagattctttctccccatacaaggttgtggaaaagagcacagaccctggaggcattc

SEQ ID NO: 20906 - DNA, 201 bp, Homo sapiens
ataagggtgggtgcctatagtcccagctacttgagaggctgaggtgggaggatggcttgagccaggaaggccaaggctgcagtgagctgtgaccacaccaytgtactccagcctgggtgagagagtgagaacttgtctcaaaaaaaaataaaaagagagagagagtgagatagagagacagaaagaaaaagaaatagggca

SEQ ID NO: 20907 - DNA, 201 bp, Homo sapiens
  misc_feature (1)...(201): n = A,T,C or G, or insertion/deletion polymorphism (see Tables 1-2)
tcaaccagtgcttctcagattttagtgttatgcagaaaacacacctgtggagtttgttaaaactgtagattcccagggcccaacctgagtgtggaatctgnagtttaatcaagcacagcagggtaatacctgcatatctctttatgaaacatcaccttcaattattagccctcccaattgctttgtctcacttggttatgt

SEQ ID NO: 20908 - DNA, 201 bp, Homo sapiens
  misc_feature (1)...(201): n = A,T,C or G, or insertion/deletion polymorphism (see Tables 1-2)
atacctgcatatctctttatgaaacatcaccttcaattattagccctcccaattgctttgtctcacttggttatgtttattttgattagtagtgataacantagatgtatagcctaataaaatttattaatacttcggggaaaaagtagagtgggggattattatcttttgggcacttactatatgctaggcatgtgctta

SEQ ID NO: 20909 - DNA, 201 bp, Homo sapiens
aaagtttaggtgatataagcaaggaatttgattatatgaaatatcactgtctccacacagagaaaattgaaggctgaagaaaaacatgttttgtgattatwgcttaccaatgttagaaggccctgtgatctatctcagggatttggaccttgaaatcaggtggaaactattatcctaacaaacacttctcttccaaaattc

SEQ ID NO: 20910 - DNA, 201 bp, Homo sapiens
aaaatgattttggattattcatcttaatgaaaacactcttttttttttttttgacagacggtctcactctgtcacccaggctggagtgcagtggtacagtytcagctcactgcagccacaagtgatcttcttccctcagcttcccgagcagcagggagtacatgcgcatgccactatgcctggctaatttttttatttttt

SEQ ID NO: 20911 - DNA, 201 bp, Homo sapiens
  misc_feature (1)...(201): n = A,T,C or G, or insertion/deletion polymorphism (see Tables 1-2)
aagatttatttgatctcaaagtattttttaaattttaatatgtagcattcaaggctgggattaagtttgttttttgaagtaaaactaagcagtgacatganatcggataaaaacatggccataactgtgcaggcacattgcatatcaggagtttctgtgcagtgaactctaggctgaggatgcagattcattgcatcttgc

SEQ ID NO: 20912 - DNA, 201 bp, Homo sapiens
acgcccttattcttacaaaataaacagaaaacatcctcttaatgtgattctttctgcacagctagacttattttcagacttaacagagacacttgaggccwaaaatacctctaacctagctggtcttactctatgttttaaggctatttggaatttaaaaagagaaaagaaatcagacttaaaaaaaaaaagacaaaatgc

SEQ ID NO: 20913 - DNA, 201 bp, Homo sapiens
ggactcaagcaatcctccctccttggcctcccaaaatgttgggattacaggtgtgagctgcaccacctggcctgaaagtttttaagcttcaagtcccacaraacttaaatatgttcctgaagggccacagtaatgatcctggtaaaaagggcaaacactaattgaaacctgctacacttgacctgagcaaactcattagca

SEQ ID NO: 20914 - DNA, 201 bp, Homo sapiens
tttctaatgacctttttgagtggtgtcatctttctattcctagtacattcaaaggtcttgtaaattacatgttggtacacttacatgaagtatataatccatgaaaacttatccacacattgttatgcttttagcgtaatatatttaggttatttttattcatccaatttcaaacaaaaatcaccatttccaaggaaaatc

SEQ ID NO: 20915 - DNA, 201 bp, Homo sapiens
tcccaaaatgttgggattacaggtgtgagctgcaccacctggcctgaaagtttttaagcttcaagtcccacaaaacttaaatatgttcctgaagggccacrgtaatgatcctggtaaaaagggcaaacactaattgaaacctgctacacttgacctgagcaaactcattagcaccaattgtggattgactgggaagcttgg

SEQ ID NO: 20916 - DNA, 201 bp, Homo sapiens
  misc_feature (1)...(201): n = A,T,C or G, or insertion/deletion polymorphism (see Tables 1-2)
aggaaaatcattttttctacttttaattccagccttctcagtaacggcttaccacccccaccccgccctcatagaaataaggaattttaagttccagccantcttcctatatttaaatttaagaagttgcatgaaggatatttccaaatttcctaatttaggctcattttacttggatagtgatttccatccttggatttt

SEQ ID NO: 20917 - DNA, 201 bp, Homo sapiens
gtgtgagctgcaccacctggcctgaaagtttttaagcttcaagtcccacaaaacttaaatatgttcctgaagggccacagtaatgatcctggtaaaaaggrcaaacactaattgaaacctgctacacttgacctgagcaaactcattagcaccaattgtggattgactgggaagcttggagacaagcttcttacttcgtct

SEQ ID NO: 20918 - DNA, 201 bp, Homo sapiens
cattgtatgacaacctaaaccaaaaggaaggtgaaagatctgaagctgaagaatttaataccagcaaaggatggttcgataattttagaaagattttaaawgtcaagataacaggagaagcagcttcagttgaccaggtggcaacagtgtccagactccattaagaaaatcattgagaagaaacaatatctgcctgaacaa

SEQ ID NO: 20919 - DNA, 201 bp, Homo sapiens
gagaagcagcttcagttgaccaggtggcaacagtgtccagactccattaagaaaatcattgagaagaaacaatatctgcctgaacaagtttttaatgcagrcaaaagtgacctagtctgggaacgaagaaatgccgcaaaagaaatttactggtaaggaagagaagtgagctccagcaattaagggagggaggaataggct

SEQ ID NO: 20920 - DNA, 201 bp, Homo sapiens
  misc_feature (1)...(201): n = A,T,C or G, or insertion/deletion polymorphism (see Tables 1-2)
tctagacttgcctgctccttcgtctgttctccctaaagtcctttctttatatctggggactttattccaaagatttaataactgcatggcttccttagcangagagcagactcttgggggcctagcgctctatcagatataaccctttagccaccgggtcacagggtatccagaaatcccagggagccagccagggcctgc

SEQ ID NO: 20921 - DNA, 201 bp, Homo sapiens
gacagtatgaatccccaaggattgttatgcagattaactgagatgcacagtagctgttcaaaaaatactagttacctttactcgtctaagctacaattaartttattctatgcctgggattaaacactttattttctgttgtaactatatatatgtacagatcattcacttatttaacatatattaactggacaaatatta

SEQ ID NO: 20922 - DNA, 201 bp, Homo sapiens
gacttgctgcagatcattctaaccgctcttcctggttatgagttatgatattatgaaagtgtttgtggtaaattcctaagagagaacgaaaactttacccyttacaaaagcaaaatgcggttataaaacaacaggaaaaaaatcaaagtcgattgtccttattctttcttctttagtctctgtcctagtagccaacattta

SEQ ID NO: 20923 - DNA, 201 bp, Homo sapiens
caatgacttctctcctatgagtacttctgagtccttcactgcatttctcctattgacctccccattttttaaaattttattttcctcttggctgctctgaygctaacttccttgggttttctcctaccgctttgttcactctatatcattggatgacagcttttcctcttgaatgtcactgtcctcttttttttatgctgc

SEQ ID NO: 20924 - DNA, 201 bp, Homo sapiens
ctgctcccggtcactcctaaacttcccagaccaatgacttctctcctatgagtacttctgagtccttcactgcatttctcctattgacctccccatttttwaaaattttattttcctcttggctgctctgatgctaacttccttgggttttctcctaccgctttgttcactctatatcattggatgacagcttttcctctt

SEQ ID NO: 20925 - DNA, 201 bp, Homo sapiens
ttttttgtagatacagggtctctctatgttgcccatgctggtctcaaattcctggactcaaatgatcttcccacctcagtcccccaaactactggaataasaagtgtgcacccaaccagtaataaggagtcttaacaaggcattaacacaaaaactaacgtattgtttattaaaagtagtaaaatgaagagtattgacttt

SEQ ID NO: 20926 - DNA, 201 bp, Homo sapiens
ttttccagtgaaccttcagagggctaaggagaacttttccctccgcccctacagtacccagaatggtcatttccccacttcctggccactcctcatcacarcttggtttctgctcccggtcactcctaaacttcccagaccaatgacttctctcctatgagtacttctgagtccttcactgcatttctcctattgacctcc

SEQ ID NO: 20927 - DNA, 201 bp, Homo sapiens
ctcttgtaacaattcaaataaaaatgataaggacctcaacttgagtcctggtgatgaaaaggagaataggagttgagggtgagtgaaataatgaagagctrgtatgcactgtaattgtcaatggattaggcctgacagggagaaggaattccaagcttttgaacgatcttgtagtctggattggggagctgtgtcaacagg

SEQ ID NO: 20928 - DNA, 201 bp, Homo sapiens
aggctcccatgtgtacatgttaaataaaatttgtctgtcttctctccaattaatctgccttttgtgacttagttgattttccagtgaaccttcagagggckaaggagaacttttccctccgcccctacagtacccagaatggtcatttccccacttcctggccactcctcatcacaacttggtttctgctcccggtcactc

SEQ ID NO: 20929 - DNA, 201 bp, Homo sapiens
ctaaagggacagtttttaaatatgcacatttctgttttattttgtacaaggatttcttccaaagtttcatgattttgattaatagagtaattcctataaasttctgtcatatcttacagaacctctttaagaaccacaatgcaaattaaaaaaaaaaaaagcctaaccctaaagtcaggtttactgcctgaccctgaagta

SEQ ID NO: 20930 - DNA, 201 bp, Homo sapiens
tgaatttctatagtatcaggtgtaatgtctcctttttcaaaaaacttttgaaaatgaaaccaacttttgtttcattgatcttttttattgttttcttcatytcaatatcctttatttctgctccgatctttattatttcttttcttctactacttttgggtttagtttgctatagcttctccagtttattaagatgaatgt

SEQ ID NO: 20931 - DNA, 201 bp, Homo sapiens
gctatcatctatgttctctcaaggccctagggctctggcagcaaaactagccaggcctttgttcttccctccagagaagcaagttgcccccagccctgtgyggatccagaggtaacatctaggagccaaggcctggagtcagaaaccttaagaatctacctggaactctattctactgtggctaaactggcacccatgcca

SEQ ID NO: 20932 - DNA, 201 bp, Homo sapiens
aagaaataaatatcagtacaaccatcaactctgtgaacacttgacagcaatgctgatttaggggctggaggaagtgggtatgtaaatgagtacattgacasaggactctttatgtaactgcactgtcctaagtgtgctatttatattaccttttaaaatcatcacagtaatcctatacaatatgtaatagaattatcttca

SEQ ID NO: 20933 - DNA, 201 bp, Homo sapiens
taggagccaaggcctggagtcagaaaccttaagaatctacctggaactctattctactgtggctaaactggcacccatgccacaagacaaagtttctcccrctcttccctctcctttccaccatcagaggagtctttttccatggccactgccactgccaccccaggcccacagcaagtactgcttgactaccaccaatgt

SEQ ID NO: 20934 - DNA, 201 bp, Homo sapiens
ttaaaatcatcacagtaatcctatacaatatgtaatagaattatcttcattttatggatgaagaaatgaaaacatagcaacctcagtaagtacagaactasgattaaactatggcagagcagatccaggctccatgcttgtaaccaccacagcaggatagataatgacccccaaaggcatcaggtcctaatctctggaatt

SEQ ID NO: 20935 - DNA, 201 bp, Homo sapiens
tctttctttctttctctctctttcttctttctttctctctttcttattaaaaaaatggtataattctacacaaactggccaaaaacttgttttatttgctygcccttctaggtcaatatgtacaaatctactttcttatttctattggccagccagtgtacttttgcttggatgtttcagaaattatttaaccattcctca

SEQ ID NO: 20936 - DNA, 201 bp, Homo sapiens
tctttcttctttctttctctctttcttattaaaaaaatggtataattctacacaaactggccaaaaacttgttttatttgctcgcccttctaggtcaataygtacaaatctactttcttatttctattggccagccagtgtacttttgcttggatgtttcagaaattatttaaccattcctcagttggtggtcagttgttc

SEQ ID NO: 20937 - DNA, 201 bp, Homo sapiens
ttctttctctctttcttattaaaaaaatggtataattctacacaaactggccaaaaacttgttttatttgctcgcccttctaggtcaatatgtacaaatcyactttcttatttctattggccagccagtgtacttttgcttggatgtttcagaaattatttaaccattcctcagttggtggtcagttgttctcagtcttat

SEQ ID NO: 20938 - DNA, 201 bp, Homo sapiens
atatatgcaattgcacatttcttcacctcctcatcagtcattgagtattttttagctaatttggtaagcaaaaattttcttttgcaaaaaacatcacattrcatttattaaattatttgcaaaagggggtaaatgtgtttgtgtgaaaatgtcttctaagaatacactgtagactacatggcagaggtagagatgataggc

SEQ ID NO: 20939 - DNA, 201 bp, Homo sapiens
  misc_feature (1)...(201): n = A,T,C or G, or insertion/deletion polymorphism (see Tables 1-2)
cctgcatatctctttatgaaacatcaccttcaattattagccctcccaattgctttgtctcacttggttatgtttattttgattagtagtgataacagtanatgtatagcctaataaaatttattaatacttcggggaaaaagtagagtgggggattattatcttttgggcacttactatatgctaggcatgtgcttagaa

SEQ ID NO: 20940 - DNA, 201 bp, Homo sapiens
gcattttttcttctccctactcacctctttgagcttggcagcttttgtaacaattttccagggttttgttaagccttggggcaaaaatggtcacctgaaayttaaaagctgtgtttagcaatttgaaagcactgatacagaattagcatgttggcagtgactaccagagcaaaagtcaaggctgatgggcaacagtggaat

SEQ ID NO: 20941 - DNA, 201 bp, Homo sapiens
gcaccacctggcctgaaagtttttaagcttcaagtcccacaaaacttaaatatgttcctgaagggccacagtaatgatcctggtaaaaagggcaaacactwattgaaacctgctacacttgacctgagcaaactcattagcaccaattgtggattgactgggaagcttggagacaagcttcttacttcgtctgggactcct

SEQ ID NO: 20942 - DNA, 201 bp, Homo sapiens
  misc_feature (1)...(201): n = A,T,C or G, or insertion/deletion polymorphism (see Tables 1-2)
ctattacccaccaactgccccatacacacacctatacctgcattccagggttgtgatcaataaccaatcactattaaactggcatcataccaatatgaaantcctccgctgtctcaatatcccaataaccacaaagatctatagttctgatttaacattttagcaggttttttttaatctaagcacttacattgccattta

SEQ ID NO: 20943 - DNA, 201 bp, Homo sapiens
gggctcaatgctattagctgcatgcaaaactgaaggtaaatgcttaatcatagaaattagagatgattatttaatgaattctgaataaatgtaaggttttwgtccagcacgtttgcaaaaggggattgtttgttacacacagaaaggtaagaaaaatgtcattatagaaaatctgggatttagttcgcagggtttttgttt

SEQ ID NO: 20944 - DNA, 201 bp, Homo sapiens
actccattaagaaaatcattgagaagaaacaatatctgcctgaacaagtttttaatgcaggcaaaagtgacctagtctgggaacgaagaaatgccgcaaargaaatttactggtaaggaagagaagtgagctccagcaattaagggagggaggaataggctaactccagtttttcacgcaaatgcagtcagggttatgact

SEQ ID NO: 20945 - DNA, 201 bp, Homo sapiens
aaatgtaaggttttagtccagcacgtttgcaaaaggggattgtttgttacacacagaaaggtaagaaaaatgtcattatagaaaatctgggatttagttcrcagggtttttgttttgttttgttttttgtcttttctgggtaaatggtgatcttaagaagttatgttaaaaatagtttgtaggccaagcgtggtggcttat

SEQ ID NO: 20946 - DNA, 201 bp, Homo sapiens
cctgtaatcccagcactttgggaagctgaagtgggaagtttacttgagtgcaagagttcaaggagcaacaaggcaagactttgtcccgacaaaaaaaaaawttttttattctactttaagttctcgggtacatgtgcacaatgtgcaggtttgttacatatgtatacatgtgccatgttggtgcgctgcacccattaactc

SEQ ID NO: 20947 - DNA, 201 bp, Homo sapiens
gaaggaagattggtactttatacaaaagttttaaagaaatgaaaaagcaaaaaaaaaaaaacccaaaaaacagatattatgatgtatttcagtaaagtccrccaagtatgccttcctctcctgcctccctttcacttcctccacctctgccaccacccttgagagactacaagaccaacccctcctcatcctcctgctcct

SEQ ID NO: 20948 - DNA, 201 bp, Homo sapiens
  misc_feature (1)...(201): n = A,T,C or G, or insertion/deletion polymorphism (see Tables 1-2)
taatgtcttcaaatgctgggatatgttttctaaacacttggagttttactaccaacatttgctcctcttgctctgcttctaataatgttaaacaggggaanatggaattgagggtatttattcctttaattaaagattgatttaaaaagttacaagcatcataatttatctcttaattactgtccaaatgtatgtgaagtt

SEQ ID NO: 20949 - DNA, 201 bp, Homo sapiens
ttatgttaaaaatagtttgtaggccaagcgtggtggcttatgcctgtaatctggtgatttgggaggctgaggcaggatggcttgaggccaggagttcgagrccagcctgggcaacacagtgagacctagtctctcaaaaaaaaaaaaaaaatgtttcttaagtattagacatgaggaaaaatagcaatttgtagtaataat

SEQ ID NO: 20950 - DNA, 201 bp, Homo sapiens
ctggtggcctgacattgaaattgtccttgtatattaattttttaagcagtttttaagacaccgttgaatttaagcagcctccataaaggaatgcttttatrtggtcaaaaccaaatttagaaatcagaaattcttaattccaatagtatatagactctatttccaatgacctgtccagtttcgtttttatttctctttttt

SEQ ID NO: 20951 - DNA, 201 bp, Homo sapiens
  misc_feature (1)...(201): n = A,T,C or G, or insertion/deletion polymorphism (see Tables 1-2)
caaatgctgggatatgttttctaaacacttggagttttactaccaacatttgctcctcttgctctgcttctaataatgttaaacaggggaaaatggaattnagggtatttattcctttaattaaagattgatttaaaaagttacaagcatcataatttatctcttaattactgtccaaatgtatgtgaagtttatatgtag

SEQ ID NO: 20952 - DNA, 201 bp, Homo sapiens
  misc_feature (1)...(201): n = A,T,C or G, or insertion/deletion polymorphism (see Tables 1-2)
agacaacagagagggcattaaaataaagtagggaccaaagagaattttggaagtggaaaccttaaagaagatgtttcagaaagtttctaatggagtaggancaaagtaatcaatgaaacaaatgctgcaataataggtattattttacgtcatgcagccacacgtctttcagccaccatttatgtcttaacacacctacaa

SEQ ID NO: 20953 - DNA, 201 bp, Homo sapiens
attaaaataaagtagggaccaaagagaattttggaagtggaaaccttaaagaagatgtttcagaaagtttctaatggagtaggaacaaagtaatcaatgamacaaatgctgcaataataggtattattttacgtcatgcagccacacgtctttcagccaccatttatgtcttaacacacctacaagcccaaactaacaacc

SEQ ID NO: 20954 - DNA, 201 bp, Homo sapiens
  misc_feature (1)...(201): n = A,T,C or G, or insertion/deletion polymorphism (see Tables 1-2)
tgaatgtttattaaatgaattaattaaaattttcactaagctaaggatgtcagaaccttgtcatttgcagggattttgcttagacaattatacattgtcanacttacttggagatcttcaaaatccctctcctttttctctgggctgaagacttcagcattaaaaacatatgattgaaacacatacttattgctgttgcca

SEQ ID NO: 20955 - DNA, 201 bp, Homo sapiens
tacaaaaatcatacaaataattctcaaaagccattttggttacaaatagatatgaaattatttataattaagcaatctatgatgttcggaaattatcatcrgtaaaatgttatcctctatttaattatgcattcttgttgataatgcataaatccctgtgattatgttcttaagttaaggaatttaaaatagctctatttt

SEQ ID NO: 20956 - DNA, 201 bp, Homo sapiens
  misc_feature (1)...(201): n = A,T,C or G, or insertion/deletion polymorphism (see Tables 1-2)
tctactcctcgccccagttatccttcctcccctgcaccaatagtttttaaattatgtgtatcagaaccaataagttatccttagtatgagggcttagttcntacttccaaagtaaggaataatatgtaatttttcctacccagaacataatcatgtagccagtcaatttaagtcttagaataaaaatactagtaaaatgtt

SEQ ID NO: 20957 - DNA, 201 bp, Homo sapiens
  misc_feature (1)...(201): n = A,T,C or G, or insertion/deletion polymorphism (see Tables 1-2)
ttaagttaaggaatttaaaatagctctattttagatgctcctacttttctgacttaaaaaaagcctttcgtataccaaccaggataccatccaataacaantcctaaagcttggaaacttctctaatcagactcttcttaatgacgctgttctcaatacttgtcatttttaattgtagatggcaaaaacagcagtagcaat

SEQ ID NO: 20958 - DNA, 201 bp, Homo sapiens
  misc_feature (1)...(201): n = A,T,C or G, or insertion/deletion polymorphism (see Tables 1-2)
cttaatgacgctgttctcaatacttgtcatttttaattgtagatggcaaaaacagcagtagcaatttcatttctgtaggaaccaattcattattatgcagnctgccaatgatgctcttgttccaactcctcccagcatgccaacttagccttcaccaaatatttttcctttaaaagtaaaacaatacagagcttttgagtg

SEQ ID NO: 20959 - DNA, 201 bp, Homo sapiens
caacttagccttcaccaaatatttttcctttaaaagtaaaacaatacagagcttttgagtgagtcttgtggtgtggttcagtatcaatagtttccaaatcrattttattggatcaagaaaatgagatgtttccctccatctacatatccagcacctttctgttacgtaatagaaatggtaccttgtgaataatattgttcc

SEQ ID NO: 20960 - DNA, 201 bp, Homo sapiens; identical to SEQ ID NO: 3396
  misc_feature (1)...(201): n = A,T,C or G, or insertion/deletion polymorphism (see Tables 1-2)

SEQ ID NO: 20961 - DNA, 201 bp, Homo sapiens
tgtgcctacatagaaagtatgctatttataatttttgtgaataataagcatctttcatatacctatgtggcagttagaactctaggatggaccacatgatsgcttcctcctgatatacacactctgtgtaatcctatcccagtaatagtgggtggacccaggaatgtgatgaagtatcactcccatggttatgttacattg

SEQ ID NO: 20962 - DNA, 201 bp, Homo sapiens
atgtgacctctgctgtcacacaggaccagtgtttggtttaatgttctgctgtcacaatctcagaattcttaataaatttttaatcagggatcttgaacttycattctacaccgggccacacaaattttgtagccagtcctgtttgtagatatttctattgttaaaacatcttataattgtaaatgaatctgaggcactata

SEQ ID NO: 20963 - DNA, 201 bp, Homo sapiens
tggggtgtgcatttatagaaaaggtaataatttgggatacctgtggcatgttgccagaaataagttcacagtctgaagttgctgttcacaaactgaattcytattatcaccctaatgtcactccttcagatatttatattaaaaaataaagtggtaagaggatgtactcactgatgtccttgaagaaaaaaaaatcaattt

SEQ ID NO: 20964 - DNA, 201 bp, Homo sapiens
catgtaggataaatagtatttgtagctgatcactttatctttaaatacatgtagctatagtcatgctggatgtttaaattaaagttttcatctattatttyagttgaagagaattggcttgcttgtttcattttcaaaactttctctagaatagaaaaaagttaggatacagtttcgtaaaaagatgatttctaaaataac

SEQ ID NO: 20965 - DNA, 201 bp, Homo sapiens
ccccccggcagaggcagagtgccctccggatatctgtccggcgccttgctgagtggtggaggtgagggataccagctccgggtgtgcctcttttctctccytggctgccaatcctgattttccctgcagtccccttggtttgtaaattgcctgcatttattctgtcagccaacatgtacaaaatgtaagaaagaattttta

SEQ ID NO: 20966 - DNA, 201 bp, Homo sapiens
tttccatgtcaattggttttactggtcaaactacctttagttcatctactattgagtcagacactaaaggtgtattaagtcttccaaggatggagggatttatcctcatgtgcctactgtttcctgaaatttaaatctgcactgaatggcctaggatgtatagacagttaacctccctgaaacacagcctatccttttttg

SEQ ID NO: 20967 - DNA, 201 bp, Homo sapiens
agtaatagaagtgatatgccatattgcctataacaggaattcatccagggcataggcttgactttactttgtgaatattataggaaatcttaataaactamtatgctgtggttggctaaggcatctctctagataaacttttaacgattgattctgcagaaactataatgatatgcaaagaaaaactggatttattaaatt

SEQ ID NO: 20968 - DNA, 201 bp, Homo sapiens
ccagggcataggcttgactttactttgtgaatattataggaaatcttaataaactactatgctgtggttggctaaggcatctctctagataaacttttaaygattgattctgcagaaactataatgatatgcaaagaaaaactggatttattaaattaaaacatttctaatgatagaaatcttccttaataagttgcattt

SEQ ID NO: 20969 - DNA, 201 bp, Homo sapiens
tggtagcatacgtgtttttgctctccagcagacagaataactctttgaactttcagatctcttccagacttatgattttgtaatgttgacatatatttaastattaatactttattattcaacattttcaagccaaagaatatcaagcatgacaaaaattgaagcatttaaatatcttttttacccttactagatatctct

SEQ ID NO: 20970 - DNA, 201 bp, Homo sapiens
actctttgaactttcagatctcttccagacttatgattttgtaatgttgacatatatttaagtattaatactttattattcaacattttcaagccaaagawtatcaagcatgacaaaaattgaagcatttaaatatcttttttacccttactagatatctctctgaaccaaaatggatacacatgttcaaaatccaaattg

SEQ ID NO: 20971 - DNA, 201 bp, Homo sapiens
catatatttaagtattaatactttattattcaacattttcaagccaaagaatatcaagcatgacaaaaattgaagcatttaaatatcttttttacccttamtagatatctctctgaaccaaaatggatacacatgttcaaaatccaaattgtaaataattcatatttgttcccaaatgttggattaaccagagacaagtag

SEQ ID NO: 20972 - DNA, 201 bp, Homo sapiens
agagaactaaaaatagaacaccatttaatccagcaataccactacttggcatctacccaaaggaaaagaaatcattacatcaaaaagatacctgcactcayatgtttttcatagctctattcacaatagcaaagatagggaatcaacccaagtacccatcagtggataatcagataaggaaaatgtgatatatacaaacaa

SEQ ID NO: 20973 - DNA, 201 bp, Homo sapiens
tacccaaaggaaaagaaatcattacatcaaaaagatacctgcactcatatgtttttcatagctctattcacaatagcaaagatagggaatcaacccaagtrcccatcagtggataatcagataaggaaaatgtgatatatacaaacaatagaatactattcatccataaaaaagactgaaaccatgtcttttgcagcaaca

SEQ ID NO: 20974 - DNA, 201 bp, Homo sapiens
ccctgattctgaggggaggccaaggagcgactgcttgtaaggggtgtggacagagcatgtgcagtggaccaggatggccatagaggcatatgcagggctgyttatggcaactaaggaatctggtcattgaaaacccgtgacactcaaagcacttaaagaatgataatttggaacttagctttataatatatctctagaaga

SEQ ID NO: 20975 - DNA, 201 bp, Homo sapiens
  misc_feature (1)...(201): n = A,T,C or G, or insertion/deletion polymorphism (see Tables 1-2)
aagagtcctgagggatgttgctttgacatctccttcctgttttcttaacatcagagtacgtgctccccgagttttttgttggtatgtcaacttgcttatantataatttaagggctaattcagacccattcttcaaatgcaggaaaagatcacagttggaggccaactggagatcagatctcatgtgtagtgattccatta

SEQ ID NO: 20976 - DNA, 201 bp, Homo sapiens
  misc_feature (1)...(201): n = A,T,C or G, or insertion/deletion polymorphism (see Tables 1-2)
gagtcctgagggatgttgctttgacatctccttcctgttttcttaacatcagagtacgtgctccccgagttttttgttggtatgtcaacttgcttatagtntaatttaagggctaattcagacccattcttcaaatgcaggaaaagatcacagttggaggccaactggagatcagatctcatgtgtagtgattccattaga

SEQ ID NO: 20977 - DNA, 201 bp, Homo sapiens
ttttaaaagatcactctggctgttgcgggatagttgcgtttaggggtcaaaacaaggaaacctgcaaggaggccattactatagtacaagacaagagatastgagatgatggtggttttgactctgttggtagcagaagacgttgtaggagttgaatctgaggtatatttggtctttaggaaatcagaacttaatcctagc

SEQ ID NO: 20978 - DNA, 201 bp, Homo sapiens
cctcacaaagaaaagttatttttcttttgaaataacagcctcaatgtttagctctgctgttttaatgtgacaaaaattcgcttaacaattaaaaaagaaayaaaaccaaagttaggtttgactggacttaatcagaagacctcttagggttgtcatctggagctacagcctttgaaaatcattttgcacttaggtttgcaa

SEQ ID NO: 20979 - DNA, 201 bp, Homo sapiens
gatttttcatgtgcattgatatttagaacatgtctcattttaactctatgtatgttagaaattgatctgcatttgaaaagataaagatcaattggcacttygacacatttgagcattgaaaagaatattttaaaataggtttgagccattagaaataacattatgaaatataatatttaaacagaattataaaattttcag

SEQ ID NO: 20980 - DNA, 201 bp, Homo sapiens
caggctggagtgcagtggcacaatctcagctcactgcaacctccacctcccaggttcaagagattctcttgcctcagcctcctgagtagctgggactacakggacatgccaccatgcccagttaatttcttgtatttttagtagagacagggtttcaccatgttggccagggtagtctcgaactcttgacctcaggtgatc

SEQ ID NO: 20981 - DNA, 201 bp, Homo sapiens
ccttaggaacaatatgctaagggtactaggatatcaggtggaggaataaaggcaatggttgggcagagggagaaattgacctgcagagcaaatacaacacytgatgactccataggaatctgaagctcacatggcccttcagagttatagcaccctgaggctgaaggggtgagcagacctgtattcccctacatagactag

SEQ ID NO: 20982 - DNA, 201 bp, Homo sapiens
tttacttattttggaacagaggacctttgatgggcactagggaacatccaaaggaaggccacagacacataaagtcacacaccttcccttgcacaccattkcaaatacgcttgcttagagaattgatatgagcctgagtttctcagtctgaacaattgtgttttcctttagaaaatagctaattaccacaagaagctggaa

SEQ ID NO: 20983 - DNA, 201 bp, Homo sapiens
ttttttagatacacaaagacggatttccattaattctgagggttttcaaatatctgaatatttgattttaatattatgcccaactgcctcaaaatgcagakgaatttactatgtgacaaaatattattttcacaatttcatgtttgcaatatttttcaaaatgtattttccagtataaatgttgaacaaattgacgtgaaa

SEQ ID NO: 20984 - DNA, 201 bp, Homo sapiens
  misc_feature (1)...(201): n = A,T,C or G, or insertion/deletion polymorphism (see Tables 1-2)
gtggttgtcaaaataagtagaccttatgcactttgattcttcatgtcaggatagctccgctatatctacacttcaggatggtggggttctggaggattagnaaaattccaggtggcttggctgaaggagaagaaacttaaaggcaactcccctgaactcatttctagtgttcagaatccatttctaaagaacctagcctca

SEQ ID NO: 20985 - DNA, 201 bp, Homo sapiens
tgctactgctgaaatgaaacaggatgaaatcaattacatttctatctgtcatttataatgaattcaaatactgagaaccttctcatacataagtaagtagraatacgtggacttatgttgtaacagtgtccctcaactctgcacgtcttccaagttacaggtcaaaaattacatagcgatctgtcatcaaaatttatgttc

SEQ ID NO: 20986 - DNA, 201 bp, Homo sapiens
ctgaaatcaggggagagtgcgacactcaggaagacagagtgtgtgggctaaaagggtatctcaacatagtccatatgggaagtcctcaaaagctttctatmgatcctatttgttaatagaataatatttgtaatgagcaatggaagctagctgcagaaaaaaaaatatatatattaagggatcctttttgaaaaacaagtc

SEQ ID NO: 20987 - DNA, 201 bp, Homo sapiens
ggttttcatccctgctcgcctgtctaggtagctcatttagcctagtttgaatgctactgctgaaatgaaacaggatgaaatcaattacatttctatctgtyatttataatgaattcaaatactgagaaccttctcatacataagtaagtagaaatacgtggacttatgttgtaacagtgtccctcaactctgcacgtcttc

SEQ ID NO: 20988 - DNA, 201 bp, Homo sapiens
taaaaactatggccataaaaaggaattgagtcaatgacctagaaatgcttccaagcaaatcccttgaaccactcagtttcagtcatataaattatttaacytttgaataaatttagccttctacatttattaacagaattgtgtatatttatggtgaataacatgatgttttgaaatatatatcatggaatggctaaatca

SEQ ID NO: 20989 - DNA, 201 bp, Homo sapiens
cttgaacccgggaagcagaggttgcggtgggccaagatcacgccattgcactccagcctgggcgacagagtgaaactccatctcaaaaaaaaaaaaaatasggaaacttacagtattcctttttctattttaacttatatttctatgccatttcccccataggtttttactctaatagaataaattttaggcataaaaatt

SEQ ID NO: 20990 - DNA, 201 bp, Homo sapiens
  misc_feature (1)...(201): n = A,T,C or G, or insertion/deletion polymorphism (see Tables 1-2)
tagggaccaggaaagaggaggcaaagtggtgttatttgttaatggcctaggattgttgctgagaggattgttacattagttagacattggctaacataatntactaatcttctttccatagaagggtgatggattggaatatgccacttacttggaaattctttttaaactggttaatatataaacatacaaggattgcta

SEQ ID NO: 20991 - DNA, 201 bp, Homo sapiens
ttgactgtaatttccaaccccttctgcccatgcctgaggatggaagaacatgccatatggtcacccttatcctacagtcatgagctataatgggatttacrtgcacccaagattcatcttccggggaacagcaggatggctcctccggatttcctctcgatcgtgtgtgcaaaccaataaatcacagccagcatcacaaag

SEQ ID NO: 20992 - DNA, 201 bp, Homo sapiens
cctagaagacgtcccttgcctgtggctgctgataaataaattaaaacataaaaaaatgaaataaaattgaattaaattgaaagtacatgatggggaaaagygaagatactattcaatgtgaatcatttgttcatttaataaaaatactttttttccccaaggaattcaagaacatcaggtagctggacgtaattgcctcta

SEQ ID NO: 20993 - DNA, 201 bp, Homo sapiens
acataaaaaaatgaaataaaattgaattaaattgaaagtacatgatggggaaaagtgaagatactattcaatgtgaatcatttgttcatttaataaaaatrctttttttccccaaggaattcaagaacatcaggtagctggacgtaattgcctctacactcttgtacttattacgtttctgcatagcacttctcaccttct

SEQ ID NO: 20994 - DNA, 201 bp, Homo sapiens
tattgagagagaactactgaatgataatttttttccatttatatttgtggttatgctgatcttttagtaatattttactgaagcaataaggtaactcactraaatgcagatgaatctattatgtgtgttacttatgccttatttcatagatatatacatgcagaatctgagacatagtcaagatgttaattattttatagt

SEQ ID NO: 20995 - DNA, 201 bp, Homo sapiens
  misc_feature (1)...(201): n = A,T,C or G, or insertion/deletion polymorphism (see Tables 1-2)
aattaaatgcgtggttggacctgtggatactgtgttactattaatactcataaaagtgacgatctgagtagagcataaatgtagtttatagaaccctaccngataggcttgaccattttaaaactatagctggatctaatgacaaataaattataggaaaaaatgacaaactttgatcaaaacaacttatctttctctttt

SEQ ID NO: 20996 - DNA, 201 bp, Homo sapiens
tcattacccattttatttctctccatagcactcaccactctgatattctaaccaatatggtttttttaatatttttgttgattgtttgtctcttcctactrgaatgtgacctcaaaagtgcaaggactcttaaattcaccatttaaaccctaatgcctagaatggtgcctgacatattagaatatgaatgaatgaatgaaa

SEQ ID NO: 20997 - DNA, 201 bp, Homo sapiens
aagggagggagaaaaggccagaagcctgaagggattgccagagtaaaatgttaaggagaagtgaggactcacgtggagaaggaagtgtagccacttgaagktttaataattttgtgacctggtgtcaagtattgtgatttctaagggcaggagaggtaaaaatgtgaaatattaaccagcactgttcattgctagaggtga

SEQ ID NO: 20998 - DNA, 201 bp, Homo sapiens
cctttttttaattttttgtagagacagaggtcttgctatgttgatcaggctgacctcgaactgctgggctcaagcgatcctctggcctcagcctcccaaastgctgggattacaggcatgagacaacaggcctggacagtattttagttttttaataatagctttttaataaggaacatgtaacagcataaaaaaaatgca

SEQ ID NO: 20999 - DNA, 201 bp, Homo sapiens
gaccctgggggcagacttgtcatactctaatagatatacttcaaagcatccaagtatatgccactctgttgcctgggggctcccagtgagcaatagctgtyagcctgatacttaatggaaatttgcccaagcatggaaggaacaggcagagagacaacaagagaagcagatgaggcagatgaaatctaacccggacataat

SEQ ID NO: 21000 - DNA, 201 bp, Homo sapiens
ccaactctaaaattcactgtagatatttacttatgcaacagattacttctctataacctcaagcaatactcactcatgttttcccaccctacagttttgtractgccagttagccagtgagaatggccacaaagaaaggagacatttctctggacctctttctcttgccttgttacccaggcctctctctcacacagtcct

SEQ ID NO: 21001 - DNA, 201 bp, Homo sapiens
atagatatacttcaaagcatccaagtatatgccactctgttgcctgggggctcccagtgagcaatagctgtaagcctgatacttaatggaaatttgcccaygcatggaaggaacaggcagagagacaacaagagaagcagatgaggcagatgaaatctaacccggacataatgcagagtgggaaactcgggggctggacag

SEQ ID NO: 21002 - DNA, 201 bp, Homo sapiens
  misc_feature (1)...(201): n = A,T,C or G, or insertion/deletion polymorphism (see Tables 1-2)
ggcaagcttggattcatcttataggaaacgaggagctacaggaatttaaaccacagggggacttagtcagatcttacctttagacagcaggcacacaacancagttatgaagatttgaaaatgtttaggcaaaaaatgatgataatagtggaatccgaaacagaaagaaacagattcaaaaagtatgtaggtcatacaatg

SEQ ID NO: 21003 - DNA, 201 bp, Homo sapiens
gatttgaaaatgtttaggcaaaaaatgatgataatagtggaatccgaaacagaaagaaacagattcaaaaagtatgtaggtcatacaatgagtagaacttygttgtttttatgttggaaatgagggagaggaaagagtcaaagataattcttagatttctagcttggggcaatcctttgattttgaaggttttctgtgctc

SEQ ID NO: 21004 - DNA, 201 bp, Homo sapiens
tagacttgagatacaatggtcaagaatccctttgtccagggtacatcctgagctgaaacctaaacggcagtgagaagaggaaatatccttcctagagaagygaagggcaagtgtgaataccctagggtggaaatgagtttggtgtgttcaaagatacaaacaccagtctgtctgtctggagcatggccttgaaaatgagac

SEQ ID NO: 21005 - DNA, 201 bp, Homo sapiens
atttatttatataagtatatatcctatagatatataattacatatataatatataaatattatatattacataaatataatataaaaatatatattatatattacataaatataatatataaatatatattatatattacataaatataatatataaatattatatattacataaatataatatataaatattatatatta

SEQ ID NO: 21006 - DNA, 201 bp, Homo sapiens
aatacatttatttatataagtatatatcctatagatatataattacatatataatatataaatattatatattacataaatataatataaaaatatatattatatattacataaatataatatataaatatatattatatattacataaatataatatataaatattatatattacataaatataatatataaatattata

SEQ ID NO: 21007 - DNA, 201 bp, Homo sapiens
agataatacatttatttatataagtatatatcctatagatatataattacatatataatatataaatattatatattacataaatataatataaaaatatatattatatattacataaatataatatataaatatatattatatattacataaatataatatataaatattatatattacataaatataatatataaatat

SEQ ID NO: 21008 - DNA, 201 bp, Homo sapiens
gcaaaggagctaaagaaggataagcagccagattaggaatagaaatggaagaaaaatgaatcaaggaagccaaggaaagaaagtttttctgaatatcaggktatttccatctggagcttccgttcagagagtagtacttggttatgaacactgagcgttccaggataagtccactgggaagcaggctccaggggaaaagac

SEQ ID NO: 21009 - DNA, 201 bp, Homo sapiens
tctccatagcactcaccactctgatattctaaccaatatggtttttttaatatttttgttgattgtttgtctcttcctactggaatgtgacctcaaaagtkcaaggactcttaaattcaccatttaaaccctaatgcctagaatggtgcctgacatattagaatatgaatgaatgaatgaaatgccctaaaaactgtattg

SEQ ID NO: 21010 - DNA, 201 bp, Homo sapiens
ggccatgtcttctaggaagctttctgcaccatgtcaccactaggggataccggaggctttcctttgtcctggagaaagcagctgctttccaggtgtcctttgggactggaataaacctggaggttctgagcttctctcttttcctttttaggggcttcctctgggggcataggttcagtagaagaaattatttcactgatg

SEQ ID NO: 21011 - DNA, 201 bp, Homo sapiens
  misc_feature (1)...(201): n = A,T,C or G, or insertion/deletion polymorphism (see Tables 1-2)
ttctccccatacaaggttgtggaaaagagcacagaccctggaggcattcagacctgagctaaaaatcatgagtgactgaagaattacttaatctctgctanccttggttttcttatctgtaaactgggagtaagaatagtatacacctaatagagttaagaagtttaaacaagcaaaaaaaatggacaaattcttactgca

SEQ ID NO: 21012 - DNA, 201 bp, Homo sapiens
  misc_feature (1)...(201): n = A,T,C or G, or insertion/deletion polymorphism (see Tables 1-2)
cagcattctggctgtctgcagctgctgtcatcagaacttcttaaggacaatgctttaaacaagcctagttctttatattagaaccctccacttagcacctntatttcagtaatatgtttatccaaaaatactcaataattttaaaactatactatacatttatacttgtataaaatgtaaaacatataaaataggaagtta

SEQ ID NO: 21013 - DNA, 201 bp, Homo sapiens
ccatacaaggttgtggaaaagagcacagaccctggaggcattcagacctgagctaaaaatcatgagtgactgaagaattacttaatctctgctagccttgkttttcttatctgtaaactgggagtaagaatagtatacacctaatagagttaagaagtttaaacaagcaaaaaaaatggacaaattcttactgcaataata

SEQ ID NO: 21014 - DNA, 201 bp, Homo sapiens
agtggagatcttaatgtttcttgactaaattccacataggtcactgactgaaaatctgcctgtgtgtgaccatctctaataaaacttcatcttatgatagsctttttgcaaataagatacttaagaataacacacttcaatttaccatggattatacctgtatcaggacaacatgaaagaaaatttaaccattgtaaagga

SEQ ID NO: 21015 - DNA, 201 bp, Homo sapiens
acctgggatacagttcttgtgaacttaaccttggaaaacagaaagggtgtgtctccaaagctccactagaaggaagaaaatctgcagcattctggctgtcygcagctgctgtcatcagaacttcttaaggacaatgctttaaacaagcctagttctttatattagaaccctccacttagcacctgtatttcagtaatatgt

SEQ ID NO: 21016 - DNA, 201 bp, Homo sapiens
cgcttgaacccgggaggcggaggttgcagtgagctgagatcgcaccactgcactccagcttgggcaacagagtaagattccatctcaaaaaaaaaaaaaaagtatatgtatatatacgtatataatttgcaggtcagaaacattgcaactggatcagaaaatgttaggcacttacttgcagacatgtacctgggatacagt

SEQ ID NO: 21017 - DNA, 201 bp, Homo sapiens
tttcaagggcattggaaattttgaataagcctgtaaataaaagttcacgcccttattcttacaaaataaacagaaaacatcctcttaatgtgattctttcygcacagctagacttattttcagacttaacagagacacttgaggcctaaaatacctctaacctagctggtcttactctatgttttaaggctatttggaatt

SEQ ID NO: 21018 - DNA, 201 bp, Homo sapiens
gatgatccactacctattaatgagtagtaaatatattttctcttccttatgatgctcttaataatattttcttttctctagctttccttattgtaaaaatmcagtataaagtatatataacatacaatatatgtgttaattgactgtttatgttattggtaaggcttccagtcaccagtaggctattagtagttaagattt

SEQ ID NO: 21019 - DNA, 201 bp, Homo sapiens
gtgagactctatctctacaaaaaatttttttaaaaaaatagccaagcatgctagcatgcacctgtagtcccagccactcagaaggctgaggcaggaggatsgcttgagcccaggagttcaaaactacagtgagctgtgatcacaccactgcactccagcctgggacacagagtgagaccctgtctcaaaaaaaaaaagaaa

SEQ ID NO: 21020 - DNA, 201 bp, Homo sapiens
atcatttacctttcaaataatttcacgctcttatttcttatctttggaatccatgtagtaattttcattaactacagaaaatgttgccacataatgatgaytgtaacttccagtgataatgtgaaaagaaaatatatgcatgctgcaagggttgtgcctgcttctcccagccccattctctctctctgtttttatctgtgg

SEQ ID NO: 21021 - DNA, 201 bp, Homo sapiens
  misc_feature (1)...(201): n = A,T,C or G, or insertion/deletion polymorphism (see Tables 1-2)
tgggcagaaaatctctacagtcaaagtatggcaaagaaaagctctgaatattggtgaagatagaaaacatgttccaaggcccgggcaggagtgcagaaagnagaaaggtcactggggaaattgcttgtttgtaataccagtcctgaaattagaaatgaaatagcatgtgcaaatccaaacttttttttaacctgactgctt

SEQ ID NO: 21022 - DNA, 201 bp, Homo sapiens
  misc_feature (1)...(201): n = A,T,C or G, or insertion/deletion polymorphism (see Tables 1-2)
ttcttcctgaacgcccttcctcttagcggcagagccttcttgttctccctgttagggatgtgtccacatattcagcggctctgcagtccccgcagccaccngtctgcgggtgtaggtcacagttaggcactgcagcctggctgacactccaatcactggccatattcatcagccctttctttagtgctctatgtggctaga

SEQ ID NO: 21023 - DNA, 201 bp, Homo sapiens
ttcagatttgtcccatttagtatgataccagttgtgggtttgttgtatattacttttagtgtggtgaggtatatttcctctatactcagtttgttttagtmtttctatcatgaaaggatgttgaattttatcaaatgggttttcatcgtcatatgttgttgattttcattctctcaataggatgtatcacactgatttgtg

SEQ ID NO: 21024 - DNA, 201 bp, Homo sapiens
ggtgttgcagtttccagctttaactgtattgaggtctatctctctctttagctctaatatttgatttatatattatatttgggtgctccagtgttggatgmatatatatttacaattgttatgccctcttgctgaattgacccgtttatcattttataatgaccttctttctctctctctttatatagtttttgtattgaa

SEQ ID NO: 21025 - DNA, 201 bp, Homo sapiens
attttaaattgctcttgaatcacttggaagtaaattccatttcagaggagtatgcttcaagtctcagacaaagagataatggtcctatattttatgatatragcaataatagtttaagtcttatgattcagaaatatagaaacttatgtattaagttgatgaaaattaaggcttgatatatagcaataaaatcagcaacct

SEQ ID NO: 21026 - DNA, 201 bp, Homo sapiens
tggtcctatattttatgatataagcaataatagtttaagtcttatgattcagaaatatagaaacttatgtattaagttgatgaaaattaaggcttgatatwtagcaataaaatcagcaacctaaagctccctagattgatgttcatagcataatatattcctgtgaagaattaggtggaatgaaagtctataaaaataata

SEQ ID NO: 21027 - DNA, 201 bp, Homo sapiens
ttggaatgtcagtattgagtaatagtagaaagtggaaaattaagtcaaatatcagaggagggtaaaatgaataatagcgttacatctaaatcaaaaatgcrttaagttaatactgaattcaatgtacagaacaaaagcaactctggaaattttaccttgttaatttgaatgaactacatgtacaaaacgtgtttcacaatt

SEQ ID NO: 21028 - DNA, 201 bp, Homo sapiens
agtattgagtaatagtagaaagtggaaaattaagtcaaatatcagaggagggtaaaatgaataatagcgttacatctaaatcaaaaatgcgttaagttaayactgaattcaatgtacagaacaaaagcaactctggaaattttaccttgttaatttgaatgaactacatgtacaaaacgtgtttcacaatttaattaatca

SEQ ID NO: 21029 - DNA, 201 bp, Homo sapiens
aaagattttgtttgttggtttcatagacaagtgcagagagagtaaccaggaagctactcattatctccaaaagaaaagaaaacatggtgcagaggacagakgataaatttacagttttttcacatcttctattttgtttcagttacaggcagacatccatcatgggaaattcccaagtaggctgttccatggagatagata

SEQ ID NO: 21030 - DNA, 201 bp, Homo sapiens
agggagccgtggtaaggaggccgatgaggaaggaaaatggagcaactcggaatatttacatgtctttagagaaaatgaagcaggcttatggctgcgcggtsacaaaatctcctcattcccttttacgtgctgcaaaagtcttaaatgactgcttttctcttttgctattcaggagtcagcttgctgattcccgctggggcc

SEQ ID NO: 21031 - DNA, 201 bp, Homo sapiens
atcagactggaaagaggttccaaatggtgtccttgaaaaggtctctgcccttgccctgttcttgtgttgcaaagttatcaatggttagaatgagaacatawatggcaagcatatcagatttagggaggagaaaagaccggaagagatagccaatgtttggagggaagatagagcatgaagaaatagatgacccaaaattta

SEQ ID NO: 21032 - DNA, 201 bp, Homo sapiens
caggaaagtatccccatgtctacaacagaacccagaatataataaggttcaagagtatttgctaaacggatgatgaatgaatgaatgaatgaatgaatgadttccaattctgtgcctggaatgagattgcagtttcagataaataccataaggcacaaaacatttattgagtagtttaaatctacataatatttgtgaaag

SEQ ID NO: 21033 - DNA, 201 bp, Homo sapiens
ggaggctcatgcctgtaatcccagcactttgggaggccgagccaggtggatcacctgaggtcaggagttcaagaccagcctggccaacatggtgaaacccygtctctactaaaaatacaaaattagccaggcatggtggcacatgcctgtaatcccagctactcggaaggctaaggcaggagaattgcttgaacccaggag

SEQ ID NO: 21034 - DNA, 201 bp, Homo sapiens
tgtcgtttctcatcaagcacttgcctcctgatcttaacttggcagattctttctttttttcaagctccaggtcaaatttcatctcaattaaaaaaaaaaaattcttccttaattccctaagttggccatcctgatatctccaaacacattatgttcttttggtttatttttaaaagaacttttttactatttgaaatgatc

SEQ ID NO: 21035 - DNA, 201 bp, Homo sapiens
tctacaatgtgacttatgagtctgatatagtctcagtcaattacatgtgtataatcattattgaaccaaaatagacaatggcaggtctggagccagtctastctgataccttaatgggcctttagagacttttaatacactgactactggaataatagtcagtctactgaatgactttgtatattttgatttttttaaact

SEQ ID NO: 21036 - DNA, 201 bp, Homo sapiens
tcacatttttccaatggatgtttgctatggactgaatgtttgtgtctctccacaatgtgtatgttgaaatcctaagtccccaatgtgttggtatttggatrtggggtctttgagaggtaattaggactaggtgaggtcataaggatggacccctgatgatgggaatcaatgcccttataaaaagaagaagaggccaggcgt

SEQ ID NO: 21037 - DNA, 201 bp, Homo sapiens
gaggtggaggctgcagtgagctatgatcacaccactgcactccagccagcatgacagagcaagaccctatctcgaaataaatatttaaaaaaaaaaaaaaacattgttttaaagtggatataggttataagcagttacccttgaaaaagcactgctcttgaaaaagcagttgctgaggccacactgtacccagggataaca

SEQ ID NO: 21038 - DNA, 201 bp, Homo sapiens
  misc_feature (1)...(201): n = A,T,C or G, or insertion/deletion polymorphism (see Tables 1-2)
tgagcaatttgaaaagaaatttaagagttgcttatatttggaaccactgtagtacttttgcctctaatcaaagaaaatatacagtgggattcagagttccntgtaactttatgttctttctaaaaatagatgtagtggacaaataacccaggaaaattcctaaaaggataacaggggtgtaaatcaaaagatactagtaat

SEQ ID NO: 21039 - DNA, 201 bp, Homo sapiens
agaggtggaggctgcagtgagctatgatcacaccactgcactccagccagcatgacagagcaagaccctatctcgaaataaatatttaaaaaaaaaaaaaaacattgttttaaagtggatataggttataagcagttacccttgaaaaagcactgctcttgaaaaagcagttgctgaggccacactgtacccagggataac

SEQ ID NO: 21040 - DNA, 201 bp, Homo sapiens
gggattactatgaagttcaatattctattaaataatagtaataacagcacttactcattggatcattatggggattaaaagagtaggcatatgcaaagctrtaggaagtactcaattacaatataattattatcattcatttattcctttacaccaaaatttcataagtacctattacctgtgtgacagagaaaatatatt

SEQ ID NO: 21041 - DNA, 201 bp, Homo sapiens
gcgggcaaatgggaaacgtgagtgtagaccagaagccgttcagccgtgtgctcttgttttgttggttcctgagagtagaatctcttgtgcttttcccagasagatgaaaagtgacaaaggtggtagaaatatttgatattgttaccacaattctttgaaagcaaaatttggcagatggatagagaagatagggaaggggtt

SEQ ID NO: 21042 - DNA, 201 bp, Homo sapiens
  misc_feature (1)...(201): n = A,T,C or G, or insertion/deletion polymorphism (see Tables 1-2)
gtgacaaaggtggtagaaatatttgatattgttaccacaattctttgaaagcaaaatttggcagatggatagagaagatagggaaggggttaatgttcatntttgttttctttttttcaagaaacatgcttttaatatggtgtaaaacaccctagacaaatctgtaccctatatgaaaaatggttcccttcttcatttttt

SEQ ID NO: 21043 - DNA, 201 bp, Homo sapiens
agctgatctatgagtttgatattaatgaacttagtttaaatttcaggcatttatgcttcacctactgtgaatcatgagataagacatttacatcctgggaygttaattatctactattcattttcagaagggtgtggctggtcactgtaaggaacagggctatgaaccagcttagtgaggtgtggccattgtcctcagcag

SEQ ID NO: 21044 - DNA, 201 bp, Homo sapiens
  misc_feature (1)...(201): n = A,T,C or G, or insertion/deletion polymorphism (see Tables 1-2)
aattctttgaaagcaaaatttggcagatggatagagaagatagggaaggggttaatgttcatatttgttttctttttttcaagaaacatgcttttaatatngtgtaaaacaccctagacaaatctgtaccctatatgaaaaatggttcccttcttcattttttaaagtatatttgtttgcaatcagtacatataacaggtt

SEQ ID NO: 21045 - DNA, 201 bp, Homo sapiens
tggtctcgaactcctgacctcaagtgatctgcccacctcagcctcccaaagtgctgagattacaggcctgagccaccacatggggcctaacttttataatmtttataatgaatttttagtaagatctatttgtcatggatagcatataatatgaatagtttaatcactgcttacttcttccttttgaaaatagcaattcaa

SEQ ID NO: 21046 - DNA, 201 bp, Homo sapiens
  misc_feature (1)...(201): n = A,T,C or G, or insertion/deletion polymorphism (see Tables 1-2)
aaagcaaatggtaaacaaaagcctcccctataattctttaaacctcaatgctcatgtgccttcattctctgttggcttgaacaaacaattccttcatagangaggcattaggaatgtattttaatcttgtttccaaagttctgtgaagatagtgctacctatttgatttgtggagaagaatgggtccttgttgattttaca

SEQ ID NO: 21047 - DNA, 201 bp, Homo sapiens
  misc_feature (1)...(201): n = A,T,C or G, or insertion/deletion polymorphism (see Tables 1-2)
tacaaacactctactagtgatgctcaactaattgctacgtaagtcatagatttttcatatttttatgaaacaaatgtagtttttacattgtatggaatcantatgaatacctttactttaatcactaacatttattgaagatttatgtgctaacaaaattataggcacttttacatatgttctttatgctacattagtctt

SEQ ID NO: 21048 - DNA, 201 bp, Homo sapiens
tgtccgtgattatttttaaaggggctggtttcatgaaaggcctggaattttggtggtcatgacaggcaatggccctctcattgcttttgcgtaccaagcakgtacataaatagaattccagagataaaaacttcatcaagttgagggcttaactggtttgctgttttgagaagggccaggtaacagtggtctttctttttg

SEQ ID NO: 21049 - DNA, 201 bp, Homo sapiens
tgatgagtacaggaattgatgagttgattctggtgtctccaggatgtgatacagcttttggcacacagccagaatgtaatcgggattttttttttttttttaatgatgttgggtgaatgcatattttgttgatgcatacataacgcatcttggaaggactttgaggactcaggttggtaaagttcattgaaacttcccagg

SEQ ID NO: 21050 - DNA, 201 bp, Homo sapiens
gtgtcaagtgtaggataatgagaacctgaactatgtcagtgacagtagaaatgtcaagaagagatgccagagtatcaacacagcaatgatttggagtcaaygaattttagaaagtgaagggattgtggatggtgaaggcctatatttatacattaggaaacaatagcccagaaagtgatgcatacatataatctaagtctt

SEQ ID NO: 21051 - DNA, 201 bp, Homo sapiens
agagatacaatgaaagaaaatatttccataattaaaatatatgatcaattgtttttgatttaagctttaaactggaaactttttcagtactagttccgagyaaatgatattattatgaagcagcctacatgctaaatagcatacttttcttggtgtagatttctggagggatatgcaggggatttgcatgcttaattccca

SEQ ID NO: 21052 - DNA, 201 bp, Homo sapiens
tctggggaaacatttttcatgagagaaaaagatttttgttattttatgagcatgagaaaattagctatgtgagatgtggatgctgcataccaccatacacsttacaggaagtcaatattcattataacaaatttagaattatttttcattgatgaatctcatattaaaaattaagtgttcaatccataagtgtccgtgatt

SEQ ID NO: 21053 - DNA, 201 bp, Homo sapiens
gggcttcattaccatttagctagtcattaatgggcctatgagcttagtagtttctatgacacaagcctcatcagctcttgataggaaatattgtttgttcscccagtgggacagctcctactcccattgggtagttgttcatttccctgagtgtgtttagtcatttgaatattttctaggtgttaaggaaagttctaaaat

SEQ ID NO: 21054 - DNA, 201 bp, Homo sapiens
aatggtgcaatcatagctcaccataaggtcaaactcctaggctcaagcaatactcctgcctcagcctcctgagcagctagtactgtaggcatacaccaccrtgcctagctaattttctgatttttatttgtagagacagggtctctttatgttgcccaggctggtcttgaattcttggcctcaagcaatcctcttgcctag

SEQ ID NO: 21055 - DNA, 201 bp, Homo sapiens
gatctagggaatgcctgatagaggagctgtgcaagcattgtggttgtcaaaataagtagaccttatgcactttgattcttcatgtcaggatagctccgctrtatctacacttcaggatggtggggttctggaggattagtaaaattccaggtggcttggctgaaggagaagaaacttaaaggcaactcccctgaactcatt

SEQ ID NO: 21056 - DNA, 201 bp, Homo sapiens
  misc_feature (1)...(201): n = A,T,C or G, or insertion/deletion polymorphism (see Tables 1-2)
ggggacaaaaatctatattatttaagtatagatgtaaggagtatgcagatattggattatggacagaagttggaatacaagctaaaagggattgtgaaaantgttaatgagaaagcagtggttctattcttctcattttttgataggtatttccctgtgcattattacctaaaagtcttgtttgtatttttcaaggtgaac

SEQ ID NO: 21057 - DNA, 201 bp, Homo sapiens
gttaattgggtgcagcacacgaacgtggcacatgtatacatatgtaactaacctgcaagttgtgcacatgtaacctaaaacttaaagtataataaaaaaaaggtaagcgatttggcgtgtttgttgctattgaaaataattgaaaatatatgtctgatctaaaaaaacttaacattaataacaaatatcagtttttactta

SEQ ID NO: 21058 - DNA, 201 bp, Homo sapiens
cgatagtttgctgagaatgatggtttccagcttcatccatgtccctacaaaggacatgaactcatcctttttatggctgcatagtattccatggtgtataygtgccacattttcttaatccagtctatcattgttggacatttgggttggttccagttctttgctattgtgaatagtgctgcaataaacatatatgtgcat

SEQ ID NO: 21059 - DNA, 201 bp, Homo sapiens
acttaaatcataattataggaaaagattgaaagttaagaaatggaacttacagtattgttgagtatgtaggtatgtatgtatgtatgtatgtatttatttagagacggagtcttgctctgtcgccaggctggagtgcagttgcactcggctcactgcaacctctgacttcctggttcaagtgattctcctgcctcagcctc

SEQ ID NO: 21060 - DNA, 201 bp, Homo sapiens
tacttaaatcataattataggaaaagattgaaagttaagaaatggaacttacagtattgttgagtatgtaggtatgtatgtatgtatgtatgtatttatttagagacggagtcttgctctgtcgccaggctggagtgcagttgcactcggctcactgcaacctctgacttcctggttcaagtgattctcctgcctcagcct

SEQ ID NO: 21061 - DNA, 201 bp, Homo sapiens
tgtaatataactttccttgtctataaatcagggcccttgtctcagtgaagttttgaagcttaaaacatgtaaatagttaagcaaaatgtgtgatacatatraagtgctcaataaatgggacctgctattatttttggattttgtatctctctggagtttaattcagatattcattttcctatgaatctagaatagtaattg

SEQ ID NO: 21062 - DNA, 201 bp, Homo sapiens
atagaaaaatatcatttgtgagttttcagaaaatttatagttcttcaaaccacacataagaataaataacagatggattaaagagacagatgtgggaaaawataaagaaaccataaaaactgcagaagaaaatagaagcaaatacgaacatacctcaaagatattgtgggtttggttccagaccaccacaataaagcagat

SEQ ID NO: 21063 - DNA, 201 bp, Homo sapiens
atacttaaatcataattataggaaaagattgaaagttaagaaatggaacttacagtattgttgagtatgtaggtatgtatgtatgtatgtatgtatttatttagagacggagtcttgctctgtcgccaggctggagtgcagttgcactcggctcactgcaacctctgacttcctggttcaagtgattctcctgcctcagcc

SEQ ID NO: 21064 - DNA, 201 bp, Homo sapiens
  misc_feature (1)...(201): n = A,T,C or G, or insertion/deletion polymorphism (see Tables 1-2)
ataatattgtttggccattattttggaaaacaaaggcttctaacagtgaaagtgcaaagttcgcaagagggacaaggtcagtattaagaaaaagaatgggngtagaaaagatagccagaaagttgtaatcagcaattaggaattatcatttaatatttatttcctttgggagaattagtgtctggaatgcattaataaata

SEQ ID NO: 21065 - DNA, 201 bp, Homo sapiens
tataggaggagattttttagttgtttgtttgtttgtgtttgtgtttgtttttgtttgtatttttatcacgtctcttgtttgatggaaacattttgctgttygggttaaaatcattccatttaaagctatttatttctgcagctctgatttgctatagtaacaatccctactaagtcaataaactctttcatctgccctcct

SEQ ID NO: 21066 - DNA, 201 bp, Homo sapiens
tgtatctataaaaaaagcacaaactgaaaataaaagatggttaaataataaaaggaaaacatttttaaatgtcaaattttcagtgagttccaaataaaagrattatttattacattctcaaaggtcctagattcctctgcatccttgcagcaaatgattggcaaattgctttgattgttcatataatatcagtgtgcattt

SEQ ID NO: 21067 - DNA, 201 bp, Homo sapiens
tagtctcaaactcctagactcaagcaatctgcccatcttggcctcccaaagtactgggattataggcatgagccactgcacctggcatatactaccagtastttatatgtatacataagatttaaaaataagcattatacattgttatattatacatcttttataatttaaaatgtataaatacatattaagtattgtata

SEQ ID NO: 21068 - DNA, 201 bp, Homo sapiens
tggtctgtatgattggatggtaaaattccaatttgttggcttgttttttttgtttgtttttttttttttttttaagaatcactaagtattatttaaagggragatctgaaatgctccagcaagtaaaaatcaaatccttaagatagtttttaaagacagtttcagacatgtcatctaaacgctagttttaaagtgctacct

SEQ ID NO: 21069 - DNA, 201 bp, Homo sapiens
gtcaaagaagaaaatacctatacctataattctgccacccagagatagcatttaaacaaaaattatatgtatactacttgaattttctttcttttttttttatttttttatttgagacagggtttcactgtcgcccaggctagggtgcagtggcgcaatcttggctcctgtaacttctgtctcctgagttcaaatgatcct

SEQ ID NO: 21070 - DNA, 201 bp, Homo sapiens
tggcgggtatgggaggtggggaagagagcatagagagaaaaaaacatgtctcaaagagaaaaaaagagcaagaccctaattgaaatgggaagcattctcaktttagaaaatgttttcttaacagattgctttagccctctgccttaaggtttttgattaaattaatgatgggagtgataagctccattagtgttgctgttt

SEQ ID NO: 21071 - DNA, 201 bp, Homo sapiens
ttctagtccttctttgagtctcatgtatcttttccatgtcacccacagtgatggtgtattcagccacagatgccccctgtgaaagataagataatgttttytacctttttattgaaaccagtttttcgttgaaattgtttactcttataggtcattgttgtaaaatctaaaaggcaattccatttaaaagaaggaaaacaa

SEQ ID NO: 21072 - DNA, 201 bp, Homo sapiens
actcttataggtcattgttgtaaaatctaaaaggcaattccatttaaaagaaggaaaacaaatggactaatgagtttaggccaatttagaactctaaaaamtattttatatattttagcatatgcatcaataaaacatagttgcataaggttttattgggacatatttatcaattcccttttaaaaataaaagagtgtaag

SEQ ID NO: 21073 - DNA, 201 bp, Homo sapiens
ctggtctcaaactcatggtctcaagtgatccacctctctcagcctcccaaagtgctgggattacaggtgtgagccacagtgctttggcctctctttaaaartgccttttttttttttttttttttaccatgaaaggacaaagctcactttatattttgtagagcatggtatttgaacaaagttaagggattggtcatcatt

SEQ ID NO: 21074 - DNA, 201 bp, Homo sapiens
  misc_feature (1)...(201): n = A,T,C or G, or insertion/deletion polymorphism (see Tables 1-2)
aacattccctaccagaagttctctctgtctagcagaaaacaggaactatatagaattaaagaaatcaattatattctaaacttgacctagtacaatgaaangagacctgcctggctatataataacttgataaattatttgataaattgttcaatttttaaatcatttgttacagcatattataccttttaaagtacttta

SEQ ID NO: 21075 - DNA, 201 bp, Homo sapiens
agcagtctcagaaaagatcagaatccatgagatgccaaagcggtttcacttgccataaatcttcacccaattagagggatttttatcttaacatttcaggyttctatctggatttagtttctttgttgctccacagtatgttatagctggggctggaacaacgaccaaggttttcctggagcttgatagggaaaatcattt

SEQ ID NO: 21076 - DNA, 201 bp, Homo sapiens
caatttgtcctaaaactgacagagttacaggtgataaaaggaatatagtgctgttgagaacattcccaagagaagggagtggggagtgtgttagaatcttsttttcagttagttttagaaaataagtgattacttagaaagaaaaaaatagagaacaataatttgccctttgaaatgagaaaaattaatgtagatatgagg

SEQ ID NO: 21077 - DNA, 201 bp, Homo sapiens
aatgcaggaaaagatcacagttggaggccaactggagatcagatctcatgtgtagtgattccattagagattgtcatcaaaataacttcatcatatttagyatggcttaacaaactaagatgaaataatttttactcctgctttcttattttgaagcataacatagttcaacatcagagggacattaatggaagctcacca

SEQ ID NO: 21078 - DNA, 201 bp, Homo sapiens
ctagtacagagatatatgtatatgacttgctttaattctgtattctcagtggctggtacacagtgggcactgaaaaaatagttttgaataaaaaattaaggaaaaaaagaatgattattagctatagctagtgtttttaaggcagctatagtcattcacgtatttataactgagagcagagtgtggcttgccctctagtgg

SEQ ID NO: 21079 - DNA, 201 bp, Homo sapiens
gggtattattgtaatagcaaaatggagtagtacttttagtgatatattttaattttgaaaatatatatttatcttttacattatatattgttatattttttacattatttatatgaaaaatatagaaaataaaatatatattatattaaatttttgtattatatatttttaaatgttatataattttttattgtattatgt

SEQ ID NO: 21080 - DNA, 201 bp, Homo sapiens
gcagttaagcaggtaagttgaatttactttagtccaatgagttccagtcaaaatgttgcccaatcagcagctgaagtaggaaaagtttgttttttttttttaaatgtgctaatgtgtgcttatgttagcttttctgttgaagttttttgagttaacaatgcagtgttttgggccgttggtcataaataatggtgttggcag

SEQ ID NO: 21081 - DNA, 201 bp, Homo sapiens
tttcttggaggggtactaagatagagaggggcatcattattttcccaggctacacaggaacaacaggtacccaggttacaataaagaggatatactaggcygggcgcggtggctcacgcttgtaatcccagcactttgggggccgaggcgggtggatcacgaggtcaggagaccgagaccatcttggctaatgcagtgaaa

SEQ ID NO: 21082 - DNA, 201 bp, Homo sapiens
acacacatatacacatatattgagagagatttcttctctgtgaaatctttattttttataattgtacataaaaattaattaatattacatacatcaatgawtaagactaccttataaattaactgtaaactaaaatagtttgcatgttttcatttaaattcaggagagatagatgagaactaagagaagatttaggaaatt

SEQ ID NO: 21083 - DNA, 201 bp, Homo sapiens
ttgaacccaggaggcagaggttgcagtgagctgagattcacgccattgcactccagcctgggcaacaagagcgaaactccacctcaaaaaaaaaaaaaaaagaaaaaagaaaaaaaaaagaagaagaagagacactagatctctctttctgtatgtaccaaggaaaagcaatgtgaggatataaccagaaagagccctcac

SEQ ID NO: 21084 - DNA, 201 bp, Homo sapiens
  misc_feature (1)...(201): n = A,T,C or G, or insertion/deletion polymorphism (see Tables 1-2)
atgcccaagcaaataataatattcttgaattgcacctgcgtggtagtcagatctaaatatcccgagatctggggagcatttttaacttggataaattgaangtgtttacattaatgtctaatgttaatccatgtgcatagtttgcccttatatttgttaaggatttgtaaatgtcatagattcaaagtatcttatactcat

SEQ ID NO: 21085 - DNA, 201 bp, Homo sapiens
atgcgaatgaatagactgacaatgttaaatgcccaagcaaataataatattcttgaattgcacctgcgtggtagtcagatctaaatatcccgagatctggkgagcatttttaacttggataaattgaacgtgtttacattaatgtctaatgttaatccatgtgcatagtttgcccttatatttgttaaggatttgtaaatg

SEQ ID NO: 21086 - DNA, 201 bp, Homo sapiens
cttactcactactctagcatgtggacatactgttatttcaattagtggaatggaaaatggagttattctctgacaaaaagttttgaattggtttggttaargtttggtgatcttgtttcatgtgttgaaaagtaaaatggtgtgaataaatcttgacttgcttcctgttggactacatgaaattaaaacatggttcatact

SEQ ID NO: 21087 - DNA, 201 bp, Homo sapiens
cagtcacatgttttatgtgtacaaacatagttaaaaaataaagtctagttgaccttccaccttcataaatagtaataattaaaaccaacagctaacttctrtagaatttgagtcatgttttgcggagctttattgattatcagcactgtccatcatcacatataacagtaagtgctttagaagaaaaaaaattggttaaga

SEQ ID NO: 21088 - DNA, 201 bp, Homo sapiens
aatttggcttagatacatctccaactatgtgttttgctacattttgaaaggtattttcagggatatttaatccatacgtttcagtgaggctacacgtaaaycatccaaatgttattttattacagctatgtgatgtctaaaatgccttttgtgcttttaaaaatagtctttctattcttttctgaaaagcagcaggtaagt

SEQ ID NO: 21089 - DNA, 201 bp, Homo sapiens
  misc_feature (1)...(201): n = A,T,C or G, or insertion/deletion polymorphism (see Tables 1-2)
ggatacagtttcgtaaaaagatgatttctaaaataacactgtatctgagaattaatgctgaaacttgacagttttctatggagcaagaatcagaaagtgtncttttagtatgttaacttgatggtgggaccaacttcgatggttgagtaaggtacccagctcatttttgtatgtggagaaggcaaggatttcacaacaggg

SEQ ID NO: 21090 - DNA, 201 bp, Homo sapiens
taatgatgtgtatgccatggtatggggctgagagactgatgtcattaaaagaacaagtagactggcttgaagtactaggagaaaagaaatggaaaacccayaaaagtaaattaaaaattataaaaatatagatggtctaggtaaaaataatagtaatataaattgcctatcatttatgcctcattaccaagtatgatagtg

SEQ ID NO: 21091 - DNA, 201 bp, Homo sapiens
ggctgaggccggcagatcatgaagtcaggcaatcgagaccatcctggctaacacggtgaaaccccatctctagtaaaaatagaaaaaattagctgggcatygtggcatgcccctgtagtctcagctactcaggaggctgaggtaggagaattgcttgaacccaggaggcagttgttgcagtgagctgagatcgcgccaccg

SEQ ID NO: 21092 - DNA, 201 bp, Homo sapiens
aattgcttgaacccgggaagcagaggttgcggtgggccaagatcacgccattgcactccagcctgggcgacagagtgaaactccatctcaaaaaaaaaaawaatagggaaacttacagtattcctttttctattttaacttatatttctatgccatttcccccataggtttttactctaatagaataaattttaggcataa

SEQ ID NO: 21093 - DNA, 201 bp, Homo sapiens
cacacctgtaatcccagcactttgggaggccgaggcaggtggatcaactgaggtcaggagttcgagaccagcctgaccaacatggaggaacccccgtctcyactaaaaatacaaaattagccaggcatgatggcacatgcctgtaatcccagctacttgggaggctgaggcaggagaattgcttgaacccgggaagcagag

SEQ ID NO: 21094 - DNA, 201 bp, Homo sapiens
agaatggcgtgaacccaggaggcggagcttgcagtgagccgagatcgcgccactgcactccagcctgggcgacagagcgagactccgtctcaaaaaaaaawaaataaataaaaaataaacctcagctgtgttcgagcacggtctctatctcagtagagattcagcagcaggcaaagacctaacctgtgcccatagtcacag

SEQ ID NO: 21095 - DNA, 201 bp, Homo sapiens
gggtatccatggcatcatttttgctcagggcttctaaaaggtaactgatccttgcaaagactttaggtggggggagatcttagtaatttcttcatttttttcagtctccttgacaaagtagttcactttgtcaaggagtaaagattcatgactgcaaactaattggctgtgaattctatttgtatcatcactagggaagag

SEQ ID NO: 21096 - DNA, 201 bp, Homo sapiens
gcacaagacagggatgccctctctcaccactcctattcaacatagtgttggaagttctggccagggcaattaggcaggagaaggaaataaagggtattcarttaggaaaagaggaagtcaaattgtccctgtttgcagatgacatgattgtatatctagaaaaccccatcgtctcagtccaaaatctccttaagctgataa

SEQ ID NO: 21097 - DNA, 201 bp, Homo sapiens
caaagtttcatgattttgattaatagagtaattcctataaacttctgtcatatcttacagaacctctttaagaaccacaatgcaaattaaaaaaaaaaaaagcctaaccctaaagtcaggtttactgcctgaccctgaagtagacattggttatgcagcagtgagtaagataggcactgcccttcaccctctgaacatgcc

SEQ ID NO: 21098 - DNA, 201 bp, Homo sapiens
ggaacgcagttcctcaccagcaatggaacaaagctggacagggaatgaccttgacgagctgagagaggaaggcttcagatgatcaaattactccgagctaygggaggaaattcaaaccaaaggcaaagaagttgaaaactttgaaaaaaatttagaagaatgtataactagaataaccaatacagagaagtgcttaaagga

SEQ ID NO: 21099 - DNA, 201 bp, Homo sapiens
gactttgggaggctgagctaggaggatcacttgagcctaggagtttgagaccaatctggacaacacagtgagaccccatcatctcttaaaaaaaaaaaaaaggcaaattagcccagtgtgatggtgcacaccgatagtctcagctatttgggagactgaggtgggaggatcgcttgagcccaagaattcaaggctgcagca

SEQ ID NO: 21100 - DNA, 201 bp, Homo sapiens
tgactttgggaggctgagctaggaggatcacttgagcctaggagtttgagaccaatctggacaacacagtgagaccccatcatctcttaaaaaaaaaaaaaaggcaaattagcccagtgtgatggtgcacaccgatagtctcagctatttgggagactgaggtgggaggatcgcttgagcccaagaattcaaggctgcagc

SEQ ID NO: 21101 - DNA, 201 bp, Homo sapiens
atgactttgggaggctgagctaggaggatcacttgagcctaggagtttgagaccaatctggacaacacagtgagaccccatcatctcttaaaaaaaaaaaaaaggcaaattagcccagtgtgatggtgcacaccgatagtctcagctatttgggagactgaggtgggaggatcgcttgagcccaagaattcaaggctgcag

SEQ ID NO: 21102 - DNA, 201 bp, Homo sapiens
cctacaaaaggtcaggttttacttctctttgtctttgaggctccagacgcttttgcagatcttgaatatgggtagaaggctagagatcttttcccaagtgracacgttgccatatttcctggaaaaatgtccagaaatgtgatccctagattgtccagagagacaagtgggtagacacagagacgtcgacttcatggcatc

SEQ ID NO: 21103 - DNA, 201 bp, Homo sapiens
acaagaccaacccctcctcatcctcctgctcctcagccacatgaagaaaatgagaatgaagacctttatgatgatccactacctattaatgagtagtaaakatattttctcttccttatgatgctcttaataatattttcttttctctagctttccttattgtaaaaatacagtataaagtatatataacatacaatatat

SEQ ID NO: 21104 - DNA, 201 bp, Homo sapiens
atatgaaaaaaatgaataaaaatattttggaagagattaaaggagagataaatgtgctttgttaactttctgctggaatgaactattacctaattttcagraaaaaaaatcaagtaacaactttcattgcctttaataagaactgttcttttaactcacagaggctactggaagtgttttgttacagccatgtacagttat

SEQ ID NO: 21105 - DNA, 201 bp, Homo sapiens
tatgtatatggactgccaacacattagagtatggattgatccttacttgattatttattatttatgcttataaaacttttattaaaatagtctttaataaytttcattttttaaagtatatcatggctgtgtttccttgagtgaatgctttaagtctctttttttccagctcaatctttctttaattgctagagaattaaa

SEQ ID NO: 21106 - DNA, 201 bp, Homo sapiens
gaggttgcagtaagcagagatcgtgctattgcactccagcctgggtgacaagagcgagactccatctcaaaaaaaaaaaatatatatatatatatatatatgtatgtatgtatatggactgccaacacattagagtatggattgatccttacttgattatttattatttatgcttataaaacttttattaaaatagtcttt

SEQ ID NO: 21107 - DNA, 201 bp, Homo sapiens
agaggttgcagtaagcagagatcgtgctattgcactccagcctgggtgacaagagcgagactccatctcaaaaaaaaaaaatatatatatatatatatatatgtatgtatgtatatggactgccaacacattagagtatggattgatccttacttgattatttattatttatgcttataaaacttttattaaaatagtctt

SEQ ID NO: 21108 - DNA, 201 bp, Homo sapiens
aatcacttgaacaggaggcagaggttgcagtaagcagagatcgtgctattgcactccagcctgggtgacaagagcgagactccatctcaaaaaaaaaaaatatatatatatatatatatatgtatgtatgtatatggactgccaacacattagagtatggattgatccttacttgattatttattatttatgcttataaaa

SEQ ID NO: 21109 - DNA, 201 bp, Homo sapiens
tacttgggaagctgaggcaggagaatcacttgaacaggaggcagaggttgcagtaagcagagatcgtgctattgcactccagcctgggtgacaagagcgaractccatctcaaaaaaaaaaaatatatatatatatatatatatgtatgtatgtatatggactgccaacacattagagtatggattgatccttacttgatt

SEQ ID NO: 21110 - DNA, 201 bp, Homo sapiens
aaaaattagctgggcatggtggcatgcacctgtagtcccagctacttgggaagctgaggcaggagaatcacttgaacaggaggcagaggttgcagtaagcmgagatcgtgctattgcactccagcctgggtgacaagagcgagactccatctcaaaaaaaaaaaatatatatatatatatatatatgtatgtatgtatatg

SEQ ID NO: 21111 - DNA, 201 bp, Homo sapiens
gtttcacaatttaattaatcaagtcattttgcccagatagcacaatgcagtcaataccagcagctggggtgtgcatttatagaaaaggtaataatttgggrtacctgtggcatgttgccagaaataagttcacagtctgaagttgctgttcacaaactgaattcctattatcaccctaatgtcactccttcagatatttat

SEQ ID NO: 21112 - DNA, 201 bp, Homo sapiens
ctatacagcatgggtacattggatgaaggagtgattcatgtctgagagattttgtcacgctactcagagctccatgcagtttaaaacttacgaattgtttrtttctgaaattttccatttaatgtttttggaccacagttgacctcaggtaattgaaactgcagaaagtgaactgcagataagcagggggactactttacc

SEQ ID NO: 21113 - DNA, 201 bp, Homo sapiens
ggcatggtcatgttttcttggatggccttgatacttgtggatgtttattggtgtctgtgcattgaagagttgtaatctaagtttttggtcactccagctaygtgtgcattaggtggcatcccaagcccagtaacactatgacttttgcagactcatagaggtcttgtggtcttggataagatctggaagacttctctggat

SEQ ID NO: 21114 - DNA, 201 bp, Homo sapiens
gctgggaactcctagctccagggaatttgtagtgtttgtgacttccaagaatgaaagattttactagtaaaaggcagtgtgtgtgtgtgtgtgtgtgtgtkcgcgcgcgcgcgtgtgtgtgagatcagtgtgcttctgaattaggaccctcctggtttataaatgcattttatctgggctacacagcattgatatgctgct

SEQ ID NO: 21115 - DNA, 201 bp, Homo sapiens
tgctgggaactcctagctccagggaatttgtagtgtttgtgacttccaagaatgaaagattttactagtaaaaggcagtgtgtgtgtgtgtgtgtgtgtgtgcgcgcgcgcgcgtgtgtgtgagatcagtgtgcttctgaattaggaccctcctggtttataaatgcattttatctgggctacacagcattgatatgctgc

SEQ ID NO: 21116 - DNA, 201 bp, Homo sapiens
atattgggtcataggagtatttctgtcactacctgatcttcagagggtcttttaaccaggattctctgagcccttgcctccttctctgtaaatgaagggayaaacctacgatcttcaaagactttttcatctctgaaaatttctgattattcatttctcattaaaatcccagcagaacagtacatatatcctaaaccccaa

SEQ ID NO: 21117 - DNA, 201 bp, Homo sapiens
gaagcaaaagttttctctgaccttctcctgccctcctgtctctcagtccattcttccccaagaccagccatggaaaagacaatccctcttcccccgaggcragtcatagaaacccccttagtccaaaaccagccacaaaactgaaaaatattattctaaatttccatcctccattttgtgtaaaaagtgaccataaaaaat

SEQ ID NO: 21118 - DNA, 201 bp, Homo sapiens
gatgcctgtagctgtcgccattctcaattaggaaataagggcctacataaaatgtgcctttatatggcaagaattagaaaactgtgccaaaaattgcaccrtattctaagaagaattacagcatgctgcactcaaacccactgcccgttaatggtgctactaacttctgtcaccttaaaattttggaaaagagtagtagat

SEQ ID NO: 21119 - DNA, 201 bp, Homo sapiens
ttgtgctttataattttccaaacttttcagattcaatatctattttaatattcacaaaacctgatgaagtctaaaaaaagaacaacagtaataatgtaacrtatcatttatgtcttatcattctgtggaatttaaggatttagatttccactagaatagtctattgaagtatacccattgaagaattacttgcttcataat

SEQ ID NO: 21120 - DNA, 201 bp, Homo sapiens
cattgctttacttgaaagctctgaaccctgaaaaaaggtgcagttttagggggcagtatttattagtcagtcatctttttcttttttttttttttttttttgagaaggagtcttgctctgtggcccaggctggagtgcagtggcacgacttcagctcactgcaacctccgcctcctgggttcaaacaattctcctgcctca

SEQ ID NO: 21121 - DNA, 201 bp, Homo sapiens
tttaacctttctcagagatgggctggacaaatgaactggagagatatacataatctacactttacattcccaagtgttgatttccaaatgtcagagcagtytcccacagtgagccctttgagagcttttatttatgaaacaaattttgacacttagctagcttaaaatttcagattttgttttataggagctgactcccac

SEQ ID NO: 21122 - DNA, 201 bp, Homo sapiens
  misc_feature (1)...(201): n = A,T,C or G, or insertion/deletion polymorphism (see Tables 1-2)
aaagaacaataattcagatcataaccactcttaactgtttcctgctatacctgaaagagcttcaggtttttcttcaaagcaattgtagaaatgacaacatnggttccgaaaagaatgtagagacatttttattctaagtaatcatcaagaattacagaaatgactgcaaagtgtcttttcagccatcaagaagctttttct

SEQ ID NO: 21123 - DNA, 201 bp, Homo sapiens
tgctgtttggataattacagctgcagttggaaatgcttcattaactcccattaactagcctgagaaatggaagtatatatagaatctgtctttatgttgttatctgtatagtataagaaaattatgtagcaaattttttcatcagccacaattctcgagaaacaaaaatattcttttgaaaatgtaattggagtaactgtt

SEQ ID NO: 21124 - DNA, 201 bp, Homo sapiens
aaattgataagaagttctcagggcgctagccaagggtgcttagaggggggtgtttggaagcttaagtgaacaaccttatgaatagtcgtggaatcaaccgygcgactccctgtggaattcgcctgctgttactgggcatacaaaggactgagccatgggggtgggtggcgggagagggggacggggcacggtgagagaact

SEQ ID NO: 21125 - DNA, 201 bp, Homo sapiens
caaagcaaatgtttttgctctaagtagttgggacttgcttatacagccagttctgtatgactgaaatattaatgcttttctcatttttcatgtgggtatgwttataaccatatccacattatacacaatatatttacataataatttgaatatgaaatcacttagatttctcaaactatgtagactattaaaatgatataa

SEQ ID NO: 21126 - DNA, 201 bp, Homo sapiens
caggcatggtggcgggtgcctgtagtcccagctactcgggaggctgaggcaggagaatggtgtgaaaccaggaggcagagttttcagtgagcagaggtcgygccactgcactccagcctgggtgacagagcgagactccctctcaaaaaataaataaataaataaataaataaataaataatctgtaaagtgagggggttg

SEQ ID NO: 21127 - DNA, 201 bp, Homo sapiens
tcccgacaaaaaaaaaatttttttattctactttaagttctcgggtacatgtgcacaatgtgcaggtttgttacatatgtatacatgtgccatgttggtgygctgcacccattaactcctcatttacattaggtatatctcctaatgctatccctcccgcctccccccaccccacaacagtccccggtgtgtgatgttccc

SEQ ID NO: 21128 - DNA, 201 bp, Homo sapiens
atcctggctggcacggtgaaaccccgtctctactaaaaatacaaaaaaattagccaggcatggtggcgggtgcctgtagtcccagctactcgggaggctgrggcaggagaatggtgtgaaaccaggaggcagagttttcagtgagcagaggtcgcgccactgcactccagcctgggtgacagagcgagactccctctcaaa

SEQ ID NO: 21129 - DNA, 201 bp, Homo sapiens
attatatattacataaatataatatataatatatattatatattacataaatataatatataatatatattatatattacataaatataatatataatatatattatatattacataaatataatatataaatatatattatatattacataaatataatatatatttgtacatttatttatattatccatatggatggat

SEQ ID NO: 21130 - DNA, 201 bp, Homo sapiens
taaccacagaggtagagattagagggatgtagccacaagccaaggaatgccatcagccactggaatctgggagaggcaagtcatggtctctccctaagaamctccagagggagcgcataatcctgctgtccctttgattatggctcagtgaaactgatttcaattatttggcctttagaactacaagtgaatatatttctg

SEQ ID NO: 21131 - DNA, 201 bp, Homo sapiens
tattatatattacataaatataatatataatatatattatatattacataaatataatatataatatatattatatattacataaatataatatataatatatattatatattacataaatataatatataaatatatattatatattacataaatataatatatatttgtacatttatttatattatccatatggatgga

SEQ ID NO: 21132 - DNA, 201 bp, Homo sapiens
atattatatattacataaatataatatataatatatattatatattacataaatataatatataatatatattatatattacataaatataatatataatatatattatatattacataaatataatatataaatatatattatatattacataaatataatatatatttgtacatttatttatattatccatatggatgg

SEQ ID NO: 21133 - DNA, 201 bp, Homo sapiens
tatattatatattacataaatataatatataatatatattatatattacataaatataatatataatatatattatatattacataaatataatatataatatatattatatattacataaatataatatataaatatatattatatattacataaatataatatatatttgtacatttatttatattatccatatggatg

SEQ ID NO: 21134 - DNA, 201 bp, Homo sapiens
atatattatatattacataaatataatatataatatatattatatattacataaatataatatataatatatattatatattacataaatataatatataatatatattatatattacataaatataatatataaatatatattatatattacataaatataatatatatttgtacatttatttatattatccatatggat

SEQ ID NO: 21135 - DNA, 201 bp, Homo sapiens
tttggagagtaaagggaggctttacgatagccccaactccccaggtgatgttcagacaccctagggtttccggacagcattccctctgatcttagagaggygctgggggtggggatgggggtgttggaagcggaggagagcgcctagcataggagtgcggtctgggtggagaggtaagtgattagcaaggctttgtgaatt

SEQ ID NO: 21136 - DNA, 201 bp, Homo sapiens
aatatattatatattacataaatataatatataatatatattatatattacataaatataatatataatatatattatatattacataaatataatatataatatatattatatattacataaatataatatataaatatatattatatattacataaatataatatatatttgtacatttatttatattatccatatgga

SEQ ID NO: 21137 - DNA, 201 bp, Homo sapiens
  misc_feature (1)...(201): n = A,T,C or G, or insertion/deletion polymorphism (see Tables 1-2)
taagacatcatccctcaaatcagactgtcgctagtaaatactaactgtgtgtgaccttgggcaaagttacataaccactctgtttcctcatttatgaaacngagataataatggcactttcattcagttatgatgattaaatgagatagcacatgtaaagagcttagaaagtgcctgacacacagtgagtgatagtaaatg

SEQ ID NO: 21138 - DNA, 201 bp, Homo sapiens
tctttctttttgttaccaggtatggatgttccctctgggtcctgccaggtctagaacaaagtagcaatatttcaagtgtcttttttgttgacataatttgktttttttttcccagtaggagcaagtttgcataatcagtatgtggggatgtgtggggagtaaggggaaggcaatggatatggggtcttacctggcgtagcc

SEQ ID NO: 21139 - DNA, 201 bp, Homo sapiens
gaaccaaaatagacaatggcaggtctggagccagtctagtctgataccttaatgggcctttagagacttttaatacactgactactggaataatagtcagtctactgaatgactttgtatattttgatttttttaaactcttgaggtacaaaagaaagttcttagaggaaggaacattaagagtaacaatcacaatgccat

SEQ ID NO: 21140 - DNA, 201 bp, Homo sapiens
aacttttgttaatcccctaacaatagttctcttttacaaaggaagaaactgaggcatataattgaaacagccctcccaacatccacagatgagtgctggarccaatgtgtgaaggcagatctgtctcatttttaagcctgttctcatgcaggatcttggatgccagaagcaagtggttgtcagcttttattgctttaaaat

SEQ ID NO: 21141 - DNA, 201 bp, Homo sapiens
aacttctcacaatacagggaagttttgttaatacataagtgaatatgtaaaagagagaataaaactaatggaggatagaatgagaaaatccaacatttacygaataaaagaacaaaatttaaaagattttcaggtaatcaagatagagaggatttattactcataaaccttactgagtaaactactgaaaatgaaaaacaa

SEQ ID NO: 21142 - DNA, 201 bp, Homo sapiens
agatagagaggatttattactcataaaccttactgagtaaactactgaaaatgaaaaacaacaattggttccttaaaataagatgagaccaattgaggagmagctgaaaataagatggagctaaatggtagacaatattaacatggaatatgggaaggtgcaaactaagttaaaaatttccattttctatatattgctcag

SEQ ID NO: 21143 - DNA, 201 bp, Homo sapiens
agggtaggaaattggcaaaaggaaaactagtaaattaaaacaataaatgagatggtggaaataaagctacatatatcagggatcataatgtaaatgaattwaactcacctgtaaaaggaaatccaaaattgtagaaaaaaactcagttttattctgtttatgagtcacatacttaaatcataattataggaaaagattgaa

SEQ ID NO: 21144 - DNA, 201 bp, Homo sapiens
acttaagaggaatacaatgtgaaatatatagaaaatattactgttgatatttatttgttaatttgttcaaaacgaattcagatatatttccttgttaagcrcttaatacaaacacctttgactgaaaatatattaaaatgttggataaaatattgcaaacttagtagagacatacatgtgcatgcagaaagagagagagag

SEQ ID NO: 21145 - DNA, 201 bp, Homo sapiens
gctttaatttggctactaatttacttatagtttgattttgccacttaaaatgaagtattatcactgaggcaacaatgtgaaagtatgctgttgtaaacgayctctgagtcataaaatctccacttgttttgccaaaaacttaatctgatgttcaatgaatctcccactgcccgaagacctctgtaatcctgggatgcgaca

SEQ ID NO: 21146 - DNA, 201 bp, Homo sapiens
ggaggctgaggcaggtggatcacctgaggtcaggagttcgagaccagcctggccaacatggtgaaatccatttctactaaaaatacaaaaaattagttggscatggtggcagacgactgtaatcccagctactcgggaggctgaggcaggagaatcgcttgaacccaggaggtgcaggttgcagtgagccaagatcgtgcc

SEQ ID NO: 21147 - DNA, 201 bp, Homo sapiens
tcaatgtactatttcaatcttgggtgatttaatgcctactacttccattgtgcatatttacaaatcctcagaacaacctctttaacaaggaatacaatgcsacgagacagaaccttttattagtcatagaaaatgtcacattttaaattatgacaaatacaaacatgatatattcaaactaagactttcatgacatagcaa

SEQ ID NO: 21148 - DNA, 201 bp, Homo sapiens
gaatgaaatatgtgcttaagaattatcttcatactggaatgtcacccacaggagaacagagaccttatctccttacgtgctttcttttctggttttggggktttttttgttttttgttgttgttgtttttgtttgtttgtttgttttttgagattggatttcactctgtcacccaagctagagtgcaatggtgcaatcata

SEQ ID NO: 21149 - DNA, 201 bp, Homo sapiens
ggttgattctatcacttatatggaagggaaccattacttagttttatcagaaagcacaaaagagcactctaaactcctcacagagtcaaaacaagacttcyaaaatgtaagccgtttattcttaattcatggcaggtacctaacgaaaatgtccatggagtgtaaaatagatgtaaagatgacaaacatttctgtaggtag

SEQ ID NO: 21150 - DNA, 201 bp, Homo sapiens
cactgttggtgggactgtcaactagttcaaccattgtggaagtcagtgtggcgattcctcagggatctagaactagaaataccatttgacccagccatccyattactgggtatatacccaaaggactataaatcatgctgctataaagacacatgcacacgtatgtttattgaggcattattcacaatagcaaagacttgg

SEQ ID NO: 21151 - DNA, 201 bp, Homo sapiens
tgtggatcatagtcctcttggggatgttgttcatttaatattaacattttttaagcttgccatgtatcgtgggtgtatctgtttggtttcctttggtaactgcattttgccatgacccttgataccagctctactgctacagccctaggctaggccaccgtcatctgtggcctggaccctttcagtcctaactggttgccg

SEQ ID NO: 21152 - DNA, 201 bp, Homo sapiens
  misc_feature (1)...(201): n = A,T,C or G, or insertion/deletion polymorphism (see Tables 1-2)
ggcattctatcagttaagacaacttagaatatttgatcccattcagaactttttcatttgttttaaagcaggaaaagtaaaggaagtcaatgtaataactnttcttctttaaaatgtggatcatagtcctcttggggatgttgttcatttaatattaacattttttaagcttgccatgtatcgtgggtgtatctgtttggt

SEQ ID NO: 21153 - DNA, 201 bp, Homo sapiens
  misc_feature (1)...(201): n = A,T,C or G, or insertion/deletion polymorphism (see Tables 1-2)
ttctagttgtcgtattaccctagtaagatctcaaatctgtgatgttcatcatggtcatttgttgagcgcccactgggtgccactgccccctgcactttacnattgttatctcattgactgttcacaacatctctacaaggttgaggttgtcctctttcacagatgaggaaactgaggctcagagagactgatttacttgtg

SEQ ID NO: 21154 - DNA, 201 bp, Homo sapiens
tctcaggtgtttgaatgctggttggctatgggttggtctaggatggcctcagatggaacagctgggtttccctctccttggtctctcatcctccagcaagyccaggcctattctcatggtggtagtaggtagacggtggacatgaacaagagtggcctcttgaggccaaggcatgaaactggtactctggcatttccaccg

SEQ ID NO: 21155 - DNA, 201 bp, Homo sapiens
tgcttttctatttaaacactgctacacaatttaatgattttaagcatttagaagtctgctacatcagaaggttggtggttgggaggagttactattttatragttcattctaatagaggttattattgtctgtataagagaaatttggtagacatctaaaacaagtctgtatattaaaaataataacttgatgaacaaaaa

SEQ ID NO: 21156 - DNA, 201 bp, Homo sapiens
ggttggctatgggttggtctaggatggcctcagatggaacagctgggtttccctctccttggtctctcatcctccagcaagcccaggcctattctcatggyggtagtaggtagacggtggacatgaacaagagtggcctcttgaggccaaggcatgaaactggtactctggcatttccaccgcattctgtattggccaaag

SEQ ID NO: 21157 - DNA, 201 bp, Homo sapiens
ctacagcaaggaacttatcaaacttgactcttgctcatgagattgctgtaaatgagaactttcaattgaaacaagaggctctcccagaaaagaggtaacckgggggcatttgttgtatataaactgctgaagattctgtgtgtgtgtgtgtgtgtgtgtgtgtgtgtgtgtgtgtgtgagagagagagagagagagacaga

SEQ ID NO: 21158 - DNA, 201 bp, Homo sapiens
tgtttttctttcagcaacaagccctccaagggttgtaacatttgatgaagtgatggctacagcaaggaacttatcaaacttgactcttgctcatgagattkctgtaaatgagaactttcaattgaaacaagaggctctcccagaaaagaggtaacctgggggcatttgttgtatataaactgctgaagattctgtgtgtgt

SEQ ID NO: 21159 - DNA, 201 bp, Homo sapiens
ttgaaagcattttcaaggtctaggggaaacaagacagaatgttaaatgaaaagtatatattttgtatatatgctcttagctatgttaaaataatgcattcaacaagaaaaatattaaaagattaatggattaaggacaattattctgtgttttttttacattttataagatttctacaatgaggatgtttcttttataatc

SEQ ID NO: 21160 - DNA, 201 bp, Homo sapiens
tgaaagcattttcaaggtctaggggaaacaagacagaatgttaaatgaaaagtatatattttgtatatatgctcttagctatgttaaaataatgcattcaacaagaaaaatattaaaagattaatggattaaggacaattattctgtgttttttttacattttataagatttctacaatgaggatgtttcttttataatca

SEQ ID NO: 21161 - DNA, 201 bp, Homo sapiens
tgagcttgcaagcaggttaacaaggatttcagctgttctacttgaaggcatgaacaaagagtaagttccaaatttttgcatctgctccctcttgtattaaggctctgcatgtgtctcagagaacaagaatgaccttggacatctggatgtgagattcaggactgtgctttagagaagcttatcttacacctttttctagaa

SEQ ID NO: 21162 - DNA, 201 bp, Homo sapiens
gttcaagtaattctcctgcctcagcctcccaagtatctgggactacaggctcatgccaccatgcctggctaattttttgtattttattttattttattttwttatttttattttttttgagacggagtctcactctgtcgcccaggccggactgcggactgcagtggcgcaatctcggctcactgcaagctccgcttcccg

SEQ ID NO: 21163 - DNA, 201 bp, Homo sapiens
caagtaattctcctgcctcagcctcccaagtatctgggactacaggctcatgccaccatgcctggctaattttttgtattttattttattttatttttttatttttattttttttgagacggagtctcactctgtcgcccaggccggactgcggactgcagtggcgcaatctcggctcactgcaagctccgcttcccgggt

SEQ ID NO: 21164 - DNA, 201 bp, Homo sapiens
aagtgctcagtgagcctgccataattattatttatttttgaactgtgtggtggtaggaggtgttccttaagaatttttgtttgcaaacatttcttccccaytttaacctaccaccatggcagctgtcactcactgattcaccaaaaattgggtcaatcattatcttgtttttattaatttttcttgtatgtatagctcaca

SEQ ID NO: 21165 - DNA, 201 bp, Homo sapiens
agcttgcaagcaggttaacaaggatttcagctgttctacttgaaggcatgaacaaagagtaagttccaaatttttgcatctgctccctcttgtattaaggytctgcatgtgtctcagagaacaagaatgaccttggacatctggatgtgagattcaggactgtgctttagagaagcttatcttacacctttttctagaatt

SEQ ID NO: 21166 - DNA, 201 bp, Homo sapiens
gaaactccaagtgagtataatataatgtgtatttatattgaaattaggttaaaatgatgattttaaatgttaaaatttaaattaaattaaattaaattaaattaaataataaataaaatttaatttaatttaaattaattaaaatttaaaatgttaaaggttaaaatgaaaattaggtgatgttttcatttttgacttcat

SEQ ID NO: 21167 - DNA, 201 bp, Homo sapiens
aactccaagtgagtataatataatgtgtatttatattgaaattaggttaaaatgatgattttaaatgttaaaatttaaattaaattaaattaaattaaattaaataataaataaaatttaatttaatttaaattaattaaaatttaaaatgttaaaggttaaaatgaaaattaggtgatgttttcatttttgacttcatat

SEQ ID NO: 21168 - DNA, 201 bp, Homo sapiens
  misc_feature (1)...(201): n = A,T,C or G, or insertion/deletion polymorphism (see Tables 1-2)
tgagaccaggagaaagaaggttgggagatgacatggaatcaagagttcagtttggtgatgtaaacttttgagatttcatttgacatcaatgtggagatgtnaggtaggcatttagatatgaattatgagtttacaggaataatggaaactgtatatgtatttgggaatcatcagtatatgtatgatatataaagccatgga

SEQ ID NO: 21169 - DNA, 201 bp, Homo sapiens
actccaagtgagtataatataatgtgtatttatattgaaattaggttaaaatgatgattttaaatgttaaaatttaaattaaattaaattaaattaaattaaataataaataaaatttaatttaatttaaattaattaaaatttaaaatgttaaaggttaaaatgaaaattaggtgatgttttcatttttgacttcatata

SEQ ID NO: 21170 - DNA, 201 bp, Homo sapiens
  misc_feature (1)...(201): n = A,T,C or G, or insertion/deletion polymorphism (see Tables 1-2)
gagcaacatctgattttcatttttgaagaatattcttgttcctggctacagaataggtcatgtgggaacaaagagggaaacagaggtaccaattaggtggnattacagttgctcaggcaagaaatgatggtggcttgttccagatggtaatggtggaaggagtgagaagagaccagattctggatacattttgaaagtgga

SEQ ID NO: 21171 - DNA, 201 bp, Homo sapiens
ggattatctattttgccttttctggagggctctggcctatttcctgttttattctttaggcactgttcaagaaggacatcaggacaagtttgactgtctaraagagttcttgtaatagagtggtatttaagctatcacagcagtgggcacaatcagaatttcaaaactgcaagaggttggactgttctgaatttgaatctt

SEQ ID NO: 21172 - DNA, 201 bp, Homo sapiens
ctccaagtgagtataatataatgtgtatttatattgaaattaggttaaaatgatgattttaaatgttaaaatttaaattaaattaaattaaattaaattawataataaataaaatttaatttaatttaaattaattaaaatttaaaatgttaaaggttaaaatgaaaattaggtgatgttttcatttttgacttcatatat

SEQ ID NO: 21173 - DNA, 201 bp, Homo sapiens
aattagaatcatctggggcgtttaaacacagaggcctgagccctgcctcagacagaataaatcaaagtctccaggagctgtgcccatgaactctttttttyctttttaaagctccccaggtgattctaaagtcagccaggattgagaaccactatgccacactgttgcttttgttcaaggtaactaaatgggctcttaaat

SEQ ID NO: 21174 - DNA, 201 bp, Homo sapiens; identical to SEQ ID NO: 3416

SEQ ID NO: 21175 - DNA, 201 bp, Homo sapiens
ctgtgccaggaactctacctccagtgaattgctggaagaaagtgtagtttcacattgttaagcatgactgccataagcacatttaatttctcagaacttctagtgatgcctcatggaactctgggtttggagcatcatatattccttgctgagagaaaccttatgactggcccaacctctcagaaaaatgtgcataaagtc

SEQ ID NO: 21176 - DNA, 201 bp, Homo sapiens
aagtataaaacctcatttccagtgatacatattttttatccagaagaattgaacttgataaacttgtctaaagtggaaggacaatctaactggacattgtytttaaggtcatagtctttaaggtcaaattaagtatgagactcaagttcagtgatttcttccttcctcactgcttccttctccctttcccatcttgacttc

SEQ ID NO: 21177 - DNA, 201 bp, Homo sapiens
ctgtaatccagctactcgagaggctgaggcaggagaatctcttgaccccaggaggtggaggttgcagtgagctgagattgcaccactgcactccagcctgrcaacagagtgagactccatctcaaaaaaataaataaataaataaataaataaataaataaataaatattacagttttaaaaatcagttatttcatattga

SEQ ID NO: 21178 - DNA, 201 bp, Homo sapiens
gccattctcctgcctcagcctcccgagtagctgggactacaggcgcccgccaccgcgcccagctaattttttgtatttttagtagagacggggtttcaccytgttagccaggatggtctcgatctcctgacctcatgattcgcccaccttggcctcccagagtgctgggattacaggcgtgagccaccgcgcccagcctag

SEQ ID NO: 21179 - DNA, 201 bp, Homo sapiens
tgagattgcaccactgcactccagcctggcaacagagtgagactccatctcaaaaaaataaataaataaataaataaataaataaataaataaatattacrgttttaaaaatcagttatttcatattgagtttacttaatgagacttctgaattacagaataaaaataattttatcaatttcctatataatacatataata

SEQ ID NO: 21180 - DNA, 201 bp, Homo sapiens
  misc_feature (1)...(201): n = A,T,C or G, or insertion/deletion polymorphism (see Tables 1-2)
ggcatcttttgaagcaactctgtgtgagttgtttgtcatagaaactgctagcaagggaactctgctaataataactattaggcacctagtaacctatattntagtaatatttaagtgccatatgcttaaaaatgaaatgaattcaagtataaaacctcatttccagtgatacatattttttatccagaagaattgaacttg

SEQ ID NO: 21181 - DNA, 201 bp, Homo sapiens
ccctaggctaggccaccgtcatctgtggcctggaccctttcagtcctaactggttgccgtgtctcctttcttagcccccaacagttcatcttccatatccmgtagccttaatgatgtttttaaagaatgagctatattagatgatttctttgccaaaaactcttcaatggttttcacttactcagagaccaaaaatctaag

SEQ ID NO: 21182 - DNA, 201 bp, Homo sapiens
atgttttccagataacatctcctttaaagcattggcttttctttaaggagatctgctgagattctgctccctcaagctagcacgctaactggtatctacaraaagaaaagaaaagaaaagaaaaaagccaagttcccaaaaaagctcattttaaccaccccactgcttagcctactcactctttttattccacgggtgatc

SEQ ID NO: 21183 - DNA, 201 bp, Homo sapiens
  misc_feature (1)...(201): n = A,T,C or G, or insertion/deletion polymorphism (see Tables 1-2)
actaaataactcactctttaattacctttacaactttctggactctatatattggagattatttatcagttacttgaataatgtgaaggagcttattatcnttggtcatgatcagccaaaagttctaggtatttgacctctgaatatcttcatttgttgtttttgattggtgttatagatttactgctcaggcatagatga

SEQ ID NO: 21184 - DNA, 201 bp, Homo sapiens
  misc_feature (1)...(201): n = A,T,C or G, or insertion/deletion polymorphism (see Tables 1-2)
tttggaatgggcctattatagcagtagtcagtgctagctaacattttgtatgagcacttactacatgctaagtccttactgtaccactttagtagtctatncaagcatcacactagccctatgaggttggtactgttatcaccccctaatacaactgaggaaagtgaggttaaggtacttagtctagatgactactagtaa

SEQ ID NO: 21185 - DNA, 201 bp, Homo sapiens
tgtggcaactgtccacagcagcatttctctgagacttagtggttgctttcatttgtgtacctgtgtatgtaagcacatgtacaaatgcacccatatctttmatcaagatagcttggaatcttgagcaaattctctaatagggtgaattatgattttcttcatctcaaattatttgcctattttttttctgttttttttctt

SEQ ID NO: 21186 - DNA, 201 bp, Homo sapiens
aagaaactgcaggcattttcagacatactatacatagttgtggtttcccattctggccgctttaaaagcactgcatccctcattgcatgggctggtttagstttaaaaggattcagtgaactcttcctctcattattgtccatccaggatttgaggtgcctttctccttgagcccgggtttccccttcagtgtcaggtgat

SEQ ID NO: 21187 - DNA, 201 bp, Homo sapiens
aggtgagtgtctccactccactccttgcccttcagcctgcacaagtggactctagtggttttctgcttgcaaaagtggtgggctcagcaaggatacatttytgtggcaggattgaagacggttgtttaggtgaggcaaggcgcaaatgaccttagacctttcacccttattagatccctctcagactcatccttgtcccca

SEQ ID NO: 21188 - DNA, 201 bp, Homo sapiens
agagcatgacaaggacctgagaatcttgaggtttaaatctaataagataggcttaagcagtagattctctgctctaaggcttgggctttggcagtaccagsctggttaacgtgtcatgatatcaggttgcaaatgttctggttgaagctgtaccaaatgagattcagggattctgatttagctgacactgaatgaatactt

SEQ ID NO: 21189 - DNA, 201 bp, Homo sapiens
gctacatagacgataacttccttgtgatccaagagggaagaagagtctgcaacactttttgccattgaagcagagttttcttttttgtgtatggtggccayattgagaattgagttttatgtaaatgttttggaaaggtaggagaaagactggtctgcatgtagtgggtaatttactttgcaatcttgggcaggttaatag

SEQ ID NO: 21190 - DNA, 201 bp, Homo sapiens
cacagtccaattcaggggtccttgatcagacaaccctccacgtgtcatccagggacccagcctcctcctgtgcttggctctacccttgctcaggtccttasagtcctctccattcagctggcaaatgggaaagagaccatggggaagacatatgcaatatatagccacctcagcccagaagtgacacattctctttgacca

SEQ ID NO: 21191 - DNA, 201 bp, Homo sapiens
  misc_feature (1)...(201): n = A,T,C or G, or insertion/deletion polymorphism (see Tables 1-2)
atataccatattttctttatccagtccaccattgatggtcatctaggttgattccatgtctttgctgttgtgaatagtgctgcagtgaatatatgagtacntgtgtctttttgatagagtgatttctattcctttgggaataaacccagtaatgggattgctcagttgaatggtagttctgttttaagttattttagaaat

SEQ ID NO: 21192 - DNA, 201 bp, Homo sapiens
ctaacctgctaggactaatctgcaaattttcaaagtacaacattgacggccttaagaatacaaatacattttattattgatttgaggctttcaaatggtgktgttcatccttatccctggggacatggaatgctggggatccaagcttcaactttgcccccagaaaggaacagtgttggtgtatacgacattgtgggctgc

SEQ ID NO: 21193 - DNA, 201 bp, Homo sapiens
tccccccaaagattgttttatgttctttagtattggccactctttttcaaaaaaggatcaagttcactggcagagtttccccctgcacctcctggagtagrgtgaaggctggaaaaatagtgccatggacacagcttagggtgatgctaaagcgcagagactctggtttagtgacgggttctctctttaagtctctctttc

SEQ ID NO: 21194 - DNA, 201 bp, Homo sapiens
  misc_feature (1)...(201): n = A,T,C or G, or insertion/deletion polymorphism (see Tables 1-2)
gcagtgtgtgggagaggaccagccaagcgattctgattcttcccggttttccgaaagcatggcttcgctcagtgactatgaatgctccaggcagagctttncaagtgactcctccagcaaatccagctctcctgcttgtgagccgatgggggagcaggggttgtgggtggcaggggtacttctagatatgtgttggatttg

SEQ ID NO: 21195 - DNA, 201 bp, Homo sapiens
tattcctaaatacaaaaccacagtacatttcaacttcagtatatttaacattggataacagacagtagattcaaatattgttaacagtgctattgattgactgatactgtcctttacagcatttttgcttcagtataggatccactctaggatcacctattgcactcagttatcaagtgtttttttttcatttggaacata

SEQ ID NO: 21196 - DNA, 201 bp, Homo sapiens
gactggcccaacctctcagaaaaatgtgcataaagtcacacggcacattaatgatgaacccaggccacaaaccctggactcctgactcccaattattttartctttgcacttttctgccttgttaaacacagttaagaaacctaccaagtgtgctatccagctaaagtagaaaaatgaaatggacagttaaaactattaag

SEQ ID NO: 21197 - DNA, 201 bp, Homo sapiens
tttatcagtcagctattgctgcataacaaaataccacaaaactcctgagcttaaaaaaaataagcatttattattactcaccagtctgtgaggcgaccggstggctcttttggtcttgctgaactcactaatgtatttgtggttcagctgtgactcaggatggaagctttgctgatcctggctggactttctcaggtgttt

SEQ ID NO: 21198 - DNA, 201 bp, Homo sapiens
acatggtgaccccatctgtaactaaaaatacaaaaattagctggatgtggtggtgcacccctgtaatcccagctactcaggaggctggggcaggagaatckcttgaacctgggaggcggagattgcagtgagccaagatcacaccactgcactccggcctggtgacagagcgagactccatctcaaaaaaaaaagaaaaga

SEQ ID NO: 21199 - DNA, 201 bp, Homo sapiens; identical to SEQ ID NO: 3420

SEQ ID NO: 21200 - DNA, 201 bp, Homo sapiens
actattaagctagttcataaattctcatggctggaagctcttattcaatttcacttggaaaaacagccagagctcatttgagggcaaccgaagtagagaaraattaagagcagagcatgcatagcacagcggttacattacaggggaataactgggggaaaaatgacttaaagtggaaacaaactttaagatattcaaata

SEQ ID NO: 21201 - DNA, 201 bp, Homo sapiens
ggcaggagaatctcttgaccccaggaggtggaggttgcagtgagctgagattgcaccactgcactccagcctggcaacagagtgagactccatctcaaaaaaataaataaataaataaataaataaataaataaataaatattacagttttaaaaatcagttatttcatattgagtttacttaatgagacttctgaattac

SEQ ID NO: 21202 - DNA, 201 bp, Homo sapiens
gcaggagaatctcttgaccccaggaggtggaggttgcagtgagctgagattgcaccactgcactccagcctggcaacagagtgagactccatctcaaaaaaataaataaataaataaataaataaataaataaataaatattacagttttaaaaatcagttatttcatattgagtttacttaatgagacttctgaattaca

SEQ ID NO: 21203 - DNA, 201 bp, Homo sapiens
gacagttaaaactattaagctagttcataaattctcatggctggaagctcttattcaatttcacttggaaaaacagccagagctcatttgagggcaaccgwagtagagaaaaattaagagcagagcatgcatagcacagcggttacattacaggggaataactgggggaaaaatgacttaaagtggaaacaaactttaaga

SEQ ID NO: 21204 - DNA, 201 bp, Homo sapiens
caggagaatctcttgaccccaggaggtggaggttgcagtgagctgagattgcaccactgcactccagcctggcaacagagtgagactccatctcaaaaaaataaataaataaataaataaataaataaataaataaatattacagttttaaaaatcagttatttcatattgagtttacttaatgagacttctgaattacag

SEQ ID NO: 21205 - DNA, 201 bp, Homo sapiens
acctaccaagtgtgctatccagctaaagtagaaaaatgaaatggacagttaaaactattaagctagttcataaattctcatggctggaagctcttattcamtttcacttggaaaaacagccagagctcatttgagggcaaccgaagtagagaaaaattaagagcagagcatgcatagcacagcggttacattacaggggaa

SEQ ID NO: 21206 - DNA, 201 bp, Homo sapiens
aggagaatctcttgaccccaggaggtggaggttgcagtgagctgagattgcaccactgcactccagcctggcaacagagtgagactccatctcaaaaaaataaataaataaataaataaataaataaataaataaatattacagttttaaaaatcagttatttcatattgagtttacttaatgagacttctgaattacaga

SEQ ID NO: 21207 - DNA, 201 bp, Homo sapiens
acacagtgatgggccattcgcttttggtttttgtctgtcaaacaagtgccaagagttctgttctatgttaactaccagccttgtttgtctgttgaagaatrtggtgttatcctgacataaaactgttcttccctccagagtgtttaattcctgaggcaatgatattaacaaaaaaaagcaaataatagaaaacatttgtat

SEQ ID NO: 21208 - DNA, 201 bp, Homo sapiens
taatcaagaggagccgggatcaagaacccagtccacctagctccagaggcaatgttcttatggcttcagtgacatgtattatcatcagtgtatctttgcarttctgaaccagtgcagaactatttgcagatagagttgctgcagaaaggaaatcaggaagtaaagctgcacacgagctgaggaatcacaagcaaattaaaa

SEQ ID NO: 21209 - DNA, 201 bp, Homo sapiens
  misc_feature (1)...(201): n = A,T,C or G, or insertion/deletion polymorphism (see Tables 1-2)
cacttactaggagcttaagtacttgacagatactatttcagttaatcttcacaacacttctacaaggtggatactattattgtcccattttacaaatggcnagttctctgtttctagtcagtaaataatcaagaggagccgggatcaagaacccagtccacctagctccagaggcaatgttcttatggcttcagtgacatg

SEQ ID NO: 21210 - DNA, 201 bp, Homo sapiens
  misc_feature (1)...(201): n = A,T,C or G, or insertion/deletion polymorphism (see Tables 1-2)
ggtttttgctttgctgtggatgaataactttagtgctgctatttaagactgattctaaagcagcattttgcagaagatggaaatttttcacatcatctgcnatttttttctttagagcccagacttagtcctctgactcccttccctttactacacatatgtgaaggcttgtccttgcagctgacctcgatctagtgttga

SEQ ID NO: 21211 - DNA, 201 bp, Homo sapiens
ctcaccctcctccagacctccacctttaagtgtaggagccagtatctgttgttcccctttatgtccatgtttactcagtgtttagttcccacttataagcragaacatgtggtatttggttttctgtttctgaattaatttgcttaggataatggtctccagttttacccatgttgctgcaaagaacatgatcttattctt

SEQ ID NO: 21212 - DNA, 201 bp, Homo sapiens
tgagaacttaagatgattcaggtacagatgtgtggcacgtaatatgtactcaatgaatgctagctattaataactagtcattaaatcatcctctttataaytgtatctggttgtttatctggttgtttcattgtttaaatttttttcctgtgttaggaaatcaatacaatcaattctcaattatcctcattacggatgggg

SEQ ID NO: 21213 - DNA, 201 bp, Homo sapiens
gtcatctgggggcctttccaacacagtgacacttgtggggacagttgtctacactggaagaagcattggtggtgcctgtggaagtaccacagaacattgaygcagggtctgtttgtctgtgcaggtgctacctttttacccacacttaagtgacgcaaaatgcccttcaatggcgagaagcagtgtgtgggagaggaccag

SEQ ID NO: 21214 - DNA, 201 bp, Homo sapiens; identical to SEQ ID NO: 3419

SEQ ID NO: 21215 - DNA, 201 bp, Homo sapiens
actgaagggccctggatccccttgccccgtcgcgccgtcgtccccccgctatccggttttgtgatggccgcgccgtggctgcctccctagagtccctcagsgccctttaaataccgcgttgggggggacactggggctgggggggtttgttgggctggtgagttttcgaggtgactgtgctgtgctcggtgaggggacgcc

SEQ ID NO: 21216 - DNA, 201 bp, Homo sapiens
cacgtgtatgagcttctatgaaacatgaccctaccaaatggcaattggaactttaaaaccattttggggatgtttattgttttcagcctggaacatagatmattgttagtgaatttcagcttcacttcttaatcatctctctattttaattctaaaatttttagacaaatattccatgtcctggacctcatgcaaatggac

SEQ ID NO: 21217 - DNA, 201 bp, Homo sapiens
tttccctttagcctaagaactcactgattaaaagcaagaaaaatctagggcagtacattgtagtggataaaaagtcggaaggtaaaaattttattacaatsagtctatccttgggttacagaattccaacgtcaggtccagtgtgggcttataacaaattccagtcaaggcagaatgccaagaacttatttcttattgctg

SEQ ID NO: 21218 - DNA, 201 bp, Homo sapiens
agctaatgagtggtaaaggccagaccgaagttgagactgcctggctcagaggccacggctcccaactactgcaccagccacttgctctgcatgggggagcytagcacaagttcttagtcacatgttgattgctttgatattaggttgcactaaattgagattcattcatctgcaatgcaaatttgactccccagtcaagct

SEQ ID NO: 21219 - DNA, 201 bp, Homo sapiens
cttttgaaaagatattagaaagggatttttctgtcgaatacatactaagtaaaaattatggattacctgctgtgtaaattatttgcatgcctacgtctactttttttttttttgagatggagtcttgctctgtcgcccagtctggagtgcagtggtgtgatcttggctcactgcaacctctgcctcctgggttcaagaaga

SEQ ID NO: 21220 - DNA, 201 bp, Homo sapiens
tcttaatcctgtccccaggaaaagccgaggttgcaggtgcctcatgaggctgaccttgcttttggaaccagagagagcagtcaccgtgccagcctgtgagrgtgaagtctctgccgatccctaagagaagagccaacgtttcactctaaacgcatgctccttctgctttaccggtcattctcaagtctgactacaaattag

SEQ ID NO: 21221 - DNA, 201 bp, Homo sapiens
  misc_feature (1)...(201): n = A,T,C or G, or insertion/deletion polymorphism (see Tables 1-2)
gatagcaaggctccattgtcacgatggttgatgtgggctgtaaacgtaggccatccctgaacactctcaccactcagatcccgggaaggagtcggctctgntgggcacgtgactctgctcggccagcccctggtcgggaagatggggcctctgaattgagactcacaaaagaaaacatggaaccagaggaaatggtttctc

SEQ ID NO: 21222 - DNA, 201 bp, Homo sapiens
gcaggtgctacctttttacccacacttaagtgacgcaaaatgcccttcaatggcgagaagcagtgtgtgggagaggaccagccaagcgattctgattcttyccggttttccgaaagcatggcttcgctcagtgactatgaatgctccaggcagagctttgcaagtgactcctccagcaaatccagctctcctgcttgtgag

SEQ ID NO: 21223 - DNA, 201 bp, Homo sapiens
atgagattgctgtaaatgagaactttcaattgaaacaagaggctctcccagaaaagaggtaacctgggggcatttgttgtatataaactgctgaagattctgtgtgtgtgtgtgtgtgtgtgtgtgtgtgtgtgtgtgtgtgagagagagagagagagagacagagagagagatagacacatatttacactgattcctgga

SEQ ID NO: 21224 - DNA, 201 bp, Homo sapiens
gaaaccaggtctcccaaatccaagtccagattaaaccaagctgctactttttcagccttctttgaatttttcagttttgtgttatattacctgagttgtaytgcaaggaacagaaaccaactctagctgacttagccaaagggaagtgaatggaaggatggaggaagtttgcagaatcaaaggaaaagccaaaatgtcaga

SEQ ID NO: 21225 - DNA, 201 bp, Homo sapiens
tgagattgctgtaaatgagaactttcaattgaaacaagaggctctcccagaaaagaggtaacctgggggcatttgttgtatataaactgctgaagattctgtgtgtgtgtgtgtgtgtgtgtgtgtgtgtgtgtgtgtgtgagagagagagagagagagacagagagagagatagacacatatttacactgattcctggaa

SEQ ID NO: 21226 - DNA, 201 bp, Homo sapiens
gctctcccagaaaagaggtaacctgggggcatttgttgtatataaactgctgaagattctgtgtgtgtgtgtgtgtgtgtgtgtgtgtgtgtgtgtgtgtgagagagagagagagagagacagagagagagatagacacatatttacactgattcctggaagttcttgtataatatcctcaggggtaaacatttagttctc

SEQ ID NO: 21227 - DNA, 201 bp, Homo sapiens
ctctcccagaaaagaggtaacctgggggcatttgttgtatataaactgctgaagattctgtgtgtgtgtgtgtgtgtgtgtgtgtgtgtgtgtgtgtgtgagagagagagagagagagacagagagagagatagacacatatttacactgattcctggaagttcttgtataatatcctcaggggtaaacatttagttctct

SEQ ID NO: 21228 - DNA, 201 bp, Homo sapiens
ccaggaggtggaggtttcagtgagccgagatcgcaccactgcactacagcctgcgcaacagagtactccgtctcaaaaaacaaaaacaaaaacaaacaaamaaaaaaattcccctaggatacatattacccataatctttagaactcagtttatatgtcacttcctgagggaagctttttctgacattggtgaacccccta

SEQ ID NO: 21229 - DNA, 201 bp, Homo sapiens
  misc_feature (1)...(201): n = A,T,C or G, or insertion/deletion polymorphism (see Tables 1-2)
caaagtacagagttaggacacattgcctttgtttaaagataaagtcttagccgggcgcagtggctcacacctgtaatcccagcactttgggaggctgaggngagcagatcacctgaggtcaggagtttaagaccagcctgcccgacatggtgaaaccctgtctctactaaaagtacaaaaattagctgggtgtggcggtgc

SEQ ID NO: 21230 - DNA, 201 bp, Homo sapiens
ctgccttgttaaacacagttaagaaacctaccaagtgtgctatccagctaaagtagaaaaatgaaatggacagttaaaactattaagctagttcataaatyctcatggctggaagctcttattcaatttcacttggaaaaacagccagagctcatttgagggcaaccgaagtagagaaaaattaagagcagagcatgcata

SEQ ID NO: 21231 - DNA, 201 bp, Homo sapiens
ttagccgggcgcagtggctcacacctgtaatcccagcactttgggaggctgaggcgagcagatcacctgaggtcaggagtttaagaccagcctgcccgacrtggtgaaaccctgtctctactaaaagtacaaaaattagctgggtgtggcggtgcacgcctgtaatcccagctacttgggaggctgaggcatgagaatcac

SEQ ID NO: 21232 - DNA, 201 bp, Homo sapiens
agtcggctctgctgggcacgtgactctgctcggccagcccctggtcgggaagatggggcctctgaattgagactcacaaaagaaaacatggaaccagaggaaatggtttctcagagaaagccagcaccaaaagaagggaaagtgagatgttgccaggcaaaaaaaaaagatgtcatggataaggaaactacatttttccaa

SEQ ID NO: 21233 - DNA, 201 bp, Homo sapiens
gaggcgagcagatcacctgaggtcaggagtttaagaccagcctgcccgacatggtgaaaccctgtctctactaaaagtacaaaaattagctgggtgtggcrgtgcacgcctgtaatcccagctacttgggaggctgaggcatgagaatcacttgaacctgggaggcggaggccgcagtaagctgagactgcgccactgcac

SEQ ID NO: 21234 - DNA, 201 bp, Homo sapiens
agcagatcacctgaggtcaggagtttaagaccagcctgcccgacatggtgaaaccctgtctctactaaaagtacaaaaattagctgggtgtggcggtgcargcctgtaatcccagctacttgggaggctgaggcatgagaatcacttgaacctgggaggcggaggccgcagtaagctgagactgcgccactgcactgcagc

SEQ ID NO: 21235 - DNA, 201 bp, Homo sapiens
attgaaagcattttcaaggtctaggggaaacaagacagaatgttaaatgaaaagtatatattttgtatatatgctcttagctatgttaaaataatgcattcaacaagaaaaatattaaaagattaatggattaaggacaattattctgtgttttttttacattttataagatttctacaatgaggatgtttcttttataat

SEQ ID NO: 21236 - DNA, 201 bp, Homo sapiens
aaattggaggcttctgtcattctgattacttatccaacgaatgacacaaataagagcatgtttgtagggaagaactcaggtggggacagcaccttctattyaatctcttaacctgtattattaggttgtatattttaggagaagagaggaaagtggcaaaaggaggcacagatacaaatttatacagatcaccagctaagt

SEQ ID NO: 21237 - DNA, 201 bp, Homo sapiens
agatgacatggaatcaagagttcagtttggtgatgtaaacttttgagatttcatttgacatcaatgtggagatgttaggtaggcatttagatatgaattaygagtttacaggaataatggaaactgtatatgtatttgggaatcatcagtatatgtatgatatataaagccatggaactgggtactagttaacacttagaa

SEQ ID NO: 21238 - DNA, 201 bp, Homo sapiens
gtgacagagtgagaccccgtcttaaaaaaaaagaaaagaaagaaaataatattattcaaaactccccattcccatcgctggtgtttgtaacctggggactrtcaatctggtaagagagaatgacaattgtttgtggacatgtgcacgtgattgtgcacattcactttgggaaaggcatatctccaattagttattaaaagt

SEQ ID NO: 21239 - DNA, 201 bp, Homo sapiens
tgatttctttgccaaaaactcttcaatggttttcacttactcagagaccaaaaatctaagcattttcctatggcctggatggccccactcccctgaccccrtctcagtgctgtccctcctgcttgctgtgcttcagccacactggcttccttccttacctcagggttcaccaatctggatcttgtctcataaactttgttc

SEQ ID NO: 21240 - DNA, 201 bp, Homo sapiens
gccaatgtcacattcactgtaaagaaagagaatccattctgataattaatcaatataatttcattctattaacagccaaacaggaagacaagtgtttcacrgacataagaaatttaaagtggaagcactttctagagcacacaaaacagcctccctaacacatgagaagtcaccagcaacacagaaatcaccaacaagtag
